United States Patent 11,401,555 (GENETIC POLYMORPHISMS ASSOCIATED WITH STROKE, METHODS OF DETECTION AND USES THEREOF) - sequence listing, part 2

SEQ ID NO: 274 - DNA, 180995 bp, Homo sapiens
gctcctgggttccagcaattctcctgcctcagcttcccgagtagctgagattacaggcatgcaccaccaagcctggctaatttttttttgtatttttagtaaagatggtgtttcaccatgttggccaggctggtctccaactcctaacctcaggtgatctgcctgcctcagcctcccaaagtgctgggattacaggcgtaagccactgcacctggccccatttctttaacatacacataatgcttactatataccaggcactattctaaacactgcaaatatttgctcgagcccctcaacaattcaacagggtagtttctaattattaacccaattttaagatgaggaaacaggtatagagaggttgattacttgtccaagattacagctagcaggcattgtagctaggattcgcaacaaaacagtggttccagagcctgtttgctgacttctaccatgatctacaggtgaattaactggggcgctgagaaaagcagtgatatgccctagaattaattaactgtcaataggctgcaactagttccctatactagtggggtgaccacaagcacaggttgcagagacagtcgacctggatttcactccagctgcactagcagaatgagtaggaacatgctggatgttgagtttctggactttgtaaaatcctatataccctaatggtagtttgatttaaaacaactcatttatgtagaagcttagcactgtgtctggcacacagaaagtgattaataaacatcaatgactcccaggcctggatgctggttaaatgctaggcatactgtgtcacacaacacaggaacctagcaattctcctcagctccaacctgagacctcacctgggagatgctcacgcctgtgagtctttccacactctctggcaggcgagttagaatgtccagtacttccccagtcactttggctgcccccatggtcccactgccgctggacaccagtgtgatcttattggctgaagtcaagggaccactgatctcctctgccacctggcaggagagagacacccactcagtgcccatgatctgaccacattcctcataaaacaacttactctgggttttaaggtcctcgttccactgatcatccttcctcactttggtcactaataattcccacccctaatttagagtccccctaggctgtttctccctaagcccctcactacaccccaccccttagtccctggttctatttcctcctttcttggtgcccacatgacctccagacctggggcagcttctctagcagcatgtccagctgagcagcctcttggtacagctggaaggcttctgccttcttggccatctgctcagcctcggctcgggctcgggcccctatggcaaaggcctcagcttccccacgcatctgagggttaaggatgcttgtgagattgacggaaatcattaagaacaagaaatccccgatcaagcagcaacccccaccctctccacaagccagcatggaactgcctcttaactcacccgcacagacgcggcttctgcctccgcctgcataattagttgggacctgtggacagaagggaagtggagggtggagcccagcagcccttactcccaggagaaaggcccagtgctgcagaggcagacgctcctgaaacctgaaatccataggagtccaggtggtgaaggcttcagcactccatcttggggtgcctaggtggcaagtgagctaggcagggtcagggaggggacatttacttctctgcctcggctaggcgctccagcttgtagcgctccgcttccgctggcttccgcacccgggcctccagctccttctcccgccgggcgatctcctgctcctgcactgccacctgctgggcccgctccaccacctgcacctgcacccgctgctcctcaatctgctgcttagtcttggccacctgggtaggagggtgaagtcaggttcacgctctgagtcagaggtgaagagcaagtgcccgggaaccagagctccagagtgggatataaaaataggagccggtggccgggcgcggtggctcacgcctgtaatcctagcgctttgggaggccaaggagggtggattgcctgagttcaggagctcgagaccagcctggccaacatggtgaaaccctgtctctactaaaatacaaaaaattagccaggtgtggtggcgaatgcctgtagtcccagccacccgggaggctgaggcaggagaattgcttgaacctgggaggcgaaggttgcagtgagctgggatcacgccactgcactccaccctgggcaacagagtaagactccatctccaaaaaaaaaaaaaaaaaaaaaggagcaggtgcatgaaggtgggttccctcctgtctgcttggccagtccagtggagtccagtgtttctctgatgagcccccgtttaatctatttttcccacgtgtgcccccttctagagtataaataccttgagggcactgagcacatgttggctttctgctatctccagtcttgctcaaatccccccactgttgctgcgataaccttagtgctagcctaggctactgcaatagctgacttattttttgtgggggtggggacaggtgatcttttttgtcttttgcacatggtgcagatttaacagaaaaaaaagtgaaccacgaggcttcttcctcattctccaaaccacctgggtccctttcccagagaaaccaccaagaccagcttcttgtgtatccttccagggatactctgaacatctacaagaatgtgtgtattcatagaattcctcttatttaggcagatttctttctttttttttgaggcagtttcgctctattgcccaggctggagtgcagtggcacgatcagctcagtgcaaccttcacctcccaggttcaagctaatctcttgcctcagcctctcaagtagctgggactacaggcatgtgctaccatgtctggctaatttttgtattttttttagtagagacggggtttcaccatgttggccaggctggtctcaaactcctgatctcaagtgatccatccgcctcagtttcccaaagtgctgggattacaggcatgagccatcgcacccagcctagatttcatcttcttattccttgcagtgtgagggaatcagaaggctcttatcaagatgctagtgaggagaggtgccaggcaaggaacacattttttttttctttttgagacatcatcttactctgtcacccaggttcaatggcgtaatcatggctcactgcagccttgacctgcctgggctcagatgatcctcccgcctccccctctagagtagctgggactacaggtgtgaaccagcacacccggctattttttgtactttttgtagagacagggttttctatgttgcccaggctgatctcaaactcctgggctcacgtgatccacctgcctcggcttcccaaagtgttggggttacaggcatgtgccatcacacccagccagaacacatgccttcgttgtcccattgctcaggctcagccatgcaccatcatcattgtaggtctcatcaatacatgtgatgcttcccctgcctcctaccttcccccgggcccatctgttcactccagagagaagcatagctctggagacggcactctgtactgtctttcaccctaaattttcaaacccgttccaaactggcctcgttgccctctacaccggtgtgcaggatcacctctctcctgtgtcccttaggcaaccatttgtctgtttctttttccttcctgtctatgcccaccttttggtgaaactcaacctccagaagcttcctcagaaagaatataaagacaatattttttctgaggtcttgctttctctgagatttttattctacctttttttgagatggaatttcgctcttggcacccaggctggagtgcagtgacgcagtcttggctcactgcaatctccatctcccaggttcaagcaattctcctgcctcagcctcccatgtatctgggattataggtgcctgccaccacgctcagctaatttttgtgtttttaatagagatggggttccaccacattggccaggctggtcttgaactccttatctcaggtgatccacctgcttcggcttcccaaagtgctgggattacaggcgttagccactgcacccggcctctacccttctattttaataccagttaggctgaaagcaggctgctatgttgggattaactttccatcagaattctgaaggcattcctccatggttttctagctttttaagaaatctgggcttgggccagtcatggtggctcatgcctgtcatcccagcactttgggaggctgaggtgggcagatcacctgaggtcaggagttcatgaccagcctggtcaacgtggtgaaaccccgtctctactaaaaatacaaaaattagccagcaatggtggcacatacctgtagtcccagctacttgggaagctgaggtaggagaatcgcttgaacccaggaggcagaggttgcagtagctgagatcacgccattgcactccagcctgggtgacaagagcaaaaatccatctcaaaaaaaaaaaaaaagaaaagaaagctgggcttgatgcagtggctcatgcctataatcccagcactttgggaggctaaggtgggaggataacttgaacccaggagttcaagaccagcctgtgcaatatggcaagatctcacctctagaaaaaaatttaaaaattagctgggcgtggtggtgtgcccctgtggtcccaactactggggaggctgaggtgggagaatcacttgagcctgggaggttgaggttacagtgagccttgtttatgccactgtattggacaacagagcaagaccctgtctctgaaaaaaaaaaaaaaaaaaaaaaaaaaggaatctgaagtcattttgaagcctgcctctttgagatctctctctctctagaagctttcatattttttgtcctcagcattcttaagtttcacagtgttatgtttcaatgtatatatttttcattcattgcattgggcacttagtagaccatttcaatctaaaacctcatttttatataatttttctcagaatgtttctgctcccaataagtcatgccacatttgcatgtgcttgacttttttttttttttttggagatggagtctcgctctgtcacccaggctggagtgcagtggcatgatctcatctcactgcaacctctgcctcccaggttcaagtgattctcctgcctcagcctcccgagtagctgggactgcaggcgcgtaccaccacgcctggctaattttttgtatttttatagagttggggtttcaccgtgttagccaggatggtctcgatctcctgacctcgtgagccacccaccttggcctcccaaagtgctgggattacaggcatgagccaacacccctggccctgcttgactcttattagtccctttcccttacttccctgcttctttctgtggggttttatttttcccctttgtcagctcttgccaggttaccaagcataccctgtccctggctttcttggttgctcccaaatctgtgatggcttgctctgttgcccaggctggaatgaaatggcacgatctcagctcactgcaacctctgcctcccggattcaagtgattctcctgcctcagcctcctgagtagctgggattacagtcaccatttcagctaatttttgtgtttttagtagagacggggtttcaccatgttggccaggctggtttcaaactcctttgtcatctgctcagagggaagaaggtctcaacactgaaaggaagctctgagtatgtgggtgaggcttgctgactttgagcttcaccctacggtgatctggataggccatgtacggagaaacatctgattcaggattttaagttatttctttttggattggtcatgttccccagagcagtcttctgatctcttttttggaagatggaagttctgggagctgagtggggttgagggggttggggttggggttggctctcagtatttagcattcatgaaagttatagtcatttcatgcccctgttactggtaaactatctaggtcctcacctgtgctgggccagcccccatcacatcctctagtctactctcttcagataatagacttccaatggcaggtatggtaactcacacctgtaatcccagcacattgtgaggctgaggtggatggatcacttgaggctagcagttcgagaccagcctggccgacatggtgaaacccctctctactaaaaaaaaaaaaaaaaatacaaaaattacctgggcgtggtggtgggcacttgtaatcccagttgaggattacttgggagggtgaggcacgagaatcatttgaacccaggaggcagaggttgcagtgagccgagactgcgccactgcacctgcactccagcctggacaacagagtgagagaccctgtctcaaaaaaaacataaataaaatagataaataagataataaacctccagatgtctgttggagcagggcaggaaccattacccagaggcagtgaggggctctgagaaggtgcttttcacatgttcctcttatttaaccagtctaccacagctggagaagcactgggtgctgccagctcctgagcctcagatcatttcattgttttcccttttgcaggtttcaagctcagctgtgtcatacctgcttagtcaattactactgacttccagtttccaaaatgatgctctggtttccgttcctattttctccatcttttttttttttaaagcctagtcagctgggcatggtggctcacgcctgtaatcctagcattttgggaggctgaggcgggaaggatcctttgagcccaggagtttgagaccagcctgggcaacatggtgaaattccgtctctacaaaacatacaaaaattagccaggcgtggtggcatatgtttgtagaccaagctactcaggaagctgaggtgggagtattgcttgagcccaggcagttgaagctgtagtgagctgagattgtaccgctgcactctagcctgggggaccgagtaagacccggtctcaaagaggagaggagagaagaaagaagagaagagaaggaaagaaaggaagaaagaaagactaatcaagtgcaatagtgagaagtaggtaaagagtagaacaaggagttcaatctgtaactgactgaacaatcaattgagataactcactacctttggacaagcctctatctttaccttaaaaaaaatcattttagatcgcgccactgcactccagcctgggcgacagagcgagactccatctcaaaaaaaaaaaaaatcattttggctttagtgaggttttaggagagagtaaaattagctacatttgtttaatccatcatctctgaaaaagagcccaactcatcttttgcttttttttttgagacagagtctcactctgtcatccaggctggagtgcagtggcgcgatctcggctcactgcaagctccgcctcccgggtttatgccattcttctgcctcagcctcccgagtagctgggactacaggtgcctgccaccacgcccagctaattttttgtatttttagtagagacggggtttcaccatgttagccaggatggtctcgatctcctgacctcgtgatctgcccacctcggcctcccaaagtgttgggattacaggtgtgaaccaccgcacccggccttgcttcctctctttgcccgttctccacaaggcaaccagactgatccctatacaaatataaataagaccatggcacctttctgcttgaagttctccaatagctttccactgtgctttcagttctcttctgtgtctccatcgtgaccacacaaaccctttgtgatctggccctgcctgcctttcctcctcactcacagcacaccagcgcccccagatcagaaacctcctttctgactccacctcacagcctttgcacttactggtcccctgcctagccacaagccacgtatgactgactgactgactgactgtctgtcgtccgtccgtccgtccgtccgtccgtccgtccgtccgtccatccgtccatccatccatccatatatctatcttagaaggagtctcgctctgtcgcccaggctggagtgcggtggcgcaatctcggctcactgtgccttctggattcaagcgattctcacgcctcagcctcccaagtagctggaactgcaggctcaaaccaccacacccggctaatattttttgtatttttggtagagacagggtttcactgttggccagactggtctcaaactcccggcctcaagtgatcttcctgtctcagcctctcaaagtgttgggattacaggcatgaaccaccgcgcccagccactttttaagtatgactacttaaaaagcacaggctagaatattcttggctcagaactgtacattgttccttcttatctccaagtctgatctcaaacaccacttcctcatagaaactttctctaccacccgctaacctaatatactaactcccctcccacagtttttcacatcaccctgtttatttccttcacagcacctaaacaagaattatagcctgggaaggtcatttacttgcttactagctgtttcctgtgtcataatgtaagctgcataagggcaggaatcttttctgcctcacctccatatttatagcctcacctccaaaatggtgtctagcacatagaaggcacttaacagatatttgttgaataaatccttctttcctgaacacctagcacactgcctggtgcataacgagaaactgataaaagttgaaaagagtccaaccagtccaatcccttaatctgcagacaagtaaggtcatgtttagaaggttaagaaccttatccatagcttcactgcaagctagcagtttccatcatggtaacccttttcaaactcaaactccaatgtgcatacaaatcacctaggaattcaccttgagattttgttaaaatgcaggttctgattcagctggtcagggccagggcctgcaattttgtatttctaacaagcttcgcagtgatgctgcagctgctgctgggtagaacacagtttgagttgcaaagctgtatgccatgttcaacctgtcaagtcacccaggaatttaacataataacaaaagatgtttttaccttcattatgctttcagcctgtaccaactcttggcaaaaacaaaatgcataatattgctatcctttgggtaaaggtctcaaagtacagttgattttcattgttcttggtagttctgttctataaagtagccatgaatgctgaattagttaatacctaatttgttcctagaagaaatacaggctaggttcccgtgagcctctggtcaaaacattttcatcaactgatcaacatagagccttgctttatatgtgtttctgtttaaagacaccttatgtaaaatatattgttgattcattaacactgaactcacagctaacagcagtataacttatgcatgaacgaagcttacctaacacatgtatttctcccataaggcacatcatagcccgcttgcactaaaggacactagacagcactacagcactgatgcttgggggccattttaaagagtgaattcaccaataaaaagcacaaaaatgcaaaaaacacggcagtaaatatactgtgaaaataacacggcttacggtatgagagctgaaacaaggcagcagagcatctccttgatcaacctcacctgggtactgtgcgtgtctgcaaaagatcctgaaagtgctgcgactttattggtaaccttttgaggttaccaatacattttagtgaataggcaaattctcagatacgaataatgaagaatgaagatcaactatacttcctggcaatatcaagggctgcccatatctcactttgcaggattcaatgtccaagtccatgttttccttcttcatacccttttttaattaaccagggctgccgctagcccatagcatgcctctgtgcaaatcagaaattcctctgtgtagatgcagacccatgtcagaatgcactgcttgattagaggggcatgggccggatctgagctcggatccactttctcagtcagatgcctttgcacgggcacagcctgctccaaacatatgatcagccttattgatcatatcccttcttggccttctcttttttttttttctttttttgagatggagtctcactctgtcacccaggctggagtgcaatggcgtggtctcagctcactgcaacctctgtctcccgggttcaagcaattctccggcctcagcctcccaagtagctgggactacaggtgcgtgccaccatacctggctaatttttgtatttttagtagaaacagggtttcactatgttggccaggctagtctcgaactcttgaccttgtgatccacctgccttggcctaccaaagtgctgggattacaggcatgagccaccgcgcgtggccttttttttctcttttttggacaggatttcactgtcacccaggctggagtgcagtagtgtgatctcgactcactgcaacctgcgcatcctggctcaagcaatcctcctgcctcataccccaagtagctgtgactacaggcccgagctgccatgcctggctaatgtttgtatttttcgcatagacacggtttcaccatgttgcccaggctggccttgaactcctgaggtcaagcaatcagcccgccttggcctcccaaagtgctgggattacaggcatgagtcaccacacccggctggccttttctttaaagcttttcagctgtaacgtctgagtcttttaaatctctcctcatatgggggagttggtccagagatggagagccagaataagaccaaagttaaagtatgagaaatagtgtagtggtgtcctgagatggacagcctgagaggaatggggaaggggcagagagtggcctggcagtggctctgacctgaagctgataggccaggtcagcctgtgctcggcgggtgttgacctcgatgtcataggcggccttcttcagttcgtaatctctctgtgccttggccatctcgatctcactcaggtactgagcagacaccttttcctgcttggctttagcttcctgtccaagcagagatcaggtaggaaatgtcagggcagggggagaaaggccacggtgacagcctgcttcccaccaaggttctctttctgcctcatgtattttccctgctcacccagcacccctgcttcttctcagttgtgccacttctatcccctttcccactaagcaacccccatctctctcacccggatcccagcatctctcttggcctctgcttctccaatccgtgcatctttttggacttgagctgttcgagccttccccaaagagtgcaaatagtcctgtgggagagatgtagaaattagtcctttggagggcttaagagatgggagcaaggaagtggggaaggatcaattgcctagttttacctggtcatcgtgaatgtccttcagagtgtagctaaccacactgatgcccatgttgaccaggtctgaggaggccactttgaaaacctgttctgagaatttctgcctgtccttatagatctcctgtgataacaggatggtggggagaagggatgtaagttttttttttttttttttttttgctcactgcaacctctgcctcctgggttcaagtgattctcctgcctcagcctcccaagtagctgggattaccgacacccatcaccatacccagctaatttttgtatttgtagtagagaaggggtttcaccaggttggctaggctggtctcgaactcctgacctcaagtgatctgcccaccttggcatcccaaagtgctgggattacaggcatgaaccaccctgcccggccgggatgtatgctcttggatccactgtctctcacagactagtgtgggccttgggcccccctcattttgacatccttccagatggttccctgcccctaggccaacctccacagtcatgtgggccatgatggccctctggtggccctctaacgtctccagggcaatgtgggcaatctcagcctccgtcttccccaggaacatctgacaggcggccgccaacatctccttgttctgcccctggatttttacctgtagccagagtaggggtaggaaaggtgtggtgggggtctcatgaagtcagagaaaaagcagagagagaagggagagccctctaagaaatgcttcttccatttcagggaaagaaaggaggaggaggcaagtgccttggggtgcctggaaaagatgagactagcagaggaacttctctgcaggcaagggttgagaagactgtggccagaagatgtcttaatgtctgggagagagggtgatggggaagtggactgtggggaaaaggctctgaaagcttcacctgggcaatgccagtgactgagatggggaccccatggcgagtgtaaaccttttcactcttgacattgagggtcagtgtgttgagagagatcctaggggaaaaagaagggacagacagtaagaagaggaggaaaaagagaaaacggaggtcccccttccctggttcccttcttgcctacctctggatctgttggatgcagggcaggacaaagacacgccctccagccaccatgactggggggcttcggcagaaccctgcaaggtgtggggcagtgaggaacggtggcagagcttgaatgtggaagactgaggaactggcgggggtgaggggacagcaacccacaggagagaatctgggagctggaggggaagcagtctgggccttggaatggtgggaatcaaactgggcagttcgtggccatcaaggggcagaagtctggtgctgggaagttggtagggagagggagaaggggcagaggccagactcacaggggttctggggtcactggctgggaagggaacaacagtacttaccggagaccaccatggcctcatttgggccacaagtgaaaaacatggttcaggctggagctggaggagagggagggaaagcctttgcggatggggaaggcgcgctgtggcgtccacaggggcccatcctttccctttcccgtcaggccctcccagtctgcatccgccacggcccgtcccttctacacccatgggtccgctaaggcttttccctacaaaatccttaagatccccagctacctcttctccgcctgcgtatggtccctcccttcccctcgccgctccctttgataaaggtcccccgcgcccagaggcctgcagacctttcccctctctccctgcttctcggcagccccaggctccatctcccctcccccactcaccttccgggacgcgggcggcagcccggctggggtctcgggaagggcggggtcgcgcagggacctgggagccgggcaggggccgctcgcagaccagctttcctgggagctggccccgctcccgcgttccccaccctgccgcaccccgttgctgcggcagacgcgaccccgccccccgcaacggactaagcacccccacttcgccccgcctcggcccagtgcgctcggcccgcccctttcccggcaggccccgctagagtccgcagcccgcccgcccgctggctctcgggcccagccgggctgcctggttagcccggggagggccacatccctgccgccccagtcaccgcccttcttgagccgggaatcccgcccacgccgcgccacgctccgcccccgggtgagggacttgacctccgcctggcaccctggcgtaagggtgattgccacatctcggattcgccgcggggcaactacctgggaaaaccgcagactgggcaatgaaagactacatccggcaaccggatgctgggttctgtgactccaggaaaaggggctcctgggcccagggaggtgcgcgggctggggactcggccacggcgcctcccgccggtccttgccatctgaaggccgggaggagtggggagtcggcgcttgcaaagatacactcaagactgcagacagtaaatcaattttatttgtgttcacagaacatactaggcgatctcgacagtcgctccgtgacagcccaccaacccccaaccctctacctcgcagccaccctaaaggcgacttcaagaagatggaaggatctcacggatctcattcctaatggtccgccgaagtctcacacagtagacagacggagttgagatgctggaggatgcagtcacctcctaaacttacgacccaccaccagacttcatcccagccgggacgtcctcccccacccgagtcctccccatttcttctcctactttgccgcagttccaggtgtcctgcttccaccagtcccacaaagctcaataaataccaagagacctgcatttacagcagggggaacatctcacacccttgcataagttaaaataaatattacgtacacatctccatcacctaggaggacgtacataaatacatataaatattaattaggagcaataagaaataaattaacgacgctctccttcccaccgggcctagccccagctgggctgtgcctcggtctctatgcgcctcggtctctgtgcgcctcggtcccgcctcaagcaccgggtggcgtctccgctgtagtgttctgagttcaagttgcctcggaagtcccagttggggatacgctctcgcgcaccaggtacgcctggtgtttctttgtggtttttcggattctttttggggagtgcggggagtcacagttagaaggcggccgggtgttgctggaggaaagtgctgaggtccagagcgtagtccgagggctccgaagtcagattaaagggctcgaggacggcggacacaggggtgggcgccagggatgcggcgttaggggcgtcctctggaggcaggggcgccggcacaccctcttcagccatcaggatctggcagaagacgatggtgagcagcagaaagagaagccttttggctgggttcggttcctcgactggcagctggcgccggacctaaggggagacaaaacaggagacaggtcaggtcgaggcctctggagtcgggtcgttccccagtgactccagggcagcgcaccccgcgaatgcccacttcggcgatactcaccactcgagggtagagaaccctgcggctgcgctttcggtgcccgcgagaggcgctggggcgcccggcaggggccgctgcgggctccgggagagggtcgaaggtgaagatctcaggaccggagccccgccggggtcccgggatggtggagggggccggggtcggggcctgcaggatggtcatggtcgggtggcagctgcgagagtgacacatggtgagccgagcggagtgtaaggccaagtgagggtcggctgccggcagaggtaatttatgtgctcctgaaaattgggcgggtccttctaactcctcctcccgcagctggggagcggttggcagcagcgggctggaaattccgacgattaaacaaagggagtgggtggagacttgacatgcacaatcctaggcgcccaactgcacgttgtgagtgtgtgagtcgtgagtgggggtgggtgagatcccgggctgcaggcacatgtcgaggcatgtggcacctggagaggggctcactttagccacaggatccctcacaggcctttttttttttttttttttggagatggagcagtctcgttcggtcgccaggctggaatgcagaggcgcgatctcggctcactgcaacccctgactccctggttcaagcgattttcctgcctcagcttcctgagtagctgggaatacaggcacgcgccaccacgcccagctaatttttgtatttttagtagagacggggtttcaccctgttggccagggtggtctcgatttcctgacctcgtgatctgcctcgctccctccgtccttcttctagtagtctcaagttgctattgttgccatctttacgtccacgagttcccaatgtttggttcccacttataagtgagaatgtatggtatttggtttgcccgcctcggcctcccaaagtgctgggattacaggcgtgagccaccgtgccctgccaagagggctttttattggagatcaggccatcctgctgcaatactgacccagttatatgcacgcattcatgcacttgtaggtatccttagaatataaactccccaagaaggaaattgttacagaaatagtcaagattaagggagaaatgaacacactagcacacacagacacaaacctgcctgcctgagcacacatgaagacacacaccgcgtagccatacaaaagaacaaaattatgtgctttgcagcaacatggatgcggctggtggccattatcctaagcggattaactcaggaacagaaaaccaaataccacacattctcacttataagtgggaaccaaacattgggaactcatggacataaagatggcaacaatagcaacttgagaccagtagaagaaggacggagggagtaaggcaaaggttgaaacactaactattgggtactatgctcagtacctgggtgacaggatcattcataccccaaacctcagcatcatgcagtatacctaggtaacaaacctgcacatataccccagaatttaaaataaaagttggggagggagggaaggatagaaagattaaaaaagtaatacacaatggtggggcatggtggctcttgcctgtaatcctagcattttggggggctaaggtgggaggatcacttgagctcaggagcctgggcaacatagtgagaccttgtcactataaaataacaacaacaacaacaacaatacacaattaaatattattcagccataaaaagaatgcaatcctggaaaaaaaggaaaacataccacgtacacctaccaacacacatgtacacagtaaaggtgcaaagactgtatagggacagttcagcaaaactactctcttaggagcgtgcagaaatattcacataaaggctggtgcagagggccacaaatacaaaggcaataggttagcagccacccagatttgccccttgctgtaagtcaaacaaccaaatttatgggacaaacattctaaattgtgagacattatacaaatgttacagtaatggtaattactcaacttaaagcagattcacatttccataacttccttacagacagctgctcatggacacagaatttaactttttttttttgttttgagacaggatctggctttgtcgcccaggttgaagtgcagtggcatgatctcggctgactgcaacctctgcctcttggctcaagccatactcctacctcagcctcctgagtagctgggaccacaggtgagcaccaccatgcctggctaatatatatatatatatatatatatatatatatatatatatatatatatatataaaattttttgtagagccagggttttgccatgttgcccaggctggtcttgaactcctgagctcaaccaatctgcctgcctcggcctcccaaagtgctggcagccaccgtgcagaatttaacatcttttgagcattcacctgtttcaggcgccctctgttgagggtactactgttgagagtcctgaggctagtttcagtataagtgctgtgccatgcagctgcctgaggaaagccagataaagctgatactccagccatgagggccttaccctccggcatgaggagggaaccatggccaggagagctctctatctgtctgtctctgttgctctctctctctctctttttttgttatattgagtttctgcctgaaggaaaggcaagctttcttgaagatcctaagaaaggccaggcacggtggttcacacctgtaatcccaacactttggcaggccgaggcgggtggatcatttgaggtcaggagttcgagaccagcctggtcaacatggtgaaaccctgtttctactaaaaatacaaaaattagccaagcatggtggcgcatgtctgtaatcccagctactcgggaggctgaggcaggagaatcgcttgaactcaggaggcagaggttgcagcaagctgagagcgtgccactgcactccagcctgggtgacagagtgagaccctgtctcaaaaaaacaagaacaaaacaaaaaacaaaaacaaaaacaaaaaaacctaagaaaactgaagactaagtgttaagggggggacccaaaagagctagtgttcacatctgtccaatcaatcaggggaggcttcatggaagagtggcactgaaggtgaccttgaacagtgggtgggatatgacaaattcagatgtggaggatgactgtaagaatggaattagcaaagaccttgagctggaaaagtacaggatgtgtttggggaatcacaagaaaaacaatctcagagtaagtttcctgtaacggagtagtgggaagtaataatggctggaaaggagtggaattgggcagagtggggagagcagagctgccaggtcaggagcctgggtttcactctagactgtagagcttgtgggttgctggatgagataaagggaggaaaattcaagcaggaaactgattgggatgaggagtgatgctctggacgggtagagactaaggcagtagacaggaggctattggaggggctcaggtagatgataacaagagcctgagaaggtggccctaagagacattcctagcataagataatcagaattgggcaatgagatggatatcattaggggaagggagcatgggagagggagagttgccgacagcaagaggatgaaaagatctgagatgactccagagatttgaaatacatctggctcagatctttctaccatcattttaagcctggtgcacaaagtgaatacatatatgatctcttccactggaggctgtgtcatacacatctttgtgtcctccagagaacccagcatggtaccttgtaggcagcagttgctcaataatcttgttaaatgccaggtgaaatgtacaactgtaagtgtgcatgtagtattcccaccttggctgggtcacaccaagcttctgagatgtggctacactcctccaaaccactcatacaaatgtacaacatctttagaaaagctgggacaattcttacacagacaccaaacaggaaacacttttctcccctcccacttaggaaacacttaaaaggatttttcaatcaagaacatgtaggaacacaaataagaggacaggccacaaccggctagaaatacactactgctctgtgtacaattcctgggcctacaagtcactttattttatactcactactcttatctaaatacacaagatcccttccacattacacacttcttcctggctggcataaaacacacctcctctgtaaacaaaggcgcattgctttcccacgcctgtcttcacacctgccatcattcttacatttacacccaagcacagggagcccaccacccccaacatccttattccaaggcaactcgcacgctacacaatgaccaacataaacccatgactacttacacatgtggacagaccctcacactcacataaacataaattgggagtagggggagatagtgatgatggaagaaaactagtgggtgggagagagagagaagcaccaaaggttaggaatgcattacttgtttatgatggaaaatttctctagggcattaggcagaggaggggaaatgaaggggatgccaggatcttgttttgccactacctcccacatctggaatctgggcctccagctgggtctagttatcctcgctgtcctcccggcacagagagacctttctttgtggcaagaccagaatgggacaaagagaagacctgagaacccggactgctcaccattcccaaccaatcccatccccattcctgctaccctcagagccctagggctctgctcctgctccttcctgccacacaggaagctagggaaatgttgggggtgaatcattaagccaataagggggtgggggagtgcaggctggggaatgagttaaggccagaaagtgccaggggctgagacgagcaactggactggctcccactgccctgatactggagaaacaggcccttagcctcctccatttccagctctcctcctcatttccttcccatcttcccccagatcaccatgttccttcatttccctcgtttgacctttgccttgatccatcaccactgctagcctccttctcagccccttgtttttcttcatgacacatatcacgttggggaatcattttatgtatttgctttttgctgttgtttgtcccgcctactggaatataatctccacgagtgtacagggccacatctgacctttttctcattagatctctgtagtatctccagtacttggctgtcacctagtaggaacttaataaatattcttaaatctgtctcctccgaggagctaaacctcatctgcagagaggtctgtttatctagccatgttcctttagaggcccccatgtttgctcttcaaagaggaggttgggggcactcaggtgtggctcaggtgatccgccgctgaatcaggaacaattgtgcagtgacgacagcgacagcaaagccctggcccgcgccctttacaatccctgacataggagtgagtcaggcctgctgcctcacctgggtactgctgcactgctgaccacaggcccagaacgggggacggcaagaatgggcactggcggaggcagaatgggcaggggaaagggaggcagagatttggaaatgggagcatctgagaaaggaaagcagggtgaagggactgcaccagggtcctgggggtagggaatgacaaagtgaaagctttttagctgcacctggtattcagtagatcctcaataactacttggtgacttgagatgggtttgagatagaaaggaaacacggaatagcaaaaagaacatattgtaatctagtggtgttagacgaaattgggtttaagtgccagctctgctacttattaactaggcaatattgggccagttacttaatgttgctgaaaatctgtttcctcaattgataaatgggcaaattgacctctaggtaactgcaaaggttaagaatataaatttactccttctgggcacatagtaggtgcttcttgcatggagcaggggcattattataattatgagaagagggactgctttggaacagggatgggcagcagtgagccaacccaggagtagggaactggaatgagaaaataacctctaactgctaacatcaccaggagatacaagttctttctctttttactctgccctccctccctctccatatcaggcaggttttgtggctctttattttccagagaagcaaagacttctgcattcctagttcctgttcaactaatgtgagtgattttatttttttatgtatgtatttatttattttttgagacaagatctcactctctcacccaggctggagtgcagtggcataaacatggctcactgcaacctcaacctcctgggctcaagtgatcctcccacctcagcctcttgagtagctgggactccaggaacgtgccaccatgcccagctaatttttatttattttggtagagacagggtcttgccatgttgcccaggcaggtctcaaaattctgggctcaagcgatcctcccgcctcaacctcccaaagtgttgggattacaggcgtgagccacaaagtctggcctttatttatttaaaaaatttagtttggctgggcgtggtggctcacgcccataatcccagcactttgggaggttgaggtgggtggatcacgaggtcaggagttcgagaccagcctggccaacatggcaaaaccccgtctctaccaaaaatacaaaaattagctgggcgtggtggcgtgtgcctgtaatcccagctactcgggaggctgaagcaggagaattgcctgaaccagggaggcagaggttgcagtgagctgagattgcaccactgcactccagcctgggcgacgagagtgaaactccgtcttaaaaaaaaagaaagtcttactctgtcgtccaggctggagtgcagtggcacaatctcggctcactgcaacctctgcctcccgggttcaggcgattctcctgcttcagcctcccgagtagcgcatgccaccatgcccggctaatttttgtatttttggtagagataaggtttcaccatgttggccaggctggtctggaaaactcctgacctcacgtgatccgccccctcggcctcccaaagtgctgggattacgggcgtgagccaccacacccagcaaaaaaaaaaatttgtttttactcaccactatactgacaaggaacaggtgattttaaacatcccctcccacctacattttagctggaacaattctccagaggcatgggggtagagtggggtggtgagttctaggcagcaagttaacaaatgacccctaaagatattcatctaggctctaggaggcccaaaatcaggccctggcagttcccctgacgcaaaaccatggcaagagttccgggagcaccaaggcaaggtcacaaaagtggcacgatgaccctaccctgggatgcagctcagcctgacccagcccaactcaacccagctaccctggaggctgctatgagctgagccgggagctgggaaagggcccagcattcctgtccttctgccaaagccggcttcttaggaccccagtgttgtggctcctcctttggtcttggtttctttcccaccagattataactccaccagagtaggactttatctatcttgtgtactgctctattttcagtgcctagaactgtgcctgtcaatcaatacaggctgctgaaaaggctagaaatacaggatcgttgatgtcattactgttacagtgctgttcccgtgggaagcagcctgcatctctctgtagacagctccaatgtcagccattggagaatttgatggagattgaagtcaaaacataatcataggggaaaaatgcacaacaaataaaatatttccccttttgtccagacttttcagacaccccgtatttactggatgagttgatctacaaagtgaaaggcataaattaaaggctctctaatgtttctcctcctctgaaaccccatgattcagcagcgtctcccatgtgtgctcaaaagttggacgtgcctccagcctaccctccaaagcagttgccataggctcttttcttccaaggttgggagggacagttcattccccaagaggcctctccaggggcggaggcgggtgctggggctggcctgtctgcagctccctggccctacccagtggggatcgcgtgtcagtactggggtttggtgggctgccaaggggtgagccctgaggcggttttctgggaaggatagatgccatgtgtgactcagaaccaagttagggaaaaaacaagctcactcaatctctagcaccctctgcctggcctggctttgcccatgagctcataaaagaggaagctgggccggccagacagtagctctgctttccctcatgttttctctccacgtctcacggattccctagagtgtctgggcctcaggccaccgtcatcctagctcctgggccctggctcttttatgacactttcccttcccagacacttggtcatttctttccccaggttgggaatcccacctaccatagaaggggaattgcacacaaggggaggttgcaaatctctgtgttccttggccctgctgaggcctccactgtcagccatgaccatttgggtttgtgcgtgtgactgctgtgtctctgacacagaccaagtggtgctgaccctgggagcctgaattaatagatttcttgagagctgagattctctggttcaggaaagaaaaagggggtaccaaatgactgggcagccgagccaccctcagggctgcaatattccagttgggaccaacttacctagtacttttggcattcagaacagttcactaccaaaaaggcacattttattttagtgaaaatgggacaatcatgggccataaagaaccttcctaactattgttcctccggttcacctcctataccccccagggctttcttgttcaaagacagacttgaccatgtccatgcctgcttcagtaagttcagtggctccaaactctctgagttcccaacccaaatccaggcaccttgcaggctttctctttcaacacccccattgcttcttgatgttgtgcatctctaattttgtcctttttctcacacatgccaaactcttacccattggaccctataaccgttctatttcttttcctttttcctccctattctcctgggaaaaaaccactcctgaacctgccatccagaattagttcatctacattgtatacaaatctctcaaagcatcacacacacgatattatagtcatttgtctatctttttgattgccaggagaggcacgtgccattgagatgcagccgtcttaatactggtaacctcttgacaaggcctaaaattattattaaattgtcaccattaaaaaaaaaatcagtggccaggcacggtgtctcattcctgtaatcccagcactttgggaggccgaggtgggcaaatcacctgaggtcaggagttcgagaccagcctggccaacatggtgaaaccccgtctctactaaaaatacaaaaattagcctggcgtggtggcaggcgcctgtaatcccagctacttggaaggctaaggcaggagaatcgcttgaacccgggaggcagaggttgcagtgagccgagatcacgctatcgcactccagcctgggggacaagagcaagacttctcaaaaaaaaaaaaaatcagtaagaaatgtataaaccagatattctcaacctatccctgtgggttgaactcatcctatctctgaccctgagcctttcacataaaatttggtagtatttggtgatactgcattttgttttaaaaagtcaggtagattgaagtataatttaaatacagtaaaattcatccttcttaggagtagtttttgatgagttttgataaatgcatatagtttgtgtaaaggcctccaccatgatgatatagagttttccatcacccccaaaagttccctgcatccctttgtagtcagtcctgtccccatcccctatagcaaccactgatcagacttctaaccttacagttttgcctgttctagaatgtcatatagatgaaactacaggctgggcaaggtggctcatgcctgtaatcccagcactttgggaggccgaggcgggaggatcatctgaggtcaggagttcaagaccagcctgaccaacatggtgaaaccccgtctctactaaaaattagccaggtgtggtggcaggtggctataatcccagctacttgggaggttgaggcaggagaatcacttgaccccaggaggcagaggttgcagtgagctgagatcacgccatttcacttcagcctgggcaacaagagcaaaactccgtctcaaaaaaaaaaagaaagaaagaaagaacgaaactacagtagacactcttttgtgtccagattcttttgctcagtataatatttttgtgattcatccatgtcatggcatgattcagtagttctttccttttgacttctgcatagcattccattgtataaatatatgacagttggcttattaattcaccattgatggacattgtggtttttttcttatttttggaaatgatgaataaagctactatgaacattcatagacaactcttttttaagacatgtattcttatttctcttgagcagatgtctaggagtagtataactaggtgcatgtttagcttagtaagaaatcgctgctgtgcccagtggctcacacctgtgatcccagcacttgcaccacgacgcccagctaatttttgtatttttagtagagacaggtttcaccatgttgatcaggctggtctcaaactcctgacctcaagtgatcagcccaccttggtctcccaaagtgctgggattacaggtgtgtgccaccatgcccagcctaaaggcagaaggatttcttgagcccaggagtttgagatcagcctgggcagcatggagagacctcgtctctacaaaattaaaaaattagccaggtgttgtggtgcgcgcctgtggtcccagctactctgggaggctcaggtcgaaggatcacttgaatccaggggtcgaggctgtggtaagtcacattcacaccactgcactccagcctgggagacagagcgagaccccattctaaaaaaagaaaaaataagggctgggctcggtggctcatgcctgtaatcccagcactttgggaagctgaggcgggcagttcatgaggtcagaagatcgagaccagcctggctaacatggtgaaaccccgtttctactaaaaattcaaaaattagctgagcgtggtggtgcgtgcctgtaatcccagctactcaggaggctgagccaggagaatcgcttgaaccagggagtcggagattgcacagtgagccaagattgcaccactgcactccagcctggcgagactccgtctcaaaaaaaaaaaaaagaaaaaaaagaatttgctatgctattttccaaagtggttcatactgacagaactgttttaaggaagctgcatcaaaatgttcctcttgtaaattcttgcttaaaatatgccaaaactaagtgttttttttgttatagaacaggttgccactcagattacctcaagggacagagatgggctggaatagagccacctcagtggccagtaacctgccccttgaagaaccagcatgtcttccagaagccacagtggcttccagtgcccagcggcagccccaggagcacaccctgcctccctgcccagactccttgtggctcagcatctctgtctgcagtgactggctctgcccaggtcttgtggggtagtgtgaagtgacactagcccacacacctgagcatgtatgatgcctcagaggcactgtgtgtttttttttgtttgtttgtttgtttgagatggagtcttgctctgtctgtagcccaggctggagtgcagtggcgcgatcttggctcactgcaagctccaactcccgggttcatgccattctctccctcagtctcccgagtagctgggactacaggcgctcaccaccactcctggctaatttttcgtatttttagtagagatggggtttccccgtgttagccaagatggtctcgatctcctgatctcgtgatctgcccacctcggcctcccaaagtgctaggattacaggcgtgagccaccacgcccggcataggcactgttttaagagctatactcaaatcaattcattaagccttcataaccccaactgttattttatctatacacccattttacagatgagaaaaatgaggttcaatgaggcaattcactttcttaaggttgtgtaaccaagaagtaatgggagttagatgtgaacctaggtctatttcattccaaagcctagtggcatacctatttgtcagagcatagatgctagagcccatctacctgggttcaactccatgtttgtttgtttgttttttgtttttgattttgagatggagtctcactatgttgcccaggctggagtgcaatggcatggtcttggctcactgcaacctttgcctcccaggttcaagcaattctcctgcctcagcctcctgattagctgggattacaggcatgtgccaccatacctggctaatttttgtttttttagtacagatggggtttcactatgttggccagactggtcttgaactcctgacctcgtgatctgcctgcctcggcctcccaaagtgctgggattacaggcatgagccaccatgcctggcttgtttgtttttagagtcaagatcttccactacagctcaggctgtagtgcagtggcgccatcatagctcactatagccccaaactcctgggctcaagcaatcctgccacttcagcttcctgagtttctaggactacaggcgtgtgccaccatgcccaactaattaaaaaaaatttttttttttttttggtagagatagggtctcactttgttgcccaggctggtctcaaactcttggcttcaaatgatcttcctgcctcagcctcccaaaatggtgggattacaggtatgaaacaccatgcctggacaactgtatgttttaattcacttaattttcatggtacacctctgagaggagggcatgacaacactcattatacaggtgcagtgacagcacagaactctgtgaagcaggggaatgacagagttgagtttggcatccaggaagtttgtctccagagacaaagctattgacctcaacaccttcctgcctctcaacaatcctcattattaatgttattattcaacccactgacctagctctttttgtctttggggttttacactgctctgatgttcatgtccttgcttatgtcttaaattgagactctgaatgggttgtgtacacactccccaggatacagtaacctttttgggtattctcacctctggctgcatcactggcctcttgccagcccttgagaactgcccctagctcaagcaaggatcctaatttagtagatgaggtcagggccggaagattatctgcagggtgacctatgcccaaggacttactcccaaatacttttctcaagagaaggtggtgtaaccagaagacactttaaggtcttgaggccatccccaaagatcatttgtttcctcaaacagattttgggctttttcaggtgagagactaatcactgaacccactgtcagtattcagcagtgtgcctgattgatatatactaggtactcaatggttttgactgaatgatgaataaataaatgaataaataaagaagcccagattctcttaatttaggtctatgctgtctaatacagtagcatgtggctatttattttattttattttttgagatggagtctcactctgtcgcccaggctggaatgtagtggcatgatcttggctcactgcaacctctgcctcccaggttcaagcagttctcctgcctcagcctcctaggttgctgggattacaggcttgtgccactatgcccagctaatttttgtatttttattatttatttatttatttattttgagtcaaagtctcactctgtcacccaggctggagtgtagtggcgtgatctcagctcactgcaggctctgcctcccgggttcacaccattctcctgcctcagcctcctgagtagctgggactacaggctcccgccaccacactcagctaattttttgtatttttagtagagacggggtttctccttgttagccaggatggtctcgatctcctgacctcgtgatccgcccgccttggcctcccaaagtgctgggattacaggcgtgagccaccgcgcccagcatttttgtatttttaatggagacggggtttcaccatgttggccgggctggtctcgaactcctgacatcaggtcatctgcccaccttggcctcccaaagtgctaggattacaggcgtgagccactgcgcccagctgcatgtggctatttgaatgtaaattctaatgagtcaaaatttaaaattcagtttctcagtttcattagccacatttcaagagcacgataatcccatgtggccagtgattaccatatttgaaaacacggaaatagaacatttccatcattacagaaagatttgttggacagcactaggctagatgacagatagggtgggggaagagaaaatgctgcattgggaaaatgcttggtataggctgatggctttaatctgcttttgacacttttaaaagagtcaagatcacttgtctctcattagattgtatcgcacactgcccattcagaggtccagaaaccacttcttcttcagaaatcttgtactgagaaatggaagcccatttctgatcacatacatgacccatgcttcttcagaaaggaaggcatgaagttgaagggggaactaagactgctgagttcttctgtcttcggccacaggaaactaactgattcatggcactttgtacccatgagctcatctagtcctcccagggcacaggaaagtggtgaaaataagtggccatggttcacagatttttcagctggtagaggctagttcctacacttaaaacatcagtagattgtcaaatgtgttccaactaagagcagtggaaggcagaaaggtgtataaaatatgggtcttaagaggtttataaccaagttaagggaaattaagagatcagcacataaatataagtatacaaaactgtaactgtatctgtagctatatgtgtgtgtgcatctatttattatctatctacctacttatctaataacataattaactaacatttatttgatatcttagagcttaacaagtacttttcctcatatgaagactcagcagatccccatgatgaatgtcaaacaaatggaatgttggtacagagagcaagcattctaggcattcgcagccgggtgagatcactgtggatggagtgatgggggaaagcttttgttgaggcagaaccagcaggaatgtggggtagtcacacaaacacagatacaattcctggtttccctactagacacttcccaggctctcaattgcttgtagtttttgtttgctttttttttttaagacatggtctcactctgtggcccaggctggagtgcagtgccatggtgtaatcatggctcggtgcagtggtactatcatggctcagtgcagtggtgcgatcatgtctcagtgcagtggtgcgattatggctcagtgcagtggtgcgatcatggctcagtgcagtggtgcgatcatggctcagtgcagtggtgcaattatgtctcagtgcagttgtgcgatcatgtttcagtgcagtggtgcgatcatggctcagtgcagtggtgtgatcatggctcagtgcagtggtgtgatcatggctcagtgtagtcgtgtgatcatggctcagtgcagtggtgcagtcatggctcagtgcagcctcaactgccagagctcaagcagttctccctcctcagcctcctgatttgttgggaccatgggtgtgtgccaccacatctggctaattttttgactatttgtagacacagggcctcgctatgttgttcaggccggtctcaaactcctgggctcaagtaatcctcctcggcttcccaaagtgctgggattacaggcgggagccactgcgctgggcccactgctagtagttcattttactttctaaaagataaaatgttgatgaagagttcttagtgatccatgttttctctccagtcctccaccaaaataacgcattttaaaaaaacaaactcccacatattttatagtgattctacaaatgtagaataatttggatactcttaatacaaaatggtttgagttacctttatttaataatcctgtgatgagcatacaatgacatacgtcaaataacttacaactcaggcttatataacatcggctctgccccaaattcctgccgtgtagaacacataaaaatccaaccctgcagtctgaccagtcttgcctaggttctccttacataatcataaccacttccctgccaggagcaattttaaaatgttcttctaaagccctgtgcacttcgccttggcttcctttaacttttcttttctctttttttttttgagagggagtttcgctcttgttgcccaggctggagtgcaatggcttgatttcggctcaccgcaacctccgcctcccaggttcaagcgattctcctgcctcagcctcccaagtagctgggattacagtgtgtgccaccatgcccggctaattctgtatttttattagagatggggtttctccatgttggttaggctggtcttgaactcccgacctcgggtgatccgcccaccttggcctcccaaagtgctgggattacaggtgtgagcaaccgcgcctggccggtttcctttaacttttctaaagagcttctacttttcttccttggcatttgaatttctttggcttcaagccacaaaaatgattgtccttaacttgaacagaatagatgagtcttgggaggatattgaatagctcacagaatcaaaggaaggccagagaatcaggctcaggagacaaagaaccagggtagctccagcggatgaggtagcaggaatcgacggtgttgtcctggctacctgctgaaatgagtaagtgacaaagggttttttccatcctttccattttgttcatcattcaaagccctagcagagagaatctgatcagcctagtctaggtaaaggctaggggaaaaagcacaccttaaccatagctcattaggaatgcacacaggtaattctccaaggaatccagtgactgttctcaggagaagagaatgcatgcaggatggtcaaacctcagaaaatatccaccacattcgcattttctcttacctccattttctactttttctaattatccacaacaggggtgactaacatatcttccaaggttgtgaaaaatatatagaaaaataaatctacctgtattggaatttttcccagaaaggattaatggttgggaaagtttggccctacttacccctcagtgttaaatataaggattaaagaaaatatatgcaaaatgcctattaccttacttggcatgtagcaaggttcattaaatgtcagtcccatttcaccccttcccattcacccactgttgtgctgaagccagctcacaccagttcatgagaagaatcattatagtttcaggaactttatgagccaactggcataacattggtagcttgaagttggcctttgtagagacagaaagatgtgattgctttctgcacccatcctgagtcatgaccaatactcccataacaaaagacaggcgaacaaaacaaaagcataacaaatttattttattttatgtatctatttttagaaacggagtttcactcttgcccaggctgtagtgaagtggcatgatcatggctcaccatagccttaacctcctgggctcaagcaatcctcctgactcagcctacagagtagctggaactacaggtgcagaccaccacacacaggtaattttttgtagagatggggtttcaccatgttactcaggctggcctcgaactcctgggctcaaaccatctgcttgtctcatcttcccaaagtgctgggattacaggtgtgagcccctgtgcccgaccaacaaatttatttcatcaaagttttacatgacatgggagccttcagaaatgaagaccccagaaatgctcagagaaaacaatttttttgattagtttcgatgaagaatggacagccaaggctgggtgcagtggctcacacctgtaatcccagtactttgggaggctgaggtgggaggatcacatgaggccaggagtttgagaccagcctggccaatataatgaaaccccgtctgtactaaaaatacaaaaattagccgggcgtggtggtgtgtgcctgtaatcccagctactcaggaggctgaggcaggagaatcacttgaacctgggagacagaagttgcagtgagttgagatcgtgccactgcactccagcctaggccacagaatgaaactctgtctcagaaaaaaaaaaaaaaaagaacagacagtcatgtagaaatgtgactgaacacaggctgggcacggtggcttatgcctgtaatcctagcacttagggaggccaaggcgggcggatcacctgaggtcgggagttcaagaccagcctgaccaacatggagaaaccccatctctactaaaaatacaaaattagctgggcatggtggtgcgtgcctgtaatcccagctacttgggaggctgaggcaggagaatcgcttgaacccaggaggaggaggttgcagtgagccaagatagtgccattgcactccagcctgggcaacaagagcgaaactccatctcaaaaaaaaaaaaaagaaaagaaaagaaatgtgattgaacacaaagtgaatggtcgcatgggaataggctgagggagaaagccagcagagcctgtctgttgggattctgcttggtctctctgtgcagcattccttccttctggatataggcagggactctccaaaataagggttttatgacctactattagaaaaggtagctcagtttttttttttttttttaatgagctgtgcttatacagaaaggcaaaggaaggctagagtaatagttctaagttttatgattggctttgggggaaagacattctggtttctttgacctgccttggaggagagaggggagcaggagaaggtcagaggcagactttacttctcaggtccttcccatgttcttctcaacttgccaaaacaccaaactctggggtatcattttctgagccccaacaccttgatggaagtatttacaccacagaaatcggaaatgttgcaagtcagaactttcacctacccccagccctccactgcctctgagagttaaacatttacaggccactgccacatctgctcctttctttccttcacaagttgtgagaagaaccaagttagcattaggttgacctgtgagtgacaaaaaccgaatagaacaatggcttcctagatggaagtccatttctctctgacagaaacaaagtccagagccaggcaggcagctcggggctgggacagctccgccttgctgcctcactgtctttgatgcatggctctttgtgatttaggatgactgctcaggctccatgttcaggccaaggggaaagagaaggacaaagaaatacacaccccatcctagtaggtccacagacagaagtaacccgtaacatttctgctcatttcaaataggttggaaggaagtctctctgccacatctggctgccagggaggcttagagccctgttgcttcctgcaggcagccatgtgccctgctgggggctgagaaggggaggacaggggccggggggcagctgagaagccaggtgggattcgagaacatgtaggggagagggagaactggtgttggtgtgatgggaatgagcatagtttgtggaactctgggggagctgactggaatagaaaattaaaaatactgacaaatgaggttaaataaacaaggtggaagccagagctcagtgagggaccaggaaagcagacaaaagaatctttatctgctgccactagacaccggaggcactgaactttccagcaggggagctacatgatcagaggcatttcagaaatgttaatctcacacttaagtgctagacagattggaggcaggaggaaaaacaggaagcagcagggaggttggaaaggagaattatttcataagccaggtgtgaggtgattatcggggaacctgccccattagtcacgtaggttcttttctattttcctaagcatcggccagtttgagaaataaagggacagagtacaaaagagagaaattttaaagctgggcatccgggggagacatcacatgttggtaggttccgtgatgccccgcaagccgcaaaaccagcaagtttttattagggattttcaaaaggggagggagtgtgtgaataggtgtgggtcacagacatcaagtacttcacaaggtaatagaatatcgaaaggcaaatggaggcagggcgggatcacaggaccacaggaccggggcgagattaaaattgctaatgaagtttctggcacaattgtcattgataacattttatcaggagacagggttttgagagaaactggtctgaccaaaatttattaggcaggaatttcctcttcctaataagcctgggagcgctatgggacactggggtctatttcacccctacagcctcgaccatagaagatggccacgcccaggggggccagttcagagacccacccccaggcgtgtattctctttcccagggatgttccttgctgagaaaaagaattcagcaatatttctcccatttgcttttgaaagaagagaaatatggctctgttccgcccagctcaccggcggtcagagtttaaggttatctctcttgttccctaaacattgctgttatcctgctcttttttcaaggtgcccagatttcatattgttcaaacacatatgctctacaatttgtgcagttaatgcaattatcacagggtcctgaggcgacatacatcctccttggcttacgagatgacaggattaagagattaaagtaaagacagtcataggaaatcacaagggtattgactggggaagtgataagtgtccatgaaatcttcacaatttatgtttagagattgcagtaaagacaggcataagaaattataaaagtattaatttggggaactaataaatgtccatgaaatcttcacaatccacattcttctgccatggcttcagctggtccctccgtttggggtccctgacttcctgaacagtgattacatggggacaatgggaatgaggaggaagaatgagaggcatttgctagaaaatgtattcaaactgatggctggtctgaaagggagttgtaggctggggtgatgagagacaggtctcatagcaacagggtaaacaaagtaaacttggcttggttggtgttttatttattattattatttttttgagatggagttttgctcttgttgcccagactggagtgcaatggtgcaatctcagctcactgcaacctctgcctcccagattcaagtgattctcctgcctcagcctcccgagtagctggggtaacaggtatgtgccaccatggccagctaatttctttatttttactagagacggggtttcaccatgttggccaggctgatctccaactcctgacctcaagtgatccgcccaccttggcctcccaaagtgctggaattacaggcatgagccacggcacccggcctattattattattattttatttcgagacagggtcttcctctgtcactcaggctgaagtgcagtggtgcaatctcagctttctgcaacctctgcctcctgggctcaagcgatcgatcctcctgtctcagcctcccaagtagctgggactacaggcgcatgccacaaagctaggctaattttttttttgtatcttttgaagaggcaagattttgctgtgtccagcctgtctccaggctggtcttgaactcatgagctcaaagcaatctgcccaccttggcctcccaaagtgctgggattgcaggtgtgagccactgcactcggcagcaggtgttttagattgggctaccttgaagcagaacctggggtggggacttttgttcaagagatacactgcgggaggctctcaggagaaagactgaagaaaacaggatagggaagggaaaaaggctaagcaaggatgtgagcttcagcctgagctcatggggaagctcagggcagcaaattgcaccagtcaattgcacttggaggcatgggggctggcgttttgtagatctgctttaaggtcaggcagccactgggagtctgtccagagtgtgtgcaagggaggagggcttggctcctgtttggcccagggcaattctccagaaaaggggacaattgtgtgtggttatcagctgatattcccaaaagctggaaagtgagtggactcactggtgaaaaggacctgagcccaaacagtgtccatgatagtgaatccattttggttgtgttggatttgaggtggcaaagaaataaggaactggcatgtgactgcgggaaattggagctacaagacaggagttcaggtgaaaagataggactaggtatgtagctattggagtgggggacttcggcgcacagatgatagggttttttgtttgtttgtttgtgagggtttttttgtttgtttgtttgtttgtttgtttggagagagggtcttgctctgtaaccctggctggagtatagtggcatgatcatagctctctgcagccttgacctcccaggctcaagagatcgtctcacctcagcttcttgagtagctgatactacaggtgtatgtcaccactcccagccaattttttaaacatttttttagagactgggggtctcactgtgttgcccaggctggtctcaaattcctgggctcaaatgatcctgctgcctcagcctcccaaagttttgggattataggtgtgagccatggcgcaggcctagatgatagtttaaacaagagggaatttgtatatttgtcactttgggggttgctggtggcctttgaaggaagagtttcacagcaggacagagtacaaaaccatatggtgacgtgaggtctagtaatgctttccacagttaatgtccttccattctgactaactcttaacacctctagggtactttctccttcgacttatgtgctgctcattctggcttgtcctctgtgttctggttattttttgttgtccaacaaattgcctcaaaattttgtggcatgagacaaccctttattacgttcacggattctgtgggccaggaatttggacacaccgcagtggggatggcttgtctctgctccatgttatctggggctgcagctggaagactcgaaagctgggggactgaaatcgtctgcagacactttgcagtggatgctggcagttagctcagggacctcagggtttctacctgtggtctagttagagtttctcttgcatagtggctgggttgctgtgagggaaccaggcatgaactgctttttttttttttgaggcggagtttcactcttgttgcccaggctggagtgcagtggtgcagtcatggttcactgcagccttgactacccaggcttaagtgatcctcctgcctcagtctccctggtagctggggctactgccaacatgcctggctgatttttgtattattattatcattattttgtagagacagggtctcactatgttgcccaggctggtctccaactcctgggctcaagcaatctgtccatctcagcctcctaaagtattgggattacaggtgtgagccactgtgcccagctgcattctttttataacctcatctttttttgatctgcatcacctccctcctaccctattggtcagagtagtcacagccccgctcccattcaaagagagggaacatggcccctacctggagtgtcagtcatgggacaaggagagcaagtggaaaggggcacccaactttggaaaataccatcggccacactctatcggagcctccatttgctttttatgagtggccttcatttatttagctgtcattgggtcaacaataacagcaacttgaggaacctcttgagggcagggatcaggcctgttacgtttgtttactttatctttatatcctgagcattggcccaggaataagtatctgtggaaggacgggatccttctaagtctctcatctatttttcatacacggcatcatttaattctaaactagctgtcattaccatttcacaattgaagaaactgaggcttagaggcgcaaatggtctctctcagatgactcaggtcttctgggttgatgtggcttttattaagaacttgttgtctccaacagcaaatagcattcctaggggctggggctgtttcttcaaggcccctgcctctgcaccctggtagcagcacaggcctagctgtagggctgtggacagcgtgccctcggctgcttactgactggttggcatttgatacatatgatgatttaacatgaagatttagtgtgattttgcatctcttcatgggagcagggtcaggaccaggtcctgttgcggaattcagctttggggctgggtagaagactgggatgaagttgctcctcatctctgtgccctggctatgagcaggcagcacctgggtcaggagtgtgaggtgagtgggtgatgctaaggagggttcaggtggagcagtcagactgtgctgagtaactcccctggaggggaagggggacgtggtggaggcagttcctggaggcccagctcagagcggagaaaggagccaattaccacctcctcccaagtcacatcccagccctgggaatacttcacaggctccggggaaatcccggccaagtggcagagtgggtggtggggtgcttatcactcatgatcaggagtgggtgggggcggatcttagagcttgcatcaggcctcaattttccaactcctgcctgtgatccacccccgcgcccactgcacaccaccaaccaacctttgactttatctctttagttgatttctcagagattgcagatcaggaagggcctttggaaaccacagcttccacttccgctgtgggggcagaaagcacgggacaatctaaccctttcgtgcctggaaagtaacaaggaggactctgcccttaccaggttcccaaggtcctgtaccagccccacagggactgctgaggggagctttttctctctggttcctcatcctctcctctactcaggtgtaggctgtccctgcctagttggtctgacagtagctccctgcgacttctcatatcacctccgactccccagcctcacctccacgggccctgatgcactggcttcggctgtgtcttttgtgagtcatccttgctgctttgttccagccccactgatgggcctcctgccctcccccatgcaggacttagtcaccgctcgtgtcatcaatccctctggaatgcacccctcctccagacacccatgctccccacatcctttattattttgttaaaactagcaatgccccccccaacccccatgattaaaatagtacatgtttgttgtgggaaatctgtaatatgcaaaatatacacaaaagagaataaaaagcaccaataattccataacccaaattagctaacattacattccggtggatttccatctggcattctcctcgccagaactccgtccagcttcaggccttcatgtgtgcttattgcttcttttacctgcagtcatgctctctgtctctcccctccttcaatctgtgagcaaatctactcatccttattattttaagggtcattctttcagagaaaccttccctctacccccaagctagtctctttattacacactcacaatacccagtacttttccttgtagcactcaccacaactagaaataaatcatcatttttgtcctcttgtgtttaatgtctgcctagctacctgacgtaaggtctgtgactggttttcttgtttactctgatggccctagcacccatcacagtgccctgtactcagaaaacatacatcatacccagatgccttcccggaataaccatgtgcctgtcttcccagcacttacaataatcaatttaacaaatataattaatcaattactatgtgcctggcttggtttcaggtacaggataccaagcaaaatgacccagttcttaccctcgaggaggtctcagtcttttgagggagacagatcagtaatggaagctttctaatgtacagctaagtaaacggtgatcaatagtgttaggtaaagtgtggaggagaggtccgtgaacaatcctggggagatgacaccattgttttatcttgttaatgcatttacttcacagaatcacaggataatggaattggacggcaccatgagatcagcaggcccatctcttcctgtacagatgaggaaactaaagtggtgaagggtagtgaagccacttagccaaagccattgggtgacagatctgggaatagaacttggatctttagattcccagcccagggctctttccactgtacctgggggcctttggactccccctcccctctcctcttattctgttaatccccaagtcctttgattttccccatgaaggtctctccaatctctccacttttcctcatccccacatcaccaggctctaagcctccaacatcatctccagcctgagcacctaccctcacctcctacctcatctctctgcttctagtcttgccctgctcagatgccttctccactctgccgccaaaatgagcctcacagatgtacgcatgtctgtccctggcttagaactccagtggcttcccaccaggcttttagaaatatactcaaaattcttatatggtgtattagtcagctcaggctgccataacaaaatatcctagacggggtggcttaaacaacagaagtttatttctcacagttctggaagctgagaagtccaagaccaaagtgctggcaaggtcagctttattcagactttcagagtcctcttttctttctttcttttattttattttattttatttttttattttttttgagacagcatcctgctctgttgcccaggctggagtgcaatggcgtgatctcgggttcaagtgattctcctgcctcagcctcccgagtagctgtgactgcaggtgcccgccaccacacccagctaatttgatacttttaatagagacggggtttcaccatgttggccaggatggtctcgatctcttgaccttgtgatctgcctgcctcggcctcccaaagtgctgggattacaggcgtaagccaccacgcctggcctctttctttctctttttttttttttttttgagacagagagagtcttgctctgtcacccaggctagagtgcaatggcatgatctcggctcactgcaaactctgcctcccaggttcaagtgattctcctgtctcagcttcctgagtagctgggattacaggcgcccaccaccatgcctggctaatttttgatttttagtagagacggggtttcaccatgttggccaggctgttctcaaactcttgatctcaggtgatccaccctcctcagcctcccaaagtgctgggattacaggtgtgagccaccgcacctggcccagagtcctctttacttcgttgtaggtggccgccattttgctctgtactcacatggcctcttcgtgcatgtggggagagagagctctcttgtgcatcctgttccttttataagaacaccagtcccatcagattagggcctcacccttaggacctcatttaacctgaatcacctaaaaaccctatctccaaatatagtcgcattgagagttaggggttcaacatacgaatttggggggacacaattcattccatagtgtagggtccactgggccttttttggttgagcccaccttaccagcctcttctaaacccaactcacctctctgtctgtacgcttttatatcttggaatttttttggttcctccgacttgtctggatctcttgtagctcaggttccccctccccctgctctgatgtttttatattttcatcattttcaagtctcagtttgaacattagcttctaggagaggccttccctgatctgcatcctgtgttaggtcctctggctatacatgcctatggtaccctgaactccaccttgtgtaagagtcaccacctcagtcctgtgtgtttcatatctgtccttctgagctccacaaggcaggaagatctctgtctggttggttgcagtatccccagggctagcacagtgcctggtgcctactaagcagtcaagattaacttttactggtagatgctcaatacatttccattgacctgagctgtcctcagagagtatatgtattttgttgtctaatttgggttgaaatctctcagaagggtcctatctgttccttacttgaaatctcctatcccgtgcccatcctgggctccttcattcaggaaacattcccataaatgattattaactgatctccctacaactttcccaacatgtatcacatttgaaggaacaatcatatttaaaagaatatgttacatagcaggacagtttattatgaatgtcatgtaacaacaatctactgagaattaaaaagaaactaaagtgttcctctcctctcccacctctgggcaaccaggacttcatttctttgaaattgtggatttcctgacccctgaggtgtttggctttttgtgtatgttttagaaggaacagaaagaatcaggctgggtggggctgtaaaggaaacccaccctaagcaggcctcgttttggaagagctggaaagatacctgtggtgccagatggtatgagagtacagggtgtgagggcaggagcctacttcttggttgactcttagacttccatggactcatggaaaagagaaggggtgcaggctgggcacaatagctcatacctgtaatcccagcactctgggaggccgaggtgggcagatcacttgaggtcaggagtttgagactagcctagccaacatggtgaaaccccgtctctactaaaaatacaaaaattagctgggcgtggtggtgggtgcctgtaatctcagctactcgggaggctgaggcaagagaatcgcttgaacctgggaggcggaggttgcagtgagctgaagtcattccactgcactccagcctgggcaacaagagcaagactctgtctcaaaaaaaaaaaaaatcagaatggtggttagtttggagtgaggtgggcaggaaagagggtgctacatattgactgcaagggaaacaagggagactcctgggttgaagctatcttgtctagatggtggttaaatgggtaaatataaatgtaaaagctcatcggtttgtttcctgctgatagccaattagttaattaatttaatttaaaaaaactaattggggccaggtacaccggctcattcctgtaatcccagcactttaggagactgaggcaggaggattgcttgagcccagatgttcaagaccagtctgggcaacatggtgaaaccctgtctctgcaaaaaatacaaaaattatctgggcatagtggtgcacgcctgtaatcctagctgctcaggctgaggcagaaggatcacttgagcccaggaggttgaagctgcagtgaaccattatcatgccactactccagcctgggcaacacagtgaaaccttgcttaaaaaaagaaaagaaaaggaaaaggagaaaaacatcaaactgcatacatttttaaaatgaaaaaaggaaacaaattactgacacatgcaatgacttggatgaatctcaaaggcattacgctgagtgaaaaaagttctcaaaagttacagactgtatgattccatttatgtgacacttttgaaaagataaaacgatagcaacagagactagatcaaaatagcaaaatagcagggagtttgtcgggggcaggaaagaggatgggactacaaaggggtagcccgagggagtgttttaggcagtggagctattctgtttcagtggtggtgattacatgatcgattgtggtgattacatgaatctttacacatgtgaaactcataggactgtccactgaaaaaaatcaattttactttatgttaatttttaaaataaaattatttttaattaagaagagaccttctagcccctcaatagcgcagaggagttcctgaaaggaggcgctaaggaactggctaccctggaaaaggcataccaccttccccgccttgccctgtaccaggcctggggatcttcctgggccctctgtggttctcactctccttccttgtcctcctgctgggccagagtgacccacacatcccctcctttagcatctaagtctcggggtctaggaagccagtgtgctttgctcactcctacgtccccggtccctgagacacaggtacgaggtggttgctcattgacagagtgaaggaatgttctagcaccaggcctgatccgtcttggcacactccacaggcttttctatgtttagcctcctttccagctgcccagaggacacgccatagctgggagacatcactgtcgaggtgtgggtcacaagcttacccctcccatgaggcagggttaccagctttcctatcgtttgaagaatttagcaatctgagtttattattgctgtcattctaattttgaaatacatttttattatacaagaaaatctgttcaattaaaaaaaaaacagttaaaaaaaaagggagatccggtcccacttcccagactcataactgttactagatccttctctatctatctagaaacatttatgtgaaggtaggcatgtatgtccacatatatgcaacagatatgattgccccacagctcctgggctacaagtaatgtcttgtttctttgtggactcactcaaatagactctgggtccagccctgcccaccactgactggaactccagtgtcagacagttttcaggctccctccctcaggtcatacaagatgcccagactgatgcagtactgatgaaacggaagagtctgttcctctggccacatggtcagcacttgccagctgcttgcccaggtcagtggggaccattatgagtcaggctgctggtggggtgtggtggctcacgcctgtaatcccagcactttgggaggccaaggtgggtggatcacctgaggacaggaactcctgacctaagtgatctgctctccttggcctcccaaagtgttgagattacaggcgtgagccactgcgcctggcctattctgacttctgttaccataaattggttttgtctggaaggtttctaacaattgtggtgcaagttttataacccacctggttttgtcttgggaattagaagtctctcaatgttttggagagagattctgatgcccctcaccagaagtcatgctctggggccagtgagcaaagatgagcttcttatcctttttcttcctgggttccagcaagccaagcctcacagcagtgtccaaaaagttggtagaaaaggcctaatttttttttttttttttcaggcagagtctggctctgtcgcccaggctggagtgcagtggcgcgatctcggttcactgcaagctccgcctcccgtgttcccgccattctcctgcctcagcctccctagtagctgggactacaggcgtctgccaccgcgcccggctaattttttttgtattttttagtagagacggggtttcactgtgttagccaggatggtctcgatctcctgatctcgtgatcctcccgccttggcctcccaaagtgctgggattacaggcgtgagacaccgtgctcggcctttttttttttttttttttgagacagagtcttggtctgttgccgaggctggagtgcagtggcaccatctcagctcactgcaacctctgcctcctgggttcaagtgattctccggcctcagtctcccaagtagctgggattacaggcacacaccacctcgccagctaattttttgtagttttagtagagatagggtttagccatgttggccaggctggtctcgaactcctggcctcaagtgatccgcccacctcagcctcctaaagtgctggtattacaggcatgagccactgtgcctggccaggcctagcatcttaaaaacccagtggaggggaaggtcacagtcctaggaatcaaaaggcatgggttcacttcctctctctgatatttgctgcatgttcttgaacaaactatgtaaacttcttgagcctcagctatttcatcagtaaagtgggaacagtaacatccactgtgattatcagacctatttttaaatacttgaggccctctttccttcaaagggtgtaagaaaattgaactttgccactccatttaactcctacccactaatccaggcgtggctacgtgacttactgaggccaattaaaatggtgccttctaggtggaagttttaaaagctagtgtatgcttttccacatttttttttctccttcaactatagtaattggtgatattccacatagtggctgctctgtcaacctgggtcctggagttaggacaatgacagctcagagcagagcctcggccaacccaccatggatatgtggcaggagagtcaatgaagctttgctgcataaaagccattgagatttgggggttgtttgttactgaagcataacctagcctgcttggttgatataccacattacacatttattactaagattatgtgaagtaaaatgtttggaacttcttggtacataataaagctgattttcttcctttcagactctccttttttctttctaagagtcatgaacccagggatacttttttttttgagacagaatcttgctctgttacccaggctggcgtgcagtggcgtgatcatagctcactgcaggcttcccctcctgatcttaagtaatcctctcccacctcagccttccgagtagctgggattgcagacataccctgccatacccagctgatttttttattttttgcagagacagggtcccactatgttgcccaggctggtcttgaactactgggctcaagtgatccccctgccttggcctgccagagtgctggattacaggcatgagccaccgcacctggcccccaggaatgttcttaccagcttctaaccctggctaaagggcaatagaacagagagccactcaaccacaaaagaaaaaggaagaagaaaggatataaagcaacaaaggtacagaaatgtaatacagaggaaaggaaaagaaacaaagtgataaagaaggcgagacaaagtataaaaacagggaagaaagaggtacagagggccaggcagggtggctcacgcctataatcccagcaatttgggaggcccagtcagatggatcacctgaggtcaggagtgcaagaccagcctggccaacatgctgaaaccccgtctctactaaaaatacaaaaattagttggccttagtggtgcaggcctgtaatcccagctacttgggtggctgaggcatgaggatcgcttggaactgggaagcagaggttgcagtgaggtgagagtgcgccactgcactccagcctgggccacagagtgagattctgtctcaaaaaataaaaaataaataaataaataaaaataaaaaaaaacaaaacaaaacaaaacaaaaaaacaggtataagggatgtctgaggcatagacagaggtgattctcagaaaaacaaaagaaaacaaaaggaaaaaccactgaggcaaagggaaactgtatttcttggaattgttggccccaaccccaggcaaacaacattttcccttaagacaaatgaacaaacaaactttggcaaatagagcttctgggtgtgcatttatcagtctttccactcggtttactgggcgcctactctgtgcctgacattgtgcttgggctggctttacaggggcaaccaagacctagtgctggcctctgccttcaaggagcccctagactggtgtgaaacagacacaagaacagttgggattcaatctggcttgtgcaatgatggaagtgccaggaggaattaagggaagagaaggggaagcaggccctgcaaaggggctttctggaaaatttgagcctgagtgtcttgaaggataactaggagttagcaatggcaaggtttctgaggagaaagagggaccacgatgggcagaggggcaataggagccaggtagctgcaggtagtctggggttgctggacccttgatgagaggctgtgggcagcaggagatgaggctggagagggattcagggtcctatcacagagactcaaatgttaagatgttggtctttaagtggatgggctcggggatatttgggctgttatgtggggaagtgacatggtcagatttttagctaaattgctctgcctgccatgtggacagtgtgttggggcagcatttctttgcatgaggtctctggggattgggctgaatacccacccagcccagggcctgcaagtggacaggatggcctctggaagaatcatcctagccgctgcttcatcagtgtctcaggggagtgatggctatctgcggtggtggcgttggggtaaaagaatttaccagccgggcgtagtggctcacgcccataatcccagcactttgggaggccgaggcgggtggatcacctaaggtcaggagtttgagaccagcctggccaacatggtaaaactctgtctctactaaaaatacaaaagttagccgggcgcggtggtgggtgcttgtaatctaatctcagctactcgagaggctgaggcaggagaattgcttgaacctgggaggcggagcttgcagtgagccgagattgcgccacggcactccagcctgggtgacagagtgagactccatctcaaaaaaagaaaaaaaaaatttaccaaggcagttgtaggtagagaaaggcagatttattacagtaattaggaaaacgccagggttgcagggaggtaacttgcatttttttgtcagctgggatgtctggaaagttgaagtgtttgatggtaagcaggaagtttgtgagttctgctatctgagtaggagctggggcttgtaaagcagccaacagttgagcctgccttttggctccgtgtttgtttttttcttagtcttgtcctccttattttgttcttggttataaagactgaggaggctaatttggtaattttctgcataggggtcatgctgtgttatacaagaaaattagatgtttctttttgagagtttggcggtagaatttgtcacaattctttacagcctagaggcaagtttgcaggaacggacggggtttgctccatggtgggactggaaaacatgccgctctggggcaatgtcaatcagggacatgaactgcacttttctgcggggggcatctcactgagatgaacagagggttccacttacatccacagagggacttggatgcactttccaaagggggcatcccaccaattagaaaagacctcctggccgctcaggggcctcatgctggatggccagtccaggcactcacttatgctgggtgatcagcccaggcacgaggaaaaagaagggtaaaggaagatctctacctggtcttggcccaggaggtggggtgggtaagagaagactcaccgttctgaggctgtctgacatcacctgatttagcaaggcccaggacaggatggctggctgactccataggtgaatttagagtgagaaagagagcgtctgagttacctaaaacgtgtgtgagtttgccccgaacaagcttctgctgtcaattgtgtcacatatagggatgagggacttgcaattagagaagatgggcaacagcctttctcccttccaggcagggcagctagccctgttcactctgggccttcaggcaacactggagagtggccctggccagttacctttgattgccagagagatactagaagctggttgctgaaagactgaaaaaagaaaaaaagtcaggtcactcacccaaaccaggcaatgatgatcagatgcttccacatggacagacacctttcagtctcactggagtgtagctctggccagagacctgcaattgtctttgtgcttagatgctgtccttcgagggtcccgagttgggaaagggaaaggagagagagtccctgtatggagagggagagttccctgtatgggccaccaaaatgtttcaggggagcaacggctatctgggctggcggctcaggggtaagagaatttaccaagacagttgtaggtagagaaaggcaaatttattagagaaagtagaaaaacaggagagcaatgggcaggagagcaacgggcaggccagcagaagaggagctgactgcaaggaaacaaaggcttgttggggattttgtaggatggctcttaggctgtagagtgttatgtgcagtactgattatgccagggtagcagggaggtaacttgcatttttttttttttttttttgtcagccagggtgtttgataaattgaggtgtttgatggtaagcagaagtttttgagttatgtacattatctgagcaggagggccatatgtcttgggccatttgcctcatttctttgctttcccctggtcccaccagcctgatttgttttttaattattactcaacagtgagtgctgtcacatgctgggcattgtgctatgtgctctatgtggagtaactcacttactgtccccctatcccccaagaccatcctgtgacatgggcattcttttttttttgagatggagtcttgctctgtcaccaggctggagtgcagaggtgtgatcttggctcactgcaacctccgccttacgggttcaagcgattcttctgcctcagcctcctgagtagctgggactacaggtgcgtgccaccacgcccaattaatttttgtgtttttagtagagacgggttttcaccacgttggccaggatggtctcaatctcttgacctggtgatccacctacctcagcctcccaaagtcctgggattacaggcgtgagccaccacacccgaccagacatgggcattcttatcctcattttgactgagtaactgggcacagagaggctgttatgcatcccaattgcagagctaggcagcggcaagcccactttcacacagcgccagctgcctggctctgggatcagcctgtagtcactctccattctgcccctcaggatctgcttctcccaggaagcctctcacagaggcagaattttgcattggcatcctgcttcaagcttatgaaatcttctatacagatgacctcattccagccttgcaataatagcttctgtgaggtattattattcatagctttaaaaaagccagttgaaggaaatccagtgatttgtcaaaggtcagaagttaggtggccgctctcctgctcagacttacgttttctgacttggagtacagtgctccgctctcacgttatctgtcagctgacgctgcagccagcctcatactcaacacatcacatggttcgaaggctaggccactttccactactattgagctgcctcctctctatgaaaatgcttttctggattgagggagacagtcatagagaaatgtgttgttggcatcgatttcctatggttgggcaatggcttccgccatctggaccaggtgacgtcagctatctggatttctgccagcattccccggcccaggaaacagacttccggctgtctgggctctgagccatcttcggcctcctgggtgagtgggtcttgcaattcgcaaagtgaggaactgaaaagtcagctctcagggaagatttcactgtataaagtcaggtaaaaatggggaagaggcatactgggtcagagagacagggagcccttctatctgagtctggggcctttctcagatgagaggggaggatctagtgatcagacagggaaattgaagatctttgtgactaagactcaagtcaattgggggtagatgaggagtaaggtaagcaaagctaaagaaatctggggaaagatacacataaagatacaaacacagaaggtcaaatactggccaaggatagaatgttgatcccaaaactcatgcacttttctgtggacactgagacttgaacaaatcaataacttgagaatgtaagcagccctctgccatgttatactttgttgagttatataacagttgggggaaaacctaaacaatggtacatgtgttaaggtagacagttaaattgtccctccaccactccctgtctcattcccaaccctgctctccaggccaggctcataaaagttgttactcattttagccattccttcagccaatattcatcttattcattcttacaatcaccctgtgaggtaagagctatcattatgcctttattttgaaaattgtagtaaaatagacatagaatttagcattttaactgtttgtaaacatacagttcagtggcattaggtacatccacattattgtgcaaccatcaccatcagccacattcagaactttttcatcttcccccactgaaactccacccagcaaacaataccttcacattccccactttccttagccctggcaaccaccattctactttctgtagaatgtaaccactttagatgccttttattttattttttatttatttgtttttttgagacggagtctttctctgtcaccaagccagagtgctgtggcacgatcctggctcactgcaacctctgcctcctgggttctagtgattctcctgccccagcttcccgagtagctgggattacaggaacacgccaccacgcccagctaatttttgtatttttagtagagacggggtttcaccatgttggccaggatgtaggtgccttttataagtggaataataggctgggcgcgatggctcacacgtgtaatcccagcactttgggagaccaagtctgatggatcacttgaggtcaggagttcgagaccagcctgtccaacatggcaaaaccccatctctactaaaaatacaaaaattagctgggcatgctgccgtgtgcctgtaatcccagctacttgggagactgaggcacaagaattgcctgaacgcgggaggcagaggttgcagtgagctgagctcacgctactgcactccagcaagattctgtcttaaaaaaagtggaatcggccaggcatggtggctcacgagtgtaatcccagcactttgggaggccgaagtgggcggatcacctgaggtcaggaattcaagaccagcctggccaacattgcgaaaccccgtctctacttaaaatacaaaaattagctgggcgtggtggtgggcgcctgtaatcccagctacttgagaagctgaggcagaagaatcgcttgaacccaggaggcgagtttgtggtgagccgagatcgctccagcctgggtgacagagcaaaactctgtctaaaaaaaaaaaaaaaggtggaatcataaaatatttttcctcttgtgattggcttttttttttttttgagatggacttttgttcttgttgcccaggctggagtgcaatggcacaatcttggctcaccgcaacctttgcctcccaggttcaagctattctcctgcctcagcctcccgagtagctgggattataggcatgcaccaacacactgggctaattttttgtatttttggtagagacagggtttctccatgttggtcaggctggtctcaaactcctgacctcaggtgatccacccgcctcagcctcccaaagtgctaggattacaggcatgaggcaccacgcccgatcatgattggcttttatttcacttagcaggatgtcttcaaggtttatccacattgtagtgcatatcagaattttctttttaaaaaaatattccattatatgtatatatgtattatacaattttttttttttttttgggtggagacagagtctccttctgttgcccaggctggaatgcagtggtgcgatctcagcccactgcaacctcagtctccctggctcaagtcaacctctcaccaccttagtcccctgagtagctgggactacaggtatgcaccaccatgcctggctaatttttgtgtttttggtagagatgaggtctcatcaagttgcccaggctggtctcgaactcctaggttcaagcaatcctcccacctcagcctcccaaagtgcttggattacaggtgtgagctaccaggcctggccacattttgcttattcattcatctattgatggacacttggatggcttccaccttttggctattgtgaatgatgctgctgtgaatgtgggtatacaatttaataacatttatattgagatacaattcacatactatataattcaccttgtaagaggtggaggttgcagtgtggtgagccgagatcatgctcctgcactccagcctggggggtacaaagtgagacgccatctcaaaaaaaaaaaaaatccaccctttaaaaatgtacaatgaaatgtgttttttttttttttttttttgagacagagtctcactctattgcccaggttggagtgcagtggctcagtcttggctcactgctacctctgccgccctggttcaagcgacactcctgctcagaccagagtagctaggattataggctcctgccaccgtgcccggctaatttttgtatttttagtagagatggggtttcaccatcttggccaggctggtcttgaactcctgaccacgtgatccacccacctcggcctcccaaagtgctgggattacaggcgtgagccgccgcacccggcagaaatggtttttagtatattcacagagttgtgcaaccatcaccacaattttagaacattttcatcacactcaaagacgtcccatgctcattagcagtcatttccggttttacccccaatctctccccttcccagccttaagcaaccactaatctactttttgtctctatagatttgcctacactggacatttcatataaacaatcatacaatatgtggcattttatgtctggcttctttcacttagcatagtgttttcagtgttgtagcatgaatcagtactttctttttattgttgaatactatttcattgtatggatataccatattttatttatacattcatcagttgatggacatttatactgtttccaaattttagctattatgaataatgctagtgtgaacattcatgtataagattttgtgtggacatccattttctctttggtatacacttaggagtggaatttcgaggtcattaactttatgttccacttttgagaactgctttccaatgttgctgagccatttgacattctcaccagcagtgtatgaaggttccagtttctccagtctgtctttttgattctagccatcttagtgggtatgaagtggtatttcatggtggtttagatttgcattttcttggtggttaatgatgttgaatatctttttttttttttttttgagatggagtctcgctctgtcgcccaggctggaatgcagtggcacgatctcagctcactgcaacttctgcctcctgggttcaagcgattctcctgcctcagtttcctgagtagctgggactacaggtgtgcaccaccactcctggctatttttttatatttttactagagatagggtttcagcatgttggccaggctggtctcaaactcctgacctcaagtgatccgcccacctcggcctcccaaagtgctgagtcaccgcgcctggcctgaacgtcttctcatgtgcttattggtcatttgtatacctttggagaaatgtttattcagatcctttgcgtattttttaattgagttgtctttttattattgagttgtaagagtttgttataaattctaaatataagtctcttaactgatacataatttacaaatattttatcccattctatgggtcttttttacctgtttctttctttctttcttttcttttttttttttttttttaatagcgacagggtctcgctttgttgcctaggctgatctcgaactcttgggctcaagcaatcctcctggcttggcctcccaaagtgcttgggctacaggcatgggccaccatgcccagcctattttcttaatgtcctttgaagcacaaaagttttaaattttgaagtccaatttatctatttttttttcctgcttgtgcactgtgtcatagctaagaaaccactgcctagtctgtggtcacaaagatttacatctgtcttttcttctaagaatttaatagttttatctcttccatgtaggtctttgatctattttgaataaatttttgtctatggtatgaggtaagggtccaacttcattcttttgcatgtgcatatccagtggtctcagcattagtatgccttgttacggaggaataaattttcagcttcgtaagaaaaggaccatgggcctggcaaggttgcttatgcctgtaatcccagcactttgggaggccaaggtgggagcatcacttgagccctggagttcgagaccagcctgggcattagagtgagaccccgtctctacttaaaaaagaaaaggaaagaaaagaaaaaggactgtgcccggttttgctcaccattatcttcccaggattctcttagccccatgcaagacacatgctacatgctcaataaatatagcctgagtgagtgaacatatgagtgactgagactcagtgtggttaaataacttgcataggtcagtcagttggaaggtggccagatatggctcaaacccagatcttctcatctaattcttttttttttttttgagatggagtcttgtcgtcaggctggagtgcagtggcatgatctcggctcactgcaacctccacctcccaggttgaagcgattctcctgcctcagcctcctgagtagctgggactacaggcgcgcaccaccacgcccagctaacttttgtgtttttagtagagacagggtttcaccatgttggccaggatggtctcgatatcttgacctcatgatccgcctgcctcggcctcccaaagcgttgggattacaggcatgagccactgcacctggccttctcatctaattctaattaagagtttttgtataatacttcaaagtttctgaaaatttcctgagttaccaaaagctctttgtcacaagaaaccatatttcttaggctgggggtggtgctcacgcctgtaatcctaacactttgggaggctgaggtgggtggaatacctgaggtcaggagttcgagaccagcctggccacatggtgaaaccctgtctctactaaaagtacaaaaattagccgggcgtggtggcaagcacctgtaatcccagctactggggaggctgaggcagggaatcgcttgaacccgggggcagaggttgcagtgagccgagatcatgccacttcactccagcctgggcaaaagagtgagactccgtctcaaaaaaataaaataaaataaaataaaataaaataaaaataaaaataaaaataaaaaataaaaagaaacggtatttctccaaagtttcatttgctgtctctgctgtatgatcccaatcatttcattgtttgtgagcagcaaaactcaaatctagggagcctcatgtcccttctgcttctgactcctccctcactcgagccacagagtcaaagattccacttccttctagggtagttttatagttggaaagttcttctaaatctcggaccacaacctcctgctgcaaaattgtgccataaatccccatgagtgttcagtgtaaccattgactataggacctggtttgatgtgggaggcatttggggcttgcggaaagctttatgtgctctgccccgtacaaagggcagccttggggcagccgatgcccttgctctggccctgacatgctgctccctttttgaagtgtggtttctgattctgggtgcagcttgccatatcagaggagaatgaagctaggtggcatgaaccccagaaaattttggtgaactcacctcttggaatgaggacaaaggagagtcttgaagcagaaaagagctgtgctccttgaaggggtccaaagttaaagctcacactggggtggattgggtagacttacctgtcccctctttgacagtgatgcatttgagcttctcctattgggtcctttggaaaagaattctttgaactactagaaaattaggacagggtgggggcaaaagaaaacgtatattgagagcttgctccatgtatttgttaggcatttaatctaggtatctaattttatcttcaaagtaatcctgtgggttggttttatcaatcctattttgcagagttggatgctgaaacttgcagtcacacaaggacttgaacctagagcttttctaaagcccgtactctttccagtaccctgagccaggggagccagcgggcagaaatgacgtgtgaggtaccctctctctcttcacttccatgtgatctgttactcattttgtcaagacatcctgggtcccaggtaagctccagtgattcccctgaaccagtggtgtgctggagccagctcagacctgctagtgagagtgttaaatattcaggaaatttgcaagctggttgttaaactgtcagtggttggaaattggtcatgggaggaagtatctacaccacggaataactacacacggataactgctacaaatcagggatccccatctcccccacaagctggtttgctaacacatcactgtctttcttttttttttttttttttttgagacagagtctcactctgtcgctcaggctggaatgctgtggcgtgatcttggctcagtgcagcctctgcctcccaggtttaagcaattctcctgcccaagtagctgggattacaggcacgtgccaccatgcctggcaattttcgtatttttagtagagacagggtttcgcaatgttggccaggctagtcttgaactcctggcctcaagtgatccaccagactcggcctcccaaagtgctgggattacaggtgtgagtcaccgcgcccggcccagagcactaaccttggggtccagagtgagagctgaagagaacagggcctgcccccagcagtcacagagtttcagctgcagactgagggaagaccgatagtatctatgggaaagtgtgtgcacaaaagagacagaaaagaggctggagaatattgattattcacacatgaacaaagtaagtaccaatgttattaatcccagggattttgctgggaggagttctggcttgttattagggtccttttctttcagatcaagaaaagggagatctaattcatgaagaaactagaaaagtgccctggattggtgggagtgtggtgggggtggtgctgcacaacacagaagaggggaactttgactttgagcctgaggtcttgggatgaaaagcagtttgtggaccggattcctgaccctggggttacagtaggaatccctttgcctgacaggtggtgaccttcctctggcaaggtccccagactcctaaggcagaagcaatcctcccatctcagtctgccaagtagctgggactacaggtgctcaccaacacacctggctaatttttgtgtttttttggtagagatggggttattccaggctgggatctgtgaagagcagaacaactctaagccccagggcaaaaatctgcagagctgagtctcatgccactttggggcactccatctgaggcctggaatcagaggccttccgcagcttgtgtagatgctgccaaaaggctgagctcggtggcccatgcctgtaatcccagcactgtgggaggctgaggcaggcagattacttgaacctaggagtttgagaccagcctgggccacatggtgtacccccatctctacaaaaaatataaaaattagccaggtgtgttggtgagcacctgtagtaccaactacttgggaggctgaggtgggaggattgccccaggggtttgaggctgcagtgagccatgatcatgccactgtactccagcttgggcaacagaatgagaccccatctcaaaaacaaccaaaaagatgctgcaaagaaacagcagcctcctgtaacaaaataagtggtacatcttttgtgatgggagcatctccctggggagcgaagctggacgttgcagccctaccctgtccccagaggtttttctgtccctttatgtctatgaacaagtacagctgaggccatcagcactgcacacacctggaacagtcttgttaaaacaggacctccctaaaggccaagagctaaggaaagagaaagtgaaggactgagcagcaggtaaccagaatcagagtcattgaaggcaactgcaggagttgccccttcctggctccctcccatggcaactccctgagtctgagtagagaaggttagagacgcatggaggttcccacccctcctgtgaaaggctcccttctgagttccaggtccctatctgatgacccacctcacctatgcctgcctaatacctgaatggccatctctttcagagaccactcttattcccaggtgtgtgacctcctcctacagactacagtgggaaagacaccatctccaggtaaccccaacacagtgaggggtggagcggggatgtggtcattcgttccaggtattgttgattctcttgaggttcaatccagggctagagattgtgattaaagagatacccagattgggtatgcgtgtaaagggcaagagctatgagaccaatgtgacatttaggattaattagtcccttccacagggcaggctgccactcactggtacagctcctgggctgagcctggcagagctcattagcaaggcagacactggaatgtgtgtgcaatggagggaggcttaaactcagaggctgctggttcctattaagcagagagaggttagaacttagtggcacagaaactgatatcagctaaatatgggttagtcaccaaccctgcaccatcttccctaacctttgagaaagtcttttcctactgcttgttcacatccattcattcaacaaacaattatgaattttctcttaggtgccaggtgctacacaagatactggctatagcagcgaacaggacagcccgtctcatcctcatggaggtcacaggacaatgagaagaaagacttttttatttttatttttttgagacggagttttgctcttgttgccgaggctggagtgcagtggtgtgatctcgactcactgcaacctccgcctcccaagttcaagcaattatcctgcctcaggcctcttgagtagctgggattacaggcacctgccaccactcctggctaattttttgtatttttagtagagacaggggtttcatcatgttggccaggctggtctcgaactcctgacctcaggtgatccacccacctcggcctcccaaagtgcagggattacaggcatgagccatcgaacccggcccaagaagaaagacattgaacaagtaattacagggtattgggtgttatgaaagaaaagcatggtactgtataatgaggtcatctaatttagtctggggtgacaaggaatgcctactaaagaaggtatcgtttaagacatacctggggaatagcggtagtgaaaatagaagctccagaaatgcagggaccatggctgacatgtttaccatgccagtgtctggcatggaagaggcccaattcctttggttgaaaggatgaagtaatctagctgaataaagggtgtgtgcgtgcacgcaggtgtgtttgtagttaaccttcctttagctcagcttaggaaacagcttttgtaaaactgcgtaactagtagtaggtgagagaggaatacgaatgatatacacaccattaaagacaacttactaacagcatgagtccgacatagattccttcctacttgggtttgaaccctgagcccaccacttactagctgtgagaaagtgaatgagttgcctccctttcctgtgcctctgtttcttgtaaattctatttccaagcatcatgaggataaaagacaatgtatatacgttgtttggcatattacagtcaatgcttggtaactactattgttattttttaaaaaattattattattattttttgagacggactctcgctctgtcgcccaggctggagtgcagtggcgctatcttggctcactgcaagctctgcctcttgggttcacaccattctcctgcctcggcctcctgagcagctgggactacaggcgcccgcaaccacgcccggctaattttttgtatttttagtagagacggggtttcactgtgttagccaggatggtctcgatctcctaacctcgtgatccgcctgcctcggcctcccaaagtgctgggattacaggcgcgagccaccgtgcccggccccactattgttatttatgtacaccaaatttatatccaaagggactttgatagttacaagaaaagacatataagtccagatatcattgaacaagagtaaaataataaatcaagtaggaatggaggggaggatatgcatgcagcactagataatatctatacagagagaggatgaggtcttggaagatgagtctgaagactttcctgttggagaggggctctatgctcggcatgctgactgcttttacaaccccacccccacatctcatcttaaccacaagacagtcttgttctggggagttcagagcctttattttttatttatttatttattttttgagatggagtctcactctgtcaccctggctgaagtgcaatggcatgatctcagctcactacaacctttgcctcccaggttcaagcgattctcctgcctcagcctcctgagtaactgggattacaggcacgtgccaccaagcccagctaatttttgtatttttagtagagatggggtttcaccatgttggccaggctggtctcgaactcctgacctcgtgagctgtccacctcggcctcccaaagtgctgggattacaggcgtgagccactgcgcccggccccagagtctttatttattatttagagagggtctcactctgtcacccaggctgtagtgtagtggtgcgatcttggctcactgcagccttaacctcccaggctcaagcaatcctctcacttcagcctcctgagtaattggggccacaggctcacaccaccatgcctggctaattttttaaaaaaatttttatagagacaaggtcttgccatgttgcccaggctggtcttgaactcttgggctcaagtgatcctcctgcctcagcctcccaaagtgctgggattacagacatcagccaccgtgcccagcccagaatctttcaacccccaaaatccattggtgtggggttagatgagggatcctaaaaggagagggaggctgctgtgcagtgatcccaccggcctgcttgcaggaaggagagccgaccctttcttgacctctaccaaagacactagagagctttgtaaatcttccaattagatgatacataaatacttccccaggtcttctaggcctgattcaataatatttacttcgagaggctgctgcttcctgtttgtattctcttaccacaagttatctgctgttcctactttcacttaagctttgtatcgtactctgtgagaaatgtttgagctggctggacacatttcctgaaatcatttctctagtcttttacgaaatgtctgcatttatgctggaatcatagagctgaactatcattgagataaaaattccagtctttaccccaatttacaattcctaaaaactgtcactttcttagatctcttcacattttcattacttctttttttttttgttttttgttttttgttttttgagactgagttttgctcttgttgcccaggctggagtgtaatggtgcgatctcggctcactgcaacctccgcctcccagattcaagtgattcttcctgcctcagtctcctgagtagctgggattacaggcgcccgccaccatgcccggctaatttttgtatttttagtagagacagggtttcaccatatttggcaggctggtctcaaactcctgaccttggcctcccaaagtactgggattacaggcgtaagccaccacacctggccagacattttcattgcttctattacctgtgtaagcaagtggctttattgggaggcgattttcacaaagaaacaaggttttttaaaaaaggtgtttcccgtaggtttctgcctgtgagaccacctgctgagaaatgcagagccgctttgggaagctgggtagtcagctctcatccatactcactcaaccatgcccagctgggcagtgccacttgtgtctgagcctcagcaaaactgcatgtccctaaatgtcaggggtcttcacagacaagtgaagcaaccagaaatactgaattttcagatggacatgtttatcgtactgaatctccatagccaggaggcacagacaactaataaagccctgtgccccattattgcttcattgattcactgaaataatgctgggtatgattgtggctacagagttaagccccattgttaattatatggtttggtgagggaaagagttttttttgtttttgttttggctagactaatgtaaacacagttcaaatgttgctccttcactggggacagaaaaatccatatgtggctcacgcctgtaatcctagcactttggaaggccaaggcaggcagattgcttgagtccaggagtttgagactggcctgggcaagatgacaaaaccctgtctctactaaaaataaaaaacaaaaaattaatttaatttaaaaaactgaggtgagaggatcacctgagcttggggatgtcaaggctgccatgagccatgtttgtgccactgcactccaccatggatgacagagtaagaccccatcttaaaaaaaaaatccacgtaatatagttcacatctttgcttcccatgtaaattcctcttttttgtgtgtcactatcagtatgtaattattgaaacttcaaggtatgactcttgttaggaaatgatagagaaaaaacaattgctctataatcaccccttacattgtgacttcttgcaaataaatacaccccactttcagcctcactcatttattataaaattgtaagaggtggaacaagcctttgtttagagatgtgattcatgtgttgcttgctggagtttctgaaaacaaacaaacaaacaaaaaaacccaagatagcagatggccagatgagccactgggaatggagcaatggctggtcatggcttctgtcaaacacaaagctctgactggagaagcttggaatcttctggatgtcttttgcaaagatgacaaattcttttagataggctgctgcttgaaggtaagatggaagaagctttgttcattgtattatggaggtctttgacccccacctcctcccaccccatgaactcagaccttccacattagacctgggctgtccctcagcatctttgctgcacattgcatgaaacttttcagttatttcatataacttccaggtgtttgaaatacgaaatgcgtaagagacatgttcctgagatgtcggagtgaggtttcctttgagagaaggaagtgagggttgttgcctacagattgttgagggtaataatgggatgaggcataaaaaggacctagcctagcagcaggcatgtagtaagagctcagtaagtattacatttgtttaattagtgtctgcctaccaggttcaacccttggcttcatatgtccagcaacacttcctaacttgcccattcttgcccttccttgggtcctgctgtttattctgttctctgaaataaggagttcctcccagtattgtagctgataaggttagagctcaaagcagttagggacctcaagaggtatcctagtctggttcctggtctagataaaatattatcccttattgcagaagtagcaactgaatctaggaaaggttgagtgatttgagagactatagtaggcataggtggggatattggctaattcttagttcttctgacttaggagcatctaggtcgtggacacagagtgtcccttttttcaaagtggagtcccacagtgcatcatttacagttattctagctgctggtggtatttggaggagtatcctaaacacttctctttccaaatcacaggcccagttgggatcaggaacatcaactcatatcacatgagcagaacttgttcatttggggacatccccaataatgccaaaatctatgctccagatgagtaagagtatgaattggaaccactttcagggaacctcttgtctgcacctcattctgtttttatttatttatttatttatttatttatttattatttttgagatagagtctcactctgttgcccaggctggagtgcaatggtgctatctcagctcactgcaacttctgccttcctggttctagtgattttcctgcctcagcctcccaagtagctgggactacaggcacgtgccaccacgcctggctagtttttgtatttttagtagagacggagttttaccatgttgaccaggctggtcttgaactcctgacctcaagtgatctacccaccttggcctcccaaagtgctgggattataggcgtgaaataccacgccccgcctgcacatcattctgggtggctgaatcctccactctcctggttctctcctctgtgctggtaggaggggaggctgggagagaatgggagaggtggtcatgatcagtaaagagacaattggagggagatggtccaaccctgtggttctggactctgaagtggtctttactgaaaacagcagattcctaggctcagaacagtggcaaaatagcttggaatttaggggtctctgatttttttcagattctcccaagctggagtgcagtggtgtgatctcagctcactgcaacctctgcctcccgggctcaagtgatcctcccacctcagcctcctgagtagctgggactacaggtgcatgccaccacacctagctaatttttgtagttttggtagagatcttcctgtcttgcccaagctggtcttgacctcctgggatcaagcaatctgcctgcctcagcctcccaaaatgctgggattgcaggtgtgagccaccgtaccctgcctcatatattttgtttcgtaataagtttactttaaatcaagatcgaaggccaggcacggtggctcacacctataatcccaaaagtgtgatttcagaatacaaaatttgggattataatttgtaatcccaaaagtgggatttgggcatgggccaccacacccggctgattttttttttttttttttttttgatagagacaggttttataccacattgcccaggctggtttcgaactccttgattgaagcgatctacctgccttggtctgacaaagtgctgagattacagatgtgccttgcctgacctgattattgttttttatatctcctttaatgtacaggttagctctctcattttttccccctcttgaaataggtttgttggagaaaatggattttttttgtactgtacagctttccagtctgggttttgctgattctaccctggaggtgctatgtaagacactcctctgatcgctgacttcttgtgaattgctaatttcatctagaggtctgatcagattgaagttcagtgtttgtttttgcagggccccttctcagggaatgttgtgaacattcacccagaggtacatgctgtctgcttgtgtccgtctcttttggtgatgttctaagtcattcgtgatcatcgactaatccattatttcattaggagttgcaaaatagtaatattggaattctattatttctttcttcatttatgtatttattcttttttctcccccacacccactctcctgccctgctcgctcctttcttcagttattaggtagactgcttgtgtaagagaaattgcttcatcaaccatggggttcagttatggtttctataggaaaggcagaataaaggatttctctttattaccagttttcaagttgttgagttggttacgtagagtccttcacaagtgaccaattatttaagataccattatgaaatcatggattgaaacatatttgatgtacttcagttcactatagtccattatagtgattagtcttatgaatgctcaaattgtcccgtctttggcaagtgggagtcttttcacctctttctgacacagtccaaagagactttgatagctttttgagtttctgatttgaccagatatcgaagcacatcttgtacatttccgttcccagtctgagagccaagcatttctttaagaagatctgatttcagttgaagggaaatgatagactgccagagatgcttgttgctgctggattggttcttgtttctagggccttttagtgggaagaaaatataaacatattttaaaaataaactcattgtctgtttatactaatactttctttatttttttaaaaatttttttaccagctctaggatcaaggaaaaagatactttccattcaaatagaggctctcagtgtttttatataacttcacatacttgcatctgtttttttctcccaaccaaatattctagtttccaaatccaccaacgtttgctttatccctcaatacttatacacagtcttaaaataacaacatcaatattatcgccattaatatgataatgcttttccatgaaagggccatacatgcaaagtggcccccaaaggtcaaaggagctgagaaaccaaagaacaaggtaggcaagtccagtttgttgctaaagcgtgtttcactggggaacttacagacggaagcctgctcttgggcagctgcaagacaggtggatctcacactgttatctcagacccaaggcttatttatataccatagggaaagagtatatgtgcttagtgcaagacaaaggcaactgtccagaacaggctagaatgctatgtgcgtcacagcctataatttgtgtgataacatcaaagttgatatattcttacactagggacagtaaataaagtaggaatcaggaggcgttcctgggactggggctaatcagatgacgacatggtggattagcatccaagatggggccacttttgtctccacaataaaactattctttcagttcctttttttttgtccttagggtatatctcactaggaatatacaatcaaattgcagtggtctaaagttgtttgagacagtttttctctctgtaattgtatcactaactcactgtgcggatagtcttttatttttgcttttgatttttagaaatttaaatatatacatgtatatattcttagatatagagtagcatccagatttccccacttctcttttttttaaatgaacattgggataaaattgacatacagtttgacctttctttacttaacaataggtgctgtcaatcagcccatggcagtatgtagagatatttattctttttttaatgctccatagtacttcatatttaatttagtcagtcccttgttgttagacatttgggttatttccagtatttatttatttatttatttttaaaatttgaaatagagatggagtttcaccatgttgctcaggctggccttgaactcctgggcttaagcaaacagcccgccttggcctctcaaaaagtgctaggattacagccaccatgctcggcctatttctagtcttttgttatgacaaacagagctgcaataaatagcctacacaaatactttttcatatttttgccagtgatgttttggaatagtttcctagaaactgtattgctggaaatgcatatgtaattttgctagatacagccagtcaaattcccttccatagagattgcctcattttgcattcctagtcacaatgtactagaatgcctatttccctatagctttgccaactacatgtattgacaaatttttggattttttgccgatctgataggtataatatgctaccttaggatagttgttttgtttcgtttgttttgttttttgtttttgtttttgttttgttttttgtttttttgcgattctcctgcctcagcctcctgagtagctgggactacaagtgagcgccaccatgcttgactaatttttgcatttttagtagagacggggtttcaccatattggccaggctggtcttgaactcccgacctcatgatccacctcccttggcctcccaaagtgctgggattacaggcatgagccaccatgcccagccaaaatttatcactctttctcttcaattgcagctgaagatttagccatagttatgcaagtcttttccactcccaagctgtagaagaatttatttccctttaatattgtgtggtttttgttttttaaagtctcatatggaatttatctttttgtatgtatgctatgataagtggaccaacttttatcttttttcatatagagtctcaaatttgatattactagctcctctctcccactccctcccttcagcttgatttttcctggacattttattattttcttggccaaagctggacatggatcaaaataaacgtctgttcaactccctgtgtttggttccattttgctgcctgtttttctttcctggattctttgtgatttcagcacagtgtttttccagccattcaaggagttatgacctttagggcttgaggaagagtgcattaaaggcctgtccagagaatgattcaagctggagtggatcctgtagacgtccaggagggcccagctctacttgggccagggggttggagagctgcttctcaggagcaggatagccactcacgcgtgtgaagcactcaggagcccagttttttgtgtttttgttttttccttgagacggagtcttactgtgtcgcctgggctggagtgcagtggtgtgatctcggctcactgcaacctctgtctcttgggttcaagtgattctcctgcctcagcctcctgagtagctgggattacaggcgcccgccaccacacccagctaatttttatttttagtagagacggggtttcaccatgttggccaggctggtctcgaactcttgacctcaggtgatctgtccagcagcctcccaacgtgttgggattacaggcgtgaaccacggcgcctgtcctggagcccagtttttgttgataacccatgtttcctgtttccacccctcccctgctcttgatttccattaggaatttctacctttctaactggaaaagactggggtcagggggtggagaagtgggcagaggaagggaggagtggaatacagaaattgaaacctgtcttactctgctcatgtaactcttagcgcagatccatatcattaatgccaactaccatttagtggttatttcctaccaccacgcatcagatactgcgctaagtactttatacagaataaatcatttcatcttgacctgttagttggctagggtggttacttccagaaggaaaaagaggcccagagataagttcacacaattggtaagtagtgggatttgggtctgtgtgacatcagattccaggctcaaaacgtctaagtttgtggcctccgcaaaaaaggctcataacagtctgtatttctgtttgcttttccatctaaagactaactttactccacttcactgcccagatctgctgagctcagatgtgagcagtgtgcttggctgtgactgcaggcatcatgctaggctgtagggacccgtggctggagaggggctccgtcttgccctccgtctgttctgttgccagcacagtgcttggcacacgtgggctctcatcacgtatctgttggataattagatgaaaaaggaggaggaagaggaacgtgtgctggagataaagcggcaggagtggaggaggcgcaggggaagagaacagatttgggaaaaaccagtgggacatgaggatgctgggcaggtgggtagaaggttgccatgtgttcagaagcacagaaaaagggtgacttccaggtcaaaagtgatttcaggatgggtgtgatggctcatgcctgtaatcccagcactttgggaagctgccggacggatcacctgaggccaggagttacagacttgcctggccaatatggtaaaaccctgtctctactgaaaatacaaaaattagcaggtgtggtggcaggcacctgtaatcccagctactcgggagggctgaggcagaagaatcgcttgaacccagcaggtgaaggttgcagtgagccaagattgcgccactgcactccagcctaggcggcagagtaagactgtctcaaaaaaaaaaaaaaaaaaaaaaaaaaaatatatatatatatatatataaacacacacacacatatatatacacacacatatatatacacatgtatacacacacatatatatatacacacacacatatataaagtgatttcagttttttcacaacttgatcactgagcaagtgacttagactgtggtcattttctgttaactcttatctgatccaactagaaagcaaagcaaaacaaaaacctgactgccttctacagacaagccaatgtgaaggtattcagctcacacaggttgcaaaagacagagaaacacccaagttacctcaggggatggacattccctaaggatacacaggtgagtaaggaaaataggaaatggcttctgtaggtctcaagaactagagcaccattcaggatgcgatggccacacacagtgtggcctggcagagaggaggaaactgctctccatcatcaagaatacagctctaggccgggtgtggttgctcacgcctgtaattccagtactttgggaggctgaggagggtggatcacctgaggtcaggagttcgggactagcctggtcaaaatggtgaaacctcgtctctactaaaaataaaaataaaaaattatccgggcgtagtggcgcatgcctatagacccagctactgaggaggctgaggcaggagaattgcttgaacccaggaggcggaggttgcagtgagctgaggttgtgccattgcacttcagcctgggtgacaagagcaaaactctgcctcaaaaataaagataaaaataaaagccgggcgctgtggctaacacctgtaatcctagcactttgggaggccggggtggacagatcacgaggtcaagagatcgagactatcctggccaacatggtgaaaccctgtctctactaaaaatacaaaaattagctgggcatggcagcgcgtgcctgtagtcccagctactcaggaggctgatgcaggagaatcgcttgaacccgggaggcggaggttgcagtaagccgagatcatgccactgcactctagcctggcaacagagcaagactccatctcaaaacaaaataataataataataaattaaaaaagaaaatacagaaatttggctgggtgcagtggctcatgcctgtaatccctgcactttgggaggccgaggtgggcggatcacttgaggtcaggagttcgagaccagcctggtcaacatggtgaaaccctgtctgtattaaaaatataaaaaaaattagccaggcctggtggcaggtgcctgtaatcccagctactcaggaggctgaggcaggagaattgcttgaacctggaaggtggaggttgcagtgagctgagatcacgccactgcactccagcctgggcaacagagcaagattctatctcaaaataaataaataaataaataaataaaagaatacagctcttctagttcccagcccctctggggttcttgtgtgaaagaaaacattttaatgtgtcctttgattacatgaaattcaggcagagtctgatcaaagagatgccccattgctgagcacagtgaagagaaaggatgtcttccttgagcagagaggtggtgagaaatttccagaatagggcaccttgcatggagattattttaggaatgtcatctctggtatggaattctacttgtcccctgtagaattctgggctggcctacccatggttcaagcttccactgaagctgtgttgacccctagtccagtgtcagctggtaaaggaagggaagggctgaaggagctggacccccacagggaggtgttgaaagaaaggagaagcaagaggtgatattgaccagggaaatggcgccacttcctgagccagggccctggacttcctgtagttgtagaaaagtgcaggcctgagttatttaactatcaaagaaaaagtgatgctctgtgtgtgggaaaaacaacactcaatgtgctttttcctactctctcactcacaacaatcattaacacagaaggcttctgtgaccaaatgtgaggagttttgtctctacacatcaagcaagcaattaaatctgcagcagacaccagttgggtgtcttctaatccaattctgacactgtctacctagaggtagcatcagatcccacaggttgagggctcagtccccaagactgccccccgacccacactggtcacaggtttggccttgggaacttctgacccaccagcttcaagttgggattcccacaaccccctctttgggttcagttaaatgaacacttgcatttactggtttattacaaaggctagagatgaagagatgcacagggagaaggggcacagagcttccgagtcctccctgtgtgcaacaccttccaggaacctccatgtgttcagctctccagaagctctctgaaccccgtcctcttgggcatttatggagacttcactggacaggcatgactgaagcatggacaaccatgtcaaaatgtgattgaacaaaaaggatatgatctaatactaacagacagactggggaaacccagtgagtcctgtccagattcttcttggcctctctgtgcagcctttcttcctccaggatatggggcatcctttctgaaatgggagtcttatgacctatagtcagacaaggtaggtcaaagacagaaagatgggcaaagattcctgccttggagagataaaggagcagatgaaatgagggcaggagaaggtcagagagattccgtttattgagacctgcttctgaggcttaaagcacccaacattacaacaacagatggtaacaagggcaatgggaattataagccaggaaccatggactaaaacctatatataaattataatagcacagaatcccaaaggctggaaaacttgtgggcttccctttcaccatatagagccactgttctctccacagtgcctgcatattcctgtctctttctgttgaatgactttttttttgacacagtctcactctgttgcccaggctggagtgcagtggtgtgatcttggttcactgcaacctccacctcttgggttcaagagattctcctgcctcaatctcccaagtagctgggattataagctcctgccaccacgcccgtctaattttttgtatttttgtagagacagggtttcaccatgttggccagcctggttttgaactcctgacctcaagcgattcactcaccttggcctcccaaagtgttgggattacaggcgtgagccactgtgccgagcctgtagaatgactttaaatctccaccctctacctatagcagcccacttcctcctctctcttcaaatctcctttttctcactttcttctccatcttccttgcccttttagaagcagaaaagggcataccttttctgtgataccttttctctccatcatgaaagtctcggccacggtcctctaacaaaagacaggttaatgagagaaaaacatttattgaatccaagttttatgtgtcacggtggcctttagaatgaagacccacaggggccggatgtggcggctcatgcctgtaatcccagcagtttgggaggccgaggtgggcagatcacttgaggtcaggagttcaagaccagcctgtccaatatggtaagatcctgtctctactaaaaaaaaaaaaaatttagctgggtgtggtggcatgcacctgtagtcccagctactcatgaggctgaggcaggagaattgcttgaacacaggaggcagaggttgcagtgagctgagatcacactgccacactgcagcctgggcgacagagcaagactccgtctcaaaaaaaaaaaaaaaaaaaaaggaaaaagaaaagaattaagacccacagggaaaattctcattttttatgcttagagttgatgaagaatggatggtcatgtggaagcattatgggacagaaagggtatgatctcctggaggaatccagcaatgcctgtctgtccggattcttctcggcctctatgttgtagcatttctgccagccaggtatgggactggacccctctggaatgaggatcttattgtgtccagaaatggtgggttcttggtttcactgacttcaagaacgaagccacagaccctcgcggtgagtgttatagcccttaaggtggcgcttctggagtctgtcctttctgatgttcagatgtgttcggagtttcttccttctggtaggttcatggtcttgctggctcaggagtgaagctgcagatcttcgcagtaagtgttacaacttataaaagcagcatggacccaaaaaagtgaacagcagcaagacttattgcaaagagcaaaagaacaaaccttccacagtctggaaagggacccaagcgggttgccaatgctggttcgggcagcctgcttttattctcttatctggccccacccacatcctgctgattggtagagccgagtggcctgttttgtcagggtgctgattggtgcgtttacaatccttgcgctagatacaaaggttctccacgtccccatcagattagttagatacagagtttggacacacaggttctccaaggctccaccagagcaactagatacagagtgtggactggtgcactcacaagccttgagctaaacacagggtgctgattggtgtatttacaatccctgagctagacataaagactctccacatcctcaccagactcaggagcccagctggcttcacctagtggaccccacactggggctgcaggtggagctgcctgccagtcctgtgccgtgtgcttgcactcctcagcccttgggtggtcgatgggactgggcgtcgtggagcagggggtggtgctcgtcggggaggctcgggccgcacaggagccctttgagtgggtgggaggctcaggcatggcgggctgcaggtcccgagccctgccccgcgggaaggcagctaaggctcggtgagaaatcgagcgcaccgccggtgggctggcactgctgggcgacccagtacaccctctgcagccactggcccgggtgctaagtccctcattgcccggggccggcagggctggccggctgctctgagtgcggggccctccaagcccacgcccacccggaactcccgctggcgcccaagcgccgctcgcagccccggttcccgctcgcacctctccctccacacctccctgcaagctgagggagtgggctccagccttggccagcccagaaaggggttcccacagtgcagtggtgggctgaagggctcgtcaaatgccgccaaagtgggagcccaggtagaggaggtggcaagagcaagcgagggctctgaggactgccagcacgctgtcacctctcattatggcccaccattagacaagcgtaggtcagactatttatttatggtcatgtcttaggaagcagtagaagaaataattctagtttttatggctggctttggggaacaggggttctggtttctatgaccttagggaggactaattctggcttctgtggctcacttcaggagagaatgaggggcgagagacaggaggggcagaaggtcagagggatcttggtttcgaggctgcttctgagtcttcccaatgtcctttagttcaaagtattcagcatgccaaagtgccacactttggggtattgttttctgagccccagtgttttcttcctctcttcttcattctttctcaatctcttcttctttttttaattgagatggagtctcactctatcacccaggctggagtgcagtggcgtaatctccgctcactgcaacctccgccgccgtccgggttcaagtgattctcgtgcctcagcctcccaagtagctgggactacaggcacatgccaccatgcctggctttttttttctatttttagtagagatggggttttgccatgttggccaggctggtctcgaattcctgaccccaggtgatccgcctgccttggcctcacgcctgctgggattataggcgtgagccactgcatccggcccccaatctcttctcaatcgcattcatcaatatttttttttcttcttttttcatcccatcaccttgggtctctccttgtccgtctcccagtctttcttactgtcagctagccccttgcttttccccttcctttctttgcaacagcttcctatctcatttgttcagcataatagaagtgcaaaccgatggcctactgcctgagtatctgctctgcagaaacatataatttgctaagagaacgtttatccaaaatattgtcttcaggaactgggagcagtggctcatgcgtgtaactccagcactttgggaggccgagttgggaggattgcttgagcccaggagtttgggaccagcctgggcaacacagtaggaccccgtctttataaaaaatacaaaaattagccaggcatgatgctacacacctgtagtctgtagtcagcttctggggaggctgagctgggaggactgcttgagcccaggaggtcaaggctgtagaaaactttgattgtgctactgcactccagcttgggtgacagagcaagaccctggctccaaaaaaaaagaagaaaaaaagtcttcaatctcaacaattaagaattggagatttcacataaaaatccagattttatcctgggcaacatgggcaacacagtgagaccctgtctttacaaaaaataataaaaatcagctgggtgtggtggttcacacctacaatttaatttgagaggctgaggagggaggattgtttcagcccaggagttccaggctgcagtgttttatgatagtgccattgcactccagactggggtgagacccggtctctaaacagaaatcccagttttacagcttaaaaaaaaatcaggctatctggcatcatgcgacctacaccgattgctagtaacagttgatggagctgggcggtggctgccccactctgttcaccagtgcccactccatgcctcctggcctccttaacactgagggaaagtgccaattggcatttattatttagcttgagtagttattttttcctctagcagacaaattttagtttctacctatatctttactgaaaaaagggaaaacagagaacaagagccaggtctttcttatcccaagcctgctacctcatttgcattttctgctttgcccctgcaggtggctgaattttcaaccttcgctatagacaaaggctcaggtctcccttcccaatttctcaccgtgcctcacttctcttttactctctccatatatcctcgtttctctttttgttcatataaggttaatatttaggccgggcacagtggctcacgcctgtaatcccagcactttgggaggccaaagcgggtggatcacttgaggtcaggagttcgagaccagcctggccaacatggtgaaacaccatctctactaaaaatacaaaaatattagccaggcatggtggtgcatgcctgtaatcctagctacttgggaggctgaggcagcagaatcacttgaacccgggagacaggagttgcagtgagccgagatggcatcactgcactccagcctgggtgacggagtgagactccatctcaaaaaaaaaaaaaagttaatatttaatgcattgatgtaaagctaacttcaggaccacttttgaaactttttttcagactgttttgaaatcttcaatcttcagaaaaagtctgtgaaaaatcattttattttcgcactagtgtgtgtgtttgtgtgtgtgtgcacgcacatagatgagagtagttactctgtgaaggatctgttacttatcttgctatttttcttgtttgactaacagcctatttatatggataagatctgagaatcggttactaggccgtatgaaagaggagtcttctttaggatcattatcagtacaggcctggcattcacctaaccagtaatagaaacctgaaaaacagtggcataaaaaattgagagtttaatttttctgcatttagaataaatctagaggtgagagcagggatcctaatagcatagcaatattggcaagaacctagtgtaattaaccatgttttctagtttctatattctgatacttccacatcgtggggtcttgctgaccctggagtgactgcctctcccaggttgagctaattcctagaagcaaagaactcgcctgtcatatgtagatcaaccaagctagaccccatcctcccaaccaccaccttcatcaggctctgccactcctagctgcaattcccctagtcagcccaggaccagtactagagagctagggacagcccctatgccccagaggctgctgaaattattcaaactagccgagcctgaacttgcttacctgcctgcacactcctgcctgtgaaaccacaataaaggctcttgcccacattttcctttcactcccactgcctcctgactgactcaggtgcttccccatggggcacccctgcacgccatgccatgcctcatgcatgtttctagggaactgtgagtaaatgtcttcctccatgaaagtgattcctgtgtctgcacgtcttgccacacctgattaaaacaaaccctggctacctttacaacccccaggtccatccagccttctgagccaccaccctgacttgatcgagcatcaggaatctcatttctgggcggggtgcagtggctcacgcctataatccctacactttgggaagccaaggctggcagatcacttgaggtcaggagtttgagactagcccggccaacatagtgaaatcctgtctctactaaaaaaaaaaaaaaaaaaaaaaatagctgggtgtagtggcatattcctgtaactccagctacttgggaggctgaggcacgaaaatcacttgaacctggaggtggaggctgcagtgagccgagaatgtgcccctgcactccagcctgggtgacagagtgagactctgtctcaaaacaaacaaacaaacaaacaaaaataaaaagaatctcatttctgggtggtgtggtggctcacacctataatcccagccccttgtgaggttaggataggaagatcacttgaggccaggagcttgagaccagcctggggaatgtagcaagactccgtctctacaaaaataaaaaataaaaaaaaaattagccagatgtagtggtatacacctgtagtcccagctactcaggaggctgtggcaggaggatcacttgagcccaggtgtttgaggttacagtgagctatgatcgcaccactgcactctagtgtgggcaacagaaggagatggagtgagagtgtccctaaagataataagaatctcatttcttaatttattttccttaacacttaccatattctgaaatactatatatttgtttgcttataatttgtttcctctcactagactgtaagctccttgaagccagagatttttatctgttttctttatggtaagttcctagaactgaaaacagggcctggcatgtatttactgaaaaagtgattaagtgctctccagttgatggctggagttcagaccatcatggttttgtttcaggctggaggaagtgggagagtaaaaggcaaagggggcccatgccagttgagtcagtcctagaaaagaacttttctgaaagtcccctttacatgacttaggctaacatctcattggccagccctatgccacaccaccactcctacctgcatggcagtttgaggcaaaaaaaaatttaaagcatagaactttgctaaacaaaataaaattggggttctgctagaagaaggaagggacaatgaacactgggtctctgcaagggggctgttggctgcactccaaatgcccgcagcattatacacgaatcatacatggagctctttttttttttttttttgaggtggagtcttactctgttgcccaagttggagtgcagtggtgtgatctcggctcactgcaagctccacctcctggattcacaccattctcctgcctcagcctcccgagtagctgggactacaggcgcccaccacccccggctaatttttgtatttttagtagagacggggtttcaccatgttagctaggatggtctcgatctcatgaccttgtgatccgcccgcctcggcctcccaaagtgctgggaccgcaggcgtgagccaccgcgcccagccctacatggagctctttaccctggcctgtgctttcctctctatttactttttttttttttttctttcctgagagggagtcttgctctgtcgcccaggctggagtgcagtggtgtgatcttggctcactgcaacccctgtctcctgggttcaagcgattctcctgcctcagcctcccatgtagctgggattgcaggtgcctgccaccacacccagctaatttttgtatttttagtagagaacagggtttcatcatgttggccaggctggtctcaaactctctacctcaagtgatctgctcgtcttggcctcccaaagtgctagaattacaggcgtgaagccaccacgcccggtttcctctctatttactcttgtgagtaacatcagcttctttgaacttcaccaaacttaattccttaattccatactaactgtttatttgttgagtttccaagatgcaattgcatataattccaggaactgtgagtagtaagaacccccttatcagctgtcctatttttagatatcatgattcctactgaaacattcagtggcttaagctctgcccagcatgttcttgaccctgtgtgcctgtggggtgtgtgtgtgtggtgtgtgtgtgtgtgtgtatgtgcacacagtcatgtgcactctcacatcacataaggggaagataaagggagactctccgtggctcttcctccttttttccaaggctgatgttggccctttctgaaaatgctttaatgtgtagaaagcagcccacagataggcactccctgtgataaagcagtcacagccagagcagggtccctcccacctcagcctcctaagtagctgagactacaggtgtaccaccacgcttaggtaagtttaaaaaaaaaagttttgtagagatgggggtcttactatgttgcccaggccgatctcaaactcctggcctcaagtgatcctcccaccttggcctctcaaagtgctgggattacagatacgagccaccacacctagctgagaatttctttatggccatcttctggacaaaaagtcaaggagagtttagagtaataattccagtttttatggcttttgcttcggggaaaaagggttctagtttctaggacctaccgtggggaagaggattctggtttctatgactcacttcaggggagaacgagggacgagagagacaggagggcaggagcaggtcagagggaccttggatctgaggctgcttctgaggccttccaatgtcctttagttaagtactcatcgccatactttggggtattgtgttctgaaccccaacagaaacaactcactctctcggcatcagccttgtgcctatacccacaggagcaggagcacaagccattgcaggtgcgggctcctcagatggagcaactccaatgtcacctgctcctcacctgtacccagtggacttttttggcagcctcccccatcttctcgtgtggctccatatctttatatcttctgtggcagacgtagcctgctgcctccccaaactctatcgtcctcttctccttcaaccatggaaacttgattttgtctgtggcatccatgtgcctctttgaaacactcacctcctcagactgccttgaatccaggggtggccacatgactgggtaatgagtcaccggtagaagtcggcttgatggggcttttagggaaacaacggctttcctgtttttgtttttcttcttcttctttttaaattttctcctgctacccctccccttgtttgtttttaagatggatttgttcggaacacatcttttgctctttccttctcctttctgcctggaatgtaaatgtgatgtctgaaggcagagcaaccatcttgcacatgtgacatagaaaggtagatgtgaagacatctagcaggagattgcatctctggtgattggagcagctgtatcagctctggactgcctgctcaagtcttcttcataactgggaaaaataaacacctatgaagttaggccattgtattgagtttttgttactcaagaaccaaacacaatatttattgagatggcatttcactcttattgcccaggcttgtgtgtggtggcctgacctcagctcactacaacctctaccccccatccagccctgctccaggttcaagcgattctcctgcctcagcctcctgagtagctgagattacaggcgcccaccacatctggctaatttttttgtatttttagtggagacggggtttcacaatgttggctaggctggtcttgaactcctgacctcaggtgatccaccctcctcagcctctcaaagtgctggaattacaaaggtgagccacggcacccggcctttttttttttttgagacagtctcgctctgttgccaggctgggatgcagtgtggtgtgatcttagcttgtgtccggaattggtgggttcttggtctcactgacttcaagaatgaagccacggaccctcacggtgagtgttatagctcttaaggtggcatgtctggagtttgttctttctgatgttcagatgtgttcggagtttcttccttctggtgggtttgtggtcttactggcttcaggaatgaagctgcagacctttgcagtgagtgttacagctcacaaaagcaatgtagactcaaagactgagcagtagcaagatttattgcaaagagcaaaagaacaaagcttacacactgtggaaggggaccggagcaagttgccactgttggctggggcagcctgcttttattctcttatctggccacacccacatcctgctgattggtagagccgagtggcctgttttgacagggtgctgattggtgcgtttacaatccctgagctacatacaaaggttctccacgtccccatcagattagttagatacagagtatggacacacgggttctccaaggccccaccagagcagctagatacagagtgtcgattggtgcactcacaaaccctgagctagacacagggtgctgattggcgtgtttacaaaccttgagttagatacagagtgccgattggtgtatttacaatccctgagctaaatgtaaaggttctccaaggccccaccagagcagctagatacagagtgtcgattggtgcactcacaaaccctgagctagacacagggtgctgattggcgtgtttacaaaccttgagttagatacagagtgccgattggtgtatttacaatccctgagctagacataaaggttctccaagggcccactagagcagctaggtagagtgtcaattggggcactcacaaaccctgagctagacacagggtgctgattggtgtgtttacaaaccttgagctagatacagagtgccgattggtgtatttacaatccctgagctagacataaagactctccacgtccccaccagactcaggagcccagctggcttcacccagtggatccagcaccggggctgcaggtggagctgcctgccagtcctgggccatgcgctcacactccttagcccttgggcggtcgatgggactgggggccctggagcagggggcggcgctcgtcggggaggcttgggccgcacaggagcccacggagggggtgggaggctcaggcatggcgggctgcaggtcccgagccctgccccgtgcgaaggcagctaaggcctggcgagaaatcgagcgcaccgccggtgggccggcactgctgggggacctagtacaccctccgcagccgctggcccgggtgctaagcccctcactgcctggggctggcagggccggccggctgctccgagtgcggggcccgccaagcccacgcccacccggaactccagctggcccgcaagcactgcacgcagccccggttccgctcgcgcctctccctccacacctccctgcaagctgagggagccggctctggccttggccagcccagaaaggggctcccatagtgcagcggtgggctgaagggctcctcaaatgccgccaaagtgggagcccaggcagaggaggcgcccagagcgagtgagagctgtgaggactgctagcaggctgtcacctctcaagctcactgcaacctctgcctcccaggttcaagtgattctcctgcctcagcctcctgagtaggtaggattacaggcgtgtgccaccacacccggctaatttttgtacttttagtggagacagggtttcaccatgttcgccaggctggtctcaaactcctgacttcaggtgattcacccaccttggcctcccaaaatgctgggattacaggcatcagccactgctcctggcctctgtgtagttttgtttggagctgcagtaaatagtgtctaatcttttccttccttacaggctatttctccatattgcttcccagatacaaaattcataaatgtatacaagccatacccatgttacccactccctcaggccctgccaaggccttgagaaactagactcagactgtgtctccatgtagggggattgcacatagcatctttgaacttcagtttctctttctgtaaaatggggaattttgactacttagcatgcgtcatgtgttaaaaccctaacctcgttagcaattataaccactatcagtatcccatactctggtttttttagggctttcccaaggcaaatgggaagatttgctgccaagctcacttcgggaggtcaccaggcccagaacattcttgtcctcacaaattttcacttccttcatttaagaacaaggactagagtgttctcacttaattacaactgggataggtgggagggagttacccatgtgggcaacattagggaaactttttctttgagacagggtcttgctctgttgcccaggctggagtacagtggtgtgatcatggctcactgcagcctcgacttcctgggctcaagcaatcctcctgtcttagcctcctaagttctgacagcccttagggactacaggcgcacaccaccacaccccattcatttttgcatttcttgtggagatgcgttttttccatgtttctcaggctggtcttgaattcctgggctcaagagatccttagggaaacattctaccaaaccagaagtgatggatcaactcccagcaagcctttagtgggcattgttcttttcagggagctggatagaagaggggtctcggagccacaacacccgtgctgcccatgatggtagaaaagggaagtctaaaaagagtttgggtctgaactggggcctaggaaaagttaatggggcagtgattttggccttttctacccacctccttgtaataatattattttaacaatctggctgggtatgtggctcatacctataatcccagcactttgggaggccaaggtgaatggatcacctgaggtcaggagttcaagaccagactggccaacatggtgaaaccctgtctctactaaaaatacaaaaatcattcggccgaggtggtggttgcctgtaatccaagctactcgggaggctgaggcaggagaatcgcttgaacctgggaggcggaggttgcagtgagctgagattgcgccactaccctccagcctgggtgacagagggagactccttctccaaagaaaaaacctaaccgccccccccaaaaaaaaccaatcaaacaaaaaaccaatcttacccccatgacgttgcctctctctagcctcccagggtatttctgtagtctcaatatttggccttagctataagaaaatttccttaccattactctttattgtgcaattctctgaagatattcttctgatggcattctttcctctccattccttgtgtgtcatcattatttcttgcttattcctgtcttgtgcttacttcctgaaatctgatctatcctttaggcctatctcagaagcctttatgaagccagcctgcacggagacactttccttctctggaacccatggcacttagctgctatggcttttgtgctcatcagcaaactggaatgcgcttccattagacttatcctttcaccttagattccttaaggcaggaactgtcctgtacttagccttgctcttgtcatgttgtatttacttgataattattccttgaatttaactggaaattccggtttggaaggagaggacatatatacacgaagcatggtatatttaaataaactggagttaattttccttcagaaatacctcctatttaagcctttgccacacaggtataggcctggaaataaaaggtgtggctaaaagctacctgctcagagaactctttttttgttgttgttgttttgagatggagtctcgctctgtcgctaggccggagtgcagtggcgcaatcttggctcactgcaacctccgtctcccgggttcaagcgattctcctgcctcagcctcccgagtagctgggactacagacatgcgccaccacgcccggctaaatttttgtgttttaatagagacggggtttcaccctgttggccaggctggtctcaatctcctgacctcgtgatccgcccgcctcggcctcccaaagtactgggattacaggcgtgagccaccgtgcccagcccagataactcttttcttcagattttctttacagattcttcaagctgtaaaataaatgaataccatctctcatcacctatacctaggaagtgctgagtaactctttcctgtggacccactgagtcagaggttcacatctggttgggcaagtagtgggtgtgatcagtgatgaatattctttggtttcagcaccagcatcagctatttatatgtcagtgatgcaaatctccatatgcagagtccttgatactgttcggagtgcttccatacccatgcccaaactggacccagcgggggtggctgccgagaaaagaaacttgacagagcaggttcaaagggtccctggtttcttgcactggaagaattagggtgggaacacagtgggagaagagaggtggaatgtcacagttctgacagcccttagcatggagatagccagcagccaattagatatgggaatcggaagcctagcagagaggatagctggagagtacatttcaaagtcactgccatataaacaggaattaaaaccctgatagtgggtgggatcgcctgggagagtacggaggaagaggaggatggattcagaatggagtcccagtgcttgggtagtgcatggaggacaggacccctgaacaggccggcaaagtgtgggtagagaggtcaaggagagagaggagaagttactgtagaaatcgataacttcaacaaatgagagagaggtcagctgtaaggtaagaaccaagaagggcccactggatttggcgtggagcaaagggatggagtgagtggagtaaaagcgaagatggaaggtggatttcagtggtgccagaggggaatggtagtaaggagagcgtagtggacatggagatgtgctgctcagatctcccccaaggaaggacttgttgcccagctatgggagagcagtcagcagacagcctccagccatcagctccttcagggtcccctggctgcaaagagctgcctggtccctcttcctggtcacaccctttctcctggcagctccatgtggtgactaagcagggctggatataaatgtctggctctttcagttcaacttgctttgctttgatagacaatactgccccaagctctctgcagagttatgagaggtgtggttgggcctgcagctcagtttaacttctccctctgcccactcctgcttccttgcccttattcacaggtgttaatacctaattaacatcttgcatcccaactttatctcagtatctgtttccagagaacatggtctccaacagaatcatgggaacaagtcttctgaagagtttgagagcaggagtcgagggacgggaaggaggtgttaaaaaattagtagggaatggtgacacgcctatagtcctagctattgggaggctaaggtgaaaggatcacttgagcttaggggtgactatactcagctcttctcggggctcacgaaacactttacaaaacatctttctgtatctcatttgagggtttttgcctacagtcattgccaaggccacttatctgtagttttcttttcttttttatttttgagacagagtctcgctttgtcacccaggctggagtacagtggcctgatcttggctcactgcaagccttgacttcctgggctcaagtgatcctcctgcctcagtcccccaagtagctgggactacaggtgtgcaccaccacacctggctaatttttttttttttcttgagatggagtttttgctcttgttgcccaggctggagtgtgatggcacgatctcggctcactgcagactccaccatccaggttcaagcaattctcctgcctcagcctcccgagtagctgggattacaggcatgcgccaccacacctggctaattttgtatttttagtagagacagggtttctccatgttggtcaggctggtctcgaactgctgacctcaggtgatatgcctgccgcggcctcccaaagtgttgggattacaggcgtgagccaccgtgcccagctaatttttgtattttttgtagagatggggttttgcccaggctcatctcaaactcctgaactcaagtaatccacctgcctcagcctcccaaagtgctaggattacaggcgtgagcccccacacctggcctgatctgtgcttttcaacattcatctttttttccatctttgggaatcagagccacacaatctccaacttctaatacctttctgcctctttgtgatttctcagagatcgttgatagtgacttggagatactctcagttaatttttattttggtacttaggaatgtaatccattcagaccaggaggtttgaacacatttggagcagctactcttgctgttattattatttttttcaggtgttatggtgattcccacttagcagtggccgttctgctgtttcctagtcaaattccatgctgcttactgataagctgggggcactggcttctgctcttgctctttcttctggaaacattattctgttcctttggacatgggcaagggtcctgtccctaacttgtccttctttttcttttgatcttaaccagtttcacttgtaccaagaccaaactttcttacctttccatgcagggaaacaggcaccatcaagatcaatgccctggtactccttatgtagtgagtgatagatgctcacggaaaatggggagaaaactaaggggtgaaagggaataactctaaaaaggacacgttcacactttctgacagcatagttgcatgttttcaatttattttggccaccagatggcataactgggctcattaagataaacaaagagaatggctactactctgaaaaaacaaaaaaaaaaactctagataattaatggtgaaaatgcccctgagaaagctcatttctaattcttactcctagctggctttttatacacaggcaggggagacccatctttggaattttaaggttcaaaaaggaatttgtctgtacctgatggccagaaaaccacactgaaatcgtcaactggcatttagaattgtctgttctaagagttagaaatgagcgtgtctctacctgcttctagcacacaccttcctttgaggtaaactccttactgttgagcccttgaatctcggagtggatgaagagggtgatgagggattgtagctaatattagcattgttgagctaaaataccatcatattttgtcaggagaagtgctgactgtcctgtggaatctgaggatgagtggcattggtccctaaggattagcttgtccctttcggttacttttgaatatgatttggaacttgtggggtttgggttatgacaagaagggaactgagaaagtaaaaacattcattgcttgttttgtgcttctacatatttttgactctgggagattttaaaggtctatttctaatatttgttctaggtgcatagatttgtttattcaacaagcattccaggcaccatataggggctgggaagaaagagtaaataaggcagagttccaactttcaaagagctttctaatcttggtttttagtcccacaggggcaagatgggaatgccatgagaggctctttgattgtggcccaagggaacactcagtgcctagatgtgtgaagtgggatgcagctcctggtgaaggcagaagtcctttaaaagtttattgactgcaaagaataaaccaaaatgggccgggtgcagtggttcacgcctgtaatcacagcactttgagaggccaaggcaggcggttcatgaggtcaggagttcaagaccagcctggtcaacatggtgaaaccccgtctctactaaaaatacaaaaattagctgggcatggtggcgggtgcctgtaatcccagctacttgggaggctgaggcaggagaatcgcttgaactcgggaggcagaggttgcagcgagccgagatggcaccactgcactccagcctgagtgacagagtaagactccatctcaaaaaaaaaaaagaataaaccaaaatgacaaagcttcttgataacatcccagcccatttcttcttcttcttctttcacttctccttctccttcttcttcttcttcctcttccccttcttcttcttctcctccttctccttctttttttttggagatggagtcttgctctcttgcccaggctggagtgcagtggtgtgagccaccccgcccagccatcccagcccatttcttatacaagaaacattgagggtttactaaagaaagaaagagacagtagaataatgggaaccacgttgcaaaaatgtaaatcgctcactggtgactgccaggattttgatgatctaataaaatgactggcatatgaggtggggaaaatgtaccctcctgtgatcagccagaggtttcagcagcagtggaagatgcataccagaaggcggtgcaaagggggattagagaggatctaaactggtatcagggattgggtgtggtggctcacatctgttatcccagcactttgggaggccaacatgcgagaattgcttgagccaggagtttgagaccagcctaggcaacatagtgagacctcatctctgcaaaagttttaaacaattagccagacatggtggtgcatgcctgtagtcccagctactcaggaggttgaggtgggaggatcactcaagcccaggagacggaagctgcagtgacccataatcacgccactgcataccagcctgggcagcagagcaagatcctgtctcaaaaaagaaaaaaaaacacaaaaactggtgtcgggaaaagtagttgggaagctatggaaattgctccagtgagaggtgatgaacatctgaattagtggcaggagtctctctgaacctattcagtttcaggggattgcttgatttaaaaaaaaaaaaaagacaaattagccgggcgtggtggtggatgcctgtaatcccaactacttgggaggctgaggcaggagaatcacttgaacccgggaagcggaggttgcagtgagccaagatggcaccattgcactccaggctgggtgacagtgcgagactccatctcgaaaaaaaaaaaaaaaaaaggcagtggttaagggactgagtggggacagatgggagatggattttagggtaggaagggtggatgtaagtgtgaaggagaggaagaatgactctggagagaacaccagctccagtggcctgaccctaagtcctgtgtgctttctcgcatattgtgctgcctcgtcatataacgaagattccactttagtccaactcttccattttacagtgaaaggagaagattaaaacccagaaaatggaaaccctcatttatgttaaagctgagaaatcaagtgtcccttccctgatccaatcctcttccgcaggttcatgacagggtgcacattagaactacctgcagagccttccaagcggcacgtgcctggcccatccctagatccagtgaaccagaatccctgggctgggaccactggctcattccagacagtgcacaagcatctcttcctggtgcaaccttccatagcacgttccgcttggatcactttctctttctctgttttataattgtccattacatacagccactgataactgaaaaggctcgcagtgtttggatgaggaaccatatgcaaacaaataccacagttcttccttatagacccacttaactgatttgcaaacatctcactgaaaccgcaggggagaggttttagaaggctatgctccagtaaggaaaaattaatggaagtaattgttcagtaagcagttaccaatctaagttttataaaattgatactctctttatgagtgtattttagtaaaaatagggaatagcttttttttttttgagacggagtctcgctttgtcacccaggctggagtgcaatggcgccatctcggctcactgcaacctctgcctcccaggttcaagcgattctcctgcctcagcctccgattacaggcgcccgccaccatgccttgctaatttttgtattttatagtagagacggggttttgccatgttggccaggctggtctcgaactcctgacctcaagtgatctgcctgccttggcctcccagagtgctgggattagaggcgtgagccaccgtgcctggctgggaatagttttaaaacataaaaaacgcaaaagttttaaaaaacatgggttttctaaagatttcagtattccctatccctaacttttcataaagtcctgagtttcttaatcacaatgttttcatccaaggaggcttttaggaacaggaccccagggttagggcaggaatacactattgttattttaacagtctatcaactagaaaggcaaaaaaaaaattagatttttttcaatattaatgaagttgaattgttcgttgataattgttaattagttatggtgtttctgttataaattgtctgtgtctgaatttctcacacagtacaatataaaatacaaatagctgtggggtattttctaggtgctggttactgttctaagagctttaaatggagtaattcagttaatcctgcctcacggtacaataattagtctcgtatgacggaggaaatagaagcctggagaggtcaagtaacttgcccaaagtcatacccagaaaggctggattcagagactgttgccaacattttccttatttatttgcattccatttttttctattaaatataaaaattagccaggcgcagtggctcacacctgtaatcccagcacattgggaggccgaggagggtggatcacttgaggtcaggagttcaagaccagcctggccaacatagtgaaaccctgtctctactaaaaatacaaaaaatcagctggacatgatggcctgtgcctgtagttccaggtactcaggaactcgagaggctgaggcaggagaatcgcttgaatgtgggaggtggagtttgcagtgagccaagattgtgccattgcactccagcctgggtgacagagcgagactttgtctcaaaagaaaaaaaaaaaaatttaaaaactttttgtagttaaatctatgcatatattcctttcttttgttggcctattgtttcagttaatttgtttttttacttttttcccatgttttacttattactttcatatttcttgtatgatatttatcttaaaatctagttttatttttctttaagagactgggagtcttgctatgtttctcaggcgggtctcgaatttctgggcataagcgatcttcctgcctcagcctctcaagtagctgggaattacgccaccaacacacctggcttctttcagctaatttagaacatcctacccttttcagagattaaaaaatatttagatttgctcaggatatgttagatgaagtgaggatttacatctactatatgtattttcccaaatattaataattatttctcctgaaccatttattgcataatatttttctgttccattgttatatgacagcacgtttctgcctggttgtaatctcatagtggcttgatttttaagtgaacattatatgtttaactgcctccttgaggatactgaagactctttccaatgattatattcttttcacttcacctgtcatgcatcaagtgttgatgttgctggctgcctttctcagtgttagtttttatgtgttttggaatttcagcttccaggttcatttccaggctttctctgtctcccttctcttgttcctcactcctccctgcctagtggctgtgcagttgcccttcccaggggccagtgttcaggactaggtcttatatggcagtcggggctcctgccctgggataaccctgggaatgactcacatccagccccatggctgtgggtggctcagttaagcccaggtgtggtgccgtttggtaaccacgggcctccctaggccacagtcccaggcgaagttagtagcaagctatttcagtcttcttgaagagggtggaagtgtgggcaagaggggaatctgagtccctaatattttcacagtgaccatgacactggtcccccacctcagtgggcaatttaattctatctcaccactcagtactcaacaggacttgacttcccagctgcctttaactgtaccctgagtcagaacccaacaggccacagctgtagccctgttcatcttttgcatttatattcagtttctgggaatatctttggggatattctccctttgtggagcattgctttttaattttctctaatattatatctatcattgctctgtattgaaagcccctgggctagcctgtttcacttgtgtctattttttagaagcatttactgtagctttatactacatatttggggatcactaacaattttttccggtcacactctaatcactttctcaaggctggatcaggtgcgagactctgtagcagtaacctgaagttgagaattgaggaagtagtgctgctatgagaggagacctgcggtggcatccctaggatggggtgctggtggggggtgggtggcaagggggaaagggggtttctgcctaagggagtttctgctccatgccagcacttcatcagaggtcttgagccagggtggaatccagctccagggagcatatgagagcaaacaatggaagcttgacatgatcactggatgaacatctgaagtttcatatgtgatgggatctccccagaaaacaatagtgcacatcacagccaggaggcacccagagcattgtgttgctgtgttttttgaacccagtgagttaactgtccagtgttccacatcattctgacctgggtcaacagatggaggcagggcacactcttggctgtagctcgatccgcctctcctgctgcagcaggacatttctcagtagcacaggcaaggtgctccgggcaggggactgcatagtaagtggtgcctcctttgcaatataagccaaacaaggcttcctgctggagcgcctcttggctaattcaggggcatgagaggcagcatctaaccttgcccaggggccctggctcccctttactatggggggtggcctgtgatcaggcccagtgggactgaggagcaaatgtggacagtcttccccggcacacatcggctgacctgcatgcccagactgtctcctggggcgcctgtacaagttggtcctagaatccaattcttcctggaactgggtgtcatttcaggacagagaataccgggagtcataaattggccctgaagcaaacgaaagtcttccaatcctgcatgacatagcagattgttttgcttggggctttggcttggtctggggcgtgcagttccatgggggaacctctggcaatcccaccagggggagccctttccccatcttggggctgtggatctcagctttccagaatatttgtgtgcatgtgagtgagcacatctgacttaatttttatattcagtatagaatcatgactcagctttccctgttaatgtagtcaacttaagctactgccatggttcaggttccatcatgcttcaaatatagtttatgactgtagttacgtagtgtggcagcaacacagggcaacttggggctggggagaagtgagcgtgtctttccctccccaaatgcagtcatttagcatcttcctctttcagagtcctgtatcccagcgatggggatcaagattcagacttaaggacaccctacctggaccttggcaaggagatttttacagtgggaatctggtccagcctctctctggccccaggcctctactgtccaccttttacaaatgccacatggtaaggagtcaactgagctaccttccaaggagctggattggtctcctggctctgcctgaccttcctcagcccctccgcaacccccacctgctcgcttctccttcacctcctctcctgttcacctgtaccttctttccttagatgtggccacactctgttcccccaggcagcgtcttcactgagtagtctttgaaccattaaccacctgcagccctatccatgttctctagggcacctgcaagaggaggaaggggaatttgctgatagccacagctgtgcatcctactggaggtgccttccggagggcagcatagttaatctagacacccagcattctcagtccacttccatggccttctcttcccattgcctgggtctcaaaaggcccaggacaatctcatgaggtggaccgagcagtatttggggagggaggatagaaaagagactgggatatctttaattaatagatactattaaaacctcctccccagcagcagtagtagggatcgttagtggcagcaaatccataggggtctgcagcaacctcaattcttgcctctttggtcacttactgggatcttattgggaaactgctgatcaccagtttcagatgtttctattgggagactgcctgtctctggtgccagctgtgaccaattattttagagagcccgttaacaactgcctgaccctcacctgatgtttgcctgacattcctgtgggtgtgtgtctggggcgccctctcctgccctgctcatccctgactagctacttactctaacaggatgagaagacatacaaaatagaggctactttaaaaaaaaaattctcagagtgtagtgtgtaaacgttcacctccactataaagacctccttgccaggggtaggaagcctttagtctgaaccttgagctccgtcgctgggatacaggactctgaagaggaagacgctaatgatgacattgagttgactccacagcatctcacaattctttctttttctaagtcatctgcatttagtatccactgaccaagcaggcaggaaatgtaattgaagttttattagggactcccctatctcttctcctatggggtccagtgaccatcccaggggtctgacccagcctagaacattcagagtctgggcctctgaccttcagacacagctgatatgaatgggagtctttgtggttagtaaggccaaggttcttagctagtttcctttggaatccctgacctccctccatccccactgttgtgtgtgtggggttctatgtgggagcagggcttctcctcactactccaaggacccccaaaccacatcccttccacagcatctgggaatctccccccaccccccactcccttgagcagcttttgcctccttcagtccagtgtgcttacctctctcccctggcagagaacccaggtgctggcggggtctcctctggatgccttgccaacttctttttttttctttccaacttcttctcttggtgaggctacgcaaaatcttctggggccaggatgtgcaaacgcttcctggaatggggtagaacagtgacaaaacaggaagaacaaaaaaacacatgttaatatctcaagaaagtatccagccaccataatgaaggggcttccaggctctgagggaagaccactgagctgaggggcctttgcactctattccagggaagataatggatgcccagaagaagtgggacatttggagccccagacaaaccaatgacacagactgagacactgtggagctggatgcctttctgtgtgtttgttagagtatgagaagcccgctgggaacaagtaagggcatccctaaccatcagtgtccattgcccaagagagatggcagaagtgggttggtccaaatcctttccgttgtaaatgtggagggctaacattttgaaatattctctggccaggtgcggtggctcacacatgtaatctcaggtacttgggaggctgaggcaggaggatcacttgagcccaggggttccaggctgcagtgagctgcaattttgccactgtactccaacctgggtgacagagagagacctcatctctagaaaaaaaaaaaaaaacaacttctgatttatttcatctgtatctctccctcctcccctcccactccccagcccttctagcagttggggtaggagggtgggcagtcagcagaaagcagagccaagcagcatcttctgcctcataaatttcaaacatgagacctcatgggaactgaaaggatttatgacataggccaggtatttaggagaaatggacactaagaacaaccatcccctcaccttccaacagaaaggggttcccttgtgctggtggggcagaggggccataataacaatgtgcacatttgtgggtattagagaaaggggtccctgggctgagtcctggggaggtggcagaaatggcagacaggtttgtggggtcagacagaaagctctgtcttgcttcgtctttgagccaaaggggacctggtgcccctgagttgggggcactgtgtggtgcccagtcacactctccgtggtgtcctcagtgagtggcactcattgagggacaggaggagcagagctgctcccaatagagaagcactggagcccacactgcctaaagtgggaatgacccaaatagccttcagcaggagaaaggggaggaaaattgtggcatatgcatgcagtggaatatttctcagcactgaaaatgaatgttcctataactgcatgtgataacaggcaaatctgcagacataaagtcgagtgaaagaagccagctgtgaaagagcacattgtatgattccatttatataaagctcaggtccaggcaaaatggtagtagtgaggagagaggttgtcctttggggagggtagtaactaaaaggcacaggagggggcccctggcatcctgggaatgtcctttccttaatctaggcactggttgcatgcatatgctgtttgcgaaagttctttgagctgtacatttaaaattaatgcacttctctgtatgtatgttttatttatataaaaacatttttttaaaagatagaagtagctggatgcagtggctcacgcctgtaatcccagcactttgggaggccaaggcggatggatcacctgaggtcgggagttcgagaccagcctgaccaacatggtgaaaccccatctctactaaaaatacaaaaattagccgggtgtggtggcacatgcctgtaatcccaccttcctggaggctgggaggtggaggtgagctgagatcgcactactgcattccagcattccagcctgggctacaaatgagactctgtctttcaaaaaaaaaaaaaaaaaaaaaaggactttctgctctttcctgcttgacatcttccttgactccatcttctttttgatcacctttttatggcttcctgaactgatctcatggattttttatctgcatcaaaaatggaaatggattagatgttgcgatttttagggtataaaattcaatgattaattttatgtgtcaatttgattgtgttgcactacagggtgcccagattaaataacatttcttggtgtgtctctgagggtgtttctaggtgagattagcattgtggactcagtagattgtcttcgccagtgtggtgggcatcatctaatctgctgagagcctgaacagaacgaaaagaggaaagagaaattcactactgtttcttcccgcctgcgcgctggaactggaatatcagtcttcttctctccttggactgagatttgtactattagctcccctggttcctctggtccacaagattgtggacatagactggaattatattactggctttcctgggtctcagttcgctgatggcagactgtgggactttagagcctccataataatgtgagccaattcctcattctatctatcaatctatatatcgattgattgatcgatcgatagatcgatctatctaatctatctatctacttatctatctatcatatcatctactgatttctctctctctcttcttttttttttttttgagacaagatctcactctgttgcctaggctggagtgcagtggcacaatcctagctcattgcagccttgacttcccaggctcaagcaatcctccagcctcatcctcctgagtagctaggactacaggtgcccaccaccatgcccaactaatttttaaactttttttacagatgaggtctcactatgttgcccaggctggtctctaactcctgggctcaagcgatcctctcacctcggcctcccaaagtgctaggattacaggcatgagccaccgtgcctggccctgatttctcctattgggtctgcttccctggagtaccctaatacagatgggtttgtgttattgagagccctatttgctgcctccttcacaagatgctagctgaactcttgagcatgggcatcagcattggtaaatctggcagtaaggcctgtgggctgctcacatcagccaggcagacatttgattaagtttgagatcttgatgtcttcaccagagccactaagttttatatatgccattgttgaagccaaccccaactcacctggcaatcagctggaggaaggggactacttctattcattgcagatttaaaagttggctacatatcctttgctacttctcccattgggaggtggggaccccttaaatctgggtggctgtgtggctgctcgagcgacacaaattgttggaagtgatgctaaaccagcttccagcacaggattcaatagcaccttccacctcctgtctcctggagcattctctgggagcctgaatcaccatgtaaaaagttcaaaatcaggctgggcacggtggctcacacctgtaatcccagcactttgggaggctgaggcgggcggatcatgaggtcaggagttcaagaccagcctggccaacatggtgaaatgccgtctctactaaaaatacaaaaattagctggatgtggtggtgcgcacctgtaatcccagctactcagggggctgaggcaggagaattgcttgaaccccggaggtggaggttgcagtgagctgagattgcaccactgcactccagctctgggtgacagaacaagactctgtctcaggaaaaaaaaaaaaaaaaaaaaaagtttcaaattcaggctgggcacagtggtgctccgtaatcctagaactttgggaggctgaggcagggggattacttgaggtcagaagttcagaccagcctggtcaacatagtgagagtccatatctacaaaaaagaaaagattagccgggaatggtggctcacgcctgtagtcccagctactcaagaggctgaggcaggaggattgcttgagacctttaaggttgtagtcagctatgaccatgccattgcacaccagcctaggcaacagagcgagaccctgtacccctcttccccccaaaagaagaagttcaaattccctgccactgcctgctggagtggccgagtatggtactctggccaaccactagcagagcccagctgtccccacaaaggtgacaaaaatgtgaaggaagctgtcttgaacactccagaccagccagctgccgaagatggcattgagtgactccagttaacatcaagcagagtagaattgctgaactgacagacacaattttttatgtaaggaagtggctgttgttgtaagccactaggtttgggatggcggttgctcagtgatagataactgaaacagctgtatctgcacctggaccagagctttcatgcccagggtgagtagcttcttggttctgtaaggctctgtctccttcaactcactttgccgggttgcggctacagcattacccagctcttcattccattacagttcatcaaagctcccatgccaggcttgtggcagggtaatttactgtggaattgttttgttttgttcttgttgctctgtgtatactcccctcaccaagagagttactgggctttttgttcccaattctgaggctctttcttgagtatggagaaggtgggtagtgatggcatttggattatgcgcaaacacctaggctaagagaggcagaagtggactgtgggtgtgtcttgagcagaggttgagattctctagggtctggaaatttggtgctttctccccacgagtgaggagacccccacttctgcccagagcattcccaggctgaaggattgctggagaatgcccagagaagccatgatttctcccagctaggggcacagaggccagggtccccagggagattctactatgggtgatgtggacattgctgatgtgaggggaagtgctgggcctgacccagaggacatcactccaggacttgactgtagcctctgaaagtagaggcagctagagaaacaatagtggcttctatgggctaaatgtctctgtccccccataattaatatgttgaaaacccaacccccagtgtgatgatatttggaggtggggccttttggaggtacttaggtttagctgaggtcataagggtggagcccccatgtgtgattagtgcccttataagacgagttagagaccagagctctctctcggccatcggtagtgagaaggctgcagtctgagaatcaggaagagagccctcagcagacatcaaatctgctggtacctggatcttggacttcctagtctccagaactgtgagaaatacatattcattcagctgggtgtagtggctcacacctgtaatcctagtacaggtttgggagaccaaggtgggcagattacttgagcccaggagtttgagaccagcctgggcaacatggggaaaaccccatctctacaaaaatacaaaaacttaggctggcatggtggctcatgcctgtaatcccagcactttgggaggccaagaagggcagatcacctgaggtcaggagttcaaaaccagcctggccaacatggtgaaaccccatctctactaaaaatacaaagaattagctgggcatggtggcgggcacctgtagtcccagctattcaggaggctgaggcaggacaattgcttgaacctgggaggcggaggttgcagtgagccgagattgtgccactgcactccagcctgggtgacagagcgagactgtgtctaaaaaaaaaaaaaaaaagaaaaattagccagatgtggtggtatgcacctatagtcccagctgcgcgggaggctgaggtaggaggatcacctgagcctggaaggttgaggatgtagtgaggtgacattgcaacactgccctccagcctgagtgatacagtgagaccctgtctcaaaaacaaacaaaaacatatttgtcatttaagtcacctagtctctggtattctgtcacagcagctagagcgaactaagttggctatcctgagtactaaggacctggccttgctcccagcttttctggtactgcctaagcccctggtattttgtaatgtgttggagggaggagacagccccactaatgactagggttgaatttcctcccagtcttctgggtaggacacagagcagattacatttgattgagtaaaagtaaggaatgtgacatttcatgcacattttatagccccaaatgacaaaaataacatgcttctcaagccacctggaacattttatagctttctgttttttttgcattgtaggctcctgtgtccatcaatttatcagcatttttcttggcaaggattccctgaaatgtctccaagtttggaaattttgtctttatgaaaagtggggcatgggaccagaggagggacttggtcagaaaaacaaaatacgattatttttgatccatgtccttatttcttggttactaaatagctgccctctgtatttctttgattttaataaatcgtccagatatggatttttaaaattctatgtatgttttttgagacagggttttgctctgtcacccacgctgaagtgcagtggctcactgaagccttcaactcttgggctcaagcaatcctcccacctcagcctcatgagtagctgggactacagccatgtggcaccatgcctggctaatttttaaaatttttttagtagagacaaagtcttgctatgttgccaggctggtcttgaactcctgaactcgtcatcctcccaccttggcctcctaaagtgctgggattacaagtgtgatccaccacacccaggcctagtttttaaaatgatatttcatttatgtagttcaaataaaaatgacatcaataagtacatgagaaatatcactcctaccccacacttaccctctctttttcccctcacattgctcgtcagtaaccatttttaccagaatagtgccttatttattctcccaacgtttctttatgcaaacataaataacatacttttatttcctcttttattacacaaaaaaagcatgttatatacatcttgctccttccttttaaaatcgtaactaaatatactgggtatccttccctatcaccacgtaaagctgttcctcctgcctttttcattttgacagctctatagtattccattggtggatcgaccagagctgtgtgttcgccagtctcctattgctgggttgttgggctgtttctgatccgttgttattataaataatgccacaatgaataaccttatacctaagcaagtttacctttgtgtaggtgaatctataagatagattcccagaagggggatctctgggtcaaagggtttgtgcatgtatagttctggtagatattgcaggtctgctccacagaactgtgccatctgcactgctgccagcaatgcatgggacagtctgtttcctctcagcctccttcacacactgtgatatcatattctggactcttgccaaccaaggaaagatttatgtataagttcaacatggatgcacttaggctaattctccttcctgcatttccttcagaacatcctcagtctcctcactcatttcagataccttaattagcttccatttttcatgacacaggttagccatgtttatatttccttcgtgatcatcacagttatgaaagatttcttcttgggttgataggttaagtaaccatggtccagtattggttattgcaatcaaaccaacagctacaggtggcttggattgttttagatggaattggtctcaaatttaaaaggtcactttgtcattctttgtatcattgttattcatgtctgtatcttttacaaatatatttatttaatatttaataagacaaataaaatgttaaaaattattttgtcctgggaaagcccaagccttcctgcacagaagttgaaatattcaaaggacaagaaaaggcctctggtacggtcctgtcttggacagtttccccggccacccagcaggctgcctattgtgctgtttgagatgcaaatgatctcttcttatgctggggaaccttctaggcatggcaggggcagtggagaggctacttcctctctctctttttttttttttttttttttgagacggaattctcactctgttactaggctggagagcggtggcatgatcttgacacactgcaacctctgcctccagggttcaagtgattctcctgcctccgcctcccgagtagctcggactacaggcgcatggcatcacgcccagctaatttttgtattttcagtagagacggggtttcaccatgttggccaggatggtctcaatctcttgatctcgtgatctgcctgcctgagcatcccaaagtgctgggattacaggcgtgagccaccgcactcggccacttcctctctttttttgcccacttctctagctagtcccaagacttgttcaactctttcttatggatggttttgcagaatacatacatggaaaccgtccacaaattctagcccaccaattaatgctgtcagactgggaacttcatgaaaagcctgcttgaaacaaaaaattgaaaataagtggcttaaacaaggtagatatttatttctctgctttatccacgaggtctgagatgaaacgtccagggcaggtgtggaggctccctggcatgatggacccaggctcctgtcttctgttcctgtcatcttagtgtgcttccttctacccttagggtggcctcatggtctgagatggcttcaggactctccacttcaggccttttggagtccatgatttcttttcttttttttttttttgagatggagtttctgtcttgttgcccaagctggagcacagtgatatgatcttggctcactgcaacctctgcctcccaggttcaagcgattctcctgcctcagccgcccgagtagctgggattacaggcacctgccactgtgcctggctaatttctgtatttttagtagagacagggttttaccatgttggccaggctggtctcgaactcctaacctcaggtgatccacccgccttggcctcccaaagtgctgggattacaggagcgagccaccgcgcccatccatgatgttctcatggccaacatcctgaggtctcccaaaggcaagggcttctttgcttgcccactggtttgggtacagatatatttgtggactctggagtccaggtgtcagggtatagcttcctgaggtgccccaggcagctggtctcctctgaggccttgatgatagcccttgacatgcctggggctgtggagctggggatggtctccaccccacagggatccacctacctcagccggtatccagtccagggcctctgtcttcttggctgccctcaaggcactgggctcctttagacactccccaccacacccttaatcctctcagggaactccagtctccagcaaacaaaggcctgaaaagtgtctacaaggaaattctgagttcaggtttctgaggtgaaggagcacaaagtcctttctcctggcttggaagtgcagggtggtgcgaagagtgggagggaggcagggttaggtgaggaaaaaacagaaaacacaaattaatttgacaatgatatgttaacttaaaaatcacaactttaggctgggcagacagtggctcttgcctgtgatccctgcactttggtaggtggaggtgggaggactgcttgagggtaagagttcgagaccagcctgggcaacatagtgaggccctttctttaccaataaataaataaataaataaaaattagctaggtgtgctggcacacgcctgtagtcctacctactcaggaggctgaagtggatcccagtagtttgaggctgcagggagctatttactccagccagggcaacagagtgagaccctgtctcttaaaaaaaaaaaaaaagaaaagaaaaatcataaatttggaaaggagagctttatttcttttaaagagttactgctgactgggcattgtggctcacatctgcagtcccagcactttgggaggctgaggtgggtggatcgtttgaacccaggagttcgagaccagcctggcaatactgatgcagaactttgctcctcagttcagctaaaaccgggttcttgtcacatgaccaggaaaagttaagcaggcagacactttgaagggtgaggggaatggaattttttgggtgaaaaaggaaaagaagaaaagaaaaacctctcagcaaagagcaaggggggttcctgccaacaggtccccactccacagattgattccaggccacacacagtagctgaagaggccaggctcctccccgaccactgcacactcggcacgaacttcccgtggctccaccccattttcccagtatgcaggcaggtgattctccagggaccctcccctttatctgtctcctgcatctatcattatctattttattttatacatttaaaacactattctgccgggtgtggtgacctgcacctgtagtcccagctactcaggaagctgaggcagcaggatctcttgaactcaggaggtggaggctgcagtgagctatgatcatgacaatgcactccatcctgggcaacacagcaaaaccttgtctcaaaacaaacaaacaaaaaacaaaaccccaccattattctcagaagtacagcagctttcacaaattgccaaaggggtctgttttaggttagtttccttcagaagcagatctggagacaaagatttgaagcaaggaggttattagagaggaaatccctggcataattgataaagtagacaggaaagggcagaagccagcatggggtgcatcgatgagcaatgaacttaatgaactccttggctcaatcccactgggaccttcaagagactactgtatagagcatgcctcggagtcatcctacccttgaggaagctggggtatttcttcaccaaatcccatttcacttgagggctgcccccagggcactgacatttctagcctgccctacccatgggtagtgctcctgtgactagggtaagtcctcaacagtgtcagaggcttaaagacggagccatctgaatggcaaccttagaggacaagtgggtagggcacaaagtttggctacaaggcctgcagcactaaaaggttaggaacgcctcagagctgccccttttaggatggacccactcagctccccggttcccactccctgacatctgctttctgtccgctgctcagtgtctccagtggattcacaaaacaactgcctttctccctttccacctcagttcattatcaagaacaaccctggggtttcccaccttaatcaggctgctccggcctctgcccacagcccttctgacacctggtttatgtgtgaccctgccacccttaacccccagcagcaggggatgtcagctttctttcagggaagaacacagactccttttgagagactatagtgagataattttgtaaactgaaaataaaatcctaagccccccagttgacttaatggaccccctcttggccaaggggaccccagagaaaccttaaaaactgagttcccaggcaggagaggatgggaggtcagacacacctcgtcatacctcatcccttttgtggtttagacaaccactgaccagcattaataaaccagagatcataagactgacagaacaaagtatttgagccaatgaaagaccaaactataaacaagacttaaggccatggcaggtcagggttaagtcacacacccctgcacttaaagaaaaagtgttctgccacaaggttttaatttttctctagcagccaaacaaacattggccttgagataagcaagattaaaacaacttgcagatcgtccatcagccaaaactacagcttgggttgaacacgagactgatttcagtaaccttctcctgataagaagactactgaccatggactggttctggctggtttacagatgctgcatacttgagtttgcttgtgtcctgaaaagaccttttgatgtataagacctaattgtaatacatttatttttttttaattaattttttttttttttgagacggagtctcactatcgcttaggctggagtgcagtggtgcgatctcggctcactgcaagctctgcctcccaggttcatgccattctcttgcctcagcctcccgagtagctgggactacaggcacccgctaccatgcccggctaattttttttgtatttttagtagagacggggtttcaccctgttagccaggatggcctcgatctcctgacctcatgatccatctgcctcagcctcccaaagtgctgggattacaggtgtaagccaccgcgcctggccagctgtaatacatttaaatgctaagtctccaccctaaggtgcacatgggtcatatgcaatatactagtttattcagtatatgtgcttcaggaccactttcatgaatattcatagctccttctgtaacctgttgaatatgtatacttggccaacccagtcagattaaattcctttcttattcctcctcgtccctcaaagttcattctctaggctctgccagaggctatgcttcccactagtccgaatggtacattgtaggctgcaactctttatttttattttatttttaaatttatttttgagacacggtctcactctgtcacccaggctggagtgcagtggtgcaatcacagctcactgcagcctcgacctcccaggctcaggtgattctccaacctcagcctttcaagtagctgggaccacatccgtgcaccaccaggcccagttaactttcacaattttcttggagacagggtttcaccatattgatagatgcaggaggtagataagggaaagggtccccagagaatctctgacctgcctatgcacttgggagaagggggtggagccacgggaagttcgtgccatgtgcagttggggaggagcctggcctcttcagttcttgtgtgtagcctggaatcagtctgggggtgggggtgctgttggcaggaactcttcttgctttgctgagagatttttttttcttcttttcctttttcacccaataaattctgttcccctcacccttcaatgcgtctgcgttcctagcttttcctgcttgtgtgacaagaacctggttttagggtttaaggaacaaagttctgcatcaataagattcaaaagaaatcattctattgaaatatgattctaggcacaggctagttgggggtctctgagccccagatcccacagctgtgctgagatgcctgcccacaagctcaaggagcatgtctaggagtccacggaggcaagcagaggcaggaagaggagaccagaattcagctgccggtggtgagcctcaggaaactctttatcaaagcctagaaaagccaaaggtgggcccgagagggaagaaagagacaaagagatgggaagaagatggaagtaggacacttagagtgggaaggaaaaagagcaagagaaagtgagagggagcagcagagccctgggaagggagcttgaaggggtggggcacgtttggaagcctctgtgattatttggggaaggctgattttctagtgccttgggctgggcccatgcaggttacttcctacccagctaccttcctggctcttctgcccagggagctccttctgccagtccccagcctactgcacttcttccttatatgcttggagtgtgtggaatgctgctcaccactctggggcagttggagactgagataactccctccctggaatgtagggaatttggtgtgctggaaagagagaaagagagagggagacagaatgtaccttgcagcagcacagctgggttctggatgggctccatctctgaaagagaggggcaaaagggttggggaaggggtagctgccggtcttagtgaagggtccccgaggcactagcgtgtcctcacatttgtgctgcctgcttcccagaagactcagcacatggggaaagtggtgccaagggcacacccaccagccacactgtggagcttggacacctggggcaggatattcagtagtcggcctggggacctccaaagatgctttcccattccttagcctgtcagccttggtagggacatcactttcctccttatccttcaatgaggacattcaagacaacatccctgagctggaggaaacccagcctcacctcctccttccacccctcatctcctaagctccccatcagtggtgtctggggtgtggaacgtggggaggcaaggaagacagctcacctggcccaggcttcaatgctcagcccctcttattccttctagcaagagcttcttgcaaatacctcaatttttttttttatcttctgcagctgatgctcaaactgtcaacttgttacttgagaccatgaatgttggttataagaatttgttgactttttaaaaaaataaaaatgatgtttgcccacttaaagttttaaattctgtttttcagaggagtttttttttttttttttttgagacagtcaccctctgttgatatggctctgatgagtggaggaacaccagggctcttgtctcacatcgaattagataagatgacacgaacacacgtggagtggttttaaggagcggagagtttaataggcaagaaagaagggagaagaaagaaagaagaaactcccttgtacagagacagagggaggggggctccaaagccgagagatggaaccccgcacttaggtaataccagccagctatattcgatgggtggaggaggcagtatctgatctgcataggactcaggggattggtttgaccaggcatgtcattcatgtagccggcgaaaaagctggccctcccaccctagccttttaatatgcaaatgtagggctgtgtcatgttccacacacgtggggatatgtgggggcggccatgctgccaggcacatgtaggggcaagggcaagaggacaaaggtgggaatagccttgttgggtggacccagtttctaacagctagcgtttgcatatcaaaggttgctggcccaagtctaagagccagggctttcatgctagacaagagctgtgaaaaattttccatggacctttttcctctctatctgcctaaaataatttcttaataactcctacctcactgtagcctaggttggagtgcagtgtggcaacatctcggctcactgcaacctccgcctctcgggttcaagcaattctcttgccatagccacccacatagctgggactacaggcacccaccaccaagcccggctagttttttgtattttagtagagaggggtctcaccatgttggccaggctggtcttgagctcctgagctcaagcaatccacctgccttggcctcccaaagtgctggaattacaagcatgaaccactgtacctggcctttcataggagattaatggctgattttacccaccaacctggtgatcatgaaccagccatctataaccttgttgatctagctcaacccattatataaaactgtgcttggattgtatggaatgctacacacttacaattaaagatatttagagctgggcatggtgggtcacacatgtaatcatagcactttggaaggccaaggagggaggattgtttgaacctgggatttccagagcagcctaggcaacatagtgagaacccatttctttttttgtcttttcttttcttttcttttttttttgagatggagttttgctcttgttgcccaggctggagtgcaattgcgcggtctcagctcactgcaacctctgcctcctgggttcaagtgattctcctgcctcagcctcttgagtagctgggattacaggcacgtgccaccatgcccggctaagtttttgtatttttagtggagatggggttttaccatgttggccaggctggtctcgaactcctgacctcaggtgattcacccccctcagcctcctaaagtgctgggattacaggcatgagccaccatgccaggtgggggtaggtggggaagcccatttctattaaaaaaaaaaaaaaaaaaggccaggtgtggtggctcatgcctgtaatcccagcactttgggaggtcaaggcaggaggatcacctgagatcaggagttcgagacaagcctgcccaacatggtgaaaccccgtctccactaaaaatacaaaaaattagccgggcatggtagcacgtgcctgtaatcccagatactcgggaggctgaggcaggagaatcacttgaacccaggaggcggaggttgcagtgagttgagatcctgccactgcactctagcctgggtgacagagggagactccatctccaaaggaaaaaaaaaaagagaaagtaaaatttgtacttcaattcagagattataaacaatgtatacttgactttgtggcagtgatcactattgtacaatagttacttaaactcaggaggcagaggctgcagtgagccaagatagctccactgcactccagcctgggtgacagagcgagactctgtctcaaaaaaaaaaaaaaaaaaaaagttactcactcatttgttctgcagaatctatttattgctgtgttcacagaaaaggaagcatcaagacggcaaagctctttgatgaaaagccaggcgtactcacacacacaactgagaaagttctggaagtaggagaaaacgtctttaaggcatataggctaaacttatataaatattgttagtgtttgccaaaacagggataatctagtaaaatcagagatacaaagccagaacagagaattggtaagtaaaaaattgttaagaatgtatattggctgggcgcgatggctcatgcctgtaatactagcactttggggaggctgaggggggcagattgcttgagctcaggagtttgagaccagcctgggcaaccctttcactactgaaaatacaaaaaaaaaaaaaaaaaaaaccaaaaacaaaactgggcgtgctggtgcgcacgtgtggtcccaattaccctggaggctaatgtggaaggatcgcttgagcccagagtgtgggggtgggggttgggaggcaaggttgcagtgagcctggattgcaccactgcacttcagcctgggtaacagagcgagaccttgtctcaaaaaaaaaaaaagtatcaaaaggcctaggaatttgttctccaggtaaatctgccctccctcatctctaacctttatgaaatcacccaaatggagacatcacagcaaggccccgacaaggaaatgaggaatgtaggtggataagggactggaatagtgcagcacaacactaactacaggtttcagccccaatgagattgccctcacttccgccgccagccacaagtgtggaggtccccaggctactcgctcctctgaccaactggctactaatctggggggtacccacaaccccctcgggtttgataatttgctagaacaactcaccaaactcaggagaatgttatacttacgattacaggcttgttacaaaggatacaaatcaggaggaccagactaatgaagacacacgtagggcggggtctgggcgggtcttccatgcagagcttctgtgtcttctctctgtgaatcaggttgtgtcaccctcctggcacatggatgtgttcaccaaccaggaagctccaccaaattttggcgtccagagttttcattacataggcacaattggttgactcatttgccaccgaattgaacgcaatctctagtcctcccaccctccgtcgaggttgggctggctctaaggcccaatccttttattatgtgatctttctgatgaccaacctcccatcgtgagttctctcttagcataagcccaggtgtgatccaaggggctcatgaataacaaagatactcatattactcaggagattccaaggatttagtttccctcctaggaaccagggacaaagggcagtcaaattctttattgttatcacagagacacagtaatataatatgatacagcagaagagaggtgaggaatgttgccatgccttgagaagcctatcacaagagctttaaggaattcacacttaaatattaataggtacattatgaaagaaatcagccaagtacagtcttttcttattatggaatctagttattgcaggaattgaaaaattgatgtaataaagcctagaatgcaataaaggaatcggcattcaagtagatgagagaggttggggaatatgtcaagatgcaaaagtgagagagctgtcacagtttacttactctgcaatctctgaggatggaacaggatcaaagatgaagccaggaagcacagagtagttttcttcctccctaatctcatcccttgttttcatttggcactttaaaaaatttccacatttatattcatatggaattgattttgagtatagagagataattctaattattattgtttttcaaatgttagccagttgaaccatttatcataatcaaggtgataatatggcttattttctttggcctacagagatgataaatttgaatatattttaaaatataaaactatctttaaaatttgaatatatttgaatatgatacatttgaatatattttaaaacatagagctatctttgtactcctggttagtcatggtgcatttttttttaatacttcatattaaatttttaccttctggattgagacactagagttcttaaaggttctttcagaaattcttcctatattcagtatgctaccagaaaacctcttacaactaaccttacagaagatactgttttctttgtactttgtccaatatcaaaggaaacctccaagttccaaggaggtcaggctactaatacccacaaatgaattctgatgagatcattacacaataaacaataactgttgcttattacatgcttactttgtactaggcaggactaagataagtattatttaagttttaagatcattcttaatttcttgtcaaaagtatactggtttgcaaagtaatgaataaaataaatctttaacaatatccctatagtaaagacaatggtgaacttcttatgcctcttttaaaaaactctgcttatgatgacaatttcaaacatacacagaagccgtgagtatataatgagtcttgctgtatccatcacaaagttttaaaaactgtcaaaagttgaccatactcacttaatctactcctaccactttttcagctggagatcttttaaagcaaattctacacattgtgccatatcatccataaattattttgcattacatcccattcttattgagtccctgcaagctgagagccgactgccaaagcacaattcactgtaagagattctgtgaagggttaaaacaaacagtccaaattcacagtgctgcaaatgtctgtaattgcataatctgcaaaatatattcttcaagaaatcctctgtgcacttggtttcccttaactgagtttttttttcttcttcagaccagattaattgatgagaactgacaagcaggggagagaggtgatgtttaaggttatatattttggcaaaaaattatgagtgtaaattgtgcttgtttctgattaagagaggtccattaatcagaaagtaaacttggcatcctcgtagaaaaatcacatagcttaacaagaattcatgactctgaattgctgcacagacaggtagcatgagttcttggcaggattctttcagctgagctgttttccattagaatggtgtctgatatggtttagctgggtctccacccaaatctcatcttgaattgtagttcccttaatccccacgtgtcatgagagggacctggtgggaggtaactgaatcatgaggggcaggtttttcccatgctattcttcttgtgatagtgaataagtctcatgagatctcatggttttataaaggtagttctgcacacgctcttgcctgctgccatgtaagacatgcctttgctcctccttcatcttccaccatgattttgagggcctcctcagccatgtggaactgtgaatgcattaaacctctttttctttataaattacccagtgtcaggtatttattcatagcagtatgaaaacggactaatacggctgggtgcagtggctcatgcctgtaatcctagcactttgagaggccgaggcaggtgaatcatttgaggccaggagttcaagatcagcctggtggtcaatatggtgaaaccccatctctactaaacaaacaaacaaaaaaaattagccatgcatggcggttggcgcctataatcccagctacttagaaggctgaggaaggagaattgcttgaacctgggaggtggagggtgcagtgaaccgagattgtgccaccgtactccagcctgggtgacagagcaagactgtctcaaaaataaaaataaaaaaagaaaatggattaatacagtaaattggtaccagtaaagtggggtactgctataaagatacctgaaaatgtggaaatgggtaacaggcagaggttagaagtttagagggctcagaagaagacacaaaaatgtgggaaagtttggaacttcctcaagacttggagggctcagaagacaggaaaatgtgggaaactttggaacttcctagagacttgttgaatggctttgaccaaaatgctgacagtgatatggacaatatttgtccaggctaaggtggtctcagatggagataaggaacttgttgggacctggagtaaaggtcactcttcctatgcaaagagactggcggtattttgcccctgccctagagatctgtggaactttgaactgaaagaaatgacttagggtatctggcagaagaaatttctaagtggtaaagctgttcaagtggaagtagagcataaaagtttggaaaatttgcagtctgatgatgcgatagaaaagaaaaacccattttctagggagaaattcaagtttgctgcagaaatttgcataagtaaagaggagtggaatgttaatcactaagacaatggggaaaatgtctccagggaatattagagaacttcatagcagcccctcccatcacaggcctggaggcctaggagggaaaaagggtttgtgggctgggctaagggacccctgctctatgcagcctggggacatggtgccctacatcccagctactttagctccagctgtggctaaaaagggccaacctacagctcaggccattgcttcagaggttccaagccccaagccttgatagcttacaaatgtgctgggcctgtgggtgcacagaagtcaagaattgaggtttgagaacctctgcctaggtttcagagcatgtatgtaaatgcctagatgtctaggcagaagtttgctgcaggggtggagcccttatggagaacctctgctagggcagtgcagaagggaaatgtggggtcagagcccctacacagagttccccaccggggcattgcctggtggagctgtgagaagagggccaccatcctccaaaccccagaatggtagatccaccaacagcttacaccatgcacctggaaaagctggagacactcaacactagcccatgaaagcagctggaaggggggctgtaccctgcaaagccacagaggcagaactacccaatgctgtgggagcccatctctcacatcagcatgacctggatgtgagacatggagtcaaagggggagcattttggaacgttaaggtttaatgactgccctactgtatttcagacttgtatggggcttgtggcacctttattttggccaatgtatcccattggaatgggtgtatttacccaatgcctgtacccccattgtatctaggaagtaactaacttgcttttgatttacaggctcataggaagagggacttgccttgtctcagatgatactttggagttggacttttgagttaatgctgaaatgagttaagactttggtggactgttgaaaggcatgattgtgtgttgaattgtgaagacatgaaatttgggaggggccaggggaggaatgatatggtttggctgtgtctccacccaaatatcatcttgaattgtagttcccataatccccatgtgtcatgggagggacttggtggcaggtaactgaatcatgggtggcgggtttttcccatgctattgtcatgatagtgaataagtcttatgagatctgatggttttataaagggctgttcccctgagcatgctcttgcctgctgccatgtacaacatgcttttgctcctccttcactttccaccatgattatgaggcctccacagccatgtggaactgtgaatccattaaatctctcttccttccttcccttccttccttcctttccttctttcttttcttttcttttcttttcttttcttttctttcgagtctcactctgtcacccaggctggagtgcagtggcatgatctcggctcactgcaacctccatctcctgggttcaagtgattctcctgccttagcctcctgagtagctgggattacaggtatgtgtcatcacagctggctaatttttgtatttttagtggagacgaggtttcaccatgttggccaggctggtcttgaaattctgacctcaggtgatccgcctgcctcagcctcccaaagtgctgggattacaggcatgagccacgcgcccagctcagaattataaattacccagtcttgggtatttcttcatagcagtatgaaaatggactaatacattatctcttggaagtgaatggccagagtgaaagaaaccagaaaaaaaaaaaaaaaaagaagaatacatactatatgatttcatttatataaaactctaggagaagcaaataatctacagtgacagaaagcagatcagtgagtgtttgagaatgggcatggcaggagggaaggaagtataacgggcatgagaaaacttttgagaggtatggatgtgttcactatcttgattgtggtgacagtttcatagtatacaaatacgacaaaactgatcaaagtgcacactttaaatctgtgcaattatgtctcaataatttttttttttaaagaatagccaaggccgggtgcggtggctcatgcctgtaatcccagcactttgggaggccgaggcgggcggatcacgaggtcaggagatcgagaccatcctggctaacatggtgaaaccccgtctctactaaaaatacaaaaaattagccgggcaaggtggcaggcgcctgtagtcccagctactcgggaggctgaggcaggagaatggcgtgaaccccagggggcggagcctgcagtgagctgagattgcgccactgcactccagcctgagtgacagagcaagactccctctcaaaaaaaataaaaataaaaaaataaagaatagccaagtggtagaaagcctgcagatgctgttccagagctgtgcccacagctctgggcccaggtcacaggtataacctgcaataagaagagacaagagtctgagggctgaccatctgtgggcccacaagttaaggaaaccaaagtttgggtgcacaaatcattactggaaagggatcctgatccagtcacttctcaagagagggttcttagacattgtgcaagaaagaatttggggcgagtccacagagtaaagtgaaagcaagtttattaagaaataaaggaataaaagagtggttacctcataggtggagtggctctgagggctgctagttggctatttttatgattctttctttcttttcctttttttttttttttgagacacagttttgctcttggagtgcaatggcgcgatctcagcttattgcaacctctgcctcctgggtttaagcgattctcctgcctcagcctcctgagtagctgggtttacaggcatgcaccactcccagctaattttgtatttttagtagagatggggcttcaccatgttggtcaggctggtctccaactcctgacctgaagtgatctgcctgccttggcctcccaaagtgctgggactacaggcatgagccacagcgcctagccaattatttcttaatcatatgctaaacaaggggtggggtatccatgaattttctgggaaagggatggagatttcctggaactgtgggttcttcttccttttagatcatatagggtaactctgggacattgccatgacatttataaaccatcttggtgctggtggggggtgacttttggcatgctaatgcattataattagcatgtaatgggcagtgaggatgaccaaaagtcacttttgtcaccatcttggtttgggccggcttctttactgcatcctattttatcagcgaggtctttgtggcctgtatcttgtgctgacctcctatatcatcctgtgactaagaattcccaacctcctgggaatgcagcccagcaggtctcagcctcattttacccagcccctatttaagatggagttgctctgattcaaacatctccgacaaaaccactgattgggtatagagtcccaaccagccagttattgaaattttgtttttttgttatcacagcctagcctaatctaactaaagaaagggggatcaggaagcaactttattttcacttcaccgtgtccctttacatccattttgtgggatttcttctccttttgccccaagatgaaatttggagcaagccccatgaactttctagtcatttgtaggtaatctaaggtcattgggttactccaattccccaaggagtttaataagtaattaaatggtccaatctcatgtaatagtagaaactttaaactttatttaaatttgagatttcttcccgtactttatgctatttacagaccagccacgctcaatgggaattgaggtgtgtggtgacctctgatttcccactttgcgctttgtggcagaaattgcagttatcaccaaatattcattctcctcttcttcctgattagtaagactcccaaatttttgctggacttatggccagcctgaaacaagactacattttccagtatcccttgcagccaggtgtggctgtgagactaacttttggccaacggatctgaatcagaacaacataagcaaccttttgttctgccctcaaacagcatgggtggcattagtttcccctttccttctttccctggctggaatgctgacccagcagatgtggggagccatttcaacctttcaagagagagcagccctcgatgcaatggcagagcagcaagacagaaggagctggggtctccaacaccgcggagtcactctatccagcctaagactcctgatgttggaactgttaatgagaaacacactttgtcttttgacatacagtttttctctcagctgctgaacctggattctacctacacaggttcattgtgtatgcatgcttctatccctcctccctcatcttgctaacttggaccctggacctctccagggttccagtggtgagagggaggggccaggaggtttcattgcactagaattactgtgagatggcagaagcactgcctgggtcattaggcatagctgattcttcctttcatcaggcacttccgttgatttttctgagctaacaccttccctttgctacgatttctcatcacctaattccctgaggtggacaaatgcccttccttaggctggtcaactatatttctttctgcagcttctaagagtctgacgattcatccctctattaggatcaccaaaccccttcagatgacccttttagacagagtctaatgccatcccctgccatctctctcttatggtggccccacctgtggtccacaggaaacatgaatccagtgcccccggcaattgcggaaggctggcagccctgaaacccagctacctcccttgttccaccatcagggcaggtagccagactcctggtgttcttttttgttgtgtgtgtgtctttgtgtgtatatgtgtttttccatttccagaaatgaaccagctagctgctcaccctgtcctccaaattgcaggaacatatattcagctccctgacgggtaccaccaaaggccctttcctggggctcgaagaaataccctcactgaattcaatttcctcaagtaattgaagatcttcccctttcccctttcctgttccactcgatggcccccactttatggggacactcccaggccggggactgcagagttgctctgctacttttggactctggtccatctcattttttcccccctctcttccatttaagaggagattcaacctttttagaagctcactgttttgagtaagagccactgtttgccagatcccagccccctctgcctctaccatctgcctcatctcttctatagctgcagaggaattaacatcctcggaagatctagtgaagctgccttcactttctctttctgccttcacatttctctttcagcccacctcaacctgaggccacaggcagctgggctccaccagtgccactgccaccatcccaaaaggccaggggctctcatcccagtagtagtaattaatctgtcatgcacaattcatagtatttcaacattaggttccaaataagtaacctgagcatccctgggtcttgctaacctatgggaatgtgcaaatggggccaccttaagatagtaacaacatttcagtgtctccttctctgcccaagtatttctgggggtctgagggaaatctcactcgtgctcctaaatccaggcacccaggccaacagcaactctccatcgcctgctgagcattcccccagggaaccggagcccttcaggcatcaattctgcattgggcagagcagtgtctatgtccagtggggaaatgcctttcccctcttttgtgttcctgttcacgaaggggccacccaagcaatgctggtgggctccagcattgtgcagagcttgtagaaccacagcttctatgttgaccttcagctttctttttgcttcggatggaggcaggactggactaaatgtggtgacaaacaacattcatttactcttttattcaacacatatttcctaaattccttatccatgctagccacatgatgaacatgataaacaagataaacgtggtctctgtgcccatggagtttatggtttggtacaagatcaaaaagcggtatacacatacacaaacacgaacaaaaaagcagttatgatttaatgtccaagactttgttattggttcaagtttatcatgcatggatgcttcttctgcttggatgagttttgtgcgtgcagcttgtcaactctcaggcaaacaaacagaccctgtcaacccactgcgacctcactgctcccgggctgcctgctggggcccagtgagggaggttaactcttactgtgctaaagtgtctgatttgtttcaacactctaacaaccaaagaaaacactgattgtatctcttaaagagcttttcttccttccccattccacactatgaatttatgaattccaaacttcacactttatgtaaatttgaagcttctggccaagcgtggtggctcatacctgtaatcctagcactgtgggaagccaaagcggatgattgcttgagctcaggagttcgagaccagcttggacaatgtggtaaaaccccgtctctaccaaaaatacaaaaattagccaggcatagtggcacacgcctgtaatcgtagctactgggaggctgaggaaggaggatcactggagcccaagaagtcaaggctgcagtgagccatgatcataccactgcactccagccttggagacgcagcaagaccctgtctcaaaaaaataaaataaaaataaaataaataacatttgaggcttcttcacttactttgtgccatttacaggccagctgctcctggtgagaatggaggtgtgtagtgatctctcacttcccactgtgtgctttgtggcagaaactgctgttgtccccaagtatccattctcctcttcttccttactaatgagactcccaaatttttgctggacttgtggccatcctgaatcaagactacatttcccagtatcacatgctgtgggactagcttttggccaacatgatctgaatcaaatgatgtgagcaaccttttgttctgccctcaaatggcaggggtgatggcaaaaattctggcagcaaaaatggatgatgtggccaggcatgctggctcacacctataatcccagcactttgggaggctgagatgggtggatcatctgaggtcaggagtttgagaccaccctggccaacatggtgaaaccccatatctactaaaaatacaaaaatgagccagatgtggtggcacccacctgtagtaccagctactcaggaggctgaggcaagagaatcacttgaactcaggaggcggaggtggcagtgagaagagattatgccactgcactctagcctgggcaacaaagcgagactctgtctcgaaaaaaaaaaaaaaaaacgatggtgaaggcctatatattagtctgttttcatgctgctgataaagacatgcctgagactgggtcatttataaagaaaaaggggtttaatggactcacagttccatgtggcaggggaggcctcacaagcatggcagaaggcaaaaggcacatcttacatggtggcagacaagaagagaatgagagaccaagtgaaagggatttccccttataaaactatccgatcttgtgggacttactaccacaaaaacagtatgggggaaaccactccctgtgattcaattatctcccatcaggtccctcccacaacacatgggaattatgggaactacaactcaagatgagatttgggtggggacacagcccaaccatatcattctgccccagcccctcccaaatctcatgtcctcacatttcaaaaccaatcatgccttcccaacagtcttaactcatttcagcataaacttaaaagtccacagtccaaagtctcatctgagacaaggcaagtcccttccaactatgaggctgcaaaatcaaaagcaagttagttacttcctagatatagtgggggtataggcattgggtaaatacagctattccaaatgggagaaattggccaaaacaaaggggctacagtccccatgcaagtccaaaatccagtggggcagtcaaatcttaaagctccaaaattatctccattgactccatgtctcacatccaggtaacactgatacaagagatgggttcccatggccttgggcagctctgcccctgtggctttacatggtacagcccctcttctggctgctttcatgggctggtgttgagtgtctgttgtttttccaggcacacagtgcaagctgtgggcggatctaccattctggggtctggaggatggtggccctcttctcacagctccactaggcagtgccccagtggagaccctgcatgggggcttcaacctcccattttcctcccgcagtgccctagcagaggtcctccgtgagagctccaccgctgcagcaaacttctgcctggacatccaggtgaaatctagttggaggttcccaaacctcaattcttgacttcagtgcacccacaggctcaacaccatgtggaagctgccaaggcttggggcttgcaccctctgaagccatgacccaagctgtaccttggccccttttagccatggctgggatgcaggcaccaagtctccaggctgcacacagcaggggggccctaggcctggcccacaaaaccattttttctccctagtctccaggtctgtgatgggaggggctgctgcaaaggtctctgacacgccctggagacatttaccccattgtcttggtgattaacatttgactcttcattacttatgcaaacttcttcagctggctcgaatttctcctcagaaaatgatttttttggctgggcgtggcggctcaggcctgtaatcccagcactttgggaggctgaggcaggtggatcacttgagttcaggagttcgagacgagcctgggcaaaaccccatctctacaaaaaatacaaaaattagctgggcacggtggctcacgcctgtaatcccaacactttgggaggccacggcaggcagatcacttgaggtcagtagttcaagaccagcctggtcagccaacatgatgaaaccctgtctctactaaaaatacaaaattagctggacgtggtggcatgtgcctgtaattccagttacttgggaggctgaggcaaaagaattgcttgaacctgggaggcagaggttgcagtgagccaagatcatgccactgcactacagcctgggtgacagagctagactccatctcaaaaacaaacaaacaaaaaagaaatgggtttttattttctatcacatcgtcaggctgcaagttttctgaacttttatgctgtgtttcagttttaaaactgaatgcttttaacagcacctacatcacctcttgaatgctttgctgcttagaaatttcttctgccagataccctaaatcatctccctcaagttcaatgttccacaaatctctaggtcaggggcaaaatgccaccagtctttgtggtaaaacatagcaagagtcacctttactccagttcccaacaagttcctcatctccatttgagaccacctcagcctgtatttcattgtccatatcattatcaggattttggtcaaagccattcaacaagtctctaggaagttccatactttcccacactttcctgtcttctgagccctccaaactgttccagtcgctacctgttacccagttccaaagttgcttccacatttttgggttactttacagcagcatctcactcccattaccaatgtactgtattagtcccttttcatgctactgataaaaacatacccaagactgggtaatttataaagaaaaagaagagatttaatggactcacagttccacatggctggggaggcctcacaatcacaattgaaggcaaaagccatgtcttacatggtggcagacaagaacagaatgagagactaagtgaaaggggtttccccttataaaaccatcagatctcatgagacttattcactaccatgaaaacagtataggggaaaccacccctgtgattcagttatctcccaccaggtccctcctgcaacacatgggaattataggagctacaattcaagatgagatttggctggggacacagccaaaccatatcagtttataatcccagcactttgggaggccaagacaggattatcacttgaggccagaagttggagacttacttgggcaacatagggagacttcctctctaaaagcaaacaaaaaaccaagttatccaggcatggtggcatgttcctgtagtcctagctgttccagaggctgagttggaaagatcacttgagcccaggagttcaaggctgcagtgaaccgtgattgtgccactgtactccagcctaggcaacagagcgaggccctctttctctctctctctttttttaaacaaggaagaaaaaagaaaagaaaatagggtggtgaggaggctggccaaagtggtgataacctcgtgcactaggtcctagcagctggtagcaggggagccaggaggtgtagcactctgcctggtaaagcagtctgtcagggtctgtttgcctgagagttgacaggctgcaagcacaaaaatataaaagggggccagggacttgctaatcttgccggagagtcggcgcagctcagtgcaaggacttgggaaggcagggaactttgagagaaggtaaaaaggaggtggattcatggagagggaaggggaaagttgagggttggggaggtgtggtgaggagctgagatcttggagagacattcttcgttggcctagggacaccacataaacacctctgtgcatggtgggagggaccagctcctccccaaacactgtttagattttggccttgaaaaccatgactactaacgttccttgggttttctgtgagtgtgaccagtctcctcagctcccagctggcacataaaggagatgtgttcttttcttgccgatgtgaggctacaggatctcatgaggaacatcccatgaacaaacagtacggctgagccctcacctgcgtctcatcctaatcttggtcctcccccagcacactcccagctctatcgcctggagttacagacaaacccgcagaccaatgtgaaaagccaattgcccagagaaacccagcagagtcttcagctacgcctgacagtcatccggggttaaacaccagcctggaattttagcttcctgtccaggaaaaaccaaatacataaatcacttctctctctctctcttttttttaatggagtcttgctctgtcacccaggctagagtgcagtggtgtgagctcagcttactgcaacctctgcctcccaggttcaagcgattctcctgcctcagcttcctgagtagctgggattacaggcgcgcaccaccatgcctggctaatttttgcatttttagtagagacagggtttcaccacgttggtcaggctggtctggaactactggcctcgtgatccacctgccttggcctcccaaagtgctgggattacaggtgtgaaccaccacgcccggcctaataattcatcttactactagaatttcaggcttcctttttaatttgcttgctttcttgttggtctgtgtcttggaacataggaactttcaatccctccaatatgggctccatccaaatctcaagttgaactgtaattcccagtgttggagtgttggaggagaggcctggtgggaggtgattggatcattggggcagatttcccccttgctgttctcgtgatagtgagtgagttcccacgagatctggttgtttgaaagtgtgtagtagagccgggcgtggtggctcacgcctgtaatcccagcatgttgggaggctgaggtaggcggatcacctgaggtcgggagttcgagaccagcctgaccaatatggagaaaccccgtctctactaaatacaaatttagccggcatggtggcacatgcctataatcccagctacttgggaggctgaggcaggagaatcacttgaacctgagagatggaggttgctgtgagccgagatcacgccattgcactccagcctgggcaacaagagcaaaactctgactcaaaaaacaaacaaacaaacaaaacaaaacaaaaaaacaaagtgtgtagtacctcccccttcactttccctctctcccactccaccgtgtgaagaaggtgtttgcttccccttgcccttctgcccagattgtaagtttcctgaggcctccccaagcatgattcttgtacagcctgtggaactgtgagccaattaaacttcctttcttcataaattacccagtctcaggtagttctttatagcagtgctaatacaccctgttacaggactaatacaccttccctctgctaagtgtctattgatctgaaaacacatgctatgaaacattaaaacgctacctgagaccatgtgtttcttttatcaagtgagagattcctttataatttggataatttcactccgtttgcaagtaggatgctctagaactgatgttataaagtcagtttaatgatttaaatcccattgtggagaaaatagatctctgcagaaaagtacatccctgccctttcccagctccccagtcaagggggggcttcctgctgagcctggagaatgcctctaagaaggtgactaatgtaccatatctggcccctagtgtgggcagcaggcaagtagtcaggtgccttctcaagtggagaaagttgaacgctattttccagagacattggatgtgagggtgatctggctatgacatctgtcaccccagtgattgccactgttgattctgctgatctagctggctaggtggtgtccccttcttccctcaccactccatgtgcatccctcctgaagctgtgtgctcagttgaagaggaggaccatccccaatagaggaggaccagtcttcggctaagggtatacgagtagctgcgctcccctgctagaatctccaaacaagctctcaaggtccagagacaagatgtgaacttcatgtctcaattgatgatcacgtggttgtgtggtggtgcagattgtgtttttgatgtgcagcaggatttgggcagtacagaggatgatgtcagcatatcaccatcatcctcaggtggggcagatcattatgaagtccttgcctctggtttccctggagtctaggtgagaggtgcatgagatatcccttgggtacctccctcctcccctcaaggtgaatgtttcatcaacaaaatcaagctaatagaagtctcaggttgtcacttttggtgtcttgaataggatatttgtgtgagagcccctttgattaacccattgccagccccctcccaccctgacctctgaaccttcacaatatccatcccttaccctccccgctgaccaagtggctctggatcccagtcaggcgctaaaaatctgctatttgtgcttaggttagctttacccatagctgaatggctctgaggttcacggtggaagatctctaagggggacagttttgctgctcctgggatggaataggtatgatggtgatccatccacctgcaagttctggtttcccagtacgtatatgatttagaattagaagcacataatacatagccttgttactggcaccccttcccctaatcttgctttccctttgtattaggccattcttgcactgctataaagaaatacttgagactgggtaatttgtaagaaaagaggtttaattggctcacggttctgtaggctgtacaggaagcatagcagcatctctttctggggaggccccaggaagctttcaatcacggtggaaggtgaagggggagcagggatctcacatggcgggagcaggagtgagagagagtgatggtaaaggtgctacacctttttaaatgaccatatatcacaggaactcactcactatggtgagtacagtgctaaaggggatggtactagaccatttatgagaaatctgcccccacgatccaatcacctcccacaagaacccacctccaacattggggattacatttcaatataagatttgggcagggacacggattcaaactgtatcacccttcatatcatcctttataatactatgccaatctgatcatggccaggttcaacttcttttttaaaggcttcccagagactactgaatcttatgacccaaatctctttgcatggcagacaacttgctgaagaaagcctgtctggctgggttcagtggctcacacctgtaatcacagcactttgggaggcctattcagtttgcgcctaggagttcaagaccagccagggcaacaaagagagaccactgtttaaaaaaaaaaaaaattagccaggcattggggtacatgcctatagtcccagctactgaggaggctgaggtgaggggatcacttgagcccaggaggttgaggctgcagtgagctgagatcacatcactgtactccagccttagtgtcagagtgataccctgtcttggaaaaaaaaataaaaaagaaagaaagcctgtctgatttcacgaaaggtttttgcaggacacgcttttagtttccacaaaacagccaccctctacttccttactggcaaagctttcatgaatattatttatttgccatttcagtgctgctttctcagatataggcataccttggagatattgcgggcccagttccagttcatcacaataaagggaatatctcggtaaagtaagtcactaagtttttgttttcctagtgcacataaaagttatgcttacactatattatggtctattacgtgtgcaatagcattatgtcttaaagaagtacataccttaattttaaaatactttattgctaaaaaatgataatgattatctgagccttcggagagttataatccttttgtgggtggaaggtgtgttgctgtctgatcagagtgggggctgctgaagcttaagtggctatggcaatttcttaaattaagacaacaacgaagtttgccacatcgattcactcttccttttgtgagagatttctctgtagcatgtgatgctgtttgatacatgttacccacagtaaaacttcttttgaaattggagtcaattctctcagaccctgctgcttctttattaactaagtttatgtaatattctaagtcctttgttgtcatttcaacaatgttcatagcatcttcaacaggagtagattccgtctcaagaaaccactttctttgctcatccacaagaagcacttcctcatctattcaaattttatcatgagattgcagcaattcagtcacatcttcaggctccacttctagttctctggctttttctaccacatctgcagttaccgaagtcaggaacccctcaaaagtcattcatgaaggtttgcaccaaacttcttccaaacttttgtaaatgttgatattttgacctcctcccgtgaatcacaagtgttctttttttttctttctctctctctcttttttttttttttttttttttttttgagacagagtcttactcttgttgcccaggctggagtgcagtggtgcgatatcagctcactgcaacctctgcctcccagattcaagcaattctcctgcctcagcctcccaagtagctgggattacaggcctctgccaccaggcctagctaatttttgtatttttagtagaaatggggtttcaccatgttggccaggctggtttcaaactcctgacctcaggtgatccacctgcctcggcctcccaaagtgctaggattataggagtgtgtcaccatgcctggctaattttatatttttagtagagatggggtttcaccatgttggccaggctggtctggaactcctaacctcaggtgatccacccacatcggcctcccaaagtgctgggattacaggtgtgagctaccgtgctcagctcacaagtgttcttaatggcatctagaatgatgaatgctttccaaaagattttcaatgtattttgcccagatatgtcagaaaaatcactatccattgcagctataaccttacaaaatttattcttaaataataagacttgaaagttgaaatcactccttgatccataggctgcagaatggacactgtgttaccaagcatgaaaacaacatttatctccttgtatctctgcatcagagctcttgggtggccaactacattgtcaatgagcagtaatattttgaaagaaatcttttttttcctgagcagtaggtctctcaacagtgggcttaaaatattcaacaaaccatgctgtaaacagatatgctgtcatccaagctttgttgttccatttataaaacacaggcagagtagatttagcataattcttaagagccagagggttttcagagtggtaaatgaggattagcttcaacttaaagccatcagctatattagcctctaacaagagagtcagactgtcctttgaagctttgaagccaggcaggcattgacttttcctctgtagctatgaatgtcctagatggcctcttcttccaatataaagctattttatctacatggaaaatctgttgtttagtgtagtcaccttcaccaattatcttggctagatcttctggataacttgatgcagcttcttcatcatcacttgctgcttcacctcgcacttttatgttatggagctggccttctttggtttgggtggcaaggagagaaggttggggtttgtttttgacatacaaatcactttttaaaacttcaacaataacaaattaatactgtgtttgtgtgtgtatgtatgtgtgtgtgtatgtgtttaagagagatagaaaataaatgtttcttattgtttgaagctacttacttttggggcaatttattatgcagcaatagataacaaacacaatggattttcaccaaattttaaggtttgtttttttttaattaaaaaatgacttaaaatatatgctatgtggcatacagcgtatctaatttagtggttctgtggtatcacctcaaagaaattagcagttttacaccagagcaaattaaagtgatgtataatgtgaggcttggaaagatagtctatgccttttaagatattgtgaatatagaaaacaaacagaaattgcaagtaggaaccttatataggaagttataactgtgagcacttcaaattacaataactaatttgccatccggctgcttcttacatgggcaactccatagaaccattcttaaggctcattacaaacatacttatttatgtcagttggtaaccgggaacaacatagggttcagctagtctttgacacaaaaatatcattaatttgttgtgggaagtcagggaccctgaatggagggaccagctggagccaaggcagaagaacataaattgtgaagatttcatggacatttagcagttccccaaattaatacttttataatttcttacacctgtctttactgcaatctctgaacataaattgtgaagatttcatggatatttatcacttccctaatactcttataatttcttatgcctgtctttaatctcttaatcctattatcttcataaactgagaatgtacgtcacctcaggaccactattgtacaaattggttgtagaacatgtgtgtttgaacaatatgaaatctgattgtaaaacatgtgggtttgaacaatatgaaatcagtgcactctgaaaaagaacaaagtaacagcaattttcaggtaacaagaaaagataaccataaagtctgactgcttgcagggttgggcagaatagagccatatttttcttcttgcagaaagcctataaacagatgtgcgaggagaaatatcgctgaattcttttcccaggaaggaataaccctggggaaggaatgcattcctcgggggaggtctgtagatggctgctctgggagtgtctgtcttatgtggttgagataaggactgaaatatgccctggtctcctgcagtaccctcaggcttactaggattgggaaattccagcctggtaaattctagtcagaccggttctttggtctcgaaccctgtttcctgttaagatgtttatcaaaacaatacgtgcacagcgggacatagaccctcatcagtaattctaattttgccttcgctttgtgatctttattgcccttcgaagcatgtgatccttgtggcttactccctgttcgtacatcccctccccttttaaaatccctaataaaaacctgctggttttgcagctcggggttgtcatcacggtcctaccagtatgtgatgtcaccgctggaggcccagttgtaaaatttctctctttgtactgtttctctttatttctcagaccagccgacactaagggaaaatagaaaagaacctacattgaaatattgggggctggctccctctataatttgtcttcatacttcatggggttttatgaaggtcaaagtaaataatgtgaggttttggcaacacaaaagaactatacagatgtatcactgtgattatatatcaatcaagaaaggtcagccaggcgtggtggctcacgcctgtaatcacagcgctttgggaggctgaggcaggcagatcacgaggtcaggagatcgagaccatcctggctaacacgatgaaaccctgtctctactaaaaatacaaaaaattagctggatgtggtggcacgtgcctgtaatctcagctacttagcaggctgaggcaggagaattgcttgaacctgggaggcggaggttgcagtgagccgagatcatgccactgcactccagcctggcaacagagcgagactctgtcacaaaaaaaaaaaaaaaaaaaagtcaagttttgccatggttaaaaaaatctttacttttttttttgagacagagtctcactctgtctctcagactggagtgcagtggcatgatcttggctcactgcaacttctgcctcctgggttcaagcaactctcctgcctcagcctcctgagtagctgggatcacaggcacctgccaccacccccagctaatttttgtatttttagtagagatgggttttcactatattggccaggctagtcttgaacccctgacctcaagtgatctacctgcctcagacttccagagtactgggattacaggcttcagccaccatgcctggccaaaaatcttaagatgtttacaacatccaagatttatttttgctcatgctatatgtattcattgcaggttggctatggccctgtccatgtcatctcacaccaggacccagatggcagagctggagcagtgacaggtgtcatgagaggagaaagagtcatggagaaccacacactggcctttgaagctatttcctggaagtgatatatgttgcttctgctcacatttgattggccacagaaggtcacatagccaaacctgatgccaaggagtgaaataatgtaatcttcccatatttttgcattttctattgttctttctttcttcctgatgctccaagatttcttctttatcctctcctgtttgtctcaagagttccttttaggctaggtgtggtggcttacacctgcagtcccagcactttgggaggctgagacaggaagatcacctgaggccaggagtttgagagtagcctgggcagcatggtgagatcctgcttctacacgcacacatgcacacacacacacacatacagaaaagaaagaaagaaagagaaagaaagaaagaaagaaagaaagaaagaatttcttttagccattcttttagggtaggtctgctgatgacaaattcttttcattttccttctcctaagaatgtcttgatttccccttcattcatgaagggtatttttgatggctacaggatactgggctgacagttattttcctttggcacttgaaaaaaatgtcatttccttttggttttcatggtttctgaaaagcaatcttctgtcatttggattgtttttcctctacaaatactgtgtcatttctgattggtttcaagattttttagtttccagaagtttaattatgatgtgcctctgcatggatttctttgggtttattctgtttgggatttgcttagcatcttgaatctgttatgttttttccccctaaatttaggaaaatttttagccattattcctttcaattctttttcagctccatcctgtttctcctctccttctgggaccccaataacatgaatgctagatcttttgttacagtcacatagttatgttcattgtggtctgaggttacgttcatttttttcctatctattttctccctgttgttcagattggatgaattctgttgttctatcttcaagtttactgagtcttttctctgtcctctccattctgctgttgtgcccattcggtgaattttaaatttttattatggcatttttcagttctaaaatttccatttgattcttctttatatcttctatttcttttctgagacttctcccttttttatttgtttcaatcatatttacaatgacttgttgaaacattttttatgacggctgcttccttgtcagataattgcaacatctgtgttatcgtgatattgacatctgttgtcttttcttattctggttgagattttcctggttcttggtatggcaagtgattttcaattgcatcctggacatttggatattatgttatgagactctggatcctatttattaatttattttgagacaaggtatcactctgtcacccagtctggaggagtgtagtagtgcaatcttggctcactgaaatctctgcctcctagctcaggtgatccttccgcctcagccccccaagtggctgggactacaggcatgtgccaccacacctggttaatttttgtattttttgtagagacagggttttaccatgttgtccaggctgttctcaaactcttgagcccaagtgatccacccaacttggcctcctagagtgttgggactacaggtgtgagccattgcacccagcctctggatcctatttaaatcttctattttatcaagcctccttgataccacactaacagaagggtgtgtgtgtgtgtgtgtgtgtgtgtgtgtgtgtgtgtgttagggggtgttgtctggttcctgctgagtgagaggtgaaggcttaggttcctcacttggcttccattggtgggggtaggaaacctcagtcctgctgggtgcagatgagtttttgggctactctctaggcctctgctgatatcattctggctaggagcgggaggggtaccactagccatgtggttgccactgataacctgggggtaaggtggagggacagaggctttatcaccactggatgatggtacaagttccagctttcctcttggcttcctctactcagaaggagtgagaggaacacctcactaccactgagggtgaagaggaaatccaggaccccatgttacctccactgacactgtggggtatgcttttcaccgttagtgtgaataaatgtctgggcttttgagatatcttttcagatttttttctatgtctgacgacttatggctccaactggatcctccaactgctcctgtggccccacccagaagtgactcagcatgtatgaggaccatttcccacacccctatgattgcaaccaatcagcagcaagcacccattgcctagctactccccttcttcccccaaactatccttggaaaaccctagtctcagaattttttctaagaggctgatttgagcataataagactccagtcttctccttcgccagctctacatgtgaaaaactctttctctactgcaattcccctgcctttataaattggctctatctgggcagcaggcaagaagaacccattggacacttacagtcccaacagttttaagttccacttctcccaacagtaagtaatctgctcattaacacacgctttattggctcttctcccttccctgtctcactcttcccagcccttcactcagtgcccctcctaaataaactacttatatccaagtacttgtcccaggatgtgcttttggagaaacctaaaataaaacagtaatttttgtggctattcatacctattaatggacatttaactacttacctttccttttcttatttatttatttctgtatttatttactcatttttgagacacagtctcactctgtggtccagcctggagtacagtggtatggctcactgcaacctccatctctcaggctcaaatgatcctctcacctcagatgcctgagtagctgcgatcacagatgtgcaccactacacctggctaattttcgtatttttttgcagagacggggcttcaccatgttgctcaggctgttctcaaactcctggcctcaagtgatttgcctacctgggcctcccaaaatgctaggattgtcagaggcgtgtgaaccacagcaatcccatcttaaataagagctgggtaaaataaggctgaaacctactgggctgcattcccacatggttaaggtattctaagtcacaggatgagacagcaggccagcacaaaatataggtcataaagacattgctgataaagcagttttcaataaaggagccagccaaaacccaccaaaaccaaaatggcgatgagagtgacctctggtcatcctcactgctacactcccaccagcgccatgacagtttacaaatgccatggcaatgtcagcaagttaccctatatggtctaaaaaggggggctgggtgccctggctcacgtctgtaatcccagcactttgggaggccgaggtaggcaaatcacttgaggccaggagttcgagaccagcctggccaacatggtgaaaccttgtctctactaaaaaaaaatacaaaaattagccaggcctggtggtgcacgcctgtaattccagctactcagggggctgaggcagaagaatcacttgaacctgggaggtggaggtggcagtaagctgagatctcaccactgcactccagcctgggcagcaagagtgaaactccatctcaaaaataaataaataaataaaataaaaaataaaaaggggaggcatgaataatccagcccttgtttagcatatcatcaagaaataaccacaaaaacgggcaaccagccgccctcagggctgctccatggagcagccgttcttgtaatcctttactttcttaataaacttgcttttactttgcactgaggactcacccagaattctttcttgtgcgaaatccaacaaccctctcttggggtctggattgagacccctttcctgtaacaggattacagccgtgcgccacctcacctggccttttttttttttttttgagatggagtcttgctctgtcgcccaggctggagtgcagtggtgcggtcttggctcactgcaagctccgcctccccggttcacgccatcctgccgcttcagcctcctgagtagctgggactacaggggcccgccaccacgcccggctcgtttttttgtatttttagtagagacgaggtttcaccgtgttagccaggatggtctcgatctcctgacctcgtgatccgcccacctcgccctcccagagtgctgggattacaggtgtgagccagggcgcctggcctcacctggccaattcttgattctatcctgtaaactgtccttggagttttccccaggtgactgccctctgacttcttcactttgtgaatcagtccttcacatcttcctctcttagtagcccagaaaccccaggttctaacttccttgtgacacaggagttaagaagaaattacttaggtagacagtgaggttaccgaagttcttggtaaggtttctcttttaatggaaagcaggcccaaatcatttttccttctaacaaagagcagcctgtaaaatcgggctgcagacatagatgacggcagttgtgccaatcatgttcaaaatggcggccccatcatcccttctctgtcagccacaggtgcagtaaggagccgacaaaatggcaccctccgagagagttcatttgcataataagcttagggtggggcggccagccttcccagctatgtaaacaaacacctgatcaaaccaatctgtgagtcctaagtaaatcagacgccgcctcctcaagctggactataaattcggctcatctgcctccagctgccccttttctctcggaagtcccctctctcactagagagagagctgttttcctttctctttcttttgcctattaaaccttccctcttaaactcctcgcgactcctcgcgtgtgtccgtgtcctacattttcctggcatgggatggcaaaccccgggtatttaccccagacaactggctgcttcacttgcactggatcttgagggtcggggagatttttgacctttaacagggactccatcattgcaagttttccttggagactcttgatggcccaggtttagtttatacctactgtgagagcaagaacttgagtaatgtatggatggacctttttggaaggaaaacaattttcatggacttaaattatttttataatttaaatgtgtggaaacacaactaactatgaattccttatgcttcagtagttaagcagttataaaaccaaagcaaagtagccataggtacaaacaaaagtataaagacaagtttaacattaatgtaataaatagtgtttttctgaaatgaagttgctgctggcaacagaccatgtactgcctgatgaaggttcttccgcacttggcacaatattccactgtgtgcctggcgatgactcaattcttccccttctcatgtctgttcaaattactaagaaatctttgttagaacttgtctcctggccttcacttggtacaaatgcgaccaagacaattaaagctataaataggtaaatgcaaatgcaggtactcacaagcagggccaggatcagttacaaatgacccaaaacatgcttataacacttttcaaatgctactaaggaaagttagacatggaacttaatagttttcacaggtattcacgagtcctcaggagtccagagacctcagtttgagaacactatcctagcactgaccttgacttccagggtgaccttgaggtaagcatttaccatttttggatctctgtacattttttgtacacaagaataatttgggccaccagtgttcttgggagataaaagaagttagaggagttaatgacaatgttccaagatgttcaaggactagagagaaaggataagaatgtattatagacctctagagttggaaaaagaatggtggctgagatcctccagcctagctttggctctgtaatcaaaaagactcagatttgggccaagcattgtggcacacgcctgtaatctcattacactgggaggctgtggcagaaggatcgcttgaggccaggagtttgagactagcctacgtaacatggtgagaccctatctctaccaatctctacatacaaacaaaaaatggctgggcgtggtggctcatgcctgtaatcccagcactttgggaggcggaggcgggcggatcacgaggtcaggagttcaagatcagcctggccaacatggtgaaatcctgtctctactaaaaatacaaaaattagctgggtgtggtggcgggcacgtataatcccagctactctcaaggctgaggcaggagaatcgtttgaacccgggaggcagaggttgcagtgagccgagagcgtgccattgcactccagcctaggcaacagggcgagactctgtctcaaaaaaataaaaataaaaaataacaggacatgatggtgcctgagccccagctatttgggaggctgaggtgggaggatggcttgagaggttgcattgagttataattgtacccctgcactccagcctgggtgacagagagcttgtctctataaaacaaataaacaaacaactgagatctgaattccagatctgccatttactgtgtgtgtatgggggatggggatggagagcaacttttctaactctcagtttctaccctaagtgggcatgtttcaaaatgccacatcacagaactgctgtgtgggccaaatgagatggctctggaaagcgctgagagcagagcctggctcacagcaaggctcagggatcctaagacgctgctgagaattccacaggctttttagcaaaggacaatagaaaagagaaagtgaagattctaacattctgcctataaatgacaacatctcctatatgtgcaaattaggtcattgtaccctaaatagccccgcagctgccctgggcttccagtcagcctttctgacctctctcttgggtctgctgctttggggtgcttcctgccattccctgcccaagcctgaatctctttcctggccgctttcactttccttccattttccagtaattggagttggtcacctgtgcagcaagcgcccccaagtggccttcctgttcactgtccggaccataaggcctaaagaatactccgataagtttatcaaggccgggcttccgcagaggcaggactcaccaggcttagcggtcggtccagggtcggtccagtctggaggcccagggagccattctacatccccctttccattttggaagactgagatggaggaatccaggggaagttctgggtaggaagcagccacttgccattaagtggcaattaaattgctattgcaatttaaggtaaatcgcagcccctctgggcctagttttcttttttctcactctttttttggcgatagagtcttgctccgtcacccaggctggagtgtagtggtgtgatcatagttactgttacctcgaactctggggctcaagccatcctcctgcctcagcttttgggtagctgggattacaaggttttctttttatgagagccctgccccactcatgtcagagggccctgaggaggcaaacacaggatggttgaaaatgctagtaaaacacctaggatgtgcactgctgtcctggctggaggcttagggggagcaccatgggacgtacacaggataaagtgggattaactcctccctcccctcagccattactctgaactctgcatcccacatgctgctgccaaaaaccacttttaaaagaacacaaatctaaacatgtcatttcccagctcaaaaccccaaggttctttctcctcaccttcagaataagccaaactactcaatgataggttccaaatctgcctttctggtttcactcatgggatggacccttcttccaggtgaggctgcatttggacatagccatattcacgcctccctgccttggctcctccgcttctctggccaggaatggccttgcctcatctctgcaaatcttagcatgacttaaggcccagttcaagctccagctcctccctgaggtcttcctgagtcttgtctcctgtcccactcaggaggacctggcctcctccttccctgggttcccatgaccctttccagctctgcctgtagcacggtgttctgtcttctgtgactacatatatacgcctaacactctctagattgtaaaggcctggaaggtggggagtgggttccattactgaatgcatctttcatagctctcgctgtcagagccctgccctatgcaaactcttttatttttatttatttatttatttatttatttattttgagagggactttcactcttgtatcccaggctggagtgcaatggcgcattctcagctcactgcaacctccacctctcgggttcaagcgattctcctgcctcagcctcccaagtagctgggattacaggtaaccgccaccatgcctggctgatttttttgcatttttagtagagacagggtttcaccacgttggtcgggctggtctcgaactcctgacttcaggtgatctgcctgactcgggcctcccaaagtgctgggatgataggcatgagccactgcacctggtgccctatgcaaactcttattttattattattattttttgagacagagtctccctctgtcacccaggctggagtgcagtggtgtgatcttggctcactgcaacctccacctctcaggtgcaaacaattctcctgcttcagcctcccaagtagctggggttacagacgcgcaccaccacacccagctaatttttttctatttttagtagagatggggtttcaccatgttggctaggctgatctcaaactcctgacctcaggtgatccacccacctcggcctctcaaagcaaactcttaataacaactgttgtggaatgacttgggaggtggcactcagagatcccaagtgacacatgagaagtccacagagagagatcatgtttagtggagtttggatggttgcttttatcagtgggcctgtaccttacagatgctatctcattatcttctaaacagactctgggccagtgaccattatctccctcttactgatgtagactcagccaagagaagccagatgttgagtcggaaccttaactctccctctcagacgcagagccctgctttctcccctcccatttgatactctgcttcctcttgcatgctgtgagaggcggcctcattactcctcttccctcctccagtccctccaagcctaattcatcacctttggctttgggatcatagtttccaaaccaaggattgtctgaacattgtctgacaatgccctttttttttttttttaggcagggtcttgctctgttgcccaggctggagtgcagtggtgcaatcatggcacactgcagccttgacctcccgggctcaggtgatcctcccacccagcctcctggtgcgcatcaccacatccagctaattttggtattttttgtagagatggggttgtgccatgttgcccaagctggtctcgaacttctgggctcaagcgatcagccctccttggcctcccaaagtgctgggattataggcatgagccaccgcaactggcaccattgccattggtatttaagaggtgatggtttaggctttgaaattggggttgtttgtgaaaactgagagcaccttttgttttcagatatttcctatggccattggtgtaattggagggaagctctcgccatatataatatttttgagacagccaactaagaaactgggattctggttctctccagggtgcaaaatcctgggagaaggaagtgaattctcaggggcccagaaggagtctctaaaggacctctgccagtcaattctaatctctcttctcccctgcaaatcagcccctgcttctgcctctttctccgcctctcctagattctccccctctggagggcctgagctcccggccaccacccccaatgccgctttctgtttcctctgcctcccttcatctccttttgtctggggtttctttgtctggggtctccctttggttctgtttcacagttctcagcctcccctccctttctccacagccaggctgctcagtccctctctgcgggggcctagaggctcggtgaggggagcgggacttggttgccatggtcacattgaagccagccgcagctggcccgggcagctgctcctcctgggcccggggccccggacgctcggacaaagccaggcagcgttggcagccccagacccgaccccaaaggcctgagactggggtgactgggacctaagagaatcctgagctggaggtgagaggggggaagccagagatgaactgggagggcaggagtgggcactggagctgggccctccccttgtgggcagggaccaggcggtccccggctggaggctggaggtgtgttgggaggaggggagcggcccagagcctggcagggaggaggggaaagagagggaatagagttgggtgccatggtgtggtgaatgggctgagggactagggtgtccccaaagggggaccgttgtccagaaacaggttagattctctctttggtcctcatgtccccatctgtcccgcaggtgcctcttcctttctcagccttttatacttctcatctccccgtgtcccttagcttcacactctgcgccccagtctccctcctctttccctccactctctgtttcactccagccccttcttcccttgtccttgcttcttgtccccttgatctgtctgcccagctctcaagcctcctcagttccctgccttcctctcttaggagtttgtttccaacactgtttccttcccgagtccacttcagttccttcatccagttcagcccttttcttcccaaacttcagtctcctcctctgagcccctggggcttcccaccttttgctgtgtgtgccctgtcttcatcctccttttcctctctcagacctgtctccttggccttgacctcagtccatctccgtctctctgggaattctctcaccattgtccccatctgaccatcagcctcctctccctcttctggtcccttgcccttttcttccccaaccacagctgagctgtttcatctctctcccagagctacgtcatctcaatctcctccttcgctccctggcctcagtttccagtttattcagtggcatcaggtctgactcacacccaaagccttgtacactccttcaccctgccccccacccgtcgcttcttactctccccagctgctgacccagcctgctcctccagaggcagctgcagctcccggaaggggactgcagctagtgtatgtgtgggggcccatctggtccgtcctctcgctcgctggtcgtgctgggcttccctcctgtggccaggtggtctgcaggcctgaagctgccttctcccctctcctacgtgcctctcctcacattttttcagctgtttcccatcctctccttcctgggcagcaggctgccactggcttgaaggggagggaagcccaggatgggaggggatggtagagggtcatttgggggttctcagggacacagggggcctctggggttcggagtgatgcaggagatgtggaatgggctctggggaccacggatgggtaatcaggccctcttggtctttggtgctgctctctgggccccaggatggctgggatttccctctcaggcccctgggaatctcggctccgagtcccgcattccagctggctccagctccctttccgttgtcacttgactccactgggccccagccttgcatccctcccactcctccagcctagagctggggcgaggtgggcatcaccactaggaatttctcctgaggcagtgagaagaggggacaaaggtttcaggactctctagctccttctgctctccccagtggacccctctgtctggcactgccatgccacttagctggggtcagcgtgggcctggggtgtggaatgtcccaccagggtatgacgggctgtagcttgcctggcaggcctgttggggctttcccagagcacagctcctggaaggaggggctgtgggctgccaggtgaggtgacttgggaagccttggccccacccccaggctggccccacccccagtccagcgtctcctgggcctagattccccagctgctgttctctggaggggtaggtgttctgggggaatgaatccctgggggcttggtgggacaggaaggcgggaagaagctgctcttcgagtgaccctggggctgtctgttagcaggtccctcagccgttggaacgtccttgggcttctgaactagtgcccatgtgtgcctcggcctttcccaagggccagcttcttcctggtagtgcttttgtgtacttgtctggttgggacttcgtgtttctttcttgggattgttgtctgggactgcaagcagggtatgtttttatctactgtgaggttcctggggcggagatgtgcagtggagcgagaacttcctgtgaccgtgacattgtctaggtggtgagcaggtgtgggggtgtggagagaggtgaggggctgaggtagtgctgagtggggaaaaagcacctcccaccacaagctgttctgtcccgctccatcctctgcccagtagctctctcagttgctttgcctactcagtctcactgtttcatcttccctgggtctcttggtccccttccttttgactgtgtgtgattttcagtgtgcctccatccttctcctgctcctcttcttcctcctcccgaccactcaactttgtcctggcctcatttttggcctcttctggccagtgatcagaccctctggcccactacggccagagctggctgggcctgagggaggcttgccctgaggactcctgagtccccctcccactccactccgttgggagcccaggggaatcagggcctgggcgtctggacccccgggtcccttagaacgcccttcagagagaggaactgagaggagaaggagaagagagtgggcccgccttcagggtctggggccttccaggttgggtcgtaggggcgggagcgcacaggctgcgagagaggagcaaaggttggtggagggagaagagcagtctggggcctggctggacaggtgagccctgagacctgagctctgctcccttctctgggctaactcccgcagctgggctgggccgagcctgtgggaacctgcttcttcctctgtgccctggggctgctcccctttgcctctcccaccaggaaccgatcccagaagtaggaggggcgtcttcccctcgtgggccctgagcgggactgcagccagccccctggggcgccagctttggaggttctcgtttggggaagcgggggtgggctgcgagtgggtggagggggctgggcgcggagccggccggaggcagcggcgcgggcggctgggcggcctgggagcgcccaggcgggcttggcgggcgggttacctgggggaggccgggccgggcgctagcgcgcggggtgggcgtggcgggcgcggggcctggagctcggcgccgggcgtgggagccactgggactactgggtccgggagggggaagggagggctgcgagcccgaacgcgcggcgagaaggccgaggggagggaggggagcgaggagcgggaggaggaagggagggagccgaggcgagggggaggcggcgcctgggcccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtagggagagcggcggcggaacccgcgggcggaggcctggggctcttggggtgggggcgcgcggcggcgcctgcagggcgaggggcgggggaggcaggacgtcccgagccatgcttggtcgtccagctcttctaagcctccctgcccgcctccccgatgctctggcataccgtctgaaaaccgggggcggggactgggtggaggtgaagcccgtgacctcccagaaagagttttgagcctccagccttgaggcaagtcccctctcactcagtgcggaggaactgagccccgggaggaggtgctcctgtgcagccccactgagtcagctcatctatcgcctgccctccacctggccagtccctgcgggcatctaactgctaagcctccgctcagccaacacccagttggtcagtctggtcacagtccagcaaaaagagggactgccactctaacccaccagtgacaccactcttcccggctggatggtcaattagctctggcatgagagaatgtcactgccggtgagcgccagcttcagggtcccacccccccatgcctggctcttggctgaacatttcttcccagcgcttccagcagccagaggcaggcgcccaagctcgctggctgttgctgagggcctgtaggtgtgtccaggactgagtggtgtggtggagacaggtgaaaggggagtgagtggaaaggcagggaaaggctgttgtccttattgccactcttcccacccagcgcccacctgttccctgccccctcgacgtccctctggcttggtcacccatgtgtgttagaggctgggccccagttctctggggatcctgtgcccaagggcccgggtgtgtgtgtctcatgctgtcttttggtcacaggagcatgtggtgtctgtcatttcatgttcacaggtgtctgaaggtggctattcactgagcgatggggttggacttgaaggaatgccaaggtgtggacgggttgatgtatgcatgagcttctgtgtttgctctgtctcagaaactctgtgagggttgtcagggacactgagaggtgggtgtgtgcatgccacatttagcctcgctgtttacagccagttcagtaagtttgtgtgtttcaccgtgtgtgtgtgtacagagctgtgtgggtgttgtctgagtgggacttgggggttgggagaggagcgtgaagggcttgaggcagggtggcctggcccctggtttgtctttggttgtaatggagtggaagggggtgggattggggaaggtcttctgggcttgtcctctcttgccctctgggtctctgactgtggactgaagacccagtggagagagatgaggtgactgggggtgttggagaacagacagcccagacgtctctgtgcttctccgtgttcctctgcttggctctgtgccccgtgtttctgagcctgctctatttacctcttgcattgtggctctcgctctgtctccgcctgcctcgtatcctctgcctgcctttgtatctctgccccgggctcctctcggctctgtgtggctctgatgactcatctgggataggcatgaaggttacttaggggaacaagagccccgctgttcccgagagaggtggggttggagagcggcacccaggaattccaagccagtctcctgggactctggcagcctgctccccggcgctggaccctaagggaccaggcgtgatgccttctggttctagcctctgagtgccccccacaactcagtcgtccccctcagctgctgcttcagagctctggggtctcagctgcctcttacattcctgccctagtgcattgtgggagcagctggaggaggacaaagggatgggggagtatcccccactcctcctacctcctggggtgacctgccttccttgtctttagacccgccctcgtctccaaggcaactcagcctttcctcagtccctcagaggcagccaccttctggaagtgggaactggggggactggatgtctgggtctcaggaaggcagagcagggataactgggcccaagatgccctgaacctgataagaggtggcagtcgagtccctcaggactccagggcctggagacttcagtacagggctctgagaccagtacaggttaggatagcttttcctgcagcaggggaggggagagtagttacttgggtttgtaaggagatgccatttagaatagttttatgtggggtaagcttcctgggcctgaggaacagagtagggattttcaaactttaatgggcacaggtcacctgggaattgtgttaaaaggcagattttgattgagcaggtcaagggtgagcctgagattctgatttcttccatgcttccaggtattgctgatggtccagggaccaccctgggcctagagggctataggggacagtaagactagaaggtgctggggtcccctctgcccttctcttagaattctggactcctatgtgggagggcagcagggtgagctggtccaggcttatctgatgtttaattctatcatatcctcaacaaggaattgcccaacctttcctgggacatatttattttttaaaagtcaaaatgattttcatattcttttacatatcttatgattttacataaatgcatttatgttacaagatttagaaaaatagtacaatcaacctgtctttttaaatttgcttttcttttgccccgttcatgttaactcttgttatattgtattctattgttatattctattatatattctctccttctagacgtacacacaggtatatatacaaacatgggtgcttgtttattctattttcaaaaggtgggatattttttatacttctgttgcttgcttttcatattcaacagatatacatggaaatcacacaaagttaggaatatattgcctctttgttacttttcatagctgcatagtagtcaataaaccttattttttttaattccagcctgtcccctgtgggcattcacatatcttacagatttatgtcttacaaaaggtaccataataaacatctttgaaatcttcttttttatttttatttttcactttttttaaagagatggggtctcactatgttcaccaggctggtctctaactcctggcctcaagtgatcctcccatctcggcctcccaaagtgctggggttacaggcatgagccaccagacccagacctgcacatatgttcttacttcctggtgcttctctctcgagggaatgctgggtcgaagaggatgtgcatttttaattataatagacattgctagattgctttccaaatagaagataacactcatttctgccattgagcatggtgcctcccttttcatcactttctaccacttttatatgttacagccttaaaaaaatatcttgtcagtctgcttggtatttccctgaggctggtgaatttgaccattaaaaaaaatgtttgttggcaatttggctttgcttttctgtgaaatgactattcacattctttggctgtttctttattgggttacttatatattttttcttgtcagttcctaaggggccttagtttattgtagttattaaaccttttcctgttgtatgtgttataaacattttttgcacacttgttgtttgttctaagccgttgtttatggggatattttgcccattcctgattggagaaatggggctttaggaagttatttaactgatctctgccctagtttcttcatgtgttaaatatggatagtaatagtatctaccttatgaagtgactgtgaagataaaattatggattctgtttaagggtttaggccagtgtctggcacaggggaagcattctaaaaatatagctgatgctgttaaacaatgactgttgttgttgttttactgttattatccccaaagcggcccattctgtctgttgctgtcagctatgactcagtcccctgattaacttacgcaccacccattttatcccctgcagagatgctgcccccacccccttaggcccgagggatcaggagctatgggaccagaggccctgtcatctttactgctgctgctcttggtggcaagtggagatgctgacatgaagggacattttgatcctggtgaggagactgaatcatgggtccctgagggccagggcttgggaggtagagagttgggggccttgacctgttacatgcctgctttttactcagccaagtgccgctatgccctgggcatgcaggaccggaccatcccagacagtgacatctctgcttccagctcctggtcagattccactgccgcccgccacagcaggtacttggcacacctggcacacttgtagctgccccgagaggagctcctgggacctctacttcccctccaacccctctgcccatgccagtgaaacccctgcaggctgagggggcaaatgaagtggggtttaaatactggagatggaggcagacctggggccagatgttctctgtgcccctcttcaccctcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgagactggcaggggcagcacccagaggaggttggctctcctcacttccagctgtactttaaacaccacctatacgctgacgactctccagtttatatcatctccagactaagcctctcagctgagctccaaacaatattgtaaacctggccaccttttggatttctccacttagatgtctttttttttttttctaatagatggggtcttgctgtgttgcccaggctggtcttgaactcctgggctcagtgatcctcccaccttagcctcccaaagtgctgggattacaagcactgtagccagccacctagatgtctaataggcatctcaaacgtacgtttaacttcccaagctgaatttgattcccattcccagcctaaacctgctcctcccctggcattctccagctcaggaagtggtatcaccattgcctggttgcctaggctataagttaagatgatatccttgattcctttttttctctcacctccttccaaagcatcagcagccccgtctgttctacctccatagtgttcctgagtccagtcactcctcaccactccacctctactgccctaggccacctgcccgccatctccagcttagatgagtgcagtagatgccaaacgcgtctccctgcttctgcccttttctgcctggagtcaaatctccacctgggggggcggcatccagtggaccttagagcatgtaaatcagatacgtcacacctagctgacacccccatgctggctttccactctgccagaacaaaagctgagtccctagctggtgcaggatgctcagcctgacctggctcctgcctgcatcacttgtttcttggcgcctccttggccacgctgcctttcttcttgttgctggaacaagccagggctcgttcccacagcttctggacattttctctgtgcctgcaaagctcctcccctaaataaccacaggctctccctcactccattcagttctctgccaggtgtcacctccttagagagccttttctggccacccacctcactgctctgtccatacttcctgcctcttgttcttcgcagctgttttccctgctgggatctcagtcctacaagggtggggagtgacgttcaccactgagaacgcgcctggcacagagcgggcactcagccaacttctgctgaatgaacagagggaatgggctgaaatgaaggggaagctgaggcaggggtgcagggctgtgaggattggggagaatctgggcacaatgggatgataggcttggagacaaatggatggagccaggcaaggagaagagggcagctgagcctgaagtctgaggatggaacatcagagctgcgacagagccagaggtctcagctgcagatcttcatttcacccatgcctggctgcgccccacagtgctgtgtgctcggtgccacccctcatgggtctctaagtggccactgtgggctgggccagggagcagctggtgggtgggaagtaagatctgacctggactccatcccacccaccccctgtttcctggcccacaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggaggggtgagtggctcagcttcctgggaatctgtttcctgagcaggggactggagggtggggagtgtggagaatgggcatccaggatcccttctcctgctgggaagctgtcactctgaggagggggctagccagcattgtctcctccatgccaatgagccagtggagagatacaagaagggacctgaaacctgcccaggcctgatgcagggatgggggatggagccttagtgcctctgacccccatcctctcaccctgccccagatggactcctgtcttacaccgcccctgtggggcagacaatgtatttatctgaggccgtgtacctcaacgactccacctatgacggacataccgtgggcgggtaagaaaggcccctgcaggatatggagtttggggtgggagggaggactgtgtgtgtgtgtgtgtgtgtgtgtgtgtgagagtgtgtgtgtgtaggggggctggtaagtagggtggggagtgagatggaagagctgagaagagggatgggttaggtggggcctcaaagggtagcactagggtgaccactagcccgtatgacactgtatgaaaaaggcacccctttgctaacacacattgttggaaattgctgcaataaatatacacatcatagattgaaatggtgccccttagaggtggtgcctttgtgctggatgtgacctgcaaggtacctgtagtgctggggtggggtggagagaggagaagggccagctgcatgagtgtgaggtgggatgggaatgggactagtggatgggagccaggctggccatgccactgtgccggagggtggcggagcagaatgcctggatgtcaagaccctcttcccttccaacctcctcttccttggtcccctcttctccagactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtgagtgagtccggctctcgaggagggctctgaagccatgcagggtgccgttggggtgcccccaccactcctagccttgaccctgtgccctcttcccttccccccaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctggtaagccctggagtagcccagtctccagtccctgaaattgacaactgatttcattcctaaccctgcagtgtccctaaaatactcattccttgcattatatctacccatcacccaccgaaacttctcaattaggggtgccccaaataacttgagcccctttctgcctcttgttctctgcgtatccatctttcctttgtaagccccttgcccgtgactattattgagccagtatgacagtactggttgttaaaatattgaaatacttctgtattagttgagaaatagcctcttctctaagcctccagatacctgtcctccacctccccacaatccagcaactatagggttaacacccaccacagctgggtgttccaggaccctgctcccccagcccccactggtcagtggttgcctattgagaatcacccatgcttctgctcctttgcacaacagtccactgcctctgcctcccttgggtctcctcctcatttacctccctcctttctttttgttccttctccccagatgtggtgaacaattcctctccggcactgggaggcaccttcccgccagccccctggtggccgcctggcccacctcccaccaacttcagcagcttgggtgagcaatcttgggtgggcgtgtggaccctctgcacccttctccctgggcctccccctcggctagggtgggaccctcctgtggtgctgaccctgctgcctccaccagagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggtgggcacagccgtggcatgtggagtggcggggggaggccaggccccagcacgagccagcgtccagtgggacctgcagggcacagcccactagcatcccaagaggagggcttagtaaagagaccacttacaccatgtcaaagagggtatggggctcacagggagggctgctccccagctctgggtctgctcagcggagaggagcaaataccacgacccagaggagagagcctgtggagagggcaccttgacaggggcagtagactttggtcctgggatgcagctggcccgtatctacccctcagggagggcctgggagaatagatgccctgacctcactttctgccccaaactcctgctgggctcctctctggctaacccaaaccaggcctgttggtgcagtgtacactggtcagccttggggcagaagcagggtagagacaggcagagagtggggttggaggggcaaagggaagacgtctggcacaccccaagccacgtcttccggctggagtccagtggcagtaatgtacattaaggttgatgactggacacggtggctcatgcctgtaatcctagcactttgggaggccgaggcgggaggatcacctgaggtcaagagttcgagaccagcctgaccaacatggtgaaatcccatctctactaagaatacaaaattagccaggcatggtggctgatgcctgtaatcccagctactcaggaggctgaggcatgaatctcttgaacctgggaggcgaaggttgcagtgagctgagatcatgccatttcacttcagcctgggcgacaagagcaaaattccatctcaaaaaaacaaacaaacaaaaaaaaaacggttgatagttatggactgggcagatgagggttagaatctcattgtgggacagggaagttacctccatgctcttgagcttcactttctctgcctgtaagatggtgctgatagtatccacagctgtagggctcttgtgagggctgagggagggaacgcagggatggacacagcagagggccaggccgtgtgtgctgagcaacacgggtgatgcctcccatccctatgacaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctggtaagacctgccttgttccagtcgcacctctgtcctctctgctgttttcttattgtatccctttcccattctctttttttcctgtcttccccagtttccacttgttttcttctttctgtgcccctggttactgtctatatcactctttgtccctaccatgtagtctctctcaagagttccccatgtattacccatagtcccccgtggtgctatcttgtctgtgtcccacagacatctctctatctttgttgtaccctctcattgtgtctccctggcccctttgctttgtattagactcaccatgtttgttccttcatctatcctccatcacccatccttccatccatagtcatacatccttgcatccatccatcaatcttccatcatctgtctttctatctatattcataaatctattcatccatccatccacccacccatatccatcatccatctatccatctatattcacacatccatctttccatctgttatccatccatccaacaaaacatctgtttaccatccatccatctattcatacgtcccatctgtccatgcattcattatccagccagccgtccgtcactctgcagatccttgttttatcctgtctgtctcttaatgcaatcatcccatcagccctggtcttgccctattcaaggtctccctgtctgtctagccttgagtctcatcccttccccgtgtttcccctcctccttctcccgacagcgttgctgctctccaatccagcctaccgcctccttctggccacttacgcccgtccccctcgaggcccgggcccccccacacccgcctgggccaaacccaccaacacccagggtaagcccctctgcccctgggctccgccaggctccccatacctctactggggcagggaaaagccctcacaccttgcacttcctcctctccccactgtggcctattctgctctcctgagctcccaaggaggaagctcttgtgcccttagctcatctctgctgctgcttgctcttttttaaggtcccccccttgagctgaggagtagaaagcttactggtccccagctcttctccctcctcctcttccacgccatctcttcagctctccagagctagacaggaggttgctgtggtggccccagactatagtaactcctcctttattctccactctctctagagctgcgaggaggagggctctcaccccgggcgcttgccctttccctcacatgtgtcctctctctgcagtcccagaggtgaaggctcatgccccaaccctttccatctgcccctcttctcctcagtgttgccttctcattgtggccccttccccagggctaagaggggacagctctgcttcctctcctgtctgtagacaacttgtgttggggctgtgagcagctgttaccctccctcctctctgtgtgcctctgtctctgcttgttgttgagcttggtgtgttgggttgaaagggttgggagggcttggccccagggggagccaggctgaaagccacgggagagcagctaagtgaaggggagggagctgtggtgaacgggacaagggtttggaaggtggagggtgcctggatgctgggaccatcctgaggcgggagaattcctggggaggaattcttcttccagccaagatttatctcacagtctcttgagagaccctagggaggccctaaaagagtaagactttatgacagttttgctcaaccatattcattgccttgaaaagctctggaatagctaactctcgtcccatgccagtgtcttcctggtttgaggttggcgcatggaatactgggaagatacagcatagacccagtctctcactcaaccgggagacacagggccctccgggaggctgaggtgtggggaactatagctcttgggctgttcctgatgcctcgtcctgtcttctttcccctcacccctgcagcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtaaggagggtgcctacccagtgtctggccctattgtgtgctctgatgccatgcctgcgcatccccctagccaggaaccttagtcatttgtaaccgtgttaatccgtttgaccctgtgaccgcctagcaaacgaacttctttctccaggtgcacctgtgtgaggtcgacagccctcaagatctggttagtcttgatttcccccttaatgtgcgtaagggacaccctttgctggtagctgtcaagatcttacggccagatgccaccaagaatgccaggtgaggaccagggatggcatctggaagaagggaggggaggccgtgaagagtggggagccatctagagagaacaatggcagagcccaacagaggggtggcatctctgggaggggatttacatgtacgctgggggtggggacgcctggtctgcctgaggtggggcaggggggtgggggcgcgggggaaggtgcaggccgcccactcggcattcctcttcagcttctccttgttctccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcaggtacctgcttacccaggctgggccttgctcagaattcccccaggggatctcctcctctcccctcgcttcagcctggaggaaaagaggggagcgtgggggtgggaagggagagaggttccaggagggcctgggataaggaatgtgtgacaagttaacccaggaacatggacagaaaggctggaggtgactatgcaagagtggtgaagggacttgggccctgccatgacgtcccttctgctttctctcaccctcactcccctctgagtccagattggggagcacaataaaagaagagccccctagtgttggccaggcctgggagattgagagggaagtgacccttggcctcacgtgggcattccacctccacatggggagccagagtgaccgggcccggggagtgggctctctctcctctcctggatgggaatctgcgaagctgcccccagtgaccttctgtcggttcccttctcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggtgagcagcccgaggacagccaggttggagcagggcaggtgggagaacactggccgccactcacagccctggtctccatcagtcacacactttctctgggttgcattttacagaatctcatctataatatgaggttctcctagcccaagggactggggaaagcaggagctgcagtgtgatgggcaagaatccaggagccaagagtgggtactggggatggagacagggtggcagagagctcaagagatgaggttgggcgaggaagctggagatagaaggggttgggtagggagaccgaaggtcaggaccagaaagtgggggtggatggagaggaaggaggagcagaaggaagaggtgggccagggccctggagagaggaccagagcatggagaggaaaggcagagcccaagggagaggagttggaaaaggtggccagcggaggagagtggagagcctggcgtcaggagggatcaggcctgagtggagcccagagtggatctggggcttccaataggaagggaggagggtctacgttgcctgatgtccctgtctgtttttgctgccttctctgcatcccaggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtcagagtggaggagagggaagatgggtccgaggcgggggacagaaggggcagagttgtcatcttggagactaaagaatatttgttccctgactctcatccacactgccacaatgcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaactgtgtgagtgggttccttgggaatttggtaactctgcctcctgcacctccctctgaacccacttcccaacccacttcccatcttccttttttcctgcctcctcattccatttcccatcacctgttttgcccagcattgtgttctgtttctggataatccaggcctttgcctgtgggacctcaggagatgcatgaatgtctgagtgcatgaaccttctcaactcagaggggtgctctggtggaggcctggaaggaatgcagtcaggccaggggtgctgaaccttttttgtgccataaacgcctttggcagtctgtagaggtctactgagtcctcctcagaattaggttttaaaacctataaaatggaccaggcatagtggctcacccctgtaatcccagcactttgggaggctgaggtgggtagatcacttgaggccaggagttcgagaccaacctggccaacatagcaaaaccccatctctactaaagatacaaaaattagcagggtgtggtggcatgcgcctgtaatctcagctattcaggaggctgaggcaggagaattgcttagaacccgggaggtgggggttgcagtgagctgagatcacacaactgtgctccagcctgggcaacagagtgagactgtctcaaaaacagaacaacaacaacaacaaaacccataaaatgtataggattataagggaaaccaatggaaacagtttaccaaaatgctaaaaaattatgaaactaatgtgcttctttttcatgtatttaataacaagatctaaaaacaggtgtaataaactgacattttccaaatactaatgagcataagccatatttgagatttctacaacagtcacagtgagacataaaagtagctgtggtgtcaattagtgacaagtcacaggtactgctaatactactggtggttttacccatattcataattggaggaaatgctaaacttctattagaggttagtaaaaggtgtaatttctttttcttgcccaaattctagaacccatctggctccccagggtctggaaatcccaggggagaatccctgggttatgctgatcaagtgtgcaaatgccccactgggggtaggggataggttgttggaatggaaaccagaaccagaaaccagaatcaagagcctcagttatctcagaggcttggaaggatgagctgcaaccaccaagagaacaattaaagggttcaaatttggttggaaagaaaaaatcggccagtggggtggctcatgccctgtaatctcaacactatggaaagctgaggtaggaggatttcttgagcctaggagtttggaaccagcctaggcaacatagcacactctggcccccatttatacatatatatataaaactagctgggcttagtggtgtgcaccagcaactcaggaggccaaggtgggaggataacttgagcccaggaggttgaggctgcagtgagccatgattgcatcacttcactccagcctgggtgacagagcaagaccctgtctcaaaaagaaaattaaaagtcagttgcagggatgggacaaggcagacccatcttgatggccattcatgtgaaataaaaaccctggggttttggttgatgatattcacaaaatgagccaattggataatgaggatcacagtaaagataaatcaatgtgaagttgaattaataggcccttggggcctaggtcccgaatctaatagtcctgctaaaacttacacaggtcaaaccactgtgcactatgatttaagttgtgtaccgataggttagagtttagaggccagatcccagaataatgagcgatggaagccacggcagtgagcctgataacccaaatctctgagctgtctttcaagcagaaacacctggagttaatttttttttttttttttttttgagacctggtctcgctctgtcacccaggctggagtgccgtggcgcaatctcagctcactgcaacctccgcctcctgggttcaagcgattcttctgcctcagcctcccacatagctgggattacaggtgtgcaccaccatgcccagctaatttttttgtatttttagtagagacggggtctcaccatattggccaggctggtctcaaactcctgacctcgtgatccgcccaccttggcctcccaaggtgctgggattacaggcgtgagccaccgtgcccagccccacctgcagttaatttaaaagtcaggccctgcttgtccaaacctgcttctcctccacagtctactgactcagtgaatggcagcatcatccacttagctgcacaagccgcacaaggtggcatccccgagctccttctcccttaccttccacctctcaagtccagtccagcacaaaacgctgttgattttgcctcccaaatctccctggaacttgtcatctctgtctccatcgccctcctggcacatgctgcctccatcttgcctggactcctgcagtggtctcccagctgtcacccagatctgcctctgctcctctctgggttgttttccaccctgcaaccacagttatctttaaaacacacaaatctgaccctaatccttcatttcaaatccagcagtgacttttcattaatcttaaaatgaagaacaaaatccttctggccaaggttggcccccacatacctctccagcgtcctcccccacccgcttgctttcctctgtgggccactggccttctttcagattcacccaatgggccacagtacttcctgccacgtggccttcgtggcatgctgttccctcacctggaacaatgttccctgcagtctgtgccttattaactcctgcttgtccttcagcagtctttcctgacttccccaaccaggtcaaattccctactgataatctcagaggacatgaatctcttctttgtggcacttactacgtgtgtaattttacatatctttttatacctgcccctcccaccaaactataagttgcacaagggcaaaatcttggaacacagggctcaatattggttgaaagaaagaattgtagcaaatatctgatagactaacatagattctatgtagttacagaactagaactaggattaataagtgaaagttacaataatgatgataatatattactgagcacccactatataccaggtattgaaattacgacatattatatcttacttaatacaacaatatatgaagtagttaaaattactttgcacagagaagaaaattctgttaggttaagcagcttgcccaaagtagcagtcagtcaacagtaaagcctgtgggaagtgggtctgtgggctcctggctctctgttcctttttttttttttttttttttttgagacaaagtcttgctctgtcacccaggctggagttcagtggcactatctccgctcactgcaacctccgccttctgggttgaagcgattctcctgcctcagcctcctgagtagctgggattacaggcacctgccaccatgcccggctaatttttgtatttttagtagagactgggtttcaccatgttggccaggctggtcttgaactcctgatgtcttgatccaccctcctcggtctcccaaagtgctgggattacaggtgtgagccaccacgcctggccctggctctctgttctttctctccaggatgctgcctgagaggaggaggtcatgagctccctatcacaggaattttcttttttgaactaccatgcccactaacatgctggccaacacggtgaaaccctgtctgtactaaaaatacaaaaaaaaattagccaggcatggtggttcacgcctgtaatcccaactactcggaaggctgaggcacaagaatcgcttgaatctgggagacagagattgcagtgagccaagattgtgccactgcatttgacctgggtgacactgtaagactctgtcccctcaccccctccaaaagaggtgtgcctatttcaattttttttttttttttttttttttttttttttttttaatttgagacagactctcattttgttgcccagtctggagtgcaatggtgtgatctcagctcactgcaacctccacctccagggctcaaacaaccctcctgcctcagcctctcaagtagctgggcctacaggcatgcaccctcatgcccagctaatttttttattttttgtagagacagggtttcaccatgttgcccaggctggtctcaaacttcggggctcaagtgatctgcctggcttggcctcccttcaaagtgctgagattacaggcatgagctactggacccggcctcaattttcagcaaaagtgtatgagtatgctcctataccctggtcaacattgaggttgtcaatccttaatttcttttttgctgaacttttatattttaattttatttatgtatttattttgagatagagtcttgctctgttgcccaggctggagtgcagtggtgtgatctcggcttactgcaacctcagcctactgggttcaagtgattctcctgcctcagcctcccaagtagctgggattacaggcgcccgccaccatgtctggctaatttttgtattttcagtagagacggggtttcacccgctcaggctagtctcgaacttctgacctcaagtgatccacccgcctcggcctcccaaagtgttgagattataggtgtgagccactgcctccggccgatttatttatttttatttttatttatttatttattttgagatggagtttcactcttgcccaggctggagtgcaatggtgtggtctcagctcactgcaacctctgcctcccgggttcaagtgattctcctgcctcagcctcccaagtagctgggattacaggcgcccgtcaccatgccagctaatttttgtgtttttagtagagacaaggtttctactaaaatgttgaccaggctagtctggaactcctgacctcaggtgatccacccaccttgacctcccaaagtgctggcattacaggtgtgagccatggcgcctggcctatatatttatttttaagagacagtctaattctgcggccaggctggagtgcagtggtgtaactgtagctcactacagccttgaactgctggactcaaccgatcttcctacctcagcctcctgagtagctaggacttcaggtgtgtgcataccgagctaatttctttttctcttttcttttcttttcttttcttttttttttttttttttttttttgagacagggtctcactgtatagctcaggctggagtgcagtggcatgatcacagctcagtgtagccttgacctcctgggtccaaacaatcctcctgcctcagcctcctgagtagctgggaccacagaaccaggcctggctaattttttgaattttttttttttttttttgagacaaagtctcgctcttgtcccccaggctggagtgcaatggtacgatctcagctcactacaaactccacctcccgggttcaagcgattctcctgcctcagcctcccgagtagctgggcttataggcgcctgccaccacgcccggctaatttttgtatttttaggagagacgggtttcaccatgttggccaggctggtctcgaactcctgatctcgggtgatccacccacctcggcctcccaaagtgtcgggattacaggcgtgagccaccgtgcccagccaattttttgatttttgaaacatttctgatattctgtttaactttctttttgctttggccaatctttctttctctttccttctttccccctccctaaccctcccttcctctcccctccccaattctcccctctccagttctcccctgtcctctcctctcttcccctctccttttgggacagggtctcacactgttgctcaggctggagtgcagtggtgctatcattgctcactgcagcctcaatctcctgggcccaagtgatccttctacctcagcctcttgagcagctgggaccgcaggagagcacaccactacacctagctaatttttgttttgttttgtttttgtagcgatagagtttctgtataatgcccaggctggtctggaactcctgagctaaaatgatccaccttctttggcctcccaaagtgttgggattacaggcctgagccaccccgccaggcctctttcttttctttttcttttcttcttctttttttttttttaagctgctccttgctgagcagggctaactagtaagcagtggtctgtcccaatctttctattatgtttctttttcttattgctttgtaacagctttttgtattttgtttatttcatcaaccatttcttcctagattgtaaattgtctttcaaccttacctaaagtttgccataaagaagctctgtcaatttttagcttttctttgaagattttaaaacattaattgctaaaaagacagggacaacagaaaacatgggtgggctacaaagtataaaaagtcttgcatagtcattaccattttgatccctggttgcttgcaaatgtgcttcaaatcccagcttgggcacttcctgtctgattgtagggattttttttttaatttttttttttttagagatgggcatctcaggttgggctcagtggctcatgcctgtaatcccaacactttgggaagctgaggcaggtgggtcacctgaggtcaggagtttgagactagcctggccaacatgttgaaaccctatctctactaaaaataccagaattagccgggcgtggtggcacacacctgtagtcccagctacttgggaggctgaggtaagagaatcgcttgaacccgggaggctgaggttgccgtgagctgagatcatgcaactgcactccagcctgggtgacagagtgagagactccgtttcaaaaaaaaaaaaaaaagagagagagaaatgggggtctccctctgtcacccaggctggtgcgatcatagctcactgtagcctcaaactcctagtctcaagcgatcctcctgcctcagcctcccaagtagctgggggtcacagctctgagccacctcgccaggctgcaggcaaatttcttaatcttgccgggctccagtcttccagtctataaggtgggaataacaaaatttgcatataggaatttggggaaacgtgtagttctgggtttgggtgaagacctccacttttgtagtaggttcataaatcaaatcagagcaaatagttggtgtcttaaaaactgtatttatctgggtcttctaagtaaacggtttgaggagtggtggaggcagaaattaagatttactgagtacttagggtcaagtaaggtgcactggatcgtgttaatcgttaactcgtggaaaccgcccagagtgtgtacgctttctttcttttctttccttttctttttttttgagacggagtttcactcttgtcgcccaggctggcgtgtaatggcatggtcctggctcactgcaactccgcctccagggttcaagcgattcacctgcctcagcctccagagtagctgggattacaggtgcccaccaccacgcccggctaatttttgtatttttagtaaagacgggggtttcaccatgttggccaggatggtctcgaactcctgacctcgggtgattcgccgcctcggcctcccaaagtgctaggattacaggcgtgagtcaccgcgcccggcctggagtgtgtattatcccaattttatggggagtaattgtgctcactcggctcaccaccaagtcgccagagcgcgcctccgcaaggaagccctccaggcacttctactttcccggacccgcctcccgctccagccggttacacgcgccgttagcagcgtgggcggagttggttctgccttcgcggaaccaactggtccagcttctggtgtctcccctcgctcaattaaaagccagctcctctcctttcggcttccccacggtgcctttcgggatttgtagtcagacgcgcttcagccggctctaaggagagcaaaggcaagactccaattcccagcatcccccgcgcccggagagtgcagcgtctattctcatcctcttcacttttccactcctccccttacctcccttctcttctgaattctccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtggtgaggggacctaggagggcgggagtggcagaggtatgagagagagagaggtgagtgggaggcgaagagtgagaggaaggcagggagaagctaggagatcggaaggcgtgggtcagggtgaatgacgtgaagtagacttgggaagggaaaagaggtggctttagatttgggaagcatggaggggagaggttaccgccgtacttagcagaagtgggctaagagatagaagataggaaggacgggcagatttggagcttgtagactggtctgaccaggatgggatggaagagagaggtgtgggctcaattttctttgtccctgtttagccaaagatgagacaagtcattgaaatacaaaatgatcttgcaaacactggacagttaacaattctgtcacttggtaattgagggaagactggagttgaagggcagaaatagggtgaggaggcaagaaagggagggagattggtcaggtttgggagaaaccagaggagatgagtgacatgggaaaggagaccacagaaaaggtggggttattgtggggactgatggatctggaatcagttagaaaggtcaggggtgacactggcatggatggtgaggttgcacttctgacgtttgcattcctcaggtgatggagagcaccccttcaaggggactgaaccgagtacacctacaatgcaggaatctgcaggaattcttagggggcctgagccctggggtattggaccgattgtatgggcaccctgccacatgtctggctgtcttcaggtgagaagccccttcatggcagggaaatgtaatggggtctgcggagtggaataaaatatcataggtaaaagtgtagcagcctggagtcggggtggggactgggggcaagggttggaaattgctctaaagtgtggaggccaaaacagcaggactggtaaagttgtgctggagtgagatgagatgtttgagaggtaattgagggcagagatgcagatacaatgcagcttctgatactaacctttgacctctgttcctgtacagggagctcccatccttggctaagaactgggtgatgcggatgctctttctggagcagcctttgccacaggctgctgtagctctgtgggtaaagaaggaattcagcaagtaagtctcagccagatacaaatttctcaacagctacatttcccaaactgctgttccttggagcacttccaggaagtgttaatagatatatcacaaaacttaaaaataaatacatttgggaaactctgcatattgccttttcccttttatttatttcccagctgagatcttgctttcaaatgtatcttccctcttaaagagttatgtgtgatatctgtaatgaggctctgataagtaatgcagtaaagaatttgtcttaggaagatactaatttcactctgtggaacagtgttccaagggtcagcaagttcagaacaggcagagatggtggcttttatgggcctcctttttgttttccaaataccctactcacctctctgcttctgttccagggctcaggaggaaagtacagggctgctgagcggcctccggatctggcacacacagctgctcccaggcgggctccagggcctcatcctcaaccccattttccgccagaacctccgcattgcccttctgggtgggtatgtcacttctctctcttcctaagctagggcaggggaactgctgcttattaaaccactaattaaactttgggagggggagctcctgggggc

SEQ ID NO: 275 - DNA, 36313 bp, Homo sapiens
cccaccctgccaggcattttttaaaagtaaatatgaaagccaaatttgactgacttccaatagataaaaatgtagaatttcctcccatacattatagtttattttttcatatgtgttccttaccacaaggcttagtattactttatctacacgttaatgaagatgatgagaatgatataataatggcttggatttgtctctaaaacttcaagattatggtgcataactttgaaaacactttgtaagggccgggcgcggtggctcacgcctgtaatcccagcacttttggaggccgaggcgggcggatcacgaggtcaggagatcaagaccatcctggctaacacagtgaaaccccgtctctactaaaaatacaaaaaattagtcgggcgtggtggcggccacctgtagtcccagctactcgggaggttgaggcaggagaatggcgtgaacccgggaggcggagcttgcagtgagccaagatggcaccactgcactccagcctgggcgacagagcgagactccatctcaaaaaaaaaaaaaaagaaaaagaaaacactttgtaagaaagacaataggtagatactcttcctcttagttttgtgttaggaaacttagagatcagaataatgaagagatgtttattaggaaaaaaatgaccatcaaagtttctgtctttggaacgtagcataattcttttagtgaaaggtcaggtaagttaactttagatgggttccaggaaaaattgcatcatttttgctaacagacaaatcaaaggctgtcgcacaaaatggaaatatttcagaggaaagatggtaatgaagtaaagtgactggtttttctgtctacaaaagcagaaagattaagattttcttttttttttctgtcccagaataaaatataaggaagtttccttcataaacactgaaccccagggtcttacctgggtatttgttgtcttgatgctttttcaatggcattacattttgcccaatccaccacttctttccttcttccagatagtcccggatgagatcttgaacttccttgttccaaatatgagctaggaatcctctctgcacatgacagtaatgctgtgcttcctcaaagctgcattgaaatctgttaagctggtaacaattattttgcccatgtggtgctgggctgtttagctcacttcctagaataatacttgttctgatgtataaccaaagccagcttcctcctttgaagaacattttctctgaattgtagcaagaaaaagtgtgggggtttagcagctgcctggtcctttaaatatatatattggcgggcttgtcttattagtattattcttttatgaattgggaacaatttaccaaggatacaaaaggttttgttttgaggacccaggtgcaggtcctacaagctgaaaacaaatagcagagatcaataaaacaatggccctttttatctggggccccaccatctgtgtctacctaccgaatatgcctttagcaaatagagatcgattataaagctgagtctaagctgcactgggtagaggatgatgaatatctaacatctaagttagtgctgctaaaaattaataagtgtagctttttcttttctgaggcagggtctcattctgttggtcaggctggagtgcagtggcatgatctcagctcactgcgcctcaacctcccacctcagcctcctcagtagctggggactataggagtgcactaccatgcccacctaatttttttttttttttgagatagggtcttgctatgttgcccagggtgttcttctgggctcaagccatctgctcacctcggcctcccaaagttctggaattacaggtgtgagccaccacactcagccacattttttttttttttttaaagaaagttattcttgcagatcccctaggattgattttttttttctttgagatagagttttgctcttgctgcccaggttggagtgcaatggtgtcatctcagcaacttctgcctcctgggttcaagcgattctcctgcctcagcctcccaagtagttgaggcatgtgccaccacacctggctaattttgtatttttagtagagatggagttttgccatgttggtcagactggtctcaaactcctaaccttaggtgatccacccacctcggcctcccaaagtgctgggattacagacgtgagctactgcacctggcctgactttttaaaaaaataaatgttattgtgtatatttaaggcacacagcatgatgtcatgggatacatatagatattaagaaggttactatagtaaaacaaacatatccatcatctcacattagttacccacttttttttttgtttttgtagcaagagcagctaaaatctcatctagcatgaatcctgtctactgtatggttttattacctgtaatcttcagtttgtacactaaatctcttgacttgttcatcctacatctctgctacccccaggactgatttaaattactgtattctgtctcttaagtacatgcaaacagaactaggcataaatgctattttttttttatggggtctcactatgccacccaggctggagggcagtagcatgatcatagctcagtgcagccttgaactcctggactcaaacgatcctctcaccttggcctcccaaactgcaggtgtgagccaccgtccctggtccatgaactttatcttaaaactcttacacggtcataaaaacaaaacaatattaaatggaagaatgaatacaaattaaatacaaacaaaactgaaaatcaatgagatccaagttttgccaagctaaatggcagataaacagggctctggcctacgactacacaggttcctttgaatctggcatgcatgctattttatgatatggggagggttcagttctgataccacgtttctttatttgactcacacacacacatacacacacaaaaaaaacctttgttcacacagcaggtcatttggtctccacctgttgcatatccatcacgtgtattacagctcgttctttcttggtgccaaaaagtgatcataaactcaaacaaatgtgggcactgaactgcttggtaggtttcagggttaagatggttatccagatagtccaaatgatgcttatgttactctaaaaatcagtacagaagtggtcaccaaaattatgaaattctctaaaacacagactgcaagaatacatcctgtttgaaaaacactgcagtaatcagccaggcgtagtggctcacgcctgtaatcccagtgctttgggaggccgaggtgggcggatcacttgaggtcaggagctcaagaccagcctggccaatatgatgaaaccccgtctctactaaaaatacaaaaactagccgtgcatggtggcgcgtgcctgtaatcccagctactcgggaggctgaggcagtaggatcacttggcagtaggttggcagaggttgcagtaaactgagattgcaccactgcactccagcctgggggacagagcaagaccctgtctcaaaaaaaaaaaaaaacaataaaaaaaaacccaaaagaaaaacaccaaaaacactgcagtaatcaaatgaaagataaatacagtatgatcctccctttcataaagtccaattagggaagaaaaggcataataattgtaattaatataggcagtgaaaagtgccagcccagagggacagcttaggtgctgctgggaaggttcagataaggaagaaattacttccagcttttggaatgaacatattaagatggcaatatttagacagatgaaatggacatctcgacagaggagtcgatgtgaataaatacacagaggtgggaaagtggaaggtattgataaagagaaagaaatacttgagtgtgtgtgtgtgtgtgtgtgtgtgtgtgtgtacatgtagggggtacttggtggaacagtagtaggaactgtaaccagaaaatgggagagtttcaaatgccagaataaagggcttgcagtttatttggaaggtttctgagcagagtagtccaccctttcaagagtttgtgacaatggaatcatctggatgtgggatgcttttgttttcaaagttcacagagcctcaacttctaaacatcttcatatacatacataaataaatgcatgatacatccacacatatgtttcaagctttttttccagattaaaaaatgatactttattataatttttaaaattgcagaacgtcaggctgaatatcattagacacatacacaaaaccactcatctctaaagtcatcttctataccctctcaaaatttggccaatgaattatgcctcagggaattttccagttcaaccccatacataaatggaaacactagccttttggttttgcccacagttccaaagtgctattacaggtggagtatctgctgcaggaggtcattcttgctgctgtgggtgtgagtaaaatgtctatctgtatgcctctggtcctgcaggctttgttctctttctccttgtttggtctccttctacaggggttaccttacatactgcaatcaaaagacatcttctgctcggaatcaaaacagatagtgagaggttcaagtgagaagtaatgttacatagtaagttactgaatttacaatgagaaattgaactctggggttacaactcaaatatgatttcaaggtaaagaaaataattacttggctggctggtgaaatgcttagttccttctaaaatcataattgcaatatggacttctgcttcatgctgcattccaaggcaccaatcaggtaacctacatctcccaaatgatcaacagagcgttccttcctattttaccctcagtgctgagaaattactcctgagcccagaagttgttgtgtaggtgacttgggtgacttggtgcccaggcaacaactgccacaggccccaccttgatgaacaccattgatttctttaaatatgatgatactaagatggaggcccctgctcagaggaagcaaggacgtaaaagccaggacaggctgcgctgagggtcactacactaacagacccagacgacacgatggaacgtgaatactgaagccaacaatcttctggaactctcttttccaaaactcatatgctgttttttctaattgggaaatcagggacagggaaacattcgcataattacccaccaacatgttcttcttaacagaaatgaagattattattattttttttttgagacagactgttgctttgtcgcccaggctcgagttcagtggcgcaatctcagctcactgcaagctccgcctcccgggttcacgccattctcctgcctcagcctcccgagtagctgggactacaggcgcctgccaccacgcccggctaattttttgtatttttagtagagacggggtttcaccgtgttagccaggatggtctcgatctcctgacctcgtgatccgccctcctcagcctcccaaagtgctgggattacagacatgagccatcgtgcccggctccactttggttttttctaatcggttcaggatctcatttactttcttctccattgtcacaatttttacatccttctgcctgtgaaagcctatctgcctcacatccacgtcagctgttttcttcaggttagaccgtggagtatttaccacattaacgttgttcttgcagccttgagtgctattggccttcacaaggtgggcgcagtctgtcagcacttcctttggaatgtcctctatattctctcccttatgcaattgaaggtatacatgagccaaagagagtctgtccgcacgaaaccagatatattcaggccagccatgcttcatcagatcttcatgatgatttatgggttagtaggagagatataaaactcaagggccgggcgcggtggctcatgcctgtaatcccagcactttgggaggctgaggtgggcggatcacgaggtcaggagattgagaccattctggccaaaatggtgaaaccctgtctctatttcatatttatcctttcccatgtaaatagcgcaggcagatgaattaacgctgctgctggtgaagtagaacaccatgatgctggcgggggtgcggtgactccaccgtggagcagcagcgttcaactgtggcggttgcctggtccccggaactctcctcttttttttttttttaatgcattatggaaacttttttatgtgatttttgtacataaggaatatgagagtaactcttttacaaatgaaactaatttactagaacaaacagtgacaaaactgaactgatatttgatgtgaatccataggagtttaagcttcaaatccagccaagaaatttgttacaactccatcagctttgcatctgagtcttctgagatctttccatcagccctgatagtgcccaacagggcttagcgctggctgacaacatgagacaagaaagcattctcaaactttgtaatcttgctgggctccagtttatcaagatacccccttacacccgcacagataacagccacttgttgttcagtaaccatgggaggatactgtccttgcttcagcaactcagttagacgcacaccgcgactcaatagttgttgagtgggagcattgaggtcagaaccaaactgggcaaaagcagcaacctcacgatcctgagccaattccagcttcatggtacctgccgcctgcttcatagtcctggtttgggcagcagatccaacacaagacacagacagacccaatgttaatggcagagcggatatctttgtagaacaattctgtttccaagatctgtctgtcagtgatggaaatgacatttgttggaatgtaagcagacacatcatcggcctgtgtttctatgactagcaaagcagtcaaggagccaccaccaaaagcatcattcattttggctgctctctccagcaaccgggagtataggtaaaacacatcaccaggacaggccttacgaccaggggggtcggtggagcaacagagacatctgacagtaagcgacagcctgtttggataagtcgtcatagatgatcaaagtatatttgccatcgtctctaaaatactctcccatggaacagtcagagtaaggagccaggtactgaagtagggcagcatctgaggccatagctgacaccacagtggtgtacttcacggcatctgcatctgtaagtctcttcaccaactgagcaacagtggatctctttcgaccaatagcaacatagatacagtacagcttcttcttttcttcagatctatcattgaaatgtttctggttaatgattgtgtcaatagcaattgaggttttcccagtccttcggtcaccaataatgagctcatgctgaccacgaccaattggcaccaagctatccacagccttaatgccagtcggcattggttcccacactgaagttcgaggaatgattctgggggctttcagaccgactcacttatgggtcttggaacccattggaccctttccatcaatagcattaccaagggcatcaactacacgacccaacagctcctcaccgactggaacgtccacaatggttcctgtcctcttcactatacctccttccttactttattattttcaaacactacaatgccaacattgtcagtttcgaagttcaaggacatatcctttaagcctgaagaaaactctaccatttcttctgcttggaacattcctcagcccatgtacatggacaataccatcaccaatacttaagacatgcccagtttcttcaaggtcagcagaggtatcagctccaagaacatgctctttaagaatagaggacatctcagcagtcccagtcttctgaagatgagtgttagaggcatggaggttccttgcagcaatgaaagatgaacccaaagcatttctggagaccagtcctgcccaccgagtgaggtcacgggctacggccgcggagacacacacagacagcatctttgcagtttctccacaggtggtacctccacagccgcagcctctggactgactgggaccgtttcaagcatttttaaatgaaacctgatgttgatgaaatctctgaaagtcaagtcaggtatcttacacaatgctgtaatttcatttcaatccttttcataaagggtaaagtccttgtatatattctttcaatacatgctttatctaagacacaagcactctatcaataaaagttttaatttaaacgaccaaaaaattggtgagagagtgctcagaactgaggataaacatgtaagtagttttttgtcccagatgagcaatgatttatgttgactaaggtgtgctgaattaacttattccattaaagtgtaaagggaagacaggttgataagcataacttttaccttgataaatgttttcaatgatttctattgcatgtagactgaaacacctagcatgtaaattattgcagtagaatctgtctctaagtctcagctgggtctgtgaatttgttctaatttgatagcttcatacaactgatgaagctcaaaaatggcttgactcaagatatttcatacacctttcttttgctctaatttctgctacgacaataacccagctatttcagctgatggcgggaacactgcaactggacaaaaatgacacggatgggtgtagagcctccaaacaataagtatctgattaatgctgttgacacctaagtctacagaggctattctccaacggccaggacatcattaggtaagacatttcaaaattcttcgtgagggcacgattgcttcagaggactacaaagtgacacattaggtcgtcataaatcaccgcagtaccatcctggctaacacggtgaaaccccgtctctaaaatacaaaacaatgagccgggcatggttgcgggcgcctgtagtcccagctactcgggaggctgacgcaggagaatggcgtgaacccgggaggcggagcttgtagtgagccgagatcgcgccactgcactgcagcctgggcaacagagcaagactctgtcaaaaaaaaaaaaaaaaaaaaaaaaaaatcaccgcagtaaaccacactccaacgggcctgcacactcagggtcttgattagaaacagtatttaaaaaaatacctccacatctgttgcaccacaatgccaaggtataaccagggccactttctccaggaggcacaacaggcgcagggccagggaagggcctctgacacttttaggatctcaagaaattttttttttttggttatttttctttgtttgtttttgagacagagtcttgctttgtcgcccaggctggagtgcagtggtgctatctcggctcactgcaacctccaccttctgggttcaagcgattctcctgcctcagcctcccgagtacctgggattacaggcgcctgccactacgcccggctaatttttgtattttattttattttttagtagacacggggttttgggtgttgaccaggtctcgaactcctgacctcaagtgatctgcctgcctcagcctcccaaagtgctgggactacaggcgtgagccaccatgcccggcctcaagaaaatgttttaatttccttaaaaaaccttaagaaaaatcaacttttaagttgaaaaagtttatatattaacatattcatctttatatcaacacagcagtaaaatttattttttaaagtgataaaaactgtacaaatatttctggtgtgaaacacagtgttttgatgctcgcggactcttggattcgaggctgcggtagtacggacaaacaccgtgcagcggcatctcatctccgccaacagccggcgatcaagcgggcaggctgggagagggcgggcggaagaggcgtggccgccgctactgcgcacgtgcacccaaccagaacctgggggtggtgccgggccttccccgctgcgcggaggcgtcctctcaacccttctgcccggcgactggtgggttggcggctaaggggcggagacaagaggggccgccaccatctcctccaatggaagggagacaggggcgggcttaatgacggaaggagcatggcgtggagacacctgaaagtgagtcccgcgagtgagcagtgtggatgggggaccagggaccggggagggcgagaacggagagtcaggccgggcgaggcatggaccgaaggcggctccgggagtgtgggcccccctgggacgtgtgcgtgtttccggggtctcctgcaaatgctcgtgcgtgtgcatttgcacgtggactcggtcaggcgtgtgcagacagcgcctgcaggtctgggtgggtgctgatctgagtgtctgcgcctgggccatgtttttgagcctggcacaggggtgcttagtgaacacatgaccgcctagcgttgtgtgccggatccaacggggaatgaaactagagtaggacatgctcccaacccttttaggtaaagttttgttaggggcgggggtctctgtgaaaagttcttagctgtatccccgtatgtaataggtgttcagaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaataggtgttcagatatttgttgattgacatggtgggggggagtacagtctccaagggaggcaatgaataaccttgactttctttttatatgtttatttgagacggagtcttgggctgtcgcccaggctggagtgcagtggcgcgatcttggctcactgcaacctccgcctcccgggttcaaccgattttcctgcctcggcctcctgcgtagctgagattacaggcgcgcgccaccacgactggctaattttggtatttttagtagagactgcagtttcaccatgttggtcaggctggtctcgaactcctcacctcgtgagcctcccaaagtgctgggattactggcgtgagccaccgcgctcggcctgagtctctttttaaaataaataaatggagagagatgggatctcactgtgttgcccaggctggtctagaactattggcctcaagggatcttcccgcctcagcctcccaaagtggtgggattacaggcgtgggctaccgcgcccagccaatgaatacttgatctacatgtctttagcagtttggaaggatccttaaaagcaaatctaatcatgtcatttcctggcttagggaacaaaacccaaatctttattttggccaagactcctgctcctttctcctgcctcgtcttaagccttactttccctcactcctctgttccaaactttctccctttttcattctcttctgctactgagagagcctttacactttttcctctccgtactgccttctggttaactatttttttaaataattgaaccagaataggttcagagagacccccatcaactcgtttatcccttgagtatcagctttaagtcatttccttaaggaagcctttccttacctctaagattaggttgaatacttccattaccttatactttttatccttcatcacagttgctatgactacatatttgcatgatcattaatttctgtctgtcgcttcataagatcacactctccatgagggtaggggcaagatctgttttgtcatctttgctcaatcagtatttgatgaatgactgaactaatgaatgaataactcagcatgtggcagtgatagagaaaagcattgtgaaccacttttgatccaataagatctgaagcttctgttttatattttacacccccgttaccttgaaatggaatatatgtataatgtctttgtatgtatacatttttgagagagtctgactctgtcgcccaggtggagtgcagtggtgtcatcccggctcactgcagcctggacctcctgggctcaagggatccacccacttctgcctcccaagtagctgagaccgcaggcgcaccaccatgcctggctaattttttatattttgtagagacggggtctcactatgttccccaggctggtctcaagcgcctgagctcaagcagtcctcccacttcagcctcccaaagtgccgggattacaagcatgagccaccaagtccagctatgtgcaatttttaaaagccagcataattaataccctaactggaatataaaggagaaaatgtaaaagtagtttatattaataataaaattacatgtatttcagtatgtaaatattgctatgactcccctagtgagatagttgtgtttaagtctctacttagaaatgcaggtacacaggtgtgttacatatcaggcaccccaggaaagcactgtaccattcccgatgagattttctgaaatggtgaacaattcttgggaatgttctatgtgaaactgtacagttgtccctcaatttacaagatatttgtactgtatgtgaaaaccatgtagaggctgggcacggtggctcatgcctgtaatcccagcactttgggaggccaaagcaggagtactgcttgagcctaagggttcaagaccagcctgggcaacataaagaggctctatctcttcaaaaaattggctgggcttggtggcatgtgcctgtggtcccagttacttggggaggctgaggaggggaggattgcttgagaccaggaggtcaggaaagacagtttgtgtttatgtggtaaaatatagtttggcttagataatatgaacggataatttttacccacacaaatgtcagaatgttcaaaagtcacacaggaaatggggcagttcatgtcagatagtctcaagccaagaaggatgtctgactttatggattcctgcccaccacatctattagcattaccctgtcactgtaaccagtagcagtgtccaccacgatcaccctaggggacagtactgtccctctttaaatttctggcctggagtcccaggacagcctttagggcctgaagaaggtgtgtaggcagaagtatagatacagcctctgactgtagagaccagtgtcagcggaaggctaagggcgtctgtttcatgtgacctgccgttatgccctctgtgtacctgggtgtgaagggctcaggaagggtgctgcagcctggcctgggggacccccctaatatgctcttttttgcagaagcgggcccaggatgctgtgatcatcctggggggaggaggacttctcttcgcctcctacctgatggccacgggagatgagcgtttctatgctgaacacctgatgccgactctgcaggggctgctggacccggagtcagcccacagactggctgttcgcttcacctccctggggctccttccacgggccagatttcaagactctgacatgctggtagtgctcccagacaccctatacattaaatacaaaggcgaaggctgcagtcccctaaacttctcagctgggactgatctttttgaaaaccagaaccccaagtgagcagtggggatttggaattcagtctgagcattattattttatgtcatgtaattagcaacgatgattatctattacgtatatgggattgtgttaggcggtgttcttgtttgatcctcccagctgctccatgagctggatcctgttaccatccccagccatggatcaggaaactgaggaacagattagcaacataaaggaactcaagtcacacagctaggaggtagcaggaccaggattcaaacccacagagtctgacgctggcttcccgccccttggccactgtcctgccttgctgaggtcgtgggtagctcagtcttcccctcagctaaatggggaagctgccagagtcattaagcactggtgagaggcaggagcatcgtgtcccagcctcactcagccacgtgttcagcacacgggccctctccatatgcttgaaatctttggcctagagtcccaggaaagcctctagggcaggaagagggtgtgtaggcagaagtgtagatacagcctctgactgcagaggccagtgtcagcggaaggctaagggcctctgtttcatgtgaccttccgggcttagtgcagcaaaccgaataaaagagtccccatcctcatggaagctgcttcctcatggaagccttggcagtttcctttcgagaggcttcttaccaaatgggaggacatcagaatgatgagtgtgaaaatgcaaacaagaagccctcagaactctggtgggaagggtcactgttataaattaaaggggccttcaccgcattttctcttcctaccttagactcctcttcactatctgattatatggtgttgagcagacgtgtcatttcccctgactggccatgctcacacactaacaggcactgtaggctcagaaagagcactccgttaaggtgtcctcacctcagactgctagtttgagagccctggaaccagtgtaaaatgggagtgaataatgagtggggtgcagagatggggtgaatttagaaggaagtgcggggtgcctgagggtgcaagctgtgtctgtataaacacagatgacagagacaggcaaacctgacctctgaggtgttgtcctcaacacctctgcgtgggcccacacttgcagcagctcatttagaatgtgactcagactttttaaccggtaaccaggattcttgatttcacaactttcctggtttggctctccacccttcacctatgtcaggcatgttagaatcccccgggggtgcacttggaatattcagatgccctggcctggtgccagaccagtttcaccgccacatctgagagcaggacctgaaagctgccaggggcctttgtggtgcagctggagctgagaaccacggtcctggaggaaggcccctacacatcttgcctaccagtctcctgaggtgctgtgagcattctcaccttcatttgttgctcttccttcttggagcatctctcttaatcccctgcttccaggatccgaccgtgttcaccccgggaggcctttgctagtctcctgaaaggtcgctggagcccatcagtcagttctgcccagctgaacatcttccttcctctggttccccgtgggaggctgggggacgtggctggggcttcttgccagcccggatgaggagggacacagctggagctgatgtttattaagctgattaaagggttttgctgcttgacacgccttggtttcagggaagcactatctagggcctgacaccagcgagctactccctcccaccaaggctagttgataagaaggtatgaaccttaaccacaattggaaaagacagtgctcgtctccgcttcaacccacggtggaaacaccatttctccccccaggcttgctaataataaagccccgtggttttcaaactctagctggtgtcacagtcccctggagagccagcactgttaaaaatagttcccccagtgctccattccacccccaaagattttgaccttgggggtgggccctgggatctgaggtttcacaagcttcccaggtcattctgatgtagctgtgccaggaaccatgctttgagaaataccgggatagccttagcgtgcctctgactttgtcttcctcttcccaggaagtgagagttctgggccataaattccgaaatccagtaggaattgctgcaggatttgacaagcatggggaagccgtggacggactttataagatgggctttggttttgttgagataggaagtgtgactccaaaacctcaggaaggaaaccctagacccagagtcttccgcctccctgaggaccaagctgtcattaacaggtaggtgagcggcccagagttaacgggggatgccctctttccagctgggggcgttcagagatataagatctgcctctgttttttttctctcatacaatgtggacattcttctgtcatttggaatgttcaggaaccctgttcagcatctactatgtgccccaggcatctatcttgaaaagcatgctttgttacgtccatttaacagttgggtagatggaggctcatagagctaaataactccgcttcggtcacggagataataagcaggagagcttgggcatggcctgggcttattggacttgagagtttgtgctctgtccatgttgtttctccaatgctcttactcgacactgtccaggagaaatgtaatgtgagccccatatgtaatttaaagtactctagtgaccacattaacacagtaaacagaaatgagtgaagttaatacttacttaaaattataatttatatttaatgttacaagtatttaaaaaaacgtatatttaaaacaccataaaaagtattaattcgctgtttttaccttcttttgcctgtaccaagtcttcaagagccagtgtgcattttacttccagcacctctccctttggaccagctgcattcccagcagccagtagccacatgcggccagcaggcttgtattggctagcacagccccagcctttagcaaacagggaaatgtaatattcaacatgcacagctgctcttagtaagagaaatccttctagactgtataaagcccttccctttgtcatccctgggcaatttttactacagcaaacccaaaaggtgaagaagtgcttactttttggtaagaggattttgaagagcctccttggggagatttcgatgggcatctttggggccactggtggcctcctgggagacggacctgtaggacatttacttggccgtgcttcctgctttcttgtgcttgtttcagggaaattctccagcattagagatcaagttattgatctttctgctgcattgcaggtggggatcaatatcttcagaattggccaggcaaaatatatttgcttaacattcagctgctacagataactgcaggtgctgggatgatggtacttggtgaatcctataggtgagcaggggtgtgagatcctgctctgagccctgtgtgtgcggcctcctggttgtgtggcatgtggtaagtgtgtagtaaacacttaatgaatgggtgaagttatgaagtcatcagatatgtgtgccagtgtgtctgttattatggatgcttttggctctaacaaagtggcttaaacaacaggcacatttgatattattttcttctcataacaggtgcaatgggcaggtccagggttggttgagcaccagggcagtgttgagactctggtccaacttctctgggcgttttctttttgcttgtcagagagcgacctcggctgcaagtattatgttcttacacggacgcccaagagcagaaaggaaaaagggcagggatgttctcagaggctcccagtaggtctcacttgtgtctcagtgtctacacttggcatacacttacgcttcccttgccagcaaggctgggaaaggagtcattagcatttttaccctgtatcagggcaggtgggtttcactggcaaagaggaagaggaaggggactggccactaggtcaaaacccacagtggggctggggatacagggatgaaagagagatgaggctcctgccttcagggagtgtctagtgacagtgacagagggatgagagaagtatgagatgttgctcaccctcaagaagattgtaacctagggaccttaagcatatatgtatgtatctatcccaagccaggagaaaggtggggccaaagctctgtatgaaggccagggggatgagggatcctttgcagctgcgagctctgtgcaggaggagagggagcgtttgctctgagctaggaagagaggtgattttcagacagaaagcctagagagatggagtggctgcaggggcttcaggaggctgtttgggagcccaggcagaaggtggcaagtgagtgtgcaattctcagagagtggctgggtaaggagtggggatccagcaggtctggggcagctgctgctgagtctgggctgtttccagtgctagctggctgagcatttgcaaattttaatctttccctgggtattggatggtgttctggcaagttctctaggagtcccagtggtgtttagaccctggaagtgtaagaactgactgtgatttttttttttctcttgtttgaaaaagtcctaagtgtatgggaagtggctatggtgccgtctcactctgcccctcccgtgtgcttgtgctctgcaggtatggatttaacagtcacgggctttcagtggtggaacacaggttacgggccagacagcagaagcaggccaagctcacagaaggtaaagtggggttgtgtcagtgggcctttcttatttattaggaggaaacgtgggagaaatgctgggaacatttctagtgaaataaacatgattgagcaatagcaaaaaccactgaggacctcaggacacctctcctagagcgattttcctggtcccacacagcttccaagagtttaactggattttgcaatttagcaaatactcactttgcctctgccttgttatgtaacctgttaccgtaactagggaggcctgaaagcaagcgaagcaaagcggctgggcaatgatcacacaggcaatgagggcaggagcaggacttgaatgtcatcctcccgtggcccactctgtcctcccttttttgtcatccattgtgtaaataatgttcattaattatagaagacttagtaaatacagagaagcgtaaagaaagaatgttcaagaaacagatactcctccctactcaaggctaactaatattagcatttgggaaaatattcttcatgagttgttttggaaactcatttttggttcgggacagttcacacctgtaatctcaatactttgggtgcccaagttgggaggatcacttgaactcaggagtttaagaccagcctgggcaacatggtgagatcccatttctctaaaaaaaccaaaaacaacatgcttttttttttttttttttgagacggagtctcgctctgtcgccccaggctagagtgcagtggcgggatctcggctcactgcaagctctgcttcccgcgttctcactattctcctgcctcagcctcccgagtagctgggacttcaggcacccgccgccacacccagctaatttctttttgtatttttagtagagacggggtttcactgtgttagccaggatggtctcgatttcctgacctggtgatccgcctgcctcggcctcccaaagtgctgggattacaggcgtgagccaccgcgcctggccacaacatgcatttttgaagacgcctccggcgatgcgggtgttctctgtggcctctgcctcacttgctctcaggatgcacttagtggtcgcagccctctgttgtcctgaccctaatgcccctgggaccctctgggattgtgtggggttgtggctcagtagcgaccattttcttctttgggtccctctgaaactccttccaggatgtcttagtctcagatagtcctggtagcaggatgaagaaaccaatggatatgggattcatttcaggaagtgaggtggaaagggctgaggcactcagcagtgtcagatttggggaataggaaattatcttttggaaacccctgggttgggtggaaccagaccccgctgtactgcagagccgcccacctggggagctttggaggtcatcacaggacttgcatggtttgtgatgcttgcccgccttcgtgcttgctttttcttctcctcggtgtctgcagtgcagtgtcctggctttatctcctgttcttcctcacccagccctccctccctgtggccctcctggtctacggagtgaagcggagcctgcagcagtgctctgcacggatgtgtctgccagcagcttaggggccttcatggcagcttgttgttagcaccatgccaaggaacacgcgttgacaaaagctttggtgccctctggggacagagtaatccagcaatttctgtctaactcccaaatcttgtcagtttgggcagatgactcctaatccgttagctacatgaaagtgatattctccttcaagtcagtttacttgtgaggaaaagaattcaagcttacagatgatcttggcttgatgggtgctagactgggaagcttggagaccttatgataaaccttttgtctaattggattctttgtttcttttgagacagagtctcccgctattgcccaggcaacagtggtgcaatctcagctcacagtagcctccacctcccaggttcaagcgattctcctttctcagcctcccaagtagctgagattataggcgcccaccaccatgcctgactaatttttatatttttagtagagacagggtttcaccgtgttggccaggctggtcttgaactcctgacctcaattgatccacccacctcagcctcccaaagtgctgggattacaggcgtgagctgctgcgcccggcttctaattgggttctgatcccctcctccagtccccaccctggaaagtagctacactcatctcatttgctgatgatgcgagagtgtgattggggttgggaaggtggtgagcagtacaatagatgttgtttgatcctctctggcctgacaacacattttgtgagctacttggtgttctaattcttcccccaactctcagatcaaaagtacagcctgtaccattgatgtaccactccccgtgcagataagatagtaaacttagaagaagtcaagtagagacaacccgtttcttttacacatagtgtgtttctgaaaatgtattttttctggaggtccaaaatgcaagtccattgatagtcctgtggatttttaagtaagctgacctaattgcttacatgtaaactgagaccctcttgagagtaaaaaggggcaggtgttaacaatgatgcccaggctaggggagtaatcaggttgtccagggagcacctaagatacagggtaccctcagttattatatgagggagagtccctttcctcagagaactaaaattataagttagaaaacaattacacctctacattttaggcatgataattgaaaacatttggccgggcatggtggctcacgcctgtaatcctaacactctggaaggccaaggcaagcggatcatttgaggtcaggggtttgagaccagcctggccaacatggtgaaaccccttctctactaaaaatacaaaaattaggccggttgcagtggctcacgcctgtaatcccagcactttgggaggctgaggtgggcagatcatgaggtctggagatggagaccatcctggccaacatggtgaaaccccatctctactaaaaatacaaaaattagctgggcgtggtggcacatgcgtgtaatcccagctactcaggaggctgagacaggagaattgcttgaattcaggggacggaggttgcagtgagccaagattgtgccaccacattccagcctgggcaacagtgagactccatctcaaaaaaaaaaacaaaaaacattttccagtatatatatatgtgtatatgtatatgtgtatatatatatatatatatatatatgtgtatatatatatatattttttttttttttcttttttttgagacagagtcttgctctgctccttaggctggagtgcagtggcgcgatcacggttcattggagcctcaatcctacttcagcctcccgagcagctaggactacaggtgtgcaccactgctcccggctgagttttcaattatagagatagggtttcaccatgttgcccagactggtcttgaattcctgggctcaagcaatcctctgcccttgaccacccaaagtgctgggattataggcgtgagccaccgcacctggcctgtttttcagtattttatacatgttctttcattttgttttttcttcgcaactgtacatccagtcaaccgagccaaggccaacaagcattccttgaggtgagagttgcgggcctgatgtgcctactgagttctctctgttctcagttttattcaatttatgaggcccatcttttgccccacaagtatttgcagtaatttgtccattttccatgaaaattttaaaaataaaaagggcaaaatgcagcaaaacatcctcgtagctgcccagactttgctagacaaagccagtgagtggttttggtcagcaggcgggcccaggccgcagttgagcacctgtcagccggtgtcgggcaggtcaggtttggagggaaggcctgcgcggctgtccacaggtggtttggtcaagggcagcctcagaaggtggcacaggaaagggtgtgcggggtgcaggcctgaccagcgatgtttgcagatggactgcctctgggggtcaacttggggaagaacaagacctcagtggacgccgcggaggactacgcagaaggggtgcgcgtactgggccccctggccgactacctggtggtgaatgtgtccagccccaacactgccgggctgcggagccttcagggaaaggccgagctgcgccgcctgctgaccaaggtgggcagctgcacccctctccaggccctgtcccaccagcctgtcccacctgctccccttcattctccagggcgaaccttcagcatcaccctcagaagctgtccttagcacctagaccagtaggacccctggctataccttcccagagtcccctctgatcccctctcatgacactgattatatgcgacggtgacaaattatctgtccctgctgctataaatcacggggtctgtaagagcagacaccacgtctctctcatttgtcactctgaccctagcgcccagagctctgagtgaactgaaggacttcatcacccagtacatgtggtaatatttcctggttatcttttaggaataaaagtctaaaaaacgttggacaccgtggctcatgcctgtaataccagcactatgggaggccaaggcaggtggatcacttataacccaggaatttgagaccagcctgggcaaaagagcaagaccctgtctctacaaaaatttaaaaattagccaggcacagtggctcaagcctatagccccagctacttggaggccgaggcaggcagatcacttgagctcaggagctgaccagcctgggcaacttggcaaaaccccatcttacaagaaatacagaaattagctgggcatggtggtgcacacctgtagtccctgatactctggaggctgaagtggaaggatcgcctgagcccagggaggtgcaggctacagtgagccgtgatcatgctactacactccagtgtgggtgacagagtgcgaccttgtctcaaaaaaaaaaaaaaaaaaagaaaagaaaagtctaaaacacccttgagctattagccaatgtccacgggatcccttggcctaaaagaatggaatcggatccatctcgactgtactcctcacgtctgagggctggctttcctgaaaagaaattgtttctgctttagtttgatcgctattgtggaaacccactgacctgcagcgtaggtcacagctgcactgcagggctgtggtctgcggggtccccagctctggccgtgtgtcgccctaggtgctgcaggagagggatggcttgcggagagtgcacaggccggcagtcctggtgaagatcgctcctgacctcaccagccaggataaggaggacattgccagtgtggtcaaagaggtttgagtcggggcctgggcccagggtgtgcctcccatggtctgcagaggccgtttggccagctgggctagcccagaatggcgttctttgtgatttcctctccttggtattcaaggctggtttggtgtgtgtcatggtgtaactcaccctgtggtcaaaagcgaatgttggaataagtgcttgaaggagtttttctaatgcctcttcctctcttttgtcaactgcatccagcaagtttaaggcttgagcttggctccttggccagtcttgactgggactgaaaattctttctctcactcctctctccagcctgtctggacagcgggtctctgtggcataggagagtagtggaaacagactgagcccggccatcgtgggttcaaatcctggttccaccacttactacctgggggcctcagacaagacactgtaattgggttgttgtaaggactggaccctgtcctaggggaatgttgtgggtggtcagcgtgtgatggctgctgtcgtcatgttatggctcattctaaaacttgttgaggaaaagatgagtagtgaggtctggtgtagctcttgctttgggggctgtaggtgtgggtacctggcccggctgctgccttcgacctccagagaagcgcctctgggtccttcggtgctatgactcatggctttttctctatctcgcactgcagttgggcatcgatgggctgattgttacgaacaccaccgtgagtcgccctgcgggcctccagggtgccctgcgctctgaaacaggagggctgagtgggaagcccctccgggatttatcaactcaaaccattcgggagatgtatgcactcacccaaggcaaggtttcccgtgtttgtgtcttcagatctgcgtgtggcttgggctcctgggtcgtgatgggaatcatcattccctaatctgtcttgattgtgggggactctggggctgaagccacatccttctttatggtgtcgccatgtgcttctctgtaggccgagttcccataattggggttggtggtgtgagcagcgggcaggacgcgctggagaagatccgggcaggggcctccctggtgcagctgtacacggccctcaccttctgggggccacccgttgtgggcaaagtcaagcgggaactggaggcccttctgaagtgagtgaggtcatgtgtggcttgaaacagaagttaggcagaggttcatttagatcactcaagtcaacgagatactgttgatctgtttcttattcattcaaaaaggagttgaggggtacactctgaaggggagagaaattctgggttactcttttgatgaaggacaaacaatgccaaggagaactgaggattaacctccaaggcaatggtgtttctaaggtggagttgtccatttgctcaagggaggggagcctgaggaatcccatcagcattcccattaattaagcaacactggttcaatgttgggagctgtcaatacttaaaagcaatttccttcctgctctgttcctacctgggtagaaatatccctaggtctctgggtgaagagtgtagaggaaaccagatgtgcctgggccgggatgatgcgtttctgggtgaacgtgggcttcctgtaagagcagggcctgttctccactgtttgctgaaattgctttgtttgctctttttccagagagcagggctttggcggagtcacagatgccattggagcagatcatcggaggtgaggacagcgtctgacgggaagcctgatctggaaccttcccaaggactcaggcaagcctttgtggctggatcatgagaggagggactccatcttgagccatgtcccccagccatggcatggctgcactgtaaacgccaatcggggggtcaccaggatcaaccgcaggctttcttcagtcccttggtcagaccataaactgcatttttgattctttgtggattcaaaccctaggatccatcagtcttgcaaggacattgaatattaggaggaaaaagtcatggaaaaaataaagccatttagaacctgggtttcaacgctagccctttctggtttgccataggccctgccaagatactgcaggtccatccaggcctctgctatctgcatctgcagtgggcttcccaggaacttgactgtctttcatttgatctttatttttgtttatttaatattttaaactttattttaaaaatatttcaaacataagggcggggtgtggtggctcatgcctgtaatcccagcactttgggaggccgaggcgggcggatcacctgaggccaggagttggagaccagccaggccaccatggtgaaaccctgtctctaccaaaaatacaaaaaattagccagatattgtggcaggcacttttaatcccagctactcgggaggctgaggcaggagaattgcttgaacctgggaggcggaggttgcagtgagccaagattgcaccagtgcactccagcttgggcgacagatcaagactctgtcacacacaaaacaaacaaacaaattttcccgtttctctctgtccctttctctataacatggataaaatattcacgtcttatgtatttattattgctgagtcattggtgccttattcttcagtgtttcagtctgtatctcctaagcatcctgatgttagttttttgactataaaattgacctgcattctttactagcaattcaaacggtacagcactcttgaagtgtaaacattcctgttcctcctcaccccactctgcagacatgcctttctgtctgtcctcccagacttttcccctgcataaagatgttcattttgtacatacactcagacatacatgtggctgtattttttgtataccgatttctggatggaatgcacactgttatctgtttagttactttatgttttcatacaaatgacatcatcccacaaatagaattctgccatttactttcttcactattcttatgtggcatggttcatgctgggcctcggtcttttgagtggggtctgtttacccagtcccctgttggtgatcacatcgctaacttccggcgttttcctatcaccatcggtgcctccgtgaacaccttgtgaatgtgcctgtgccttcgttctggtgtcggtgcagagcagggtccaaggggcgtgacagctgggctgaggggctggcatgtttcacattctgatagatagagccaagttgctcctatcaggttttcaagctgcccatttcccaccgtggagacagcaacagaggggacatccccagctcctctggctctgcctgttcaaagctaccctgtgaggcctgaagacagagctgccctgaaggcagctcatgtccactgaacactgactgtgggctggatgctgtgccaagggcttgacgtttcctctttaaggatgaggaaacgggcagagaagcggctgattgtccagtccccctgcgtggaggctgcttggctgggctcgagcccagcggtgtggtcatagagcatgttgtgctgaatggctctgccatggaccaagccttggctgctctaaaagccggctcattgccttctgcttctccggattcgttccttactccaggaagagcagtgcactgaaggagaaatgggaatgggcaaaaggaaccacatgctggccagacccctgcggggtcactttcctcagcctgggctccgacatgccacgtcaggtgccagcgcacatactctggacaccctcctcattctctctgggctttgatgctctctgtgagtcatctgccctccctttcccatgctacaggcatctaccttgctctgtcccacctaatagcttcaggactgaacaattcaggaaagggaagggaaggggtggaggagaagagggaagagtcggcccttggaaggttctccacggaagactgccttttttttttttgagatggagtctcgctgtgtcgcccagcctggagtgcagtggcatgatctcagctcactgcaaactccgcctcctgggttcaggggattcttcagcctcagcctccagagtagctgggactacaggtgcatgccactgtgccctgctaatttttgtatttttagtagagacggggtttcaccatattggccaggctggtctcgaactcctgacctcttggtccacccgcctcagcctcccaaagtgctgggattacaggtgcaagccaccgcgcctggctcgagagactgacattctgtctcagcacagctggaagaggctgcttgagcaccaggataaggagttgtcttgcattcaggggccatgtggtgtgcggatacctatttttctttcttttcttttttttttctgagacagagtctcgctctgtctcccaggctagagtgcagtggcatgatctcagctcactgcaacctctgtctcccgggttcaagcaattcttctgcctcagcctcccaagtagctgggattacaggtgcccactaccacacccagctaatttgtgtgtgtgtgtgtgtgtgtgtgtgtgtgtgtgtgtgtgtgtgtgtgtgtttttgagatggagtcctgctctgtcaccccggctggagtgcagtggtgcgatctcagctcactgcaagctccgcctcccgggttcacactattctcctgcctcagcctcccgagtagctgggactacaggcgcctgccaccatgcctggctagtttttttgtattttaagtagagacagggtttcaccgtgttagccaggatggttcgatctcctgacctcatgatctggccgcctcagtctcccaaagtgctgagattacaggcgtgagccagcgtgcctggctaatttttgtatttttagtagagacggggtttcaccatgttggccaggctggtctcgaacccctgacctcaagcaatccacccaccttggcctcccaaagagctgagattacaggtgtgagccaccgcacccggcccaaggatacctatttttcttaatgctggaagccacactcagacaccagagcagctctcaatgctgggaatcctgggagactgatgatgaccgcgtctccctctgggaccaaggatggtggaagggtgtgcagaattccaaatgttatttacatcactcactcttgtgtggagtgcataattgtctttgcttgccaatttcatatcagttaaatataagcagtaagctaatcctattctgtgacttacttttctcacgtgtcatcataatgatatacgtcaatattcatccctcagatcggccttgctctaacagcccttttcacggcataaatgcatcaatgtttgcttatgggaaacacaaaggatattttcaggttttcacatcagacagtgcttcagtgctcagggcttatgtatctttgtggtcttctggtagaatttctgtagattcccagaagtggtattgcttgggcaaaggttatacacactgaacatgttgatacttactgccaaattgccatgcgagagggctgtccaactttgtaagggaaggcctctttcctcttatgttgttccacatgggaatttcaatttcactggtctggaataagctgttcttccttctcaacttttccactaggaatggcttgcattatggctctcccttggttaaaaaaaaaaaaaaaaagagagaaaagaaatggagggtttagcaggttactttgggctgcagccagagtgattgccacatgcatttctctctttatctcctctctctcctaccataggctcagttctgtatcagaaagggctgaggttcctacatgcaccaccttccttcaaaggggcaggtacgtcaggtcacatacactcaagtgttttgaaagaatccatttccccactgactttctgataggctgcttctgggtcaagttctgtagccaatactttttttagtctgttttccccatgaggaaaacatccagtcagaatggcagtctcaaggacaagtggggaactgtgatgtagcgtggagacgatttgcttacttccatcttggaggccaagggtgtaacttggctacctcagtagctccttggtggtgcttactcagtgcccctgggtaggaaaatcaagttgtcaggacaccgaggattcactcagctctgctctcagcagcagatgggaggcacgggctccatctggaagaagaccttgctcttgcactccagctagtttgctgcccacaacgctggccagcctttaataagagaaggcaggccgggcatggtagctcatgcctgtaatcccagcattttgggaggccaaggcgggcggatcatgaagtcaagagatcaagacaatcctggccgctgggcacggtggctcacgcctgtaatcccagcactttgggaggccaaggcaggcagatcacctgaggtcgggcgttcgagaccagcctcaccaacatggagaaaccctgtctctactaaaaatacaaaattagccgggcgtggtggcacatgcctgtaatcccagctactagggaggctgaggcagaagactctcttgaacctgggaggcagaggttgcggtgagccaagatcgcgccattgcactccagtctgggcaacaagagtgaaactccgtctcaaaaaaaaaaaaaaaaaaaaaaaaaaaaaaaaaaaaaaaaaaagaccatcctggccaatatggtgaaaccctgtctctactaaaaatagaaaaatttgctgggtgtggtggcatgcacctgtaatcccagctacttgggaggctgaggcaggagaatcacttgaacttgggaggtggaggttgcagtgagctgagatcgtgccactgcactccagcctggcgacagagcaagactccatcttaaaaaataaatacataaaaataagagaaggcagaaatctgcatgttttgtggatcatctccagtttttaagacattaactgatactgtgccagtccattgaaactggtttatgggccatatgtgaattagggcttctaatttaaatccatactgttaacaaaagaccacgagatttgcagaggcaaaagggagaactttgttttctgaaggcagtctgcagattggggagacacaggctttggtgtaaaatgaaagtgcgctcagagaatgtgtgagagagtaggacgttataaaggcaaaaaaccacaggagaggagtgaggaacagccttaagtgtcttgctttgtcacccatgctagagtgcagtgacacaatcatggctcactgcaaccttgaactcccaggctcaaagagtcctcccgcctcagcctcctgagtgtgcaccaccatgcttggctatttaaaaaattttttgtagacatggagtctcactcagactggtctcaaactactgagatcaagtgatcctcctgcttcagcctccaaaagtgctgtgattacaggtgtgagccatcgtgcctggccaggaacagtcttgattggatgacgtttaagccccaaatcaccagtctcttcattggctggttccaggtggttggtcagttgggacctggtggtctgctggtggtcagtttgggaatttccaggtacgattgttttcaggcactgttctttgacttggttgcagaaaaacagattttgcaacactttccaaggacacagtgttaccactccctcaccctgccatggcctcttggttctgcttttaacttctgagcctcagggagtccatcttgtctgtcaactgggggtataactcgtcattttcccccttttggtagaaacttgccataggcagcactgatgaccaatttatgctccatcacatattgttgccagcatggtgtggctacctgccctgggaccatctagtcccccggtgggactcatgtggctaagaaacttatgacaattgaacaacttgggccaagcagagtgtaaagtgggcagacacctgctagatatatatatatttttggagactgagtttcacacttgttgcacaagctggagtgcaatggtgtgatctcggctcactgcaacctccgcctcccagattcaagtgattctcctgcctcaacctccagagtagctgggattacaggagcctgccaccatgtctggctaattattatatttttagtagagacagggtttcaccatgttggccaggctggtctcaaactcctgacctcaggtgatccacctgcctcagcctcccaaagtgctgggattacaggcatatctagtagttttacttatatatattaactataattttaactcttagtagccctaatttctagtggaaaacttaggaagtgccgttgaattattttatatcagtatttgtagatgaaaaccattttgtttcctcaattttttattaacagatcgaagtatattgttttctataccatataggtgacttagacattctatgattacctattatttaacatagcatgattttaagatttttaaattaataatttgaaatgatgacacaggtacccttcctaatgtttttttctgttgtctggcatctcacatgtccatgtggcacccaaggacagctatgaaggacaggccttgttggggtcccaaatttacataccaagtatagagctcaggacaggacagagttgtgaagataatgcctggagaatccaacccatcccagcatggcaaagaggcaaaactgggccagggagaatggggccatattgggcttggttctgccttaagctggtggtcaggaactgaggacatgtccccaggtcccaccatggccagcctgtccagaccctagactccagatgctcaaaaccgaaaagaagctgacagtaagatatgtccaaggctttggggagcacaacagccaaccctcacaactctacctcacagacaaaacaagcaacagttttatgaccttaaaacatctacaggctgggcgcagtggctcacacctgtaatcccagtactttgggaggccagggtgggtggatcacgaggtcacgagattgagaccatcctggccaacatggtgaaaccccgtctctactaaaaatacaaaaattagctggccgtggtggcatgtgcctgtagtcccagctactcgggaggctgaggcagaagaatcgcttgaaccagggagttggaggttgcagtgagctgagatcgcaccactgcactccagtctgggtgactgagtgagactccgtctcaacaaaaacagaaacaaaaacaaaaacaaaagcaaaaacaaaaacatctacagaaattaattaaatctgtctgaccagtacattcaggcaagaagtctgagtcaaatttaatacggacaattctgaagacatttaattttattttgccaacaatttaaaccagttttatttaccagagattactagagtcacatgagctaaaaagcatttgagttagtttctatttttctgatacagtattttgatttaagcacttactttttcattaagccaactaattagagctctttcatatattttggtagtgaaatatcacatacacatgacacataaacatacagacagaagattttatagctttataagattcttcatttgccagttttcaaatagtttttctcccccctgcagacagactattaagctctaagcagttgttagctaggcaacctgaaatttgtactctccaagacaggacttctttggtaaaaatttacgtatcaaagacacagaacttagatataaacaccattatttgccaagacaaaaaggggtaggtaaaagcccattcaagacaagctttccaggaaaagtgtcttaaacaaatttaaggtttgttaggtaaactttaggacatcttccttgttggaaagtttctagtggtttaagtgcggggatgcagatgcccttacaaatggagattttttatacatgtaaatttattttacaaagaatttcaaaatagccagctaaattccagaaaatattttggagaccaatctaattagactggtctttttaaattaggctgtttcttgattagattattgagtcctttaacagggtaaaagcagccttttctatgcttggacttaggaagtctatttttacctgaggacctatcttttataaacactttagttagcttgttttttcttttgaaccaaaggtaccttttcaaatagtttaccaaaagcaataacccttaaccaaggttatgacttggttagtcaaggatgaaccaggcacctccaagaggtgcaaagcagtcctcacaagatccagaactaccccaaagtcagctcaaagataaaaagtctttttagccacaaatggaatacaacttatacttctaactggccatattttctaggatctcagcttctcagctgaccacctatgcataaaggcccaaaggtcccatatgccctacagaaggaaaaagacgggaaatcaaatcatgttttaggttacgtttttgctctttaattttgtgaagagaatttccaaggctagccatgacactcctaagcgtccatggaaggaaaaaggatcagtaacaaatgggtacccaaaaaaggtcaatagtcaaacaatttaaaacaaatgggattgcttctctgactcggaattgaacctgggctacagccacaagagcccagaatctcagccactagaccacagagtggagggctttttgtaaatcctacaggggatcaatagcaggcagtttgagcataaaaaatattttaactttgttttagatcatgtttttgctctttaattttgtcaagagaatttctaaggctagccatgaaactattaagtgtctttatattttaacttaattttttttaaatacaaagaaagtatttgtttagaatgagagatctctaagatatttttaaaatttaggagggtaatttaaaggatctgttttctggccattgacatttagaattttcaatcatgtactcctttcaataatggcacaatccaatagcctctttacggaaagtccagaatgtaattttccaggtgtagagaaagttttgttttttgttttttttaaaccagttaagaaacagatgtttcctggaaagggtatagaagaggcaatgccaaatatccccctatgcaaaaaagttcactcccaggaataggctaagttggcaaaagactcttgttgccacagatggttaaggatgacggtgtttgtgcatatgctgcctccagcaacctataagtctgtggggggtcgctagtcacagacctctcaatctgtgacactgggcagaccctcctggaattggactttcccaggactaaccaggcaacaagggttgagatgagagaagccccacagcgacttcttcttttctttttttttttttttgagacggagtctcgctctgtcgcccaggctggagtgcagtggcgtgatctcggctcactgcaacctccgcctcccgggttccagcgattctcctgcctcagcctcccaggtagctgggactacaggcacgtgccaccacactcagctgattttttgtacttttagtagagacagggtttcactacgttggccaggctggtctcaaactcttgacctcgtgatctgcccgccttagcctcccaaagtgctgggattacaggcatgagccactgcgcccggcccccacagtgacttcttaagacaaacccctccaagaacttgacatgttcagaacaaaatgtgtgttgaagccaggcactgcagctcatacctgtaatcccagcactttgggaggccaaggtgggagaactgcttgagcccagtaaggcaggagaatagggtctggagatagggaacataaggccaattcatgctgacttcctagaactaaatcaaatggaaacacttcagctatgacaggaaataccctctccatttacataggacatacactgagtaaatgactttctaactttacttcatcctcttcatttacataggacatacaccaagtaatcaatggaaacccctagagggtattgaaaccccagaaaattctataatggggctcttgagcccctgtgctcaggcccgctcccaccctgtggagtgtaccttcattttcaaaaaacctctgcttttgttgcttcattctttccttgctctgtttgtgcattttgtccaattctttgttcaagactccaagaacctggacaccttcaaccggtaacaccaggagttcaggaccaacctgggcaacacagtgagactctgttgctttttttaatgtgtgtacttttattgggacagaaaagagaccttgtctctataaaaaatttcaaaactggccaggtgtggtggcaaccacctgtagtcccagctactcaggaggctcaggtgagaggactgcttgagacctggaggttgaggctgcagtaagccatgattgtgccactgccctccagcctgagcggcagagcaagaccctgtctcagtaaaagtatgttgatcggaacgacaaactgagcagtctgcagggctgggttgaataagcgggcttctagcggcttagccttgtgttctacccctcttggtgacagaacgac

SEQ ID NO: 276 - DNA, 194061 bp, Homo sapiens
ccagtctgtgttttttgattggagagtttagtccatttacattcagtgttgttattgataagtaataacgtactcttgccattttattgtttgttttctggttcttttgtaatcttctcttcattttttttcttcctatcttctagtaaaggtgattttctctggtgacataatttagtttcttgctttttctttttgtatatccattgtatgttttttgatttgaggttaccatgatgatttcaaatactatcttataacccattattttaacctgatagcaacttagcactatttgcataaacaagcaaaaagaacactaataaaagtctatgccttaactttatccccctgctttttaaatttttgttgtttctatttatatcttataaatcttaactgtcttgaaaagttgttgtagttattatttttggttggttcatcatttagtctttctacttaggataacagaagtttacacagtacacttacagtgttattctgtatttctcagtatacttattattaccagtgagttttataccttcaggtgattatttattgttcattgatattttattttctttctggtttgcagtactccctttagcatttcttgtaggacaggtctggcattgattaaatccatcaggtttatctgggaaagtccttatttctccttcttgtttggaggatatttttgctggatatactactctagggtaaaagttttttttttttcagcactttaaatatatcatgccactccctcctgtaaggcctgtaaggtttccactgaaaagtcagctggcagagttattggagcttcattgtatgttatttatttactttctcttggtgcttttaggatctttatccttgacctttgggactttgattattaagtgccttgatgcagtcttctttgggttaaatctgtttcatgtttaataactttcttgcacttggatattgatatatttctctaggtttgggaagttttctgttatccatttgaataaactttctacccctatttctttctctacctcttctttaaggccaatgagtcttagatctgccctttcgaggctgttttctagatcctgtaggtgtggtttattgttttttattctttttccttttgtctcctctgactgtgtattttcaaatagccggtcttcaagctcattaattctttcttctgcttgatcaattctgctattaaaggacttggaattcctcagtatgccaattatatgtttcagctccagaatttctgcttaattctttttaattatttcaatcttagttacatttatctgatagaattctgaattctttctgtgttatattgaatttctttgaatttcctcaacacagctattttgaattctctgtctgaaaggtcacatctctgtatctttaggattattctctggtggtttactgagtttatttggtgaggtcatgttttcctggatagtactgatgcagtaaatgttctttagtgtctgggcattgaagggttagggacttattgtagtcttcactgtctggggttatttgtagctgtccttcttgggaagactttctagatacttgaaaggactttggtattgtgatctaagctgtatctgccttagggggtaaccaaagcccagtaacactgtcattcttgaagacttgtagaggaaccgccttgatggtcttggataagatccagaattatctagttttctgggcagagactcttgttctcttcccttaactttctcccaaacatacagagtctccgtctctgttctgagccagctaaagccgagggtggtgtgacacaagcacctctgtggccaccaccactatgactgcactgcgtcagacctgaagccagcacagcactgggtatcctccaaggccggttgcaaccactccctgactactgcctatgttcactcaaggcccttgggctctataatcaccaggtgccaaagtcagtcagatcttcgtccttcccttctgggcagggacactgcccaagccctaggtgggtccagaagtaccatctgggagtcagagactagagttaaaaaaccttagaagtctacttggtgttctattatattgcagctgagctgacactcaaactacatgatgcagtccttctcacttttccctcccctttccaaagggagaggagcctcaccccacagccactgccaccccaagccatgaggagtactaccagactactgctgatgttcctttaaagcacaggttttcttaaatcagcttgttgtgaacgctgtctggcctaagactcgcccttcaggacaatgggctcccctctggcccatggcaggtcctgaaatgccatctaagagtcatattttggaattgagggaccccaagagccctcttggtgctctacccccctgtggcactgttggtacctaagatgcaagacacttttccctctgcttttctgaagctgaaggagtttttccctgttgccaccacaactgggaatgtgctaagtctcatctgaagccagcaggtctcagaggcttacccaaggccctcgatgtaatagttgggtatcactcctagtaattcagggcccaagggctctccagttagcagctgatgaatcctgccaggactgtattctgtcaagacaatgggttccattttggcctagtgtgtgtctagaaatgtcatctgagagctagggcctgggataggggcctcacgactctgaatggtatcctattgtgctcttgctgggctggtattttagatgtagtaagatacggtcctccccactcttccctctctcccgaagtggaaggaagaggtctctcctgggaccacgagctgtgtagcttggggttagggaagaggtgacgccagcactcacttgactgctccagctgatgtctcatgtgtcctctccaagtccactgtctgtcttggtgtaattcagcactaggacttgcctaagagttgcagtccttatggcctagactgcctttcaagtttacctggagacacagagcactgttgccctcagtggcaaggtttataggtactcaggttcagactgctgggatcagcgattcccctctgggtagggttggtttaaatgttccttccatgggtgagcatcagctgagtttggtctggttttcctttctgctctaacaggacagccctgagttcattgcctcacaattgccatgttctccttcccccagtgcccagagatccctggcttatctcacttagcataatgttctccaaacccatccatgttatcatgaatgatagtatctccttccttataaagattgaataatatttcatttgtatatatacctcattttctttattcatttgtcgatggacccttaggttgatttcttaagatgactatagtaaacagtgctacaataaagataactgcaaacatctcttcaacaaactgacttttgagtaaatatccaagagtgtagttgctgaatagtaagtcttcatttctttagggtcagttgctggtgctttattttgttcttttggtggtgtcatgtgtccctgattgttcttgattcacgtggccatgcattcatgtcagaaagggactgattcgagtctttgcaggcttgctttggttgggcaaggacttcatcagtcaacctgtctagagattctggccactatctgctatggcccatgggcaggcttgcttcttgtgttcttgggcaggcgggcctggtgcctaggtctatgaacccagattcactggagtggacctgttgattaggtccatgggagctgatctagtgctggggtacatacagcctttgactttgaatctgcagggtctagccaggcaatgggatgatcctggcatacaagtccactgggagagaccttgaatctgagtctgtagggctaggtctgggtcctgagtctgcaggggctagcctggtactgcgtctactaggacaggtctgaaccttgggtctgctggagcgtgggtttgtaaaaactggactggcaccggataggcctagagcctgtgtccacacatgccagcttgggactggggtttgtgggtgctgacctagtgctagggcctagacctagggcctaggcatagagcctgggaccatgggggccagctttgtgcttggaaaacctggaggctgggtctatggatgccagcctggagtctgggactgcaaaggccaacctggagctaacacagactgattcctgaggcagcaggtgccaatctggtgcctgaggataggggtatctacctggtgctggggtgggcctgaaacctggggttatatgggccagcatgcactgagctgctctggagctcaggactgccagggccgtcctggtactggggtcaatggctgccaatctagtgctggagcaggcctacaagatgggtctgcatgtgctagcctgaaatctggggttgtgaaggcccagcctggcactggggcagactgggtccctagtctgcaaggactggctggaggctgggtccatgaatgctggcctgaggctgaggaggacctggaaactaggtctacaaaggccggtctggagtctggggttacagggccagcctggagcctgaggctgctggtgccagccagccaggtgttgaggcagtctggagcctcaggtcactggggccatcctggcagtgggacaggcctggagcctgagaatggtctgaagcctgaggctgcaagtgctaaactggtgctagggcaggcctggagcttgggtccatgggtgtccccttgatgactagggctgcagggaccggaccaacactggagggagcatgaagcccagggctatagaggccagcccagccctgggaacaatctggagcatggagccactggggacagcccagccctggggtaggcctgagagaataagtccactggcaccaaggcgggcctgcaggcagctccatgggatcttgtctggagcctatatccattagggtctgcctgttgctggatgagtctgaggactgagtccttggggccatcctggagcctgactatggtgtctggcctggcattggaaccagtccagagcctggggctgctgcaggtgagcttagaaattgtatgggcccagagacgaagtccagtgaggggcctggggctgcaggatcctgcctggtgcttagatgggcttagaggctcagtctgcgggaactggcctgaaatctgggcaataggggtctagcactgggttttactggggcaggcctggtgttggggtccgaggcaccattctggtgctcacctccctctctatcccccatgcagaaggtatctctccccacgtcatactacccaggggtggagggagggtggcacggatgggtcatgtaaaactctttcctatcctcttcacagcatcttttctgatttctgtgcaacattcaggtgctgtaatctctcatttggtttcctcagctcttgtgagtgtattctcatgcatggatagtcctttaaattggtgtttctgtgagggggtgagcattggaaagtcccatcctgctatattgctgatgtcactccccaaactaattatactgtagatttttatctaactttaagtgatatatcacttcacatatagtgtaaaaagtttacaacagtatacttctagttctctcctggcctttgtgctgctgttgtcatacatttaagcaattcttcacctcaggctcctgagtaggtgggattacagatgcccaccaccatgcctggctaatttttgtatttttagtagagacagggttttaccatgttggccaggctggtcttgaactcctgacctcagatgatccgccccacctcggccttccaaattgctgggattacaggcatgaaccaccatgactggccttacttatgctttaaacaattgtctaggagagatttaaacaatgaggaaaagtctttatgtaatttacttatgtagttataattgctggtactctttattcctttgaatagatccgtatttccatctggtatcattttgccttctgattcagaaactttctttatattcctttgatatttcttatagtgcagatttgctggcgatgaattcttttacccttttcatgtctttatgtaaacttcatttttgaaaggtattttcactggtcaaagaattctagattgacagcttttttgcttccaaaacttctaaagatgtcactccactcttctggtttgcattgttcctgaaataaatctgctgtcatccttatctttgttcttgtgtatgcaatgtgtctattttctctttgtgatcctaacatttttctcttatcattgattttaagcaatttgattatgatgagtatggctctactttccttgtttcctgtgcttgagtttcattaaagctcttggatctgtggttgaatcaaaactggaaaatatttggccattattttaattatatttttcctttaccctcctccctcacggactccaattacacatatattaggatgctcaaagttgtcccagagctcactggtgttatttggttccaatgttttttaaaagtgtttccttttggatagtttctattgtgccttcatattcactaatttttcactctgcaatgtctaatctgctgtgaatcccatctagtgtatttttttatctcaaacattatacttttcatttctgtaagtttgatttgaatctgtgtgtcttccacatctcttcctaacattgaattttttctctagcttcttggacatatgaaatagttatgctattaattttatcacctgtgttatttctgtatctgttttgatgtatgttttccctctcattatggtttgtatttacctacttttcatgcattttttttaatgtcaaacattgtgaattttaccttgttgagtgttggatatttttgtattcctacaaatactctggagctatgttttcagataaaatttagctatttggcttttggtcatttcctttttagctttcttaggcaggaccatgatagtgtttatcctaggactaattttgtcctgctactgcagcaaaatccttgagagtactacctaatgccccatgaattatgaggttttccagctggttggtgagaatatgaattacagtagtccccccaccttatctacaagggagatgttccaagactccagtggatggatgcttgaaactgcagatggtactaagccctatatatgtgttttcctctctatatatacacatatgataaagtttaggccaggcatggtggctcatacctgtaatcccagcactttgagaggctgaggcaggcagatcacttgaggtcaggagttcaagaccagcctggccaacatggtgaaaccccatctctactaaaaacacaaaaattagccgggcatggtggcacatgcctgtggttccagctacttgggaggctgaggtatgagaatcatttgaacccgggaggcaaaggttgcagtgagctgagatcgcaccactgcactccagcctgggcgactcagtgagactctgtctcaaaaagtgtaacttataaattaggcacagtaaaagatcaacaataatagaacaattaatatacagtaataaaaacctatgtgaatatagtctctccctctctcaatttcttattgtactgtcctcacctattttcagaccatgactaaccacaggtaactgaaaccacagaaagcaaagccacagataaggggggcctcctgctgaattcctagctttgtgtgattagattgttacctctaatccctttcgatggctattgttctgggtgccagcaatttgctcatacacatacactgattcctttctcagcaaaatattgaggaagatcttgatgtggtttgactgtgtccccacccaatttcatcttgaattgtagctcccatagtccccaagtgttgtgtgagggacccagtgggaggtaactgaatcatgagggcaggtttttcccattctgttcttgtgatagtgaataagtctcaggagatctgatgattttatgaagggcagtttccctgcacacgctttcttgcctgctgccatgttaagatgtgcctttggtcctccttttcctcctgccatgattgtgaggcctccccagccacgtggaactatgagtccattaaatctctttcctttataaattacctagtctcaggtatgtccttatagcagtgtgagaatggactaatacagaccttctgtgtacctctccctgtgcccctctgtggcctttggcctgcgaactctatcctcattatattccccagactcgcagttctatcatcttggcaacttggagaaaccattaggctctgcctgggttctctccctgcctgtggcctggaaactttcttgaggtggtaagttgggacaattaaaatgctcacctctcaggaatcactgtccctccctacctgatgcttaatgtcttgagaaccattgtttatatattttgtcgtcttctttcttttagttgtttcaagctagaaggtgaatctagagtctcttactgcttttacctgacagagaaagttctcttcccttttttctgaaagctcctttgaatcagttttgctttaggcattgagatgtcactcacaagcttattttcctggctcttcttatcagtgggcatattctgacttcccttacttacttaggagcaagcaaatagccaagactcagatttgagttttgggtacgaggttagtacttcattcaataaacttcaaatctgtctggagaaggtatagtgaggttagctcttgccccgctaaatctcaacattgtgtgctttctctgtctggctctccactgtatcccatttcctagaatggcttttggtatagaaggtattcagtaaatacttacttatgaatgaatagactgccaaatagcttgcaaattctctaacagttaaacattttatcaaattaaaaatctcaatggtcaaaaacagtatcaaactaaaaactctaacaaataacatttatttttcttttacatatatatttcacagcctgaacatcacatcttcagagaaagttacttttatgccattgtatttactatttaccacacaggcattgaacattctcattaacatgataagacaatttgctggtaaacatttaaacacacagacattagtttcagtatctcaacatatttttggtcataaccaaggaaatacatcaaaataatgacaacattggctaatattttacaagcaaatatttaactctgcatagtttatacaataggctgtggcaataaataatgtcaccaatctcatcaactattaactggccacaagaagcctaacattcattttaattatgatatgaaatgctctattggtgtagtttcaacatatccttaaatgtttgggtgtttaaccttgaatacacgaaaagaaaaagtactaaactggactaagaaggtgtgtttggttaactacaaatatgtcatgttcacatagtacattcctaacatgaaggcaaatatttaaatagaaaaactagcagtccaaaaaatgtgaatgtgcaaattgtgagtaaaacattgcatttaaatttgcactcatttgcaagttacagtactagctcagtataaacactaacaggaaaaatattcagcaggaaagaatggaaacggcctctcacagcagagaactggtcactgcgcactgctccacagctaagaaagttttccaggtggtctagcgctcctaacaaacaccttatgattatccttcattcaacagaggaggagactgcaggcatgcttcagtcagtggtaagaacaggaagaaaaacccaaatcagcaacattttcttccttaatttggtataaacgtccttttcattatttcaagttactaatttgctaatctcaaatgttttctgaatcaggtttgctaaatgctgtaaagaatagctatccttcatacaatactaggttttattttttttagtatgtcagcataataaggtacatgcgcattcattccaccaacctgtttagataatactcagcttgggtcatattcaaattctacacagagattctctgttttcaatacaactgcttagaaagcagaattgcctagtgatgactgtagtgtgccttttaactgaaatgtatataaaaataaaaccccaatctttatagaatgtcaagaattctgttagggatgttaaaagcattgggcaaaaccctggttttcagcgtgccatctgcaccacaggagaagagccgattgccctggatgatgtcaatctgcatgactccagccccaatgtttcgaaatatggactgcttagcatgttcacttttaaatgaatgaattaggccatggcctgtcaatctccaaacctagtgcaaaacaaaaggagttaaaaatatattacgaaaagaccaaaagcaaaaacatggcccttctgctcccttggcccaagtgatctcactaaagcccaaccttcccacccactgcctctttcctaagagcttatctaagtgggaaatgataacaccactcccacgattcatttactgtcctccttccatattttccttcacatcctcttgtggcttcatattaaccatatgtagcccatctctaattcaattaactatttgagttaattcagttaaatgtgttcctcatgctgagctaggtcctaaggctatgtaaaagtagtgtggtacagacagtcccctacttacgatggtttgacaagactttttgactttatgacagtgtgaaagcaatacgcattcagcacgctccttggcttatcctgaggttagtctcaataaactcatagtaagttgaaaatattaagttgaaagtatgtttttcaactttaacaatatttttaacttataatgggtttgttgggacataatcccaccataaagtcaaggagcatctgcactagctcacttactggaaacgtcacctccaccacacacaagagtactgagggagaggggagaagcttctaaggagccaaactaatgtcatcaaaaaatttcatgcattaaactcatacactttactcaaaatagaatgctttaaagctttctaatggcctgagtccaatgagtttgataatctcattgaccataacagtttagaaagaaccatacaggagcatggggaggcggcagagtgttgagatatgcagtatctccatgcagtagcccaagtgaaataaagtgaagctttatttcaaagaatgtggagtttttgttttttctctttccaatcagtctttagcacattccaacctcttgtactgactcacctttatgttaccttctgctgaacctgtggtaaaatattcctcatagggatccaaggccagagccttaatagctgagtcatgggcctggaacgtgtgaatgagctgcctttgcctgatgtcaaaaatgcagacgtgtcctttcctaccccccgagattaggagttgctgtttgggtgcatactgcagtaccgtggcaccatgatcgtggcacgtgaaacctgaagaagaaaaacatcagagaatttctcaaaacaatttcttgtcttggtaattatgatgtctacatccacatttaaatacagaccttactgatgcatttttcattctaaggtacatttattgttttgtaagtcattgaatttctgtaatcacatgattaaagaaaaatgttaagcaatgtcagaacaaactttttatccataatctcaatatgaaatgaacacagagagaaaaagaaagtttaaaccttaagccctaagtgatactgcctcataaaaagtatacagaagagcagagaccaaccttctcaaagttggtgagtattaacccagccaagtgctgtaccgtacaaaaagttcttttcaggtaagtaattgaaacaacgacactatgagaaaatgtgtgaatgttttcagttacaagttaagaagttcattatccttcccaggagtatttgcattttaatatgattaaagattcaaattaacatgcagaaaatctgtaagcaatgttaaccactgtttgcagaattctgcaataaaattgagaattaactacatatttcaaaatgcatatcagtgtattaaaagactgagaatctttctgtctttctgacaatctacttcatttaaccaaacttacttgagcatggagcactttttgggtggtactatgtggaagacagagttaggacactaatttggcaagtattgtcttaaaaggaataatatttaaatggcactgtttacatttctagtcattataataaggttaacctttgttttattttatggttagggccaggtgtggtggctcatgcttgtaatcccagtacttagggaggtagaggtgggaggatagcttgaccctaggagcttgagacctgcctgagcaatacagcatgaccttgatctccacaaaaaggaaaaaaagacaaaaagtattttatgatgaggtttaattctttaaaatatgttattttctattaagctcaatgaatactttgcaactaatttcttaaatagccttgttagtagtaccactatccataccatattttctgaatagaatataaagactattttggatttctgagaccatatatctttaactcagcaaggaagccagatatgctaattaactttccaaatttttagtcattcattctaaatatttctccattttcaacctgtcaataaacactcactggattcactaattaaaaccaagaaagcattccttcatggtgtattattccttcatggtatatttttaaaaatcatagaccttaactcaccatgaatgaggctgtttccgggtgatattaatgtgtcccagaggcaaacatttcttttaaagaaacacaataacaaaaatacatcataaatgattgttataagtcgtcatcagggacaacctgtctttcagtcaaatattttgcttattcattcttatcttttttgttcactcacacctatagagagtagtgattcccaactaggatgggggtagggtcaaactacacagttccatctcacatggtcctgcccgtctctgcatcctctaccccatctcctttccattgccactccaggaaactgatatgacttcctgagtataaggaatgcttttatatccccaggtggtagccactgcagggaaacaagatgttattcatgggcatgtgttgctaatgaaaaccatgtgaggtcaaaataaatgttgagaatgatggggacagtgtcaaatacctgttagtccctgaatcctcatctctcaccttatacaaaaattaactcaagatgggtcaaacttaaatctaacacttgaaaccataaaaattctagaagataacatcaaaaaaaactactctagacattgacttaaagaattcatgaccaagaacccaaaggcaaatgcaacaaaaataaataaatgggacctaattaaactaaaacacttctgcacagcaagagtaaaaaggcaacctgcagagtgggagaaaatacaatgtatatatctgacaagggacttatatctagaatctacaaggaacttaacaagaaaaaacaatcccatcaaaagcgagcaaaggacatgaacagataattctcaaaatacaaatggccaacaaacaggaaaaaatgctcaaaaccactaattaccaggaaaatgcaaattaaaactccaatacgataccaccttattcctgcaagaatggccataattaaaaaaccaaaaaacaatagacgctggcatggaggtggtgaaaaggggacacctcactgctggtgggaatgtaaactagtaaaaccaccatgaaaaacagtatacggagattccttaaagaactataagcagaactaccattcaatccagcaatcccactactgggtatctacccagaggaaaagaagtcattatatgaaaaagacacttgcacatgcctgtttagagcagcacaattcacaattgcaaaactatggaaccaacctaaatgtccatcaaccaacaaatggataaagaaaatgtggtacatatacaccatggaatacttcataaaaaggaatgagataatcacattttgcagcaacccagatggagttagaggccattattctaagtgaagtaactcaggagtagaaaatcatatgtcgtatgttctcacttgtaagtgggagctaagctatgaggatgcaaaggatcagaatgatatataatggactctgggggcttgggaggggtgggaggagggtgaagaataaaagactacacactgggtacagtgtacactgctcaggtgatgggtgcaccaaaatctcagcaatcaccactaaagaacttatccatgtaaccaaacactacctattcccccaaacctactgcaataaaataaaaatgttgagaatgatggagacaatatcagatgcctgttagtcctagagaaactaacagtgttaacagtagtagtttaaaaaagactgaatagctttaaaataaaaattacatatattaggaataactttcatttttgcttttctctttttggtaagaaaaaacactctgaaataagaattatgtaacaaagtttttttttttaatgcctagagtggaaaaaccctactaatagaaaagtattcttgctaaaggtatggatttctaacgtttttatatttcttactttgcttttctgtcaacctacctattgtcattggagtgtccagatgtggcaactagacttgaagaggtaataaatgcaaagtcacttgtggctttactgtggcactgccaactctacgaaaaacaaagtgcaactgatgttattttaccattggataaaatttgatacagtaccaacatacatgtctgctaataacatactatatgcatgagctaaaaatagtttttaaaaactcggtctaggataaaagaataagtgatagtatgaggcttaactgtcatgtgtatattatttggctactgtccaataatttttaataactggagttggtaaaaacagaattaaaggtcatgtttttcagattatgtaagaataggacatcaaagtacatgaacctacctaagacccgtcaattttagtgctaatgatctcaaatacatgtaataaactttaacagtcacaaaggaaatgcttacagacccaactagtcttaggatgtcaaggtattttaaaatataatgcatgtttttctgtctggaattatagtggtacagatctgactgaagacaaaagtataaattcaagattacttccatttctgcatagacaaggtacagtctatagtgtcctaatttaagagaattatcttatacacataattaagaacatatgtatagtttagaaaaattttaaaaagtatttgggtaatctatctggtcccaggaggttcaaggcgttctgaacctccctccatatatgtgaagcctgaagtttcacacaggacagcatcaccttccaccctcccccatgttcctttcccccaccatatctccatcaggtaaagatctacttatcttcatcaccaactattttgtaatccaatttggattaaggtggctcattgggattggttattttataatctggtaagcacaattctggaacaaattggaacagatgtttggaacctgattctttttttttctgagacgaagtctcactctgttgcccaagctagagcgcagtggcacaatctcagctcactgcaacctccgcctcctgggttcaagcgattctcctgcctcagcctcccgagtagctgggacttcatgcacgtgtcaccatgcctggctaatttttgtatttttagtagagagggggtttcaccaggttggtcaggctggtctcgaactcctgaccttgtgatctgcccgcctcggcctcccaaagtgctgggattacaggcgtgagccaccgtgcccggcagaacctgattcttaatgacagaattttatcatgtgtatattaagaagatagagttttcaaaatggatgaaagtataataataatgaaaaaaaacccaagttgtaccacacacagggaaagcccccaaaatttttaaaatataaactgtacttcaaggtgaaaagcaaggctttttgtttttcaggtcatttcagtctaaaactagggtaaggatgggtgctgctgtcaggctgggattgctgaaaaaaatcatccttttcccaataggaccaccaatgagattcactgtctgaaacagacacttcatgaacaaagtgttgtgtatatgcgccctgggaacatttagtgatacttaccatataaggtttaggatttgatgcagtttggttaacttgccagatactcagaaaaccctctccatccgcaacaccacactgtaagaacagtataactactaaacacatgttcttagcatccacagcaaaggtaaaaacatggaaggaagattcactaaggccctactaaataaacattctgcctctaactatgtttctgttgctgtcattcccaaaaagtccaagtgctaaaaaattccctgtcactttttttttaaatttttttagagacagggtctcattctgttacccaggctggagtgcagtagtgcaattataacttactataacctcaaactcctgggttcaagggatcctccagcctcaaccttctgagtagctaggactagaggcacatgcctgggctttttaaaaaaatttttgtagggatgtggtctccctttgttgttcaggttgtctcaaatgctggagttcaagcaatcctcctgccttgggctcctaaagtgttgtaattacaggtgtgaaccactgtgactggcccttccattacttcttaactgcttacctgtttcactgttttcctctaacctcttactgatgaaatttagtaagaaactaggtttctctcaagaactttactgtgcttacaggaatcaccaacacactcaacacaggcagtttttttactctcacagtatatttagtatctttaaatagatgattaatccatactaaattttgtagatttttgcttctattggaagaaaagagagtgtatgaatagactccaacaaactgtctactcagtttaaatccagggtcactgaattcatttttcgatgcacttttatcacttactcctaaatatccacaactattttcagatgaattcagcagtagcccccagaaactaaccttgttgccttgtgaattaaaatataatctagtaactcttgcattgccagcttgacgaaagcagacaagttgctgaggccgcgtccattcaaacattcgtacactgccgtcctgagcacctgtaagatctgaaacacaagagaaaaagcaggaaataagaaattaaagagttccaatattttctattctataaatcaacctccaaatgaggacacttacaattattaggtcataaatacttacagtattgatggactgggtgtgaagtcattctcttaacattatgtagattccttttcataagctttaaaagaaaattttaaaaattttattttgtgtatgcagaaaagatgaggaaggatatgcttcaggataaattctgacatttattctcttacaccttgcttattactgagataaagcctgttatggatgttctgaaccactacatagaacacttgtctgaagagggtgaggaagcacagtcacttgctggtatagccctggcctgtgaggttaccaaggagcttcatctcataataaaggaactcttcttcaagtgcccctccctgaggatattcaggagcacctccagatgcttcagagcagaacataagaatgggacccctccagctacagtgacaagaatgttactgacatgctttcaagcacttagaagtagacatgaattcccctttaactttgctttaccattttgtatctgtttattcatctgtaaaatgataatggagggtaataatagcacctaccacctaggattgttgtgagaaaaagcatgtatctgacactaagaaagtcatatgaggccagtgtggtggctcatgcctgtaatcctagcaccttgggaggctgaagcgggtagatcacttgagcccaggagttcgagaacagcctgggcagcgtggtgaaaccccatccctacaaaaaatacaaaaattagccaggcacgctggcatgcacctgtagtcccagctacttgggaggttgagatggaaggatcaattgagcccaggaggtcaaggctgcagtgagccgaaattgcaccactgcactccagcctgcgcgacagagccagaccctgtcaccaaataaaaaagccacaataaatgtcagctgtcattatcatggcctatctactggtgtttgtccctgaaatttaggatcattcctatgtcaaagagattccaactgatttttcagagtccaaatccagaaatgatacctataagtaaataacataccacactagctccagtgctagtctgtccagtgcccagccatggcagagatgaaggtggatgcacctgacttgctgaataggatgttgcactgggttgataaagagttgtagtggaaccacgataatcaacatcatctgaactgtgaaaaacattcatgtgttactgtgaacattcccttttctcttaacacaaattccaactaaaaatcttcttatgtacccataggacaatctttattttaaaaactaagtagccatgagaaaaacttaggtacaagtcctaatcgccaatgttaatactggttaacttttttcccttttggcaaaatgtaaatttagtctaatgttgtttggggacaactttattgctgcacaagttgaaacaaaagtttgttgttatctatggaaaaatattatgttctcttcaagtacagatagctcagtatcaaattaacacgtttaaagaaatttgagtttaaagatttcttggagtaagacatataaaatgtgaaagtaattgttgggatggattgtatcatagtacatggttatatctactctgaaatgtgatattaaatcctagttatatcacatactaacaaaaaaaagaattcaacaaaatgaggagagaaactatcatggcaccatcctcaagcatgaacaatttctaagagtctggagaaaagcaggagggaaggcaaaccacaaagaagaaacctcaaaataggtaagaatggcaaaacactcttggtgcagtgtccatagcttcaatgaaaagtaaagccgtctacatttttatgtttaagaaaaggtatgcttatcaggtgataagaagaaacactgcaaaattactcggtaaatgtgactcagtgtaattaacatatttgtgtctactgttttaattatccagatcagattaatttactgaatatcatgaagccaagtgttagggattatccttattgaaatattatcaatagtgtagggtttaatggaagtgtaattcattcagttaatgtagacaaagactttcactggcagctaaaccaattatatttgtcacctacccaaatgaaggagatacacgtataccttttgaaataattcaaatcatgtgcataaccatttggtgggtacttcttacagaaaactatatgtaaaagtgactatgagacaaaccttttggattctctgtcatattcttctccgatccatatgtatgactgacaggccagtagagaagtaacatcaagttcttgaacatcatgtgttgaagccaaaacaatttcattacaatttgcctataaagcaaaggcagaatcgatgatttaagcaatttcactaaggagaaatacactgtgtataatgatgagagcttttaccttattaacagaaaatgccatgatcatatcagattccttatggatgactttcgcctttccacctggatagcccagatcagcttcaacctagaaaacattcatcagcagttttagttgctgcagcacagctctatttagagttatgcacatcccataagatttaaatgtaggataagaagaaaatgtagcagcagcagcagcagcagcagcaagaaaaaagggtaagagtaactttaatgtgttgaaaactagctttggaaaatttgcttaaattctctgatgtcctgtaatcaccccaatttccactgtgatggtaagatactgattaattataaaacatggctaatatatttttattagtaatttatacagtagtatgtctctcttagctcttccaaaagtgcataaatattctgcaataagaatgtgtatacattaagaggcacagagtggagtaaaaagccatagaaaaccgcaaagaaaccaccctttgaagtaagggtggtgagacagaaataaggaaaagttgtaaagagggatacttcgaaaggaataaaagagactgatgagaggaagatgcaatggcttagggttggtgatgggaaggaaagaaaaggcagaatcaagaagatgaaacagccatgcttaaaacagaaaaagtgacaagtgaagatgggacagggagcaagaaagagaagaaccaagggcaagacagagcaagccagatacagtgaagcatctcctcccctgtgccactgaagtggtatgggagtactatgagttctctgagtagttagccagttgggcaggtcatggttagtatcagagatgaggcgttagctccttgaactttaaagaatgagctaaatacaagatcttggaatactaccttgatgtggcaatcttctgctatgcagttttggttgacctgctccacatgttcttctatagactaaataccaccacaccgtcacaaacacaaaacacatgcatggaatgaaattataaagacagtgaaatatttcaagctgaaatggccactccaccacttaaagatgataaaaatgaatttgcaaaatcaagaaaaaattaaaccgaataaaacagtcatcaaataaacacaacacaaagccaaaagagcaaaattaatgtgactattacataaacacaagaacataaaagctatttcaaaataaaaattagttatctgtatacagttttaagaaatctaagttacataactggtaatctataaaattaaagcccatttgtataagcagatgcagaagatgctacataaattcctgccctataggggttgatttaaaatacaaattaaaatatttatttctaaacatagattcaaaatattgataattatttcactcttataaggaatatgatgatttttctctaagtaaataaatgtttaataaaatcaggcacggaaaaagaaataactcagtaatttgctcccgggttgatgcagggtcctaaggatggctgcaatcagaagttatatttctgctctgctgtggaaactctgaaggtttgatcagagaaacaaactcttcctcataccttttcaggtgactgccttcctttcatcacgaagggccattcaaattttctgcccatgcctccagggactcccctatggctgctgcagctgataaagatgcatccaagaaaacttccaaggaatggtcaatgtgtggcacagctaactcagtgaaggccaaactgctgaagaatctatttgtcttaactagctgaattcaccaatctgtttcccaaaaacttgttttgtgaaatattttcctgtaatatcttcagtgaataaaagatcttattcttataaatatataacttcagcatttctcagggattttttttaaatgcacccagcatttttaggattagcctgccaattttattggtcaattttctgaatttgccaaatttagtgattaccaaaatcctatttgacaattttaaagatgtaagcactcttactggattgggtagagttttagtaagttttgcatatttctgagcctaacgacgagtttttattttgtcctaacagccttaatgttttattcataatttttttcttaataaaacaccttttttttcagatctgagctattcaaaacagcaatcactaaccatatgtaactatttaaatttagatcaattaaaattaaaattcagtttctcaatcatgctagccacatttcaagtactcagtaaccacatgtggctggtgactactatgttggactatgcagatacagatttccatcatcacagaaagttctatgggacagtactggacaagacagtaattccattcaatgttttaaaattaaaagggtacatgataaaaattcttccatcctaactcccagccatgtacttcccttccttggagccaactgatgcttatatagcactttaagaaacattccgtttatctctgtcctacttccctgttcatggggacccactgctggaagaaaaatagaacacacagagactgaggggcataatggaagggagactaaggggcggagagggggagaattagttaaggaagaagcaaactcgtggggaagggcaagacgagaatgggagggtccaagaaacccagacacctggcttcccacagcactctacactctgacaagtcaaccagtcaagctgctatcaaccttaccaatacttaaaacatacttgtgataaatcattaattttaataatttgaagaacaaaacactcagaaaattgatcactcaatgaactggttttctgtgaataacagagcccctaattgaccagaaatcttattgattaagacagggtctcactttgttacccaggatggagtgcagtggtgtgtgatctcagctcactacaacctccacctcctgggctcaagcaatcctcctgcctcagccctgcaagtagctgggattacaagcatacaccatcacacctggataattgttttgtatcttttgtagagacggggtttcaccatgttgccaagctggtctcaaacccctgagctcaggagatcccccacctagtgctaggattacaggtgtgagccactatgcctggctaaaatcttttattttaaatcactatcttagattcctatattttagtttatggaatttggactcagcatcactataggaaatgctatacacagtggtttaaatgacagaggcaaataatttgcctctgatttccctaacaaagtcacatcaataatttcaatgccataagggtcttttgttatgaaaaagcttataactaggactcaaaaggtctctacagttcattcttctacttcctcatttaagtatataatttttaaatccatagagaaaacaaatgactgttcataagggctgaccacaattaccattcaggtaagtgggtgagtgggaaaaagaacaagtatggtaggttccactgccctgggcatgaggaaaaactgagaagcaattttatactttatctcgggaaattgagccgtatggactctctctgttttcacttttctaagcgaaatataattcatttcttctcttctcattgattgtgtttgccaaatctttattttttttgagacagagtttcgctcttgttgcccaggctggagtgcaatggcacaatcttggcttactgcaacctctgcctctcgggttcaagcaattctcttacctcaacctcccgagcagctgggattacagacatgcgccaccacgcccggctaatcttttgtatttttagtagagatggggtttctccatgttggtcaggctggtcatgaactcctgacttcaggtgatctgcccgcctcggcctcccaaagtgctgggattacaggtgtgagccaccgtgcccggccatgtttgccaaatctttaattacatcagacgctcaactctgaatactcttcaaactgctcattccctcactaattacctcactaaatagccaaacagactgaaatgctcatataaaaggtcccacttttataaggaagaggtcacttgccaatctcccaaactgctaattcttcttgaaccatgtctgctattacattactaattgtattagcttaaaaataaccatgcaatgcagaacctctgtcttgctttgtaagagcaatcttccttcatcttgtatttgctatttctgtagtttattctctcacaaaagtatcctgaatttgttgcttcaaatcatcattctgttcatttctaagtgctaagtaaagaaaatgcttttaaagggctattttatattttaagtacatatttggagaatattatagagtaagcttatatattaaattcctcaagccatccatcacaatgtttattatgtgtaaaaacctaatgacaaatactgtaaagtaccaactttcacttgaatatatgtaatttatcaaagtacctatgttgtttcattgctatgaaatgaaaattataaggttttatcttaaaagtagttcacggtagtttagtgaactttgactattacccaaccagaaagaaaatttcagaataaatcaagcactgatttccttagaaatgttaaagaaaactaaagaaaaattacaatagaaaatatttttctcaaaatacctcactctgctttcttttcttagtgaaaatatatctaataaatgtctcttgaaggacctcttgtttaacaaggaaatgccaaagtcgtttgactggaaatgcagaagaatcccgggacctattaaaaaaaattaacatatcacactactttagtctatagaaaatatgtttatatttgcagatatttatttttaaaaccttcacaatctattgcaaagatatttatttttaaaaccttcataatctattgcaaagaagacacagcattaagctcaacaaaactgtacagtttacttttaatttttagttctcctaaaaatcatttcatctagcaactaattctctaattacactgaatgaaccagttaagctgagagtcaaatgaatctcttattattctctttttaaattatactttatattggttctcttggttaaagcatatcaacaatgaatacaagtcatagataccgattctaacagcctaacaagctaaaaagctttgttctttcaagcttattttaatagtaaaaactattaatcagggtccactacctcaaaaaaaaaagcatgctgcttatcaaaagggacctagattggcaggtaaaagatcaaaacatcagttaaaaacctgtaatgtgtttactgttaaattactgacaaaagtcagaagcaccttatttgcatatatagattgttagaaaaaaattctgtaagagttctgacaataagaacataaatatgccatacgcagtggcacatgcctgtaatcccagcactttgggaggccaagaccagggactgcttgagcctaggagtttgagaccagtgtgggcaacatggtgaaaccctgtctctacaaaaaatacaaaaaaaattagccgatggcgctcgcctgttgttccagctactcaggaggcagaggtgaaaaagatgggttgagcccaggaggttgaggctgcagtgagctgagattgcaccactgctctccatcctgggtgacagagtgagaccttgtctcttgtctcaaacaaacaaacaaacaaaaaacaccacaccggaaattaatacaataaagactttttcctttatgtaaatggaatgtctatgaattacagataatactgggaaaaattctattcaaatttctgatatttttcttaagcgtattctgctaaaaataggactgcaggttcaaaattatgaatgttttaaagtatattggcatatttagccaaactgtcttccagaaaagttaagctacgctctttatcagcattataagagctttcttacttgaatggggtattttcaggttctagcattgctttatttcgaagaatagctggtccagctcccactgaaaggtcagttggatatgtgttgatatagttagggggtggaccttcaaactgatccattttctcttgcaagatctgttcccagttctccaagtttttaatcacagcaatacctaatggtgatgttacaggcagctctacaaggtgacagaatatgttatttattttaataaaaaatatcgatcatcacccaaatatttatagaatctgaattctcagagataatacttctgaaaatacaaataaatctgcaaatgttaatgtaatacagtttagattcttaatgctttcaacaaaacagaagtgggtttctgctctttctcaatcttctgtgtagagagtgattcttgatataaactaaagtattagactgaagccaggtgtggtggctcacacttgtaatctcagcactttaggaggccaaggcaggtggatcgtttgagcccaggagttcaagaccagcctgggtaacatgatgtaactttgtctcttacaaaaaatacaaaaattagcccagcatggtagcacatctatagtcccagctactcaggagactgaggtgggaggatggcttgagcctacgaggcggagtttgcagtgagctctgatcacaccactgcactacagtctgggcaacagagcgagactctatctaaaaaaataaaaataaagtcacagattggagcctaaaataaacaagactttataaaatatctaatgcactattttttaagtaccaaatgaccttatatatagattttgtaaagagaaacttgacggcaatttattatacttaataacattaatttttaaattccaaactcaccagagaattccagtccagcaataggaaagaaattcttgacattgtgaagtgctagtttaaccattgtcaaatgtagaagagcccagctgttcaaggaggggcaaaaagagtctttaagtgaaaaataaaatcatgggagaaacagagtggtgttccctgccaactgtttagcccactctccaacccagaaaaaaagctgtcattgaaatttactatgcaaaaatggcacctctgtggtcactgaatacaaaaaacttgcaatactatattacacttgctgaaaattacctcgtggaaaaagattaaccacatagtcacatgaaacctaatagtataccaataatttatatattaaactctaatagtatatccatgagttacatattttttcctcactaaagatgcttgtgtttgcactctccataaaagctagtctttggaggtggagaaaacactatgtagacattgacctcaaaggtgtagaatttgtaacctggaaacataagtcatttcttatataaattcaggataataatgttatttaaaattaataacattgatattttctacaaaaagaaaagccaaaaaaaaaatgagagaaagaaaagtcttatttacctataggaatttggatcttggtgctcctgtatttgtgtatctgaaaaaaaggcatcatcttcttcatcactatgaatgctttcatcagaatcatatataacaccactatcagacaaaggaagaaatggctgcaataaaaggtaaaattatttttttaaagattataatttcataaacatataaaatatattttatataacatgtattatatatttaatatagaaaatatttttagtatataattatttttgttctaacataaaagtaaacattttaaatggtgtcagcataagtaaaaattttcttttgcagataatgctacatctacaaaagtcaagatgacaaggtaaaactctcatattcaataactgaatagctagatgtgaaattttttttaatcaatagttttcttcttatagatcagcaataaatagttagaaaagtctaaagaaatacaaaaggacaaactatgaaagctgtgagagagctattgtgaaggaaattataaatctttataaaattatatgaagggaaggactgaaatgtgtaaaaactgtaattctttataagttaatttacacaggctttaagtaatttcaataaaaatctccctgtgaatttctcttcctgttttggaactttaaaatgattctgaagttcgtagagaagaaaaaatagatgagattagctggggaattttttttaaataaaaaaaatcccattttttttagtggatattaaactaagtaagaaaaatgtagtctagattgatgcaaaaatataatacaaaaatcatacacgtataagaagttaatctgacaaaggtaacatcttaagtcagtgggagaaaaagaaagattatttaataaataataatggaacaactagttagctaagtgtgggaatgggagatgaagtctgatccagtctgttcctcactttattctagataaataagagaattaaaagttaaggaggaggagaaagaaaaagaacaggaggaaacagagaaggaaggtaaaataaatgtacacatttattagtggaaaagacttctgctgaaaaacaatgtaatcaataaggaaatgtatggatagatctaatttttaaactttttaaaatttctgtgcatgataaactttttaaaacttcaaatgcataataaacaaaattttaaagcaaataaactagaaaaagcttaacaagataaattaataatatctctagataaagtatccagaaaaaggaaaaataccataatctcaacagataatttaggtaagaatatgaacagtcaatacctcaaactggaaaatcaaatggcaataagatcattaaaattttaatgtcactaacagaaaataaaaatcatttaatctatcaaattaacaaaaatgaaaaaggaatacttaatgctaataagggggtaaagttagatgcatcctctcactattctcaagagagtacaaattagtaatgtggaaaataatctggcaatatgtattaaaagccttatttaagtttatagccttggacctagtacttctttttttttttttttgagacggagtctcactctgttgcccaggctagagcgcagtggcacgatcttggctcactgcaagctccgcctcccgggttcacgccattctcctgcctcagcctcccgagtagctgggactacaggcacctgccaccacgcccggctaattttttgtatttttagtagagacggggtttcaccgtgttagccaggatggtcccaatctcctgacctcatgatctgcccaccttggcctcccaaagtgctgggattacaggcgtgagccaccatgccgggcctgacctagtacttcttaaggaaataatctgctcatgaacaagacatattttaaaagatactattcttggcattttaaacatcaaatcactaacaaagtgaaaagttacatggtcactataattgatgcttatctagaaacaatgatcaaccaagtaagagcgagcaccccagcatctgtctgtagtttctaaatataatttctcacaaaaaggaaccaggttatttcaaaaaagtgattgttctcagtcacgggcaggaaatatacatgattagcctagaataaaactagaaagcaggcaaactcaaacactagtggaataatctcaaaaagattcggagccaattgtggaagaggctctcactggcaaagatggataatctgagtccccatgagaaaaaaataactgcaatagattaaaacatataaaatatgtttaaatctataagttcataacaaagctgaaagcaaaacaaaactcactggcctcctctgaaggatgcttgggaaccaactcatcattttgaaaactggtacacaaaagcaaaagaataaagcatttatcctgtctttccgactcaaaatgtacttcagggtaattgaataggttgatgaagagacattccagcaaatacatgaaaaatgaatgacaggattatattatcataatttaaaactttcactgaaataataaatgtaggcaaagatcaactaaaatcataaaaagcttcctgacagaaatatacaaaaccacctatgaagttaatcctgtactccctcttcctatccaatcagaatgaaattggatttaattttcacttgacaagattcagaggaacaaaatatggtgatgccatcagcaaaatccattgaaaaattctaaaggtcaaaattctttcagggcaaacgaaaaaggtgggagttaagttaaaaaaagagagagagagagagagagaggtggagcctatagattaaaagagactgaagatatagcaaccacttgcaaggtatgaatcatattttagatcctgatttgaacaaatcaactatataaaaacatttaagatgcaactggtgaaatgtgaatactgtctgaatatgtgataatattaaagaattgtgggtgtgcttctgtgggtgtaacactaatgtagatctatttaaaatcctttttttttttcaaaaataaataatgaaatatttttgaatgaaatttcatgatgtttggatttgcttccaaacaaagtagtggggagaggtataaatgaaacaagactgtccatgagtagataatttttgaagctacatgatggtagataaaagattcatatgctattatctctccttttgtgtatgttggaagttttctacactgaagtttttaaaatgacagctatataagtttttaatggcataaaaactgtttaccttgttaatgttaacagaaaaaaaactacatatactgatccaattatacatttttttaatctgaggaaaaaagattaatagtaaattggccacaatggtaacagttatctttgttgcacagatgagtgctatttcccttctttataatattttgcattttccaaattttcagaacatatatcaggaggaaacatttttgaaaaacaaaaatttagcacattaccatttacaaatcttaatgttgttatcactcacattaatgatgcaatgagctttcattcgtggcaaataaaaattttaaaaaggtaggagtgggaactgcctatacatttttaagagtactttattatttccctggtttattagctaaatacaactaagtgcaactcaattggcagccttaagggataggccagaatgactctggaagtataactcggaccctgatagagtgtaaacctggaaatctgcactcacaatgtgcctaagctcatagttctcaaacttcagcacacattagaaccatctggagagcttgttaagacatagattgttggttctcactcccagagtttctgattgaggggtctgagggaagacccaagaatctgcatttcaaacaagttcccaaggaatgccgatgctgccggttctgagaccacactttgagaaccactgacgtaaccaaagtctttttttttgagacactgtctcagtccgacacccaggctggtgtgcagtggcacaatcatggctcactgccacgctgacctcctggactcaagcaatcctctcacctcagcctttcaagcagctagaactacaggcaaacagcactgcacctacgttttaaaatttttttggcagagacatggtctatgttgtccaggctggtctcaaactcctggatgtaagcaatccttccacctcaacctcccaaagtgctgaggttacaggtatgagccactgcacctggcctcagagtctttagataacaaaacaaagcttccaaactcatgttgaaagactttttaaggatcagcttagcatacaaaaaaacggagcgggatcagcgcctcaataactctgagatctaataaaaatctaaaaatgggaagaggcatgactctggagatgtattccctcatgtgtatgcacagcaaggtaacaacagagttaacacatgtaaagagggaaacataccaacagaaggagaatcatgagctcaaaagagcaaagtgcagaaaagcaaacattagcatgcacccagcatggtatgaaatggggctataccagatctagtcaccatgagtattctgatcccctgagaagtttcctttgcgctgggaaaacagagatgtatcatggggcctcatcatggcctgataaaaccgccaaatgtccatccatctccttctattctaattccatgcttaccaagggagccactgataattagaagaggggtgtctaggtggtagatacaagtattccagtcactcgaaaaagatggtgctgattatgtaataagctgacttctaatttatacataactcccatgtgattttaatttgtctcctacatcatcaggtaactgatcatcctcgaatttactatgactattcagtttctggacttaataaattaaacgtctaaactatggtgattcaatccaaaagctaccccatcattcctatgtgagacacatgcaagagttaataaaatagatgatagacttctcttaaagcttgcattcctcacactccttacctttgcaacaaaataatcccacatactaagttcgggaggaataaatttttctttgtaagatggtctttctgcaggcaccggtggtggggtagcatcttttacaggccttccagggacgagcattctcatgttaaatctcctacggtgtttatctatgtcttcagaaaggacaggaggtgctaaatgaagatagaaggaaaaaaaaatctagcattcattttccattgttaattgatagagttaagctttctttttatcctactcttgccatgttttggtctaaactaaattacttattcctgtgcttctaaacttttctagttactgaatcagctttccagcagtcatggcagagatacagatggagataaagcattaaagcctatcttgccatgtgctccctaaaataaggattaaagtaattctatataaaatacactaaataagtggtatattcaataaatattaaagtgagtgattgactgattatccctggctatgaggttcaagaaagattcactgaatatgtagaatttaatagtgtgccttaaaagaagggcagaagttcaatgggaaaatggaaaaggacaatataaacaaataatcaaagaaggtttgggtaaatgaggagtaaattacttttggtagacaggagtcatggagggaagtaatatcaacaacagtctagagttaggttaggacaagtctgtggctatgaacctgggaacttatgttttgggcaattctcactaacacctcttaagttttagtcacacaatgaggtatggcttgtctgatcaattagagaggaagatggaagatgacataagaacagcctgcactaatatggtgggtggtaaaaagtagaggaagggttgtatatgagtgatacacaaaagaaatagcaaaaggattcaggaattgggtatgggagggccagaaagtagaagtcaacctgctcctctcctaaacctccccatcacagaaaataattttatctcaactcttctatcttccctaccccagacacaattcatcaacaaatccattggctctaacctcaaactatacccagaatatgatcacttttcactctgaccataactaacaccctaggatgaaccactattatttctttttaattgaggcaaattttacataaaataaaattaacaattttaaagtgtacaattcagtgatatttagtacatttaacatgtcatgcaaccaccacctctatctagtttcaaagcattctcctcaccccaaaaggaaacactataccaaataagcagtcactccttatttctccctccccctagcccatggcaaccacagtctactttctgtctctatggatttacctattcaggatatttcatataaatggagccagacaatatgagactttttgtgtctggcttctttggcttagcctatttttgaagttcatacagattatagtatgcattagtacttcattccttttatagctgagtaacactccattgcacgaatataccacactttgttgatcctttcatccttgatggtaacccacaattatcttttaagtgaactagcctccctaccaccagcctccctactcttatttatgttacccagtctattctccacaaagcagctagagcggttctgttgaaaagctgaatcagattctgtcacctcctctctttagaacaactaacgcttttaccatgatcctaaaggaacttgccccagctactcttctattctcatctcctacaacactccctcttcatgacagccatgatggtccctgggtagttcttggaaaaggccaaactcaattctacctcaggacctttgcattcatctgcctggaatgctctggtctcagatatccacatggtgtgattcccaacttccttacagctctcctcaaatgctatctcatcagaaatatgtcttccaaccaccttaactaaactggtccattcccattccctcatcaccgtctttccacttactccatttttatcacagttcttatcattacctgaaatatctttgttaattgcctgataggtgttaagtgaataaattaatgcaaatattaatatgtactggcaggttttaagcatggatgatttgatggataaattaccatgaacaaaaaatcagaaaactcaggcagagaaataaacaattttggagaaaaacttttaagtttaaagtggactataaccaagcagcaagaaagagattcagatatccacatttgatgggaatggaagcagtgggagttgataagatcatctcccttacaatgacttacacaggaacctatttatttaactcaatcacagacaatgaagacagaggttagtgtcattaaacttgtgtgccactgatttctcatctgtaatatgtccatttctaaggatgaattaagatgatttctatatatcagcatcaagatagaaatctttcctgcggcatcagtctatacctcaccatatcataccattttcaaaagtgggatgaaaaatatattctggccatgagggaagaagaaacacacaaggaaaatggaataatactatcacattgaagactaaaggaacctattttggagaataaaaaaatagaatttaaaaactgtgtgtatgattggaatggctatcttgcacatgaccatacatttaatctgaagccaactgctggtatgcgctaaagattttgaacacttacttaaattttcttctttctgtaattaagaactatccgttttgtttttgctttttttttttcattttattgtcttaggaactactctttttgtatgactttgttccttaacattttttctgtatttacctttacctttcctctatttttaatcttcttcaaacatgtcctgctttatcaacctcaaaaatgttatttctataaaaataaaagtaacaaactatatgtttattatatcatgggtttaattatttgctgtcataacaagagtgattatactttaagcatcgcttattttcaaagtgaaatttcttgaaacattaaaaaaaattttaacattcaaaatgattaacatttacatacattactggtatcaaacgtatcttacctgaaatattttctgattgtcttcgaggtttcacaacaagttttacaccgcctccaaaaacagcagcccacattcgattatttaatgggtgggctgcaagccgaaataattcactggaggaatttgtggcaagagcatgtatcaataaacttaagtaaacagcaacaacagcttcacatagcaaaatgttcagttttggctggtcttcatcttgggctgaactcaaaagattaataagtgagctcacacctataagggtatataaaatcataagacgtatgtcaggatgaagcaccagaaggaaaaaacatccaaatttgcaacttatccaaaattatgcatttatattttacaaaatatttccataatttgagcaacaaaataaacaagataggaatggattatagcctatagaataaaatcatccatttgtctacactgatataataaatgagtagataaacaaaaggtaagaaggggaagctcttccttaaagtacaatttcaactaatacataaaatgagtgatagtgttagaaaatcaccagctagtaaccccacagtaatacctgattcaggcaaaaatcatcactagatgctaaaattagcaagtgaaagtataatattttacacagtctcaaactaactcttcacaagatactgattaattacaaaggaaaaaaaaagtaactttacaatggagaaacttggcagaaaccaccttaacaagtgatcaaagttaacagcagctggggccaaatgacatcatatgcctcttgatatctcctactgagaaagacacatcttttttgtggtatccctgccaaaaaatacgtaacctgaatccaacattaagaaaaaaatcagggctgggcacggtggctcacacctgtaatcccagcactttgggaggccaagacaggtggatcacctgaggtcaggagttcgagaccagcctgaccaatatggtgaaaccctgtctttactaaaaatacaaaataattagccggtcatggtgttatgcgtctatagtcccagctactcaggaggctgagacaggagaattgcttgaacccaggaggcggaagttgcagtgagccgagattgcgccactgcactccagcctgggcgacagagcaagactctgtctcaaaaaataaaataaaataaataaacataaggaaagatagaaaaaaaatcagaaatgcccaaattgagggacacttaaaaaaacaactggctggtactcttcaaaagtgtcaaagttgtgaaagagaaagaaggaagactttactcaatataagaggagactaatgagacatgacaactaaatgttacatatgggcccccaaaagcacattagtgggacaactggcaaaattcaaaaaaggtctgtagattagagaacataaatgttaaattggataattatgtgagaatgtctgtttataggaaacacacattgaaatgtttagatggaaagggatatctggtctgcaacttactctcaaatttttcaaaaaaaatacacttagatacacaaacagcaagtgagtgagagagaagaaatgaatgacaaagcaagcatggtaaaatgttaacatttggggaatctgggtgaaatttagtattatgtttgcaattttttgcaagtctgaaattattttgaaataagaggttaaaatgaaaacaatgtgtttctacaaggcaatggttacagtaatctgaaatatacacttaggatattgaagagagtggagaagttttgaaacaactgatgtagagaatgagaaagagagccaacaagaaaaaaaggactgtcagacagcatgatatatgtaccacagaatagtcactcctaccccaatacataaatttacacgcccgagaacaactaactgtattttctatggtatgtctgtgaaaatatgtctgtgattttctaagactctaatttaacatttctaagaaagataatgtgctccatccttatgaaggatgttaagacattgcttttttatgttggttaacatagctggttttatgaagccttaacttcctgagtcttcagacaatattgcagtacttaatagttcctaatccatagcagaaaaacatcatcaaaaaacaaagaaagaaaggaaccactcactaaatccagcaacaagcaggaaactggtcagtaggcttttaggaagaaattgccaactagaagattttttttttttaatcatttaaattctcaccaggccattgagcaggagatgaatttggtgttgcgtgttcttcaatgctttctgtccttagtcttctacgatcacttaaaagaagtccttgataagccattcctgtaaactgatttccttctgtttgactgctaaaacaaataggttcagttatttatcatcctgagaggtaataaaaaattgcactttatgtatatcatctattttagacacctattttaagaaacaaaaattcttaaaatgcattcactgttctaataaaaatttattttagaaaattactgaaattagttacaaatgcttattgtttcttttaaacaaagtaacaaattttattatgttgggcagatgacacttattcctttagaattttttccagatgccactttaatactttaaaatcttttctatttgcagtaatttttattttgtgtttttacaaagtctgaggtaaggagactactgctggtactaggatacagtaggcagaaagtttcagggactagtaggttgcatttcttttctctgcaaagttgtgcaagtttaaccctaaattaaagttatgaactaaaacccagagaatcacattttagaaatacctaaacctaaaaccaaatgtccctaaatattatttaataatatttacttccctctctataatggctatctttgtgaagttggggaaaatataaaagcggaaagtcaagctgagtctagtaaatcatagccgaccaactggaaaatatatatttaaaaacaatgtatttgcattttcatttggtgccattttaatggtgactgacatcaaacaagttatctttgatcatttagatgacaacagtcaactaaatcaacttttttccttatttacatttccaatctttggagttatttagacacagcctaattaagttacaatcagagtacaggccattttgatagataattctttacttgataccaaatgttcccacaaaaggctgctaccattacaagaaagaaagccagaaatatatttaatatcaatttaatgtgaatctactattataaacttttcatttattaacattattcatttaaatctaggttatctttccaagtgattcaatttcctgctacttacattgctctagtcattaaaatgcaaagtacacactaatgaaggcaattatacatttagaaaaattcaatccatttcttctaattgatatcacttccaaagacttttacatcatatgtaaatgggtaggtaaaagtaatttaaataattccattttaggaatgtactttttcatttttcaaaagtattttttatttcaatggataattagttaaatagctgctaatccaatgcaaaaagaaattgtttctaaggaaaaacaattagaaaatttcatattataagttattatggacagtaaactcttctttcttaaaaacaaaaaggatggtaatgatggtaatttacatttactatttgttactttctatatttctctgtgactactaggtgacaactaaacaaataattattttatttctgattctctcgcatgtattaaaatatcatggctgtcatatttagggatttttcagtccctaggaaatagaaacttaatataactctggaacagtttaatgtttttgctgtattaatactattttgggtgatttttttttacctgtagctatgactgtcacataatgcttggtaaattgatgcagaaagtgatgctgctagtgaatgaagtgtgtgcacctaaaaccaaaacagtcacaattacattttgtactaacatttctacacaacagtaatatttcaaaaattagaaaacatccaggaaacctagcaacatcataaataagactgaatcctagatgagactactaactctgctttaaatcttctaaagtaactgtcacccacctttatacacatgccacaataaagctgattgtttcagacacattttaatcaaacagttacttactgtgagcctgccgtttacgaggccctgagcaaagtgctaatgttcatattacaggcatttgtcctaccctaacaattagcttaaatagtaatatttaaaaaaaagcagaagaaaataagaatagaattttcagagtttttatttaagcttgcctcacgaaattcgccttgatgaaaataaacacttaatcttatcaatgaaaatgaattaaatctttttagtaaatgtgtcaatcactgtgtgaaacagcagattttccagaaagtaatttacttggtactcatgaattgaggacagtcttagaattttacatttagaaagttttaaatttctccatataattaaaaaaaaacccaccaccctgaaatgctatactgaatcaatattttcagactcacaaaatctttaaatttgaagggaccttagaaacagtttcataccttatacagattactctttgaaagccttatccaaatgtctaggaactagaaatgtttactttgaattcatatgctttttatgccttttctgcgtgtccctattcacctaacaaatgatttaaataatctctgctaaaatactaatacaggttaattcataatatggatgagaagtccctaattggttatgaccaggcctttagaagaatgtgctgccagagagtaaatgtgcctgtcaaacaaaacaaataaaaaataagaaaacaggggacctgaattgtgcatcagccagtagaactggaaaaagcatagcacaaatacactcaggctgggacagtgaaaagtctgatcagctagctccccagatcctgccaagctccctagtgtttcttggactgtatcagtttttaagatcttagcacagggtatcaatatagttcgcagtagtaactgccaaaactctgattgcctctaactattgcctccaataaacacaaccaccaaggaaacagtaataaggacactctctctgggaccatttgtgaccagtcatgcttccctcccagatactccccaacttgtattttcataatatcttggcatgtaaacaaatagtcatatttccaacttaatggttcatttaaggggaatggaggatctaaagggatattaagtagcaagaatactgtcaagaaaattagttttattgccaaaagtatttgtctgtcttaaaggaagacaataacttctccagaagtaagaacacttacttttaaattacattcattggactaatagtcttgaactgatcatgagtgagaaaggtagcactttgaaatatttcccctaagttcgaattaaaagacaggtataacatatttaccttctcagggtgtataatatcaaatgatcataaactttacattaccttcacatcttcaatactgggatgaggtggtgttttcatctgaacaatagtataaagtatatcatggatgtgattatttaagtacaatacaggattagctatgactgtttttgttgacgcaatacttgctgaaagcagaggtagggtggtaggcagtggtagtggagactggagctgctttactgtagtttcctgtgggtgatagtgaattatttttttcaaagtagtttaaaaaattttatcagttctctgacagaaatactggtgataaacattgtgtaaagggaatatgttcgctcactcattctacacaaatttattgagcacccagtatgtaccaggtactatgctagatgtagatggtatatagataaatatgacacaagaatactctcaagctgttaagcctactccttattatcaaaacttcagtctaagacacatagagtataaatatctgcctcctataaagagaggagctgaacatatttagattaactagtaaaaagtagtaaaagagctttatagctataactggaagagctactgaaattactgaaataaccaagattgaaaaaaaagtgatattcacacctgttgtgattcttgtagcaaaaatttgagttccatccttactgaagccaaaccaccaccttgggccccatgaaggctacagtagctgagaaatactctcaggagatcttggtttttctgcaaccacgactttcgtctttctgcatgctctcgtttggcctgcaatcttcttctttctatttgatggcgctcataggaaccaatatctggtttgtctaccatttcttcctgatccagcagatcactctctactttggaatatgtcttactggaatactctttaataactgattcatgattacatatctcatgcaaggcagcaatttccttttcaagccagttatagagttgaaatctgagttttcctccatctacttcataacctgtagccaatgttcttaattcagtcataaggatctttaaacaagctctgaattttagttgttcagcaatcacatcaacttcagtatcaccttcaggatcatcctcttcctgaggtgttaataacatgttagggtctgaggccttctgatctgattgtttatctttttccctggcatctgtacttttcatcactaaaccaacagcatcgtcttcctcttcatctaaggcactgtcgtgatcttcaccccaatcaagattaagaggttcctcatcaacttttactattggctgactccagtcatactgtgatgaagttacatttgaccattcaatgccagaacttccattgccatcactcagagcttttgaatgtgaaggtacatcatccatcctgtgagaaatgaagtcaggctgatctttttttgcagataaggcagatgttttggttacttttggaattttggagagtacctccaaggctaaaacagggcatccaactttaaaatgagcatttgcagtggtaaagaataattttctttctatgaggttaattttatcaacaaagttcttctcagttttgagacctaaggttgccaaagttccttcaggggaggcaagatttcttcgaatgagcaaaggatgagttcgaaggtagttataaaaactaaatgccaccgggttacaagacttgatgataactatagaaatcaaacagataaaatcacaaagcattgtgttaatatgtatttacattacaaaacaataaaatacgtcagcatttcttcaaaaaaacaacatgtaaatattaacctacgataggttacactatggcatatacaatcattacaactgtacagctgaaatagaaagaatttcccaatatgctacggagtgattcccatcactatagagtgatgtccaggatacactaagaaaaagaagatgcagaaagtacatgtagtaagctaccttttatctatctaagacagtgaagaggaaatacaaatacacactcatgcatattggcttatcatttttaaatggaagacaaacacaaaaaattttaattgattccttaaaaggggagagcaaaacagggaaaaaaagagctagatttctctgaaaatacactggttttatatattttattttaacaccatgtcaacattttacataattttaaaataaaaccaaatctaaaccacaattcacaaaaggcaaaattaaacaaatcagtctatcaagttggtagcataatcacacagagatgaactctaaaaagtgagttaaaaacaagtaatttgactgtacatccttagcagaatgtaccataaaacaaaaaaattctgcaaaaaagcttaaattatgttcagaatcatgttattataaaaatatctatattattattctgaaacttatatgcacatagatagcaaataactatgttcatgccatgagaatccaaacatttcattataagacacaaacttaacatctaagaagaaagaaccctataatctatatgtgcatgagaaatagcagggtaaactcctaaattctaaggaaaaaaaatttcctaattccattcattgcaatagtctagaaattatgacaagattagtaccaatgaggatcctggtgcccaaactatagtttctaaatattattccccactaaaaggaagcagaatgctttggaggaatggtcatttccaggtctggggcaggaaatgtacaagatgacccttaaacattttgtagtaccagaaagcaagaaaactatcaagaaataatgccagaagaattcagaaacctgaagaagttcccatttgtgaaagaacaatctgagcatccataaaaataaaccaagagaatgatgccagcaagatggctgctagacacacctggcattcatcctccgaaaagaaaggaccaaggcaatgaataaacagctaagatttgactggagtgtcaaagggagagcactagagtgcagcaggggagtggagatgcacctgtggtgactgcaagtctaggagagcagtgtggaggtacccggcctctgcagccctatctcccccacccagactggatctgcccacagtcaggaagaacttctcattgcagaggggaaaaggtaaacagaagatccccatcagccctcatggccaccacaaacatctacagtccttacaacagaagaatcccatagtacttgcaagccctgtgtccagtttggagagacgtcagaagttcacgcaacggcactgacccagattaggagcataaggtgtgtgccctccacctaccgccagtgagccaagctgctgcagcacaagcactatcttgagaccagtcacctctggcatgcgcactgctctgggggccaggagtcactgtacctctccaacactggggacccgtcttcattccaagcctacatgggtagctgaatgctacaatcccagctatgcagagcctaggaccatgactggctatgactttggtcctgcatggcagggaaatcaacccctaccatcacacttttggtcagagaaacaatctggcagtcttgcccagggtgaacctgcccttgagccagccaaaccactacatacataccctcccccaaatgggagaggtctccaagcctacgagcagctgatatgcccccaggccagcaaagcagctacatgcccacactcaggacctcagaaacagcgtgcagcgcccctgctccctgcactcagagttctggcctgccaaaggccctgcgcctgcaatcaacgcctgagaaatagtccttcgagccgcccctggcagcacaccaccaggccagccaagcagccaagagcccacttccacggccctgtgggctatccctggtggacacatcccagcctggtcaaacagccctgcaggctgctcccagtgtgcacaccccttagccagctgaacagccttgcaccagtctcagacctgagaaatagccccatgagcccctaacagaaacgcccccatgccagctgagcagccttatgcccacacctcaggcctgaggagcagcctcactgccaccccagctaacatagtaccagaccagctgagcagccctgcacctgcatcacaggtatacaaataacccatgggcaacacctgcagaaacacccccaggccagctgagcagccatgcaatcgtgtcatgggcctgagaaatagccttatccccacccctaacagacaaaaccccaggccagctgagtagccgtgaggccacatatgagccctgtgggctgcttctggcaggcacacctccaggctggccaagtgaccatgtacccacactcctggccagagtaacagacctgtggccccaatcccagccaaccagaccctaagctggctgacccattgtgtgcacatatgcaccccaacctgaaaaactgcccagcgagcccacctggcaaagctacatggccatcaccgcaaactctttcagcctaggcaactgagaggattgcaaatgccactaatgtggattacaggtgaagaagctacatggagactacactactgtatccatctaaccaatgcactccaccaaaccaacacctcaggacctattcatagtaacaagtctttccctatgaaacctactccataaaattagaagaggcaactttttctgccagatacatagaaatcaatgtagaaacacaccaaccatgagaaagcaaggaaatatgacaccaaaggaaaagaatggaaaggaaaatactaattctccagtaacagaccttagtcacaaggaaacatgaaatgccagaaaaataattcttaaggaaatcatagtcttaaggaaactcattcagatacaaaagaatacagatatacaactaaatgaaatcaggcaaagaatacatgatgtgaatttgaaattcaccaaggagatagatatcatacaaaagaaccaaacagaaatactagagctaaaaaattcaatgaatgaaataaaaaatataatcaagagcttcaacaacagactagatcgagcagaagaaagaatttctgaacttgaaaacaggtcttttgaaataactcaggcaaaccaaaaaaaaaaaaaaaaaggaagaaggaggaacagaaaaaaaagaatgaagaaagcctacaggatttatgggacactattaagtaaacaaatattcatattatgggcattccagaagaagaagaaaagggaaaaggtgaggaaaacacatttaataaagtaacagcccaaaattcccaagtcttgggaaagagataggcatctaggtccagggtgttcaaatactcccaaatagattcaacctaaaaagatcctctccaaggcacatggtcaagttgtcaaaagtcaaagacaaggatctcctcatttttattcccaaaaggtagccagtgaccaatgaccagtatttcatttcttatgatttgtttcaggaaacaaccaaaggaaatggaggaggcagacataacatgtgtgcacattcaggtgcatgtttgtacaacatacatatgccaaatgcaacaagaaccacactgctgtgcatcttactttttttcacttaaaaatacagcacatattaacatatgtatctacctcaatttttaatgacacactgtttctatatgtggatatattaaaacgtatttaactattctattgacaaaaacttaaaatgttccattcctttcaaattattgaaaacaatgctgataaatatcctttaagtgcttgtaatatctaaattatttaggataacaaggaaaaaagaaaatttaccacagaggcataaagtttttccaggcccatgtgacaaaccaatacgtgtaacagccaaaatttccatttaaaaaaaatggctatatgattatgtaaaaagagctacagaatgtggcaaacattttgtatgcttgttaaatatatacgtaattagaataggatggtaatcctatctaatcctttagacacacaagaaattttaataataaattctcaaagttgaaaagcaaatctggtaatgatttttcttaatctaagtgaacattagttcagaaagtatctcttcctttaaaaaagaaaaaaaagaaatccacaaaacgtcctaccttgatgttcatcatcctcctttggtgtttgttccagtaatgtgtccaaggctcgggtgtaatctttcattacccaataggcaagactacgcaggaaaggatcaggatgtaatcttttgcaactgaatcctgagccatccttttggcaacccaaaatcttctgatttaggatggatatataagtggatgaagtctcaaattcagattcatataaacgggcaataaccatggctagctgaatatcttccattttttcaagacatacctgcaaatttaaatattaatacttatcttacttaatgataattatttagagagatgaaatatcccatcaataccctgaaattatctaccatttatatcctaatggtgggcgaagggacagtgaagggtagttaaatgattgataggagattaaagaatagcaaaaagagtaacaggttggaacccagtagcttccaaactagacagatcatttataaaataagcatgaaacaaagtatattaatatcatctcagacttaagatcaacttaaataacattcatttttaaattaaatactatatatgacactagaatttatataccacttcctcttaatttccaaacatatttctgcataatcataattattactatctgcctcatatttaaatagtaaataaattatgaaatacagccatatgttctattcatagtctctgggagcctgtattctaatgcaactaccagttctgagcatttgaggtcatttaggcaatatgagcatctctcagtcaacacttctctttgcttgaatatcttctaagctaaacttccaattttaaaatcttaagtatttgttatttaaaaaaagaaactcatatgcctgggataattgtaaaaaaaaacccaactaattctaaatttaaaatactaaagtactttcacttaattgaatatttcctgtttttctatcatatattattcccaactgtatttgtcctttacctgttcatattgttcatgatagtaatctaagaggaagatatcagaagtaaacacaaacatttgtaattactctcataatcagctgctaggattacatatcaaaaagtgggaagttttacctcctcacatcgttttctaatataatattctaatattataaactattataaaacagtacaaactggagtttcagttccttatttatgaatttcatttaaaaaaacagcttaatgtatctgcctttctgcacagaataaggaggttgtgacctatgtactttaaacagttcagaatcacaagatggtctggaagaagacattcataaactatttttcagcatttttttcatatattttacacatagtcttgaaatgcaatgtgccatatatgaaatttttctttttttctttttgagatggagtctcactctgtcgcccaggctggagtgtagtggcacaatctcacctcactgcaacctccgcctctcgggttcaagtgattctcttgcctcagcctcccgagtagctgggactataggtatgtgccaccacacctggctaatttttgtatttttagtagagatagagttttgctatgttggccaggctggtcttgaactcctgacctcaggtgatctaccttccctggcctcccaaagagctgggattacaggcgtgagccaccatgcccagcctgaaatttttcatttgtttctcccttgaatttattcatattttcctttaccacagtgccactattttaagtacagcaacctctgtagttattctgtgtcctaacaaacatatgaccaaaagttacaatctcctctacaaccttcttaggttttcaatcttttacaagtattatatagtgtgttttcttatttatacctctatggcatctttcaatgaaccagctagcaagaaaaaagcagccgattgttcaaagcgttgttttccaagtaaggaaaaagcatttttcaaagcagcttttcgccatctatcttcattaaagttgtggctgaaaaatgttgtcattttttcatcatgctgtgacctggggaccgagcataaacataaagtggttaaaccaaatttaaaatgttctacagaatgtataataatataaaataaaaacctcaaacagaaatctaaaagaagaacaataacttcaaggacaggcatttgttatcaagcatctcttcacttcttctaagaaggaaggtcaataatgccttatgtatacataaataggaaacagcattttttactttgcaaagtgcttttatcaacttttaaaacatcccatcctctagattaagctgaaaagatattttacccatttttttcagctaaaggaaccaggtcgcatagaagtggatttgatgaagctcatatacctaattattttcaaaagcattaggtttcttactcacagcacaatcttcattctgttgaatcacgttaagtgtcaaggcaacttacctaaacagaccccacactactgctttcttcttcattgaaaggtagaatagtgcagcatctaaggcatcattgttcctttgaaaagaagctttggcaacctaaatgataaataaaatattaaattcacaatttgacataagaattacaatcaattaatcaacaataatgttcccctgctacttccatggctgatagaaactgtggagacagaaaaagttggttctgtttcacaatctccagtaggttataatattaatacatgctcctagagataaccattcgcaagccagtaattatggtaaaaatcctaattacagccagcacttattgactatttaccacgtcctgggcacgagtctatgcaccttttgttatcttattgcatcactacaaaccatgaggcactatcattattcccattttatagataaagtgactgagacagaaaggttaagtgaattgcctacagtcacacagtaagggttagaaaagggaatagaaaccacgtagaactgaaactaacatagaaagcaataaagaaggcagaatattcaatagatgtgagctttttcttgaaaattcaacatgttatattgtatgcaatcatactgtcttaaacataagagcatataggccataccttatttttccaagatgctgagatatagcctctgcaaatcattaagttgaaaggcataatgacaaaacaacagtggatgttttattaattagctcacattgatggcaaagcaggaagctataatactaaggtatgggagaaagggaaaagacatctaaaattacatcatgaaaatgctttactctcgggccggacgcagtggttcatgcctgtaatcccagcattttgggaggccgagacaggcagatcacttgaggtcaggagttcgagggcagtctggccaacgtggtgaaaccccgtctctactaatactacaaaaattagccaggcatggtggcgcacgcctgtagtcccagctacttggaggctggttgggagaattgcttcaacccaggaagaggaggttgcagtgagccgaaatcacaccattgcaatccagcctgggcgacagtgcaagactctgtctcaaagaaaaaaaaaagaaagaaagaaagaaaaagaaaaaagaaaatgctttactctcaatactcttttcccttcccccttttaattgtgttgtctgccccctatcatttaacttagtgcttcaatatgttagataatttttagaggaattttatttgtattcagctgatttataatatacattttgaggcagaaaatgtacatatccctttgatttaattttaagaaataaattacttgtggaaataaatcatgtgtatattatcacagataatcataatgacaagacacatgttgacaagaagtaaaatctttgtgggatacatctgaaacatttcagataaagtatgtcctcttttatccagtgctttggaatataaaacatttaatgtagaaactgtatcatttatatcctttaacaattaacttttcctgtacatcagagatcacattttttagttggtgcaggaatgaattccttcttatatctgtgcttattttgagaaaagaaatactgatattttgttggcagccttacacgtaacagtaaaataatacttttatactcacatttaaaactgtgatctgagaaccatgcacaccagaatcatgggatgctgattaagatgaagaaacctcagccctaccactaccaaattaaaatctctggttatgggatggagaatatgcattttacataagtttaccagttgagtcttctctggggaactactattaaggaataaatcaggaaaaggtctttgcatccttcggagaaacaaattcatacttcacaaatatagtaccactgattgtactccagggaattccaaaggactaaaaggaaaatatgaataagaattccactttcctaatcctgctaaagtagaaaaggcacaggctaaatctaacatttataaatgactggagtttgggcttgttacccatcctctctgaatcttagttccatcatatgtaaaatggagatgatgacatggggttgattagaacataacatggaattatttatgaaaagcaactggcaccaaacctggtagagagctgaactgaatttttttcctaaaaggaatctaccagaaaactgactccaaaaacctgccttaaaaactttgatagccatttcacttgctgccacagatatgttcttcaagtacatacaaatcaaaactgtttttatccaatgagatttcaagtgtgcaaagaacgtttgctacttattcaactagtgatgcagagagtcctttgtataaaaagagttttttaatgtattgtaaataacaaacaagaactcaagtttactttctaaagttagatttttccattttcttaaaccagggcatacctcaactaataacagaaaatattattattccacggatatattataaattcagcctatatagaaagacacaatatcatactgcatggacattttataaaggtcaagtttttgtaatctccaaaaaactttatttaaaaaagtctcaccaggcatggtggctcatgcctgtaatcccagccatttgggaggccgaggagggcagatcgcctgaggtcagggattcgagaccatcctggccaacatggtgaaaccctgtctctactaaaaatacaaaaattagctggatgtggtggcgcacgcctgtagtcccagttactcagaaggctgaggcaggaaaatcgcttgaacccaggaggcagaggttacagtgagccaagatcacaccattgcactccagcctaggcgacaagagcgaaattccatctccaaaaaaaaaaaaattctcaagacctcaagatagacaaacaaatttcccactacaggttttctgggagatagtatctttttttcgttaggaaaaggtttttttaatataactcaaaatccactaaagaaaagttaccttttcaatgcatcttcgaagcgtgttaatgttcctcacccaccatcctatgcccatagctcttaattcagaccactgggggtcccctctctgaattgctggaatcatattaatcagttcttcttcagcctcagaatgaaaagcccaggcaaaatggcatgtagagacacctaaattggaaatataaaataataatctgcgtaactgtatcaaataagaagaaaaacaatttttcatgcagtcacatacgcattcattttggaaagaattttgaagcagaaagaaagaatgaaaggcagtctgtcatcattcaggactttatactataaaagtttctgaatacaagatcaataatgtgatacataaaatccaaatctctttttccccaaacatttgttttcatttcccctacaaaaatagggacactaaaacttaatcattagaaagaaaaatatttgaatatcaggccattcacatgtacggtacaccaaatttatcaagaggtcataagagctgcccaagctcacataactaggaaggtagggcccaggcccgattccaggtttctctgtcaccaggacctgtgaatccggcccgcccaagaggacacaaggtgtgttatcccccacaagagcccaggggaaggaaagtgtggtgaaagctttattcaagtcaaaagcacttggctcacagtcctggatgtcgattccagtgccactaccccattcttctctctagccatggagctaaatatcacttcaaagcaagctctaaacttcgtaagagttccagaaaataataaggataagttacaatcatgatgtacattcctctgcttttagtgccttcagttaaaagtttaaagctgcctaatactgatgctttttggtgaacattgttttttgttttgggtttgtttgtttttttttacctgggagaagactgacagggatctaggctgtttgaagaggcaacaaaatctttactgacgctattagacttttaagtactaatggatttatcaacagttcaattactgataacgctcttactgatattcgacttacagcaggtaaaaacgaaacataatgaatgtgaaccacacagaatggtaatcaataatgggaatgctggcaagaactctgggaagccttggaaagaagccaaactagtccaagtagccatctgtatgaattcattttagaaacaaagaaatgtctgaggtcaatgaaagtcacattacaacataggcctctcaatgctattaagtatctatattgttacacataattttttccattttcaactactatatagattttgtacatagtttaaagcttttctaataattactgcttcactgtaatttctttagaaagtataaaataaaaactattatgattattttgaataacaatcttaactcttttaaatttcccactgccaacactcatataacaactgtgtttgtaatcataccacaaaattaatgcaacatgtcttggctgccactataaatttaggggaaaacaccagaaaaaattaataaaataaatttagttttttataacctgaaaggcagactaattttttcactatttaaatctctgtctgctgtgagagaattactttatcaaataattgatattctgcttcagcaactaatatacggcaacacaaaatgcataattttgctgatataaaatatataatataaaatgacaatacatagcatattacattctatatccttaaattaattaaaattttggtataagaagaaacaaaaatacacacagacatgtcagaagaattaggttcagaaagtaagattaagagcagtgaatgtatttgaaaacctgcagaggtgaaaaaagttattagggaagaaaaagaacaggggcacgaataggcacttctttttatttacctaccaatggcaggctattctctgcagtttacctctgctcttgctcttctcagcttttctatctatgtactggctacttaacttttccctgaaaactgctcccaggaccaacacctacaacaccagtcacttctcatcgccaatgttttaactgcagtcaaagggaaaatggaatttgacacagctttagaaatttgaagtgttttagactgccctaggaaatgtacaaaattgtcattaactgattcaataccacttgactatcacccaaaactaaaacttaagagaacgtggagataccattttaaaaacctatccaaatggcatagattgcttaaaatgttaatatcaaatgtgggcaatggggttgagatttggcatcatcaaacttcttttttattttatattttttataattttttgttttcaatttttgttggtacgtagtacgtgtatacaaacttctgggaatgtaaatgagcacatttctgaagggcattttggtaatacttatcaagactgaagaattttcatgccttttgattcagtaattccactgctggaaaactagcatgaggaaataatcaggaatgcaaatatttacatgccaaggtacaaggttattcattagagtgataattcaaatagaaaaaatacctcagcaaaatctatttcaaaaacaaaggattgggcagatgaaatatagtttagacacagaatctcagatagctatttatagttatgttttcaaagaacattcataggttaaagggtaagtgccatgggtaagaataacagtgtatcaagcctagtgttctaggttctataatactaagacgtatattatgggactctttccaagatgttggtttcaaaagaaatatagtccactgaaataagctctggactgggattcgcactcccaactcttctaataaatagtcctgtatcctgggcaggtcacttttaattctatagtttcaattttttaatctgtaatacgaaggctgatataaatccttatgtctcaaatcaggtgtagcagtatgcctgaagtacacaaatccactgttatcaatatggcagatcttcctgaatcatcaactttacttgctggcaaataactagaacataatgcttacattaaagtaaatataaaaacacatcgcagagcaaagtttacataatttttcaaagaaaagacatcaagatattcagggctactctgtagacagccactttgggttacaacctcaggcataccacatttaccccctaagctactactctagtaaataaattctaaaaaacttagttagatgagcaaaagtcacagaatagagctgaaggatacatagaaaaatggtaagtgggtactatgtgacagaaagatcttaagccaagtgataggtgtgcacgtaatgacttacctaatgtttacacacaaacatgatacaccccatcgctccaatattaagtaaaagttgtgcaaagcttcaaacagtgagtgaattaccttgatgaagtagctgcactcggtataaaggaggcagcgatgtcaaaaggcatgtgtgtaggcgcatagctaacaagtatctcaaaccacactcatctaatgtatctcttcctgtaatttaaacaggaaatatgtttaaggaaaaaagaatgcaagaggccacaaactgataagctataaaacaaacattaaacttagtcataatttatataaaatacataagttttagtgtattccttcctgaacactttaacgtctttacaaaaaattatctttacaaaaaaaaatgtgactactaaactcttaaaagaaaaatgatttggagaaatacaattaactattagaatagataacaagaacatttatattgactcataataaatgaaagacatctggaaatccaataaaaaatatattaactatggtaagttaggtacaacttttaataatattttctacatgaattccgatgagatgtaatggaaattacataactgatgtgaaatcatttgttatatatttaagcaggtagtattttctactttggttaaattaactgaaatatggtactatcaaagatttaaaatttgaatacccaggctagttagtgttacatggttagtttgaaccttcaccttgattctacaaatttatttatacaaattaattccacttagtcaaagtatgaaggtatggcaagcgtaaccaaaactatagccactgctggataaaagcaaagcaaaaatacagacagcacctagcccaataactgacactttggaagtactcaatgattatagaatcaaatagtattttccagaaaaaaaaaaacaaaaacttttaaattgccaaagatcaagccccagctctgcttcccattacctatatccatccatccatctatttatttagctagatagatagctattaggttggtgcaaaagtatttacagttttgccattacttttgcaccaacctaatatgtatctatttatttatttatggacatgagatctcactatgttgcccaagatggtctaaaagtcctggcctcaagcaatcctcctaccttaacctcccaaagtgctgccattacaggtgtgagccaccatgctcattcgtccgtttattcattcaacaaatcaagcatctattacatgtgagggactcttcaggtactgggaattcagcagtgaataaggcaaagtccctactctcttggggatcatattttaggaggtagagacaaacaataaacaaataatatgtggaaattaatgctatgaagggaaataaagcaggactgagagatagggaatgctggagtaagagagttctatttcatacagtgtggccaggaaggaactctccaataagatgacatgccagcagcaatttgaggaagtaaaggaacaagccatgcatgaatctggaagaagagcattctaatagagtagaaatgagcatagatcgtgtggggccttttaggccactgtaaggctcttaacttttattctaaagtgagacaggaaggcaccagtatatgttgagcaaaggagagatttaatgtgatttggttttaaaagaatcactggttcctaagcaaagaacagatggaggtaaaaagaataaagcagttaggagatgacagggacttggaccagagtagtaactgcagaggtaatgagaattgattattggattctggatattaatagaactgatagcatttgccaatgaactggatactgggtatgagagaaagcagagtcaagaatgactgtaagttgtctcacctgaacaaatggaagaactcatttacttagaatccatttactgagatgtgtaactcatttaatctctgagcttcagtttcccacctgtgaaatggagacattcattcctgccttattacctcatgaatgtccactgtgtccaggatacactatttctatattgcttagccaatgatacagttttgtattagaaagtataaactattttttacaaatcatgccatgcctactttcttaatgtcccacagtaaaaactaatatatattaaacacacaacacaagcttaaggttgttctgggaagaatctcattcaactgcatacaacctcataatggttaagatttttcttttccaattaatagtgagaaaataagtcataggcaaaaccctagaaggtctctagttattttaacctgcagagaagaaaactttgggggatatactataaggatgtaaatctatatgaagagatattttccagctacctttcccccacagatctggaaatcatgaaatagttaaaagggtacaggctttgagtcaacagtttatccacatatgaactccacttctactccttaatgcctatgtgatctcagatgagtcccttaatttcttaaggatcagtgtcttcatctataaagttaaacataataatagctatctgctagaagactgtgataattaaatatgataaagtaaagaaagtgcctgaaacatagcaatttttcactcctccaaaatatttattgaattaatgaaattctgatcattaattttcagtttcctttgccaatgccatcatttacaatcaacaccattaccctgaactatgtgcataaaagagaatggaatctagttccaggaagcagccaaaaattttctagttacagaatgaattaggcaaaatacgtatgacattaactgtatggaaatctcgctgaagagactttttggagaaaattaggtaattgtaaaaagttgtttatggctagaaatgggaagaccaacaagttgagcccatgaggtcccaataagcctcatgattccatagtaacattaacaaatgggctgttattatcaaagaaaaaatcatagggatcaatctgtgttaaaaaacaagagacttggccagtccatggtgactcatacctataatcccagcactgtgggaggccaaggcaggaggactgcttgagctcaggaattcgagactagctggggcaacataaggagacctagtccctacaaaaaaaataaaaagaaattagctgggccccatggtggtgcacacctgtggtcccggctattcaggaggctgagataggaagattacttgaacctgagaggttaaggctacagtgacccatgactgcaccgctcaactccagcttgggcaacagagcaagaccctgtctcaaaaaaacaaacaaaaaacccacccaaacacacacaaaaaaacaagattataaatccaaaatgacacaaaggtttcagtgtaaaaactcatgagagaatgcacatggatctcacaaatccatgcattcatatgccggcctcaaccgtcttttctaactgagcatattatataatagtaattacctattaaggaggtcttttccctgcaaagtttgaaagttgagactgcaattcagtaaatgagtcagtatagagataatacaaatatttctattaggtacaactttataaatttttagcgagaatatttacctgagcaactcttatctctgctttcatcaagctcagtactagtagtagccactgtatcagccaaagctacaaggaacatctgctccaaacgggtaaggcctggtagacttgagtgcataagatgacttgaaagtacccttgcatgttcttggccaaagtaagctggtccatattgagaaagatttattacttttgatttgttttctctcttttcaggctctaaatcaatatcatccgttggtatatcctggatttgaaacagctctgaatactgatcctctggttgacttactgtctgatcttcatagctctgtggtatctttgtactttcttctgaaattctgtaggatgtatcttgatctgcagcaagtaatgcatatagtggtagtggagggatagaatctatctcagtataatctcgagtaccatcttttcctacggtgactgtttcctttgctgtactgccacttacactaatagttcgagagagatgtcgcttagttccttctccagcatcaggatctctaactattgctacttcacctgcaatacattttactaaatgagagagaatggctttagcccttcgcactttccctaaatccatcaattctaacagctgagttggatgatattgtggaagagtaggggaaagtacatgtgcagcctcaaataagccaccatcttgaattacagttggtgaacaaaaaacatcatcagaaatagctgttccttcaacaacactttttcttgccagcatattagatttaaaggtcgaatgatcttgcattgctgcctcttctgcattagaactatcagcttcagtgtctccaaatttgacagcatgcttccactgtgcatatacatgcatttcacaatccattcctaccaccaatatcccatctcttacccaagagagagaaacaggcagtgaaggagtaccatcaacagaagataccaagtctatagatctaagaagaacccatcttgacttaactccttgcttgatactaccacctagtggtaaagtgatgacagctactccatccttactgttggtttgctcagtcacaattcctgaaagccttccatacatgaagatattcgcaccgactcccactgtaagaatgtgggagccatcttcttttgatacccagtccaaatgtactaaatgtttgatattcggaataagatatctatccttgctcaagagtgcatctgacttgctatacacaaacagattactgtcgacgctgacccttgaatcaagtacactcccaaccttaaccaaatcatcaagatgaattgtttgttctaaaacccactctgatcctcctgtagattcacattcaaatatacaaacatgcatggaaaattctttagaaacaaaaccattatggtggataggctgcttataagccactgcaaggcgacctgtgtatgaacagctaacagcaactggtcttcccacaatgctcactgtactgctattatcttctccttcatcattcatcaaaggccatctcttccaatgataaatttctttctcatcacttttattacactctgggttggcttccatacaacatttccagaagcgtactttattgtcagaacaagttgtaaccactaaataaggtgcaaggcacactggataaattgaagaagaactcagatggccttaaaaaagaaaaagcaaatagttagttgtaataataataaagccacaaaataatatggtagtaatcaaattctggaatgtgatcaatttaaagtcactatgagcttcttcagaatatctctgcagtcttcctcttaactagtatcccactaaatgtccattggccaacatatctataaaggtcttgaagagcccatcagtgaaatcaaggtatgcaataataatcacttaatttgtttttaggtaattaagtttaaatgaggcaaccatttaattaaaataaaactcaaaagcactgaaacaagtcagcccttaatgtgtttctattatttatatttaccttcacaacatgcctccttagaatttcatactatatatttaatcattttcatcatgaatacttaactgagctttacaatttgcctttcaaatgcccctaaccttctctcaaataatccagaccccaggtggtacaccaaattttgtttcagaccgcaaaacagaccaatagatcttacccattttaccaagtttaattcatcctctcttagcactgaaccagaaccctcttatctattcctgactgccaaagactaacaatgcacatctgttgtcaactgtaagacaaggggatatagagattaaagatctgaggtcagaagatctggatttgagtttcaacccatcaataatttcattaacagtgggaaagctacttaatcatctgagcctattccatctaaacaattgggatcagttactgtttcccctagattactattgtcaaataagacattttataaggcgtctgtaaaatataatttattatcacgaactccaataaacttatttgagtataacccaaacctttcaaatattttgaaagattaacaaactggcctagatctgcaccagccacaaaagcccaagagtacactcttctcaatatgatctttccaactgtgaatgcaaacctgtcttacggatgaataagaaaacacctatactgaatatcattcaccagtaattttagcggccccgaacctccaattttggtttcccaaaaacactattctagaaactccccaattaaaattctgcaagtagatcactttaaacacagctgccagacttgccctcaaaatatctaccttgctaaagtcagtatcattccagaccacccaaactatagtcttttatcctacatttttcctcagagtatctgccaactgttgttcaaacattcttaataaaggtgagacgtgattaccacaatgtgaatgaagtcttaaattttaaaaaaagcctcagtggtttacaaatgaatgtatttgttcttcaaaattttactatcattatattccaaagtgtaggcaagacacctcacattaaaatattttcactattggctgggcgcggtggctcacgcctgtaatcccagcactttgggaggccgagtgggcggatcacaaggtcaggagatcgagaccatcctgactaacacagtgaaaccccgtctctactaaaaatacaaaaaattagccaggcatggtggtgggcgcctgtagtcccagctactcgggaggctaaggcaggagaatggcatgaacctgggaggcgaagcttgcagtgagccaagatagcaccactgcactccagcctgggtgacagagcgaaactccatctcaaaaaaaaaaaaaaaaatttcattattttggccgggcgtggtggctcacacctgtaatcccagcactttgggaggctgaggtgggtggatcacgaggtcaggagatcgagaccatcctggctaacacggtgaaaccccgtctctactaaaaatacaaaaaaaattagctgggcatggtggtggatgcctgtagtcccaactattcaggaggctgaggcaggagaatgggtgtgaacccgggaggtggagcttgaagtgagccaagatagcaccactgcattccagcctgggcgacagagtgagactccgtctaaaaaaaaaaaaaaaaaaaatttacactattttctgtcaagctgattacatttatcacaggaaattttgtgggtttgtgtgtgtgtgtgtgtgtgtgtgtgtgtgtgtatggagtctcactgtgtcgcccgcccaggctggaatgcagtagtgtgatgtcagctcactgccgcctccacctctcgagttcaagcaattcccctgcctcagcttcccaagtagctgggattacaggcacgtgccaccacgcccaactaatttgtgtatttttagtacagacatggtttcgccatgttagccagggtggtctcgaactactgacctcaagtgatccacccacctcagcctcccaaagtgctgggattacagaagtgagccaccgcacccagccaggaaattatttctaataaagacatgtttctaaccatctagacatatcattaatagaaaatcaatctttattttaatgtcaacatagaacatatttcagaagagttcatctattttatccactaaagagttcatatattttatcactctgagctaccactgcccagtcttaaagtgaccttacctgctgaaggcgttgctcttattacttcaactgattctgggagatcaaggggttggctatacaccagtctagaactcagaataagtttactggcagtttgaagattggcaattgatgaagaatgtggcatggggctcacactaggagaggtttctggagaagaatctacgttcttctgtccagggactgaaagtagactctcagaggaagccccttctgaagctttagctttaaaaataaattataaaattacaaaatgtatgtatatcattactataaataggagctagaatattactttgttattatttaagaaacatagcttcttaaaagtattttggaggtgaggatatagagaaaagagagctctttttaaaacagaatgaccatatgactcagcaatctcactactaggtgtttacccaaaggaaaggaaatcagtatatcaaagggataactgcactcccacatttattgtagcactattcacaacagccaagacataaaatcaacctaagtatccatcaatgaataaatggataaagaaaatgtcatatatatacacaatggaatactattcagctataaacaagaatgaaatcctgtcatttgcagcaacacagttggaaattgcaggtcagtatgttaagtgaaataagccaggcacagaaatacaaatatcacctgttctctcactcatatgtgagagctaagaaagtggatctcatagaggtagataatagcataatagataccagagaatgggaagggttgtggggtgggtgaagagactctttaataggtacaaacatgaaggtagaagaaataagttctattgtttgatagcacagtagaatgactacagttaacaacaatgtatatttcaaaagagctagaagagaagatctgaaatgttcccaatccgaagaaacaataaatttcaaggtaatgaatatcctaaataccatgatatgatcattacatattctatgcatgtataaaaatatcacatgtacgccataaatacgtataattattatgcatcaataaatttttttaaaaaaattactttgcagacaaggtcaattttcaaacttttgcttagttaccctgataagcttaaatttttttttttacaattttactctttcttagcaccaactccatcatgcaagactgacagggaagaatcacaacatgtaaaagctaaaagaaaccccttatacagtccagtgcttacaacctttaaaacacattaaaagcttgaggaatttgttaacatgcaaattcccaggcctaaccacagagacactgatttagatgatatggggtagatcccagtaaagcagcccaggtgtttttgaaatagatggatcatgaaccaaactttaggaaataacaatatactgcctcacttttagattaagaaatttaaactcagagagcttagtgattttcctgaggccatgtaattagctaggggcaaagaagacattagactagtagcctcctatcaagtactcaaatcagagaatgatttcaagaataaacacaaaaaccaaaagttctaagaaaatttaagatagtattagttgacagcctttgtaagccatattgacttgatcttccaaagaacttccagtgagtgtaaatctctgattcagttatctgttcttccgtgacatataagagatactctatatttatttatttatctgtctctccccattggactacaaattcactaaaggcagggatgatgtgttgttattgccttgtacatctcaaagagcaccagaatattcaataaataataatcctcttttgtttctgttaaacatgtcaatctatcttataatggcaggccactaagtaagaaatattttcacatttttttgtaaaatgaaataagactacaaacttggatccgtagtcagaagacagagtcccactcctggctttatcactaatgagatgtgtttcctttggccaggcacttcaccaccatctctggctactttctcaccagcaaactaaggttaaactacatcatttctcttcctgtaaatcatactattttctaacatatatctcatgctaagaaagaaaataagagcaggaaaaaaagcaaagactttagagtcaacaaggcctgattttgaaacttagttctgtgacaaaccatataatgggacttggtcaagttacatacccttactccattagtaaactggggataatatctattcacatatataaagcaccaatctcagtgcctggcacccagaaggtactcaacatgtttccttctctaacaaaatttaaaccaatcatttatcctctaacaggatattcactactgcagtaaattcaagcgttaaatgtgaatggcaggatacactgttaaatctgcagcaaagattagaacaaaaagatagatgctttctatcacagctaaaaagagtacattatttgcctctactgtaatctcattgtctgtgacctactgctgtcacaaacagggtaggcaagcaactcaactctagccctggctttagtgagacacacgcttcataagcagtggggacaaacaaaatcacatggttcctgtcctcccacaaggacctgttactacccctataaatctcttcagagccactcccatttctgtgcccaactctagaaattactacattctctgctgggtgaatctcttcctgatgaactggtttcagatcccttctcttgcatttctatcaaacaacatataatgcaaagaattaactccaaaggctttgaaagaatttttaaattcctggtgcctcaagaagattaggctcaactaggtgaaggtaaaggttctgtcacataatttggcttttctaatgccaattcatggcccagttagaactgctacaattgtgataatgtataatacatgtgaacaaaaaagtacaaattattctttcactgtattaaatgttatataaaaagttgtataaaatcaattaattacaagacataataaaatcttacaactcaaatattttgagttaacagtttaaagcagattcaatgtgatatggctatccatgcagttcttcattttaacaattatctctcaaaaaggaaaagtttgtttttaaaaaatctgtgatcaatttctttgcttcatactacagatttcccaattagtttagagattaatctaaatgtgtacagcaaaagaatggctgaagtaattttttaatcataattgcatttctttttttgaaatggaaaaattgacaagggtctcactttgtcacttaggctggagtgcggtggtgcagtctcggctcattgcagcctctgactccagggctcaagcaatcctcccatctcagcctcccaagtataggtacatgccaccacacttaattaattttttatttttttgtagagatgaagtctcactctattgcccaggctgatctcgaattcctgtgctcaagcaatcgtcctgccctagcctcccaaagtgctgggattatacgcatgagccaccatgcccatgcccagcctgtatttcttaatgctctacaaaaacagttctgcttataagtctcaggcactcaatcatatttcatcaaacagcaattctgctttttttttttttttttttttgagatggagtcttgctctgtcgcccaggctggagtgcagtggtgcaatctcagctcactgcaacctctgcctcccgggttcacgccattctcctgcctcagcctcctgagtagctgggactacaggcgcccgccaccacgcccggctaattttttgtatttttagtagagacagggtttcaccatgttagccaggatggtctcgatctcctgacctcgtgatccgcccacctcggcctcccagagtgctgggattacaggcgtgagccaccgcgcccagccaattctgcttattttaatgatgataaagctgatgatgtgcagtgtattggatgggaatgtgtattaacaaaaaagtacaatattagttctatggacatctagaacagtcataatgtacactcaataaatattcactgaaaaaaataaacaaagcttttattttttttcaatatgtctaatgtgcccttaggctggtttttagaattaaccagtttcattaatgatttatgaccttgtaattaaaagtttagaagagacataattcagcaactcaatttacagtttaatggaacttcattttacagaattaaccaaagtaaagcatattctataaaataaatttgttatgtatcatctctgtataaaactataattacttacctaaacatgcttgtacagatttaagatgaaggtgccacatatgcagaatagagttattattgctgtccttctcaattactactagaaagaacttttctgaaaatggtggtgggcggtatcctattattcaaaggaaaaggatatttaaattagtatgtttttatggggttaaaaaaacactttttaaaagctaccaccacctcttgatatgcatggaagttgggaagaaaaggcaagaaagactttaaggaggagttttatataatttttgtaccgaaagttagatagctatcaaggactaatgaaattacgtcaaaagtacacaaaagctaacatgaaaggatacctactagtcaaagaggggacattttgagcatcaaagaataaaactgaatacaatttgttaaaacgtatttatcctattacaaactatgagttcacacaaataccaaaaaagggtacataaaaaagaaagcaaaggaaagaaagcagcagcagaagaatgggaggaggatagaagggaaggaagcggggtgctgagcacacaaaagctcaagccagcctcacaggatgcccctggagtaactggggcacttacgccttatttagaaaactggcaattaaaaagaaataataaaataaacattcatcctgcttttcttgcatgaaaacagcattaaaaaaaaaaaaaacttaagttgtgggggaaggagcagtggtagggtaaagaaaaaattttgtagaaatttcatgcattttttaaaaaaagacattacttgtatatataattttccctgctgaaaattagattcttcataactgaaaatgagatctaatgcaggataataaaagctttccttaatcattaaaactcataatgacaacatattggtaatgagcgctgctagagttaaaattgtggcctctaaccattttcattagaagaaacagtctggcaccgcatgttctcactcataagtgggagttgaacaatgagaacacatagacacagggaggggaacataacacatcagggcctgtttgggggtagggggctaggaaggggaaagaattaggagaaagacctaacatagatgacaggttgatgggtgcagcaaaccaccatggcacgtgtaaacctatgtaacaaacctgcatgttctgcacatctatcgcagaacttaaagtataataataatttttaaaaaagaaacagtttggaaggatgattccattcttgcaaaggacagctacaagataaacccaggaaaatcttgctcctgaaagaaagtaaactattacaataatgaggttatgtcaaaaggacacaggacctacttcaaatgctacttactagcctaatatagcactatgtaagcatttaaaaaatgactgcaactgactgaaatatcctacatacctaaaaatccattgagttatatgagtacttctctgtatgtatattatagttcattaaagagttttcttaaaatgagttcatattgatacttaaaagacaaagaaatccaacaacaacaataaattcaacagtagcagctagagataaccagcgcgcagactcctcattctgaaactgtcaattaaatggaaataactaagcacttaacctttccaaaaagaactgtttttcaaagtaatccaatagccctagttgataaagaaatgcttttctttacagatgctttccagctaataaataaatgagaactgataaaattggaaaatcataatttttcaatccctaatgaaataactggtttaagatcaataatattcaatggaagaagccatgagataaagactgctgtcaaactataatgacaccaccaccaactgaatcttccgaatcttaatatgactaaaagtgagatatccaaatttttttttctggtatgatacatatgaagtacatggcatcacccagaatgttgaacccagatctaatcaagtctgtagagctaacttccactgtacaggcaatacagtagacaagaaaaagtttaaacaacatcacaagtaagtagtcagagaaacttctttaaaaaaaaaaacttgctctagaactgaaggagacagagatacaaaaaacccttccaaaaatcagtgaatccaggagctggttttttgaaaagattaacaaaatagatagactacttgccaaactaataaagaaaaaaagaaaagaatcaaacagacacaataaaaaatgataaaggggctatcatcactgatcccacagaaataaacactaccatcagagaatactataaacacctctacacaaataaactagaaaatctagaagaaatggataaattcctggacacatacaccctccaaagactaaaccaggaaaaagtcaaatccctgaatagaccaataacaagttctgaaattgaggcagtaattaatatcctatcaaccaaaaaagcccaggaccagacagattcacagccaaattctaccagaggtacaaagaggagctggtaccattccttctgaaactattccaatcaatagaaaaagagggactcctccctaactcattttatgaggccagcatcatcctgataccaaaacgtggcagagacacaacaaaaaaagaaaatttcaggccaatatccctgatgaacatcaatgcgaaaaacctcaataaaatactggcaaaccgaatccagcagcacatcaaaaagcttatccaccacgatcaagtcggcttcatccctgggatgagaggctggttcaacgtacacaaatcaataaatgtactccatcacgtaaacagaaccaatgacaaaaaccacatgattatctcaatagatacagaaaaggcctttgataaaattcaacagcccctcatgctaaaaactctcaataaactacgtattaatgaaacttatctcaagataataagagctatttatgacaaacccacagccaatatcatgctgaatgggcaaaagctggaagtattccctttgaaaagcagcacaagacaaggatgccctctctcaccactcctattcaacatggtactgaaagttctggccagggcaatcaggcaagagaaagcaataaagggtattcaaataggaagagaggaagtcaaattgtctctctttgcagatgacatgactgtatatttagaaaacccaatcgtctcagcccaaaatctccttaagctaataagcaacttcagcaaagtctcaggatacaaaatcaatgtgcaacaatcacaagcattcctatacaccaataacagacagagagccaaatcatgagtgaactcccattcacaattgctacaatgagaataaaatacctaggaatacaacttacaagaccctcttcaaggagaactgcaaaccactgctcaaggaaatgagaggacataaacaaatggaaaaacattccatgctcatggacaggaaaaaatcaatattgtgaaaatcgccatactgcccaaagtaatttatagattcaatgctatccccatcaagctaccattgactttcctcacagaattagaaaaaaacactttaaatttcatatggaaccaaaaaagagccctcgtagccaagacaaacctaagcaaaaagaataaagcttgaggcatcacgctacctgacttcaaactatactacaaggctacagtaacaaaaacagcatggtactggtaccaaaacagatacatagaacaatggaacagaacagagtcctcagaaataacaccacacacctacaaccatctgatctttgacaaacctgacaaaaacaagcaatggggaaaggattccctatttaacaaatggtgctaggaaaattggcttgccacatgcagaaaactgaaactggacccctttcttacacttcatacaaaaattaactcaagagggactgaagactgaaacgtaagacctaaaatcataaaaaccctagaagaaaacctaggcaataccattcaggacgcaggcatgggcaaagccttcatgactaaaacaccaaaaacaatggcaacgaaagccaaaattgacaagtgggttctaattaaactaaagagcttctgcacagcaaaagaaactatcaccagaataaacaggcaacctacagaatgggagaaaatttttgcaatctatccatctgacaaagggctaatatccagaatctataaggaacttaaacaaatttacaagaaaaaaataaccccatcaaaaagtgggcaaaggatatgaacagacacttctcaaaagaacacatttatgtggccaacaaacatatgaaaaaatgctcatcatcactggtcattagagaaacgcaaatcaaaaccacaatgagataccatctcatgccagttaggatggcaatcattaaaaagtcaagaaacaacagatgctggagaggatgtggagaaacaggaaggcttttacactgttggtgggagtataaattagttcaaccattgtggaagacagtgtggcaattcctgaaggatctagaaccagaaataccatttgacccagcaatcccattactgggtatatacccaaaggattataaatcattctaccataaagacacatgcacatgtatgtttatcgcggcactgttcacaatagcaaagacttggaaccaacccaaatgcccatcaatgatagactggataaagaaaatgtagcacatatacaccatggaatactatgcagccataaaaaaggatgagttcatgtcctttgcagggacatggatgaagctggaaaccatcattttcagcaaactaacacaggaacagaaaaaccaaacactgcatgttctcactcataagtgggagttgaacaatgagaacacacagacacagggaagggaacatcacacaccagggcctgttggggggtggggggctaagagagggatagcattaggagaaatacctaatgtagatgatgggttgataggtgcagcaaaccaccatggcacatgtatacgtatgtaacaaacctgcatgttctgcacatgtattccagaaattaaagtataataaaaaataataataaaaataaacttgctctaaaacaagtcagtggcataatgagggtgtatataaggtatcactttagattaaaatactctttaaatagacaatgaaaacacaatatgtaaactttgtttggatatagattcaaacaaaaacacataaacaaacaaaaagctcaacattttttagacaactggaagaaatatggagtagttattgcacgattctgaggaattttattatcaatttgataacagcaaatatgtaaggaagttatttttagaaacgcatatggaagtgaaacaacactgtaggtggatttgctttaaaatatttcaggggggccaggcgtagtggctcacgcctgtaatcccagcactttgggagtcaaggtgagctgatcacttgaggtcaggagttcaagaccaacctggccaatggggtaaaactctgactctagtaataatacaaaaaaattagccaggtgggcttacagccgagtagctgtaatcccagctactcgggaggctgaggcaggagaattgcttgaacctgggaggtggaggttacagtaagctgagatgacgccactgcactccagcctgggcagcaaagcaaactctgtctcggaaaaaaaaaaaaaaaattcggggggaaaaggaaaagaaaaattgtgtagacaaagcaagtgtgataaaatctttaacctacattatgggaatatggaggttcatttaattatgcactataattttgtctatttttggcatttttcttaactaaaagggtaattaactttaaattaaaacttagtacaaaataaagcagaggcagagaagaggagaaacctacacaagtcctttaagaacacagctataaaatcaggaagaaagagaaatttcacacaaaaactaaaggaaaaccaagaaagcactgaggaaatcttttggcctgatttagcagtggcataacaaatatcaaaagcgagaaataaagaaaatttttaatgcaagtcaattaaaatattataaagaaaagtaccaactttatataagcattgaattctggtaagctggcatatctttcctgttagaaataatgtgataaatggcagctacatttgttggaaaccatattaaaaagattaacccaggcaaaggtaagatactacagaaaagtaaattttaaattggtaaagcagtactgctgttataatgatagtgaaataaaacttaacataattgaataacacaaataagaaaagttttgtgtatgaagaaagatatacgaaagaaaaacaagttactagtctgacgagtgaaaagatgtttgagctaagcttcttagaatacaggacctcaatctgattttcactaaagcgaaggaaattgtctgcacaaattacatagaaacagtttccttagatgctatacataatttcgtgatgaagactacactaagaaaattaaatatgtccatctggatattcacaatttgtaaccacatgagattaattatctgaaaaccctttgtaaactaaatattcgccatagacacttaattcttaaagacatggcttttcaaatagaacatgttggttttataattatgaagttatatatatacacacaattttatttgccaatttaaaaaacttaaataaaagtttaacgtctgaagggaacattttaagctaagttataaagtttaaactaaacgtcatattgtttgtttttgaaagggttaaactacttactttcacaaaaaggaaaaaataccacacttcaaaggggaaaactgtgagatggtaccttgcattcactatttccatgaggtttctagtgtcccacacaacatgataccttatatcttatattcatcattggtctgaagcaatttactggtaattttttaaaacctgtaataaaattaactgttttccttaagataccaaatggaactaccaatcaaaataatttaattatagagttgaagaaacttactttttaaaacaaattaaggttcacagataccatttcttagtaaaagttgatgtcaccaatgaattgtcttgcaaaaagtaattttcacccacagccctcttcatctacaagcaagcaattttgacagaactaactggtgaatctgtcaaaaattatgagagtggtaacttttgaagatccatactcagtgaaaacttagagatcattttttagcatgaaggtaaacaaatgcagactatttttttaaagtaccttgtgatggctgaaaaaatatttctgtttcctttttctccatatcttccttatgtggtttatatcctataatgaagtcttcttgaaacacatgaagcaactgtgtatttgagccacactacaaatacaaaaaaaaatgaagaggttttatctttgaaattccctgtctcccatctcccatctgtcacctccccaatgctaatgcagaagaaatatatctaacaatttctattctttaccactactaattagaaagaaaaaagcaacagaagagaatcattaaaactatcctggtcagagaaaaattactttcaaaaatgtcacagccaatagcagaatagaagagctctagtacaaacaaatcaacaggtttgcttctcaggaaaaaaaaaaaaaaaaagatgctaaaaaacccaaattccaaatttaaagaacagttaagcaaccttcaccactttgagcctgaaagcatcagattcacaactgactagggagggctgcactatgtaagacacactagactactacacaacttgtaattttttcaattccactggagaaccaaaaaacaaaacaaaacccagaaagctcctcgaagtatcccaatagctctgtctagtgggaattatgagggatcctataacagccagcaggatgatacatctctagagaactaaacttacacataagtaactagaacccctcgaaggatggatgaaacatcactgtcaactgctatgctccatgaccatgttttaagactatcacgaatggctacttagaaccttaacaggaactgaagttcaaggaaaggctagatccaaacaaaagcttattttggaagtgtattaagacaatcaatcagatggctcccccagagatttcaagaaaaggaagcagctatgattatcttggcattggatgaggagtctataatcttatagaataaaggaaaacctgcctctttacataatagaaagaaataaaaggattataatattaggttgggccatacaattttatgaaagttatagggtattttgtgtttctctaggtagaaacattaaaaatctcttcacattcattgtctaggaggtcatttccccaagggacaaacaatagatgaaagtaaagagaagggtgatgtcttcacagatatagaaatcatacaacacattgggaacaaacctagaaagaattttaaactttgtcattcattattgcttacagtttaccagcccctgtgttaaaaataggcacaaggagcaggggaaaaagtgttgagcaaatatgaagtaaaaaaactgctttgtgagagcagactgtgttaatatcccatggtaatgagtgcaaaggaggctaaagtaggggatgaatttaacatccaatccattaaaaattaagttatctataggaaggaagccaacccactcttctacattcctattgagtagaaaaaagaaatcacaggctgaatctgaagaaaggtggggcactggggattaaaaagttaagcatttcccaggaggtattagcaatatgggtctggcagccccagttctgctatcaagagatgatgtattttatctatattagcagaaatgagtacattttccccaatagaaagtgcaagacactaaagaaaatttatgatgtaactctatacttgctttcaactatagttggctctttcttcatttccttgtttaaaactattggtagcttctttaccaaactaatccttttcacatttggaataaatgttagttctatcccttagaccataaacatagtcctaaagaaacaaatatcctgagggctaaaatgggttttacatctccctctagggagaagggttctccttctttcctaggtagtagctggggaggaatactacacaaaggacctgtgattaaaaagtatatgtccacttgaatctgactttcatctgcattttaaaggacctcacaaaagtacccaacatggggcctaacaaggcaaacactctgaaactgaggttaccctctattgagttgaaaagagtaataatataaaatgagaaaccacaacccgacccttctatgcagctgcactgtattttctctcagcatttcaagatcaaggtcatggtttctctaaatgaatcaaatttcctttgctacaaatacaattcaactggagaagaataattccttttttaaaaaattttacttaaatagcttttggggtacaagtggtttttttgttacatggatgaactagtagtgaattctgagattttagtgcacccatcacccaagtagtgtacactgtacctaacatgtggtttttcaaatctctagttccatttccaccctccctcttctgagtctctaaagtccattatattgctctgcatgcctttgcatactcatagcttagcgcccacttataaatgagaacatacagttcttggtttcccaaggagaaaaataatccctaaatcattagtagattttcactatgggaatcaacataagttgtctgcatttaataacaaacaagaaaattattctgagaatgacatatatcatatacatataaaacaccatgggataaagtatacgaatatcaccaattcacaagcatgtttttacttggttggttattgcgtcgagttcaataatgcagccaggtcgagcagtagactgttggctcacaatattaaacacttctccaataagtttctgtaaataaaaaacacaaaatgttaatggccaacaaattataatctaatgtcaatatgatacagcatcttggacatttaaggccccctctaaatattcactgattggcaatggaatgtaatacattcaaagaaatacttcaactttccatactcattctcatgttaagtctaaagttaagcagagagaaaactataatgtttacaaaaatagcatataacttcaaggtatcatatcttcttcatttttgcaaccttaaagcccaagacagacatggctgaagatctggcccaatgcctgagtggtctgcagatgtgcaatgccatttaaaagtacaaccctgccagaccgaaggtaagggcaagggttgagaagaagtgggactcttgtgccttgggataaggatgtatgaacaaacaaatgaagcctaactttggaaccccaaaatcccaaaactttctgctaaaaagaacagtcctcctcacccatgttccaaccagctttctcttgcataaaaacctttcagtaacttcatctgaaacggttgcctcagaaagaaatgcccattctcctcagcacccacctttaccacttttcactacctcaaaaaggccaataagaggggttagaggctagcttcgcctagagatataagtacaaggtagggagatataagtacaagcatatacactggagttgtagaaactttcttatttgtatcagtaggattccagagagcatgtaagaaaattgattctagggttattagatcaaaagaaaaaaatatgtagttaggtagggctgaatttactgatatgggtatgttcacccaagattcatgatttaaagtgttagctcagacatttagaaatggtgttaacagggccagggtggtggctcacacctgtaattccagcactttgacaggccaaggcaggtggatctcctgaggttaggagttaagagaccagcctggccaacatggtgaaaccccgtctctactaaaaatataaaaattagtggggagtgatggagggtgcctgtaatctcagctattcaggaggctgaggcaggaaaatcacctgaacctgggaggcggaggttgcagtgagccgagattgcaccactgcactccagcctgggtgacagggcgagactccgtccaaaaaggaaaaaaaaagaaatggtgttaacagtctgctgggtttgttcattgaaatctggactcaactgtggcctatagttggtgaggtgaaaacagtgaaatttttgtagcacacaacaaagctttgctactcaaagtgtagtcaatggaccagcagtgatgggaagctttttatgaatgcatacttactccctgaaactaagacatctgtattttaatgagacttccataggattcatgcgtatattaaagtttaagaaggactgctgtagatcactggttctcaatcttggctgcacactgaatcacctggagagctttaacaatcaatgatgcttaggtcccacccacagagattgaggtgcttccaatgtgcagccaaggttgagatcccctcacaagaatagttatgtattccagctaaggatttgctttccctgcccacaactctctgccagcactataattaacagactttctgaacactacactacagaattccagaattctacagaatctcactcaacatcacctccaaccaaggaactcattttatagtggaagatactactggaaattagaatgaagtaaagcattcgcccagggtgcaaaatttaaaagagtgctcaaaaattcaataatcaagaaaaataatattttaatgcaatattttaaaatcaaaattaatgtaaacaatccataatgagcaaaatatcaaacatttaaatatagaacccaagagtatcttaatgagccacactgataccattaatgtgcatcaaaactgcacatatgtgttttgatgtatatttttttttaatggttaacattcttcttttcttttttcagggtcttgctctattggcctccaactcctgggctcaagtggtcctcctatctcagcctcccaagtaactaggattacaggtgcatgcaaccatgcctgacaaattttttaatttttttgtagagacagggtctcactatgttgctcaggctagtctcaaactcttggcctcaagcaatcctcccacctcagcctcccaaagcactgggattacaggcataaaccaccacacctggctgtagttaacatttttccagaacatcaaagtagttaaaaaatgctaaaaaattgaaaagtaggtgcattaaaactcacatattactttaagtttaaatttatttataccagaaattggactaattatagttttatttttctggctttaatggaaacaaacacattaataatattttcaaaatctccttctttgcttctctggttttgacaaagtctcttgtttttttttttttttttttttttgagatggagtttcactcttgctgcccaggctgaaatgcaatggcatggtcttggctcattgcaacctgcgcctcccgagttcaagtgattctcctgtcttagcctcccgagtagctgggactacaggtgcacgccaccacacctggctaatttttgtatttttagtagagacagggtttcaccatgttggccaggctggtcttgaactcctgacctcacgtgatccacctgcctcggcctcccaaaatgctaggattacagggttcaccgcacccagccctgaactacgttttaagggcatcattctaactcctatgttgagaacagactttgagaaagcagagcaaaatcataaagaaagcaatacaaattttttcacaatctaacctctaacttcctatccagtctcagctatttccaacagccattcacattctatgctatggctgtaataaactacttacagtttactatgcacattcttctacctctgtgcattgttagttgctgttatctctacctgaaatatccttttcctccttcactttcatgtcttacccattcagtaagtcttatctcagatatctatctccaccagaaattctttcctaaccatcacaatctggattaaatgttgcttctaactataagaaaagccatcttaactgacagcattggacagagagaggacaaatcactcagcaaggtcagttaacccagagaatcatttttaaaataatatgtatactttaaacattttgttttattttaaacataaacgtatacaaataactgatattttggtgttgagtaagaccctggagtatgggcttgctaatgggaattacaggtctttcttgcgtatgccacccctgtaaggccctggctgtatttttcagttctttaaatgggaataggctgacacggtggctcacacctctaatcccagcactttggggggccgagctgggtggatcacctgaggtcaaaagtttgagaccagcctggccaacatggtgaaaccctgtatctactaaaaatacaaaaattagttgggcgtggcagtgcgcacctgtaatcccagctattcaggaagctgaagcaggagtatcgtttgaacctgggaggcagaggttgcagtgagctgagatcgcgccactgcactccagcctggatgacagagcaagattcagactcaaaataaataaataaataaatacataaatacataaatgggagtaaaaacataaagacacctacaaagcaattcgagtgcagtttttcttaaaccatttcctcctgaatcttttacagttgttttgaccatgcctaattagtgatttttagcaaaattgcttccaaagcacttatttttataaaaacattcacgttttttatactcacatttcatcaatttatataatatttaattaagttaagaatgacactaatatgtacaacttgacatatacaaggttgaaaataaacacagctggctcttgagtgacagccgtagttgtaagagtttggtctctagagctaggctgcttgggttcaaatcctggtcctaccattgctagctgactaaactgggacaagtaattaagtttctctatgcttcagtgtccttacctctaaagtatggatagtaatattacatttttcttaaggttaccaggaaggttaagtgagttaatatatataaaacatttagaagacagcctgacatacaataatcactagataaaagtttgctagtagtagtagtagtagtagtagtagtagtagtagtagtagtagtagtggtagtggtagtagtagtagtagtagcagcatttttttcaggttaaataactttcccagctgttattattgttaaggttacaagtcaacttgtggaatcaacaaagcctggtatactattccctatgagcatccatcctatattttatagaaggaatggacagcatcaatgaatccaatgagctggcttaagtggaggccaattaaatgaatttcacatcctgaaatcagccttttcttctaatttaccacttattacatactatatgtacatatttatatgactctatagatacaagatccttgaaagtagggactacttctattcattttaacactcttagcacctggtacaatatgcacatttattcttccatgtactataaggttatgcacagtgagtcctcaataaaaattaaagattgagtaaataagttactgagtgaaaacaaattacactttagatcattcctactttaaaagcttgtttttactaatagcagcacacactataccaccctatctttcatcatgacttctcctttatttatttgtagaataccttagtaagtactcactaaatacctgaatgaatggatctcaccaatctagcatctcaccaatctagatattcaaaagcttattttttaggcaccaaaacaactgtatctttgatactttaaatggaataaaaaaaacttaatccctgtcttcataaatagcctgctaaacataaatctcttcttgatgactgacagtcatatttatgaacattaactattactaatgcctttagagatctaatgacttcaagtactgtctttgtaataataaatcccaaatgtgcactggtacctaatgtggaacattaggagtatctccaatctaaaccaaacttaggggctgggcgcagtggtgcacgcctgtaatcccagcacttgggaggccgaggcggctggctcacttgaggtcagcagttcaagaccagcctggccaatatggtgaaacccctagctactaaaaatacaaaaattagctgggcatggtggcagacgcctgtagtcccagctactcaggaggctgaggcacaagaatcacttgaacctaggaggcagcggttgcagtgagctgatatcatgccactgcactccagcctgggctgatagagcaagactctgtctcaaaaaaataaaaacataaaataaataaataaacaaacaagccaaacttaggaatctaaaaccaaggtcacctcacattcaacatgtcccaaatttaactcattgtaaatacctcaaaactatcttgccatagctactggaacaactatcacacttggaatcctctgttttcatatccatattcaagcagctactaagctctgctcttctcctttcctagactatgaaatcccactttagatcaggtttgttttcccacatgcttagttggcctcaacagactccctgctatctccatgcttccagtacctaccaattctactctaccctgcaagttaatcactttatttcccttcctgtgcttcctaaatctacccctctacctacagaacaatatttatagctttcaagtatctgttacaaaatttttaaaaagctagcctttacttgtcatctactaaaaatctcatttaaggaataggagagcatgtgacaaattcttgctacattttgcctcacaattagtagaagaagtaagtaggagaactgctattgtattaagaaaatcaaaacgatgagcagaaataatggaaatgtgacagaaagtagtcatgtcatcttaagagtttaagactgaaaataagagcaagactctatagtctatattttagaaaggttaaaaaatcccagaatgccttatagcatgggggtctcaaagtcaaaatggctcaaggaagtctggaggctcaagagactttgaaagttcctgactatgcaactacaaatataactgatgagaaaagaaagttgatcagagtagtgggttaaatagtgtcctcccaaaattcatgtccacccagcatctcggaatgtaaccttgtttgaacgtagggtcttgcagacataactagtttaaaaaaaggtcacactggattacagtaggtgcaaaatctaatgacttctgtccttacaaaaaaaggatacgcagagacactcagatggacgaaggccatgagaagacagtgatgcagctacaagccaaagaacaccaaggactgccaggagcaatctaggaagaggcaaggaaggatcctccccttgaatatcagaaagagcatggccttgccaacaccttgaatttgaactaaatgtatatacaccaaagaacagtgctgaaaactatgtgaagcaaaaacttatagaagtaaaaggagaaacagacaaattcacaatatagttggagactgcaatacctcgctctcaagacttgatagaatgattagggagaaaatcagtaaagatacagaagaactcaacaacaccatcaatcaaaacaggattaattaacattcatagaacactctacccaataacaacaaaatacacattcttttaagtgcttagtgagtggaacatgtactaaaatagaccaggtcctgggccatgaaacaaacttcaacaaactaaaaaggactgaaatcatacggtacatttttctaccatgacggaatcaaactagaaatcagtaacaggacgcttggaagctaaatcttacacttctaagtaatcgagggtcgaagagaaattctcaaaggaaatcaaaacatatgaggaagttctcctctaggtttgttaattttcttgattcctcaacttgataaagagtatctacaaataacccaacagctggaggtaggaatagaggaagatggcagaatagagggctcccccaatcgtcccccaagcaagaacaccaatttaaccactatacgaaaaaaagcaccttcataagaaccaaaaatcaggtaagcattcacagtacccagttttaacttcattatcactgaaagaagcactgaagaggtaggaaacacacacttgaatcaccaacaccactcttctcccacaccctggcagcagcagcgtggtgctgagagagtttctgtgcactggggaaaggaagagcaagcaactgtgagcactgaagtcagtgctgccttgttatatagcagaaagaaaaaccagaccaaactcagctgacgctcacccatggagggagccctacccagaggggaatcgctgatcctatctgtctgagcttgattccccaaaagccttgccaccacaaggctcaggttctctggggccttaaataaacttgaaaggcaatctaggccacaaggtctgcaactcctagatgagtcctagggctgaactgggccaaagacagtgggctggggaggcatgcaacctactgagacaccaggcgggatggctaaaaaagtgctggcatcatcccttccctaaccccaggctgtacaactcacggctccaaaggagactccttccttctgcttgaagagaggcgacagaagagtggggaggattttgttttgcatcttggataccagctcagctacagcaggataagacaccagtcagagtcatgaggctccctttccaggccctatttcccacacgacatttgtagacacaccctgggccagaaaggaatccactgccatgaggggaaagacccctggcaggattcatcacctgctaactgaagagcctctgggccctgaataaccagcagcaatatccaggtactgtgccaggggtcttggatgagaccctgagactggctggcttgaggtgagactcggcacattcccagctatggtagctacagggcaagactcctgctagagaaaaggaggggcaatgtgctcgcttcgacagcacatatattaaaattggagagaagcagaggcaaaagtaaagggaactttatcttgcatcttaggtaccagcttggccacaagggagtagagcaccaagcaggctcttggagtccccagttctaggacctggctcttacagcatttctggatcttctgtgggccagaagggagcccaatgccctgaaatggtgagtctcagactaggcagcatttacaacaagctaaccaaagagctcctgatccttaagaaaacattggtagtagtctggaagtactccctgtaggcctgaagtcctggtggccacagggtgaagctcgtctgcctttggaaaggagagagaagggtaggagggactgtgtcttgtggtttgagtaccagctcggccacagtacaatagaacaccaggtagatttctaagattattgactctgctccctacctcccagatggtacttctagaccagcccagtgtatgagggaacttgtcaccctaaagggaaggacacaggcccggctgactttgctacctgcagactgcaggagccccagggctttgagagaacataggtggtagctggggagtggttacagcaggctttgggcaagaaccagtgctgtgctggcttcaggtgtgacccagcacagtcctagaggtgatggccacaggggtgcttgtgacactccactcccatctctagatggctcagaaaagagagagagaaagagagagggagggggaaggagagagagggagagagagggggtgggagagagagagaaagaaggggggtgggtggggggagagagagagggagagagagaatgggagtttgttaggaataaagtaaaagaagagaacaagagtctctgcctggtaatccagagaattcttccagatcttgtccaagaccatcaaggcagtacctcgaagagtctgcaagaaccacagcattaatgggcttggggtccccccaaagcagatacagcttagatcacaaaacccaagtccttctaaatatctggaaagccttcccaaggacagatacaagtaagctcagactgtgaagattacaacaaatacctaactcctcaatgtccatgcaccaaagaacatctacaactatcaagacaattcaggaaaacatgacctcaccaaatcaaccaaataaggtaccagagaccaatcctggagaaacagagatatgtgacctccagacagagaattcaaaatagctgttttgaggaaactcaaagaaattcaagataacacagacaacaaattcagaattctatcagataaatttaacaagaaatttaaataattaaaaacaatcaagcagaaattctggagctaaacaatgcaactagcatactgaaaaatgcatcagagtcttttaatagcagaattgatgaagcagaagaaataatttatgagtttgaaaacacacagaggagacaaaagaaaaatgaataaaaaacaacgaagcacatctacaggatccagaaaataacctcaaaagggcaaatctaagagtcactgaccttaaagaggaggtaaagaaagaggtaggggtggaaagtttattcaaagggatagtaacagggaaattcccaagactacagaaagacatcaatatccgagtacaagaaggctatagaacgccaagcagacttaactcaaagaagactacctcgaggcatttaataatcaaactcccaaaagtcaaggataaagaaaggatcccaacagcatcaagagaaaagaaacaaataacatacagtggagctccaatacgtctggcggcagaatttcagtggaaaccttataggccaggagaaaggcatgacatatttgaagtgctgaaaagaaaaaaaaatttaccctagaagagtgtatctagtaaaaatatccttcaaacatgaaggataactaaaaactttttcagacagacaaaaactgagggatttcatcaacaccagacgtgtcatacaagaaatgttacaggagttcttaaatcagaaaaaagaggacattaatgagcaataagaagtcatctgggccaggcgtggtggctcatgcctgtaatcctagcactttgggaggccgaggagggcagattgcctgagttcaggagttcaagaacagcctgggcaacacggtgaaaccctgtctctactaaaatacaaaaaattagctgggcgtggcagtgtgcgagtgagctactcgggaggctgaggcaggataattgcttgcacccaggaggcagaggttgcagtgagccgagatggtgccactgcactccaccctgggtgaaagagcgagattctgcctccaaaaaaaaaaaaaagaagtcatctgaaggtacaaaactcactggtaatagtaagtacacagaaaaacacagaatattacactgtaactgtggtgtgtaaattgatcttaagtagaaagactaaatgatgaatcaatcaaaaataataattacaacttttcaagatacagatggtacaaaaagatacaaatagtaacaacaaaaagttgtagcaggacaaagttaaggagtagagcctttattagttttctttttgcttgtttatttatgcaaacagtgttaagtcataattagcttaaaataatgggttgtaaggtaatatttgcaagcttcatggtaacctcaaattagaaaacatacagtgaatacaccaaaaataaaaagcaaaaaactaaatcacaccaccagcaaaagtcaacttcactaaaagaaacacaggaaggaaataaagaaggaagaccacaaaacaaccagaaacaaataacaaaatggcaggagtaagtccttacttactaattacttggactaaatggactaaattctccaatcaaaagacatatagtggctgaatgggtaaacaaaattcaataatctgtggcctgcaaaaaacacacttcacacataaagacacacacaggctgaaaataaagaggtgggaaaagatattccatgccaatggaaaccaaaaaagagcaggaatagctatacttatatcagacagatatactgatatcagtatcattattttctgatactatgtatcagacaaaatagttttcaagacaaaaactgtaagaagagacaaagaaggtcactatataatgctgaaggggtcaattcagcaagagaatataacaattttaaatgtatatgcacccaacactggggcacccagatatatcaagcaaatattagagttacagaaagagatagaccccaataaaatcatagcttgagacttcgacatcactcagaattggacatatcttctagacagaaaatcaacaaagaaacatcagacttaatctgtactatcaaaaacaatagatatttacagaacatttcatccaacagctacagaatatacattcttttcctcagcacatggatcattctcgaggacagaccatacgttaggtcacaaaacaagtcttaaaacattttaagaaatgaaataatatcaagcatcttctctgaccacattggaataaaactagaaatcaataacaaggaattttggaaactatacgaacatatggaaattaaacaatatgctcctgaatgacaagtgagtcaatgaagaaattaaaaagaaaattgaaaaatttcttgaaacaaatgataatgaaaacatgacataccaaaatctatgggatactgcaaaagcagtactaaaagagggaagtttatagctgtaagtgcctacatcaaaaaacaaggaagacttcaaataaacaacctaacgatgactcttaaagaactagaaaagcaagagcataccaaacccaaaattggtaaaggaaaagaaataataaagatcagagcataaattaaattgaaacaaagaaaatcatacaaagattaataaaacaaaaagttaattttttgaaaagataaaacaaaattgacaagttttttcccagactaagaaaaagaaagaaaagacccaaataaataaaatcagagatgaaaaaagggatactacaactgatgccaaagaaattgaaaggatcaacagtggctactatgatcaactatatgccaataaattgcaaaatctacaagaaatggacaaattcttagacacatacaacctatcaagactaaaccacaaaagaagtccaaaacctgaatagatcagtaaaacaagtaacaagatcaaagccataataaatagtctctaagtaaagaaaagcccaggacccaatggttttgctgctgaatgctgccaaacatataaaaaggaacgaataccaatcccactaaaattattctgaaaaatagagaaggaaggaatactttcaaactcattctatgaggccgtattaccttgacaccaaaaccaaacaaagacacatcaaaaaaagaacactacaggtcaataactctgatgaatattgatgcaaaaatcctaaacaaaacactaccaagtaaattcaacaatatgattaaaatgattaaaagatcatttatcataacagggacacaaggatggttcaacacatacaaatcaatcaatgtgatacatttcatcaacagaatgaaggacaacagaatgaaggacaaaaattttttagcatcaattaatgctaaaaaagcatgataaaattcaacagcccttcatgatgaaaactctaaaaaaagtgggtatagaaggaacataccttctataccctagtatcatgccgaatggggaaaaactgaaagcctttcctctaagatctagaacacaataaggatgctcactttcaccactgttattcaacgtagtacggaaagtgccagctcaggcaatcagacaaaagaaagatataaaaggcatccaaattggaaaggaagaagtcaaattatccttgttggcagaaagcatgatcttacatctggaaacacctaaagactccaccaaaaaccattagaattgataaattcagtaaagttccaggatatcaatcaacatacaaataccagtagcatttctataggccaacagcaaaaaatctgaaaaagaaattttgaaaaagtaatctcagctgggcacagtggctcacccctgtaatcccagcactttgggaggctgaggcgagcagatcacgaggtcaggagatcgagaccatcctggctaacacaatgaaaccccatctctactaaaaaaaaaaaaaaaaaattagccgggcatggtggcacatgcctgtagtcccagctactctggaggctgaggcagaagaatcacttgaacctgggaggcagcggttgcagtgagctgagatcacaccactgcactccagcctgggtgacagagactccgtctcaaaaacaaacaagcaaacaaaaagtaatctcatttacaatagccatacataatattaagaacctaggaattcatgaaagaagtgaaagatctctataatgaaaactgtaaaacactgatgaaagaaattgaagaggacaaaaaaaatggaaagatattccatgctcatggattggaagaactgatattgttaaaatgtccacactaccccaagcaatctacagattcaatgcaatccctataaaaacaccactgacattctttatagaaattttttaaagatttaaaattcatatggaaccacaaaagacccagaatagccaaagctatcctaagcaaaaagaacaaaactggaaaaatcatattatctgacttcaaataatactgcagagttacagtaatcaaaacagcatggtactggcataaaaacacacacagagaacaatggaacagaaaagagaacccagacacaaatccacacacctacagtgaactcatttttgacaaaggtgccaagaatatacaatggagaaaagacagtctcttcaataaatggtgccaggaaaactggatatccatatgcagaagaataaaaccagacccctatcattaactgcatacaaaaatcaaatcaaaatggattaaagatttaaatctaagacctcaaactatgaaactactacaagataacattggggaaactttccaggacattggtctcagcaaacatttcctgagtaatatatgacaaggacaggaaaccaaagcaaaaatgcacaaatgggatcacatcaagttaaaaagcataggatacaatcagcaaggtgaagagacaacccacagaatgagagaaaatatcttcaaactactcatctgaaacgggattaataaccagaatatataagaagctcaaacaactctacaggaaaaaatctagtaatctgatcaaaaaatgggcaaaacatttgaacagatatttcttaaaagaagacatacaaatggcaaacagacatatgaaaaggtgcccaatatcacagatcatcagagaaatgcaaatcaaaactacaataagatatcatctcaccccagttaaaatggcttatatccaaaagacaggcaataacaaatgttggcatagatgtggagaaaagggaaccctcatatgctattggtgggaatgtaaattagtacaaccatgatagagaacagtatggaggttgctcacaaagctaaaatagacctaccatacaatccagcaattccactgctgggcacatacccaaaagaacgaaaattggtatactgaagaggtatctgcactcccatgtttgttgcagctctgttcaaaacaaccaagatttggaggcaacctaagtatccatcaacagatgaatggatgaagaaaaaaaaaatgtggtacttacatacgacagagtactacttggccaaaaaaaaaaatgagattccgtcattttgcagcaacaaggatggaactggaggtcgttattttaagtgaaataagccaggcacagaaatacaagcgttgcatgtcctcacttatttatgggagctaaaaatcaaaacaactggacccatagagatagagtagaagggtgattaccagaggctaggaggggtcgtaagggattggcagggaggtagggatggttaatgtgtacaaaaaaatagttagaattaataagacctagtatttgatagcacaacagggtgactatagtcaataatttaattgctcatttaaaaataactagaagagtgtaattagatcatttgtaacacaaaggataaatgtatgcggtgatagataccccattttccattatttgattactaagaattgcatgcctatatcaaaacatttcatgtaccccacaaatatatacatctactatgtacccacaaaaattttaaaaaaattttttaaacctgcaactaacattatatgtaatgatcaaagactgaatgcttttcctccaaaaatgggaagaaggcaagaacatccaatctcacttcttattcaacatggagttggaagttttagtcactgcaacaaaataagaaaaataaaagccatacagattagaaaggaagagataaaattgttcccatttataatgagatgattatctacatggaaaagtccaagaaatctaccaaaaacactcctacacctaatatatgcattcagcaatgttacaggatataagataaacatacaaaattcaattgtatttgtatattcaattgtatttgtatattctggccataactacatggacaccaacattaaaaagacagcaccctttacagtcagtagaataaatgaaatacttatgtataaacctaacaaaacattcataggacatgcatgctgaagaccacaggagagggagattggggacactattgaaagttgtttactgtatatatttagagatgggggggtctcactatgttgcccaggctggtcttgaactcatggggtcaagcaatcttcccatctcattcccaaagtgcttggattacaggtgtgagtcaccgtgcctggctacattatattttgagtactatattattatttgaaggtagactatgagaggttaaagatgcatattataaaaccttgaggaaccaccaaaaacaaaacactgagtataatggagaacaaatagaaccataagaaaacacaaaatcccccaaatcatggagaatgacatcaatagcaaaaaactaaaaacaggcaaaaattcccattttcaaaaaggaaaagaacatacttctgcagggcagaccaaggagcttaatgtctacctagtacaatgttttggtcaccaagtgatgtcaaggtgtgcacattacacctatcatatattaaaacaaatcacctcatgtaactttgactttcttcgttgactgcagaagatagaaagactgtattttatttcagcaaagtatatggcaagctgtctcacagaaatccttgaaacaagctggaaaacattccaaaaaatgaaaatggagaaagatttcaaatgtatactgctaggctctttcttcagacctgcctatttatcatattaataactgactcagatggtgcaggtataacactcttcaaacaggctggtgacatagtcataaagcaaaaacaaatacattaaataacataatccagattcaaaaagatactgagagattggactgtttagttgtgcttagcaagatgaaatgtaataggaaaaataggtctacatttggaccccaaatccaaatgtacaaatacagaatggagaagacaaggtttagcagagagcagggagggggaaagacttcgggatattgacagtcagctcatgatgagtcaattacatacgaagaatgtggagtgactgtcaaaacataaatgtatctaatgagagaggtcacaatattgctatgttttagtcatcctacaaggctcagagtacagacaaactgaaaactgctcagaagagtaaccagggtcaaatgtaaaacagataaagaaacttgataggcacagggggagcagatttggcctgaggtagtaaggttcacaggttacaagaaagctgtcttttaatatcttgaggtactctcatacgcaagaaatattagatttattctaagtagaactagcactagcaagtagaatgtacacaaaacaaatagcgtttcaatatgattgtgtgagctattcaaggatagaatgagctgcatttagagttgagtctccctcatcgatggccagatgacaaattggcaggaatgaagcagaggggaataaagcatcagatggctggtgagaccaggtgacctttaaaatatcttccaattctagttctatgattctatttttctagactttctctatgtcaaaccttaagctccaatccaaatggttttctcactgtttctggaacaagctttacacatgtactttcctgtatctatacttacttccaggcaattttctcactcaggcaaagacaaagaatttatctttctaaatcttatccactcatcaagaatgaacccaaatattgtccttaataaagaattctatgcctaccttaatctgatctctctctctcctctgaataatgaaacacttctagggccatccttttggcaattaattacataccacccttagactcctcttcttatgtcttaaactgctacttaactttttattaataagctctctcttcagctaaattaaaagctccttaaaggtaggtctgaaacttatattttgtattccctctacatctaggagaacatagtagatgctcaaaaatagtcattggttttcaatactggaaacatttttattagaatagttgtttttataggtaaatggaaaatctactgttcaactctagatactaacatatatgacttccagctcagatacagaactatcagaatgagatgctgccacccactgataacaaattctaaccagagaattttttaaaatggtgaatcaagcttgaaaaagttccaattttccaacctaaacatacagcttggtaaagatgccttaaaacttcttttaagcaaagtaagactaacagaaccaaactagagagtaaaatatgttacaaacaaataatattttagaaaaaaatcctttttatttcttttcatgtaaaatgtattaatgtgtggtatgtacactaaaattttgattcatgtaccttggaacacagcttaggaaaaaataaatgtgtcatatatatgtcatatgcagcccagaacatatacttactccctaaacagcaactaacaaacacaggtcctagacaaagtcaaaagagaattctttatctccttagataaattaataaagattattaaatacttactgaagattctgggtctgacaattcatctaataatttccttgcatccactacagcttgatagagtctcagatttttgccatcagaagcaacaaagcaagcacttgcagaattgcagtatgtgcctgagaaaggaaaacaaggcctctgggttctaaacatgtagtgtatttttcttattggctaaaggataagaaacaagtattcacattttttttaggcttaaccatggtctagaatcataattaaacaggcacaataagtagatacaaaattattaacaaaaagtttaattaaaaaatggattatgagagaaaaggttaaaaacttctggaagttctaaaaatcagtctcatgcctgtattctgaatatttattaaaaatcaccttaatgaaaactgaatacttattaaaaatcttaatgacaacaaatataaaccatttcgtatataacaaataatagtttaaaagcttgtgttaatttcacaattacaatgaacacttacctagacagtaactgggaatgagagttggaagccaagccacattagagaacgctgaggtatgtaaagagttaattcgagccaattctgatactcctccagtgtatgacaaaggtcctattgggtctacacgccacagaataagttcactgtagattgcatttgggtcatgaaatgtacgagttgctgcatttctaagaggttgtttcgaggaaccttttatatgttttacagggtccattaatctacttaatttattgtctgagtcccactgacaatctaattcaggagtcaatagagcattatgatgagaggatgtcaataacagtggtaaaactgaatgacatgccaggtcattgaggtgaaatcgatgaccgcaatatctaaatttgtgagatacagttagaacagtggtaaaggcagacttatcagcaaaagtgactgcccactgatttaaagaaccatctatgtgtttagagatcatcattactgtgggagctaagatgttcatatgtgtactgtgggatctagagtgtggctgtgatccgtgaggactgcctacagacatcccctcctggtgtaacagcgtgtggtgagaatcttttgtcgcatttatacaggcatacatcatgatatttttactaagagagcttgcatcaccagagggaaatgcaacaggaatccgagaagaaaaagaaacctgaaaaacataattatatgattcagtgcaaatagtttacctcctctcaaaaaaaagacttctattctcaaaataccaaatctcagcttcttatcaaaaaatgtcattttcaacctctttatggtccagtccccttgctctatttaggtaataccatatctctattcatggcctaagagaaggctgaagaaaaaaagttcaagtgctttgcttgtacaacaaaatgaccacagccacagatctaaatagcaataaagttgagagagatgacaaaggcagcttcgtttagctcatcaaattggccacaaggaggagctcatcctgattcacattttcagggtagtttcttaatcttattcaaaatattattaattccctcaaaaatcaacacatatatttaaatattcagtactgcatttcaaggccaaattcattatcttctaactaatcaagtttgctaagcttatggtcactgatcccttctgaaagaaagaagtattctttactcagatgcttatcaaaaccaaaattttcagtaattctaaaaacatgctaactctacaaagcatttatttctttttactattttaagaaatgtaataactatttcatcaataaaatatacctgaacttgtctaaatattccaggattatattcatccaaatacttcacatgccacactagaaaggtaccatctacagggtgtattgtaaaaagcatatcaggattcttattccattcagttagcagcgtttcaatcttccgatcaagcagaaccgtaggcagtggcattggtacactaagtcgtgagtaagttctaggacttccttctctttctccatcttcatgttctgatgatcctgtacctgcctcagattctctatccagggataaatctgaaccagaaaatatatttatcaatacaagcattaaataattcatttacatactagactataaataaatggcatactatctttaaaaactaaatctcttttccaatttacagtcagaaaaaaaaacaaaggaaacttttgtctgaattgaatgttactacagttactacttttagataaattaaaacttcattcaccctatcattattactaccatttagcaaaacctgttccccagaaaaggatatggcttccaaagaacatatagagttagatgatgtttgcaggggctagcagagtacctgatccaaggcagatggtcagtaaatacttgtgtaacaaatagaaaagtaaaaaggaggaagagcgggaaggaagaattcaaaactaaaagtggtaccacagaaagctgttaactttggagtaagtaaaatctgaacacaggatactaaccatggtctaatttcatatgtaaaccccgttctctatcctcctgtgaatgttcctcatcttctctatctgcatcatcattttcatgatctacctgcttatcagaaagttttcgtaattgatgcataaatacttctgtagatgatgtaaaatgaaattccttgttgtttaaccaatgaactacaaagcccccatttccatcatcaacattaaatgcagtgccaaccaagacatttggaatatctgtggaaataaaagagatttcaatataattttttttatttctttaaaaacatgacaagtgcttacaatgactaatctatataaagaaaaggtgctaaacaagtcaacataattttagcagcatttgtaaaaactttaactgaatttaatggtaaatgtaaatcttaagaattaatgatagacatatgaaattaaactattaacttaaaaacaaaatacacgaatgcatcaaccttcagtgaattccagtttggggacaggggatgaaaaattaaagcagaaaagcagctataaaagagataactagagaagtttaaatatgaactggatattagatattatggaattacttatcattttcttaggtatgatgatattatgattatgtgagagaattttaggagatacttgctaatgtaagggtgatacaccatgataggtgtaacttactttgaaaagactaagaaaacatttcgaccatgtgcggtgactcatgcctgtaatcctagcattttgggagggagaggcgggtggattgcctgagctcaggagatcgagaccagcctgggcaacacggtgaagccccatctctactaaaatacaaaaaattagcccagtgtggcggggtgtgcctgtagtcccatctacttgggaggcttaagcaggagaattgcttgaacccgggaggtagaggttgcaatgagctgagatcactccactgcactccagcctgtgtgacagagcaagactccgtttccaaaaaaaaaaaggaagaaagaaagaaagagaaaagaaaacatttcatacacatacacacagagacatttgccacatataaagcaactgtggcaaaatgttaacaactgttgaatcaaagtgaagaatataaaagtattaactgtactattcttccaacttttctcagtgtttgaaactttactaaatagctgttgggaaataaaatcaagaaaaaaacacaagaaggcaggcaaaattctaagtataagataatttctccatttgaggtaactgaaatttatgaaattgatgagttcatgtaagagagtataaattggccaggtgtggtggctcatgtctgtaatcctagcacttctgaaggccaaggcgggaggatcgcttgaacttaggagtttgggaccagcctgggaaacacagcgagacactgactctacaaaaactacaaaaattagccaggtgtagtggcacacacctgtggtcccagctactcaggaggctgaggtggtaggattgcctgagccggagaggtcaaggctgcactctagcctgggtgacacagcaagaccctgtcctcctccgcccaaaaaatggtataaatcaaaaacttaatctccttaatttcaatccatattataaataattcattcaacagaaggaaaaattgtcctttgcaaaaagaagtgaaaatctaaagataaaatgcatggacattctggtaatgttctattacaataaatatgaatgttaaatgctctaatttgttctttctttccagttcctggatgactattctggttttgtgataaaaatgaaataaatcatataaaataggatttgtgaattagcaatcctataaaacactacatcacctatgtgcctatgtagtaatcttgctcagaatgttaaacctaaatcttattaacaaatattcagactgtgagacattttgaaagaaaactgagagacaactttttgagactaacagatttttttttgacaattgagaaagggactgttctagattggaggaatttaaagaaaataatctgcatttaagaaaggaatctatatttgtatatgaatggtatattacatgatattattttatctatgttcctcacatgcaataacagtattacagctatggaggcaaattccctttttactaaaagatacattcttaaatatttaggtaatggaaaatatttaggataattagggtatatttagggtattgtaatcaacaactttactttcaaatggttccgtcaaaaataagggaagaggcagcaaagacatatctatacaggcagaggaggagaacaaaagaataaatgacaagatgttaatatgtggtaaatctcggtaagtggtatatggatatttgctgtactattctttcaactttcttgtagtttcaaaaaattttttgaaaaaaaagtgaagaggacaagtcctaacaatataaaattatttgcatttagtaatctatttggtcaacctaaatgttatatttacatgcagtaactaaaaatgcatgatgttaaacatttttaacaaaattgtttttaaaataatatgtaggtaagttaggatgagcatggataaaattagtgaaggttagtaaagaagatggggaagaccaaggcccaatggctacaagaacatatccagtccttaggctcaaatgatgtgacagaatgctcatcctctgtgatcctattccatctaattaggatagtgtacacagttaaaaagccaaggtttctaatatgtattgaatttagtgcagactatcacgaattgcattttgttttgaagttgaatttttatcacagtaattcaagaaacggttcttttaaaaaggttaaaaattcataaaaatctaaaaccacattttgaaaacaaattataaagacattcttagaatacaattaagatattagataagaaaggataatataagcaaaacaacatttaatcagatggcaaagcactgcccaacagaaatataatgcagaccaaaaatgcaagacatgttaagtaattttagatatttcaatagccacgttacaaaaggtaaaatgaaacaggtaatagtaattttaataatatactttatttgactcaacatatataaaatagtatttcaacaagtaatcaatatgaaataaaattatttatgaaatatttttcattattttttatactaagtcttagaaattcagtgtgtattttacagcatatctcaatttggaccagccacatttcaagtgctcaaatagctaatacggggccagtggctactctataaaacagcacatatctagagttaccactgcagatcacccttttagaattctatttactaaatactgtatttacatacagaaacatttaaaaataaaagccccttcactctgaagcaacagacctccagttcaataacatacaactataactttatataaaactttatatagttctatgagcaatgtaatataaaatttatagcctttctcctacatttccatgtagaaggaaaacatattgcctttaaatagaagctctcaaatatgcatttgccaacacagaacctgcctcaaaatacttctcagtcacataggggaaaaagggaaaagaaaatattcaggttagaaggaaaagtgttttccttagtataggacaagaaagtctacaagggtagaaaacaagatatgctgagatataaggaaaactttgtaaaaatatatttagaggaggttataaagaagagttgggaagatttaaactgtgaagtgagagaaattacactaatttaccaggctgccaccacttgtgataccaggttcaatcacagctctaatttactaggaatgcttgttatagtctagacaaagatgctcagaaatagttactgaagttaataccctgagaatcacatagtcccaatcacataggcccaattcaaaaaatggtactttatattatatctctactccaattaagtattttaaaggcaacatgaaataataaaaaacaggttatgaaagtagttccacttttctatttatttacctgacttcaacatatttatgggaaataaaactttatcctttacctgtggcagggttgatgcttgctgcaatatgaaaatgacagagtgcatttgcatggtgggaaatgtgtctttgaacttcatgcattgctgtctggtcgggcattaattcagcatgagttacaagaacagatgacctcctctgtcctttccttaaatttttcaaatggtgtattgtctaaaatagaaaaatagttgctgagtccaactctggaacctctaataaatgccaaccaaagtactcttaattattaagaggtttaagatttttttctccataaaaacctgatcattttaaaggaaactttttaaattacagtagaactattttggatgtattctctacagttcttgtaaacttttagttcaaggcaaaaagcagtgtgcaaaaatacttattcatggtatctataaaacatgaataaagattcccgttaatattaggaggtccaaagatttttttttcaggatatcctagtactgagacagaattttctagtcataagagtaaaaaaaaaaaattcctgagtcttcctaccaggaagaatattgcctccccaatactgcctctcacttagaattaaacagccagctaaacaatcaaattcatgatatctattacaaagaacaaaacagggtatgaaaatacagaataacaaggggaacctacttagataggagtagacaaggaaagacctcattaaaatgttgatctttaatttgtttaaattgttttaaacaatttgcaatttggatatgtttaaatagagataaatctatatgattaaaattcttcattagcatgcgtgatcatgtggactattttagtcatggggccatgtcattcttggcattatcttttttctccatatcacggccccacctcacagtaattccttattctgtaacttaacccactccgaagaccatgtttcataataattttttattactttcctttgttccccacattcaattaaataaagtataaaatgttatcaattctttcttcattaaagtaacataactggcacatcctctcaatttctacagcccttctcattttgcatatggaaaacagtatcaggtcaatggtgtgtcccccacctctggtctcccactacggggttgctcattgctttgataatagggttaagattgacattagagaacccctggtcaaaactgcctatcaaattattttcactggatctttgacattaaccatcattttaaattagactgacaagactgatctaatactggctattttctcctagaaacaaaacatataacttaagaatatatacaattatatagaactaacagtaaggagttccataggaaaggataggatgtcagaaagccaagtggctcgtaagtcagacaattacgttttttcttttaaaaactatcttaacatattaattaataatattaataaaagacagtaaaaacttgtcaaatcactggttacatatttacttatatttctgttctattttacatggcaataattcaatttaacaaacacttgaaaagcaatatatcaggtaccatggaggatacaaagatgtctaaaagcccttagtttccaaaggctcatatataatttgaagataaaacacgttacataagtataagtaagtgatcacaaatatctacttaaaaattaagtactttgtcctactaaatatcaatatcaaaataaaagataactttaactgttttgacatctgcttttaatttcacttacattttaaatattgaaaaaaatgtaaaaatagcgcccaatcacagacagtgatatagtttagatacttgaccctgcctaaatctcatgttgaattgtaatccccaatgttggaggtagagcctggtgggagctgtttgggtcatgaggcggatcccgcatggcttggtgttggtattgcctttgcaatagcgagtgagttctcataagatttggtcatttaaaaatgtgtggcacctccccgcaactctctcttgttcctgcttccaccatgtgatgtgccggctcctgcttcaccttctgccatgggtaaaagatccctgtggcctccctagaagccaaccagattctggtgccatgcttcctataggaccatgagccaattaaacctcttttcattataaatcacccagtttcagacgtttcttcatagcagtgcaagaatggcccaatacagacaatacctgaggaggcctacttcacataaaacttttaaggaccacatccttaacttgtcaaagttgtataatatttctgcttggtaaaatggcaaagccactttgactatgcaacctttaaactgtcaatgtaaatatataatgtaaaagtatagtcaataatgtagactgtaaacaaattaagtataaaaaacttataaagtattactgcataatatgatctcaatcgtataaagaaaaatacacatattcacaggactagaatagttgaattataaattccgtatttcttctccttttcttaatccaattctagaataagcatacagtatttgaataataaaaaacagccacaagaaaaatagtaatctaagtttactataataaatttctgacaattcaaaataatgcatatatctcattgtattacctaatcatatgggacacaatcatttgtgctatgtgttataacgtaatttcttataaagcacttttatttcatactgtatttaaaaattataaaaattatttcattttcaaaatcttcaatcatggaaactccaaagcagttcatttgtgtctaatatcttaataaacatctttattcttaaggaacaaaatagtcatttttaactagaacaataagattttaatctttatgaaacaaaagcaaaatatttttaattacaactaatttcaaggatctttacatattttactaatacttagtcccatagattttcacatgtgacatgcaaaacaaaagaattaaaataatattatctagaacttgagcataaaatatcaatttttaaaaaacttttaataatatttacctataaaacatgtctgagatcattaatttctgcatttggcttcttagtggaataaatgagtagtcttacaagcataaatgagagtttattgctattaatttcactcattacatgtaccatgtgtgccatctgcatgttagttcatgaatttccaccaggctcacattatcttcaaaattcatttaccattttaaataatataatacctcaagagcatgctgtattctgtctttgtgtcttccagcatgagaaaggctgctggcaatgctggaagtggtagtctcacaaatctgctcacccaaaagacagtcttctggtaataaagtttctgcccagagccggcacacaccatcatgacatgaagttaacaacacattacagacagaacccctaacaacaaagagaaataaataaaggttaatgtgaatatcaatcccattaactaattaatattttggttcttcatgcataaagataacattagtgcaaaacactatggaaaaaaggaatcaatcaaagagcttgaaatcatatatagcatcactgtgaacatcataagaaccgggaaattgttttgaaaaaagaaacagaaattactgccagattatacattcaggctctagaggattattagtatctcctaaacaaaacatacaaactaaacagcaaaagaaaacctaatcattgcaaattagagaatgaccataataaaagatcattaaatgtaattaaactatctggcttatggcagtagtttcatcactttacatcctccttcctataacccaaacagttacaaacaaataattatcttcatcataaaactgtaaggagaatataatttcaaactataaatccatttccattaagttaaaataagcaaaaacggcatggcatggagcagctaaagtaacttacctgtttgttacaaaggaacaaaaaaatcattctccctttaaaaaaatgctcacacagaatctaagtcaaaagtattctgcaaatagatgcagatgacttaagcagaatatatttagattcaaaaagtatataaatttcccacattatcatttactgagcatctctacaatgtgtgctatatttcctatcaggcataaacaatcctcagatatatttagtaggtaaaataaccctccctcaagaacaaactagatttctaagcaagcttctgagtgcccaacagctttcttagacctgtatataataaaggaatcatttgtataagcttttttgcagtttatttaatcttctaaatacctttaagaggtgccacaatgatgaggaaaaaatgtataataaaaaatcctttgagaagcttctgttgacagctctcagatttaaaaaaacaacaacaaaaaaaacacaacctggccacttttttcagagtacattatatgctttaacaccatatacataattgacataatactgatctatttcccttcaatgtgtgctttcctgttatttgcaaacattttcttgctaggatctgctagtaccacagctactaccaacaatttcattggctggacacaaagtatgtgcaaaggcctgtactaagcacttcccacccacaaactacattttagtttcacagtaactctctgaggtaggtactattactaccctcactctacagagaaaaactgaggcatagacagcttaagaaatttagtcaaaaactcatgaagctaatagtaggatttgatttcaggcagcttgatgccagagcctatgctattaattgccaccatgtaaataaaaggactttattttcattatttttataaacatttaaggatgcaaactaaagctacatgattcattcatctaacctgggcatatacttgctagttttgcgccacgaaaaacctgtcacagctcggggatgtgccaagtaaacaaaagaaaattgagtagaggactgtctcctttttacttcatgatgatcctgaggtataattgaagacttccaaccagtcataggataccacactttcaaaagacaatcatcctgaaaaatacataggtcaatataaaattaatttgtacatacacaattcaaaatttaagtggtttgaagaagttttaaaaattaagttacatctaaaaactaatatgtgacttatacataatacaaaacttatctcaaaattacattactttaaagaaaactattcttgaaaaataaatgaacagtctattcattatcaatcttttctgtgtgatattgtttttcaaatgcagactgatgccaaattctcccatttagacataaattggtcagtacagaaaaaagattctgatgctagccccttgaataagttagttaagaaagaattagaaagatccatgctatcttttcagtcattgttatcctttcctttttgaagtggtctttaacagtgaagcccttcacccttcacctcacgaacatgaattgtttcttgctctatatcaagagtcagcaaatttttctgcaaagggccagatggtaaataagttaggctttgtgggctacacaggtctatgacacagattcttctttttttcttacatccctttaaaaaggtaaaaaacattcttagctcttgggccacagttctccgatccctactctaagtgatgataaagaatgcatggaggtagctgtcaggaaccacctcaatgcccacttaaaatatttacaagtataacaataggcactgacttaatcattttacttagtcctaacaatttagttaaaggctaaacaactgtattttaacagaaactatcttttatagtgctttataaccaataataaaaactgcattaaagggaaataataaatgttatcgcttatgcaaaaatataacctctgaggaattctgcaattatgtattcctgaaaagtatgcattgacccaaatattttcatttggactagacaaacaattctgtttttttcatcttggtactcattctcaatttgtgctgcataatgaaacaaaaatttccattaatgtctctttttttggatattttaattatacagcaaatcttttaagtgtttgcccttagacagccacttaacaatgtactagttgctttcctccaagtatcttcttcagcatagcatcattttcacataatcaaatttacagcacattctatgcagtggtttcagactacgtaacaaagaaattctacaggtacccgagagcccctcaaaagtcacaatggaaatacaaagagccccaggagcaggtgatactctagcccttctcccattcccaccaatctccccctcaaatgaagcagtccctatttcatctgttattgtctaaaactgtaaaaccacaacaaaattaagtaactagtaacagaaagttatctagaaaattcccaaatatttgaaaactaaaaacttctaaattacaggggaaattttaaaatatgttgaaaatatgaatgaaaatgaaagtacaacatatcaaaagggggagttgcagttacctgagtgcatgagggaaattcctagcttttttttttaagttcacttttgtttagtgtttttgtgttatttatttatttaatctccataggttttgggggaacaggtagtgtttggttacatgaataagttcttcagtggtgatttgtgggattttggtgcacccatcgcccaagcagtatacactgtacccaatttgtagtcttttatccctcactctcctcccacccttcctccctagtccccaaagtccattgtatcattcttatgcctctgcatcttcatagcttagctcccacttatgagtgagaacatacgatgtttggttttccattcctgagttacttcacttagaataatggtctccaattccatccaggttgctgcgaatgtcatttcattcctttttatggctgaatagcattccatggtgtgtatatatatataccacaatttctttatccactcattgactgatgggcatttgggctggttctatatttttgcaactgcaaattgtgctgctataaacatgcatgtgcaagtatctttttcatataatgacttctttttctctggatagatacccagaagtggatagctggatcaaatggtagttctactgttgttctttaaggaatttccagagttttccatagtggttgtactagtttacattcccaacatcagtgtaaaagtgttccctttataccacatccccaccaacatctattattttttggttttttgattatggccattcttgcaggagtaaggtggtatcgcattgtggttttggtttgcatttccctgatcattagtgacgttgagcattttttcatatgcttgtcagccatttgtatatcctccttggagaattgtctattgatgtcctcagtccattttttgatgggattgtttggttttttcttgctaatttgtttgagttccttatagattctggatattagtcctttgtcagatgtatagatcatgaagattttctcccactctgtggactgtctgtttactctgctgactgtttcatttactgtgcagaaactccaggaaaggacatgacaaaaaaaggaaaccacagaccaatatccctgatgaatatagatgcaaaaatccataacaaaatactagctaactgaatccaacagcatatcaaaaagattgtctaccatgatcaagtaagtttcatactagagttgtagggatggtttaatattcacaagtcaatacatatgatacaccatataaacagaattaaaaacaaaatcaaatgatcatctcaacagatgcagaaaaagcacttgacaaaatccagcatccctttataattaaaaccctcagcaaaatcagcatagaagggacaacccttcccctcaagaaatcttctcatcctagcccttgcaaaacccagtttttcactcaaaggcataatcttctctcaaagaaaatgctgcctttttaattataaattgacaacttataattgtatacatttacatagtatgaagtgatgttataattcacgaatataacatgataattacatcaagctaggtaacatatccatcacctcaaatacttaatgttttttatggtgagaagacttgaaatttactcttagcaattttaaaatatacactattctatcactaactatattcaccatgctgcatgagaactcaaaaaaagaaaagataaattccattttttgaagaaaacaggatactttaaattacttgcaaattttacaaaataaccaagtgttattttttaaaatgttccaatacaaactttatgaacataaacgaatagaatttcagcaaacatctcctagtaagcgaaccagagaaaaccaattcttaaactaaagatttaatcaggtatgtcacgttgggtagaaaaggctctttagtaagtaaggctttattttaagttcagatagaaatttaaaatactcttaagcctaagaaaaatttaatttaccacatttataaaaaatagatcttaccagccaaagtgctcaatggaccgtaatattaaaaatcctggaagtaattgaatttgagtctcacaacacctgaaataaaaccctgtcatgtgtagcagaggcggtggaaaatgccttctagtgggagatccacagtgaccatctgttttatcaattcaaatttggctttattaacagaagcagaacagattgtaccaaaaaaaaaaaaactgcccaacattccaaagttactttctgttctttttatcaggataatcttaatcagatgtggtatattctcaaaaatgtgagaaaatagctttttcaatccaagacacatttgcttaacctccataggatccttaccagaaaagcattatctttccataagaattatgaaacacttaactcttaggataactggatataagcagcttagggagacgtgactaacacaatgaaaataatactcaataatctagaaaataaaatttttgtggaaattttaacagttcatatgtctctttcagggaagggtaggcatcctgtagtttgtatcaagctactattcttaattcaatctaattacatatattttactatgtttcataagaaccaattattatacatttgattatgtccagatacagatttattaaagagccacatttcactctaagcaaactcaagggctttccaaccattctcaggcttaaaaacaaaatcagtcctcaacgtactaatagataatgatgatgtgccattaactgcctgtacaactatggaacatttacaagatttactcaaacaacaagtatttattgaaagaagccactatgtgaatggctggggatatagctgaggcagaggaagagacagaaataataaaatacatttcctaatcccacagagcttattctttagaaaggaaggcaacattaagtaaggatataaattattgttttaattacaattgtgataagcactataagaaagaagcagagggcaccaggaaagtatttaataaggagacttgaccttgcctgggagatcagaggatttcttaagcaagtggtatttaaactgagagttgaaggatacataaaagacgaccaggtaaagaataaggaagtctgggtattgtaggtattccctagacagagggaacagcacataaaaagacgtggaagcaggaaagagcttggcatattcaaggccttgaaaggacatcagtgtcgtaggcattaaggtgggaatgaagctggagaggcacggaagggccagatcatacagcagagcctcacaggccatggtaaagatcataatcttcattttaggagcaataggagtcattaaaaggtggtgaaaaggagaacggcatgttcaggtggctggctcctgtgggcagaccaatcagaggatgtttgcaggacatcacttaagagactactgtaaaggtctgcagccccgaagatgctgacacaggtagtggcagtggagggcagagacatggacttcaaaaaccttagctgcttctgtgatcactaagatcattaaaactttatgattccacaaaagtttctttgctttaatttacgcacagttaggcctgtactatctacagatgtttaactgttctcccatgtgttctaggtcttttgacaaaattaactgacattccctccttgaaccttttttcttggcttctctaatgtcacattctcctggttttcgttttatttcagtggttactccttcccagcatcctttgtaggtatctcccctctctctatcatttcttaatgtttgaggatcctgggatttgatcctgagtcccattctcttctctaatacacacgttctccctagttaatttcatccagacccataactttaaacaccgcctttggctaaagaattcaaattgccagagaactcctgactgtcttatcctatctgatatgttaactcagatgcatctcaaactttggtctaaccactacactccagctttctgttgctctttaacaagccctgctaattcctatttcagagcatttgcacttggtgtttgttcccttggccaaaaacactctttcccctgaacttcacagttgtctccttcgtagtattcaattctcagtttaaaggttatctcctcagcaaagctttctctatagatcactcactctaacagacacccaatcacactactatatcatcctgtcttaattttctggacagcacttgttaatacttgatatttttttctgtctttcctcaccagaaattaagtcctataagaacaaaagccttgtctatcatcttcatcataagactgccagcacacacaacagttcagggtatatggtggtgttcaaaagaatatctgctaaacatgtgaatgaaggttgttaatttcagatataatttcaaatcaactttttgtccaaaatgcactatcaattttacgtatataaagtctattatgatatgaatacaactataaaagattctcatgtgtctcacaagtgcagattgctagaattctaaaatgcattttctttgccccgttatatgataaaaaaaaatcaaacaatatatatgttaaagtacagttgacccttcaataacatgggtttgaactgcacaggtccacttacacgtgaattttcttctgcctctgccacccaagacagcaagaccaacccctcctcttcttcctcctctctcacctactaaatgtgaaaatgatgaggatgaagaccttatgaccatctacatccacttaatgaacggttaatttattttctcttccttaaggttttcttagtaacatttttcttctcttccttaaaagagtatagcacatattggatgccacatgcagggtttaaaaaaaaaaaaagagtagagtatacaatacctataacatacaaaatgtgttaatttattgtttattttattggaaaagcttccagtcaatagtagactattagtaattaagtttctggagactcaaaagttagacagggatttttgactgtgcagggggttggatcacctaactgccatgttgttcaagggttaactgtacatgagtcaaggaaaacttaagtgtatacaatacctatccatgatcatagtgccattaacgatatttaaaaggaggcaataggaaaacatgctccaaatgatgcacagtgtgtacaatatccaagctgacatcagcaatgattaactgggaatatcataaagctggattccagtatgactctccagcagctctctgacatgctgaactggtcctatattaaatcatccataggttcacctattatggatttgttaagtcaaaggaatgactggctttattaatcacttattaacgtggtaatcctaagaaatatgagtaacaaaaaaaagacaaatctgtgagttttttcagtcaaattttaggagtaatggggtatttgtttttaaagatccaaagttttaaaggtgactgcctgttttagagatcaagacatgaattacgtaaaataaaattaaaaaggaaaaaaagacatgaattatattatttctcaaactgtttttccagtgattctgacaagtgtacccttcatgagatacccacgcttctcaagacattacagaaaattcttcacgtgtctctacatttctatccagaaatactgttttattatttgtagattattgaactggcttatcaaaatttcagtgttttatttttaaaatctagtttaaaaacaatgaggcaaattagatggagtggagtgtgcaggggtgagagttagcagaagatgaggttgaagcagtgacgagagtcctggtaagcatggagcatgctaaaccatcacgaagacttggtcttttggtaaatgaaatggaaaagcttttgacggttttgtacaaaagaagagtgacaagatctgacaacattttaaaaagatcactccaggccaggaacagtggctcacacccataatcccagcactttgggagaccaaggtgggcagatcacttgaggccaggagttcgagaccagcctggccatcatgacgaaactccgtctctactaaaaatacaaaaattagccaggtgtggtggcacacgcttgtaatcccagtcacttgggaggctgaggcacaagaattgcttgaacccaggaggcagaggttgcagtgagccaagattgcgccacagcactccagcctaggcgacagtgagagactctgtctcaaaaaaacaattttttaaatcactccacctgctggtttgaacatagattgtacagaagtgcagcaaaaattgggaaaccaattaaaaatttaatacaataatacaagtgataaataatggtggcttcaaccagattataagagtggaggtggtaaagaagtaagcagattgtggatatattctaaaggtgagccatcagggagtagattgaggggttagggaagtagagatcagggaagaggtacaggcaaaaaatacaaagttgaatgtcatcagcatacaaaaatggcatttaaatggcatcagaaatcttaagactagaagagccctgggcactccaacatttaaaagtagaaaagataacagtaacaactaagcaggggtagccagagttaaaaacaggcagagtacagaagacttttagggcagtaaaaagacctacaaaattgataaactcttggtgagatgaatgaagaaagagggaaggcataaataatatcaaaactgaagaagaaatcactatacatgtattatagatattaaaagataaggtgttttacacaattttgtgctaataaatttgaaaatctaaataaaactgaaaaatcataggtaaatacaacttaccaaaactgacatacaaaagaaaaagaaaatctgaataatttaaaaaactgaatcctacaaagaaaattcctgatccagatggcttcaccagcaaatacttaagaataaaactatatcaatcttacataaactcttcacaaaagagagctttccaacccatttataaggccagcataacatcaacataaaaatctgtcaaggacattatgaaaacgggaaaattattggccgaatctcactctaacacataaatcttaaacaaaagatcagcagatcaggccgggcgcggtggctcacgcctgtaatcccagcactttgggaggccaaggcaggtggatcacgaggtcaggagatcgagaccatcctggctaacacggtgaaaccccgtctctactaaaaatacaaaaaattagctgggcgtggtggcgggcgcctgtagtcccagctacttgggaggctgaggcaggagaatggcgtgaacccaggaggcagagcttgcagtgagccgagatcgcgccactgcactccaccctgggtgacagagcgagacactgtctcaaaaaaaaaaaagaaaaaaaaaaaaaaaaagatcagcagatcaaatccagcaaggataacacattataatgaagttgggattgttccaggaatacaaggtttacaaaatcagtccatgtatttcatcttattaaaaaattaaaaagatggccgggcacagtggctcatgcctgtaatcccagcagtatgggaggccgaggcaggtggatcatctgaggtcaggagttcgagaccagcctggacaaaatggtgaaacttcatctctaccaaaaatacaaaaattaaccggcatggtgatgggtgcctgtagtcccagctacttgggaagctgaaatgggagaaatacttgaacctgggaagctgagattgcagtgagctgagattgtgccactggactccagcctgggtgacagagcgagattctgtctccaaaaaaaaaagataaaaattgtctcattagatgcagaaaaaatgcttcctaaaattctatatcgtttgtggtttagaaaaacaatctagcaaacaacaaatagaaggaaagtttctttatctgaaaaaaaagtatctaccacaaacatcaacagtaaacattatatttatgatgacacagtgaagggtatccctttgagactgggaacaagaaaaagatagacctgttgtcaccacgtttattcagcactctgctagaggtcctagacactgcagttaaaaaaaaaaggaaaaatatgaaaaatgggagagttacaaaagatgaactacagctttcattattcatagattatataattgtgtacatataaaatccaaaatgatctacagatgaattattagaattaatgagtttagtaagggtgctgggcataaagccaatatacaaaaactgcatttctatataccagtaacaattattttttaaaaatttacatgatgattccatttataacagtatcaaaaacatcaaatatctaggaattaatcccaaaagatatttgggatcttcacagataaaattataaaacattactgaggaaaaaaaggtctaaaataaatggatacatcatgttcataaacgggaagactaattatagtaaagatgtcaattctccccaaactgacctacacagtcaatgtaataccaatcagaatcataagaggttttctgtttgctttgtaaaaattatcatttattctaaaatttatatagaaatgcaaagggccaagaatagataagacgatcttaaaaaagaaaaacaagaggggaggacttgccctaccagatatcaagacttaatttaaagctatagcaattaagtcaggtgacactcatacaaggaaagaccaatgaactagagaaaagagcctagaaacagacctacagaaatatggacatttgattttatgacaaaagtggtaatgcagaacaatgaagaaagggaagattttttccaataaattgttcaagacaaccagatatccataaggaaaaaataaaacttgaccttcttcaaatcacatctaaacattatttcacatagattttagacctgaatgtgaaagataaaacataaaatgtccatattctagaccagaggctcttggcctgaggtcctctgacccaaaggtcctgtggatagacttcaagatataaaagatacttttgacacatcatttgtatcccatcatgccttagcattttggtgtgccagtttcaactgcaagcatctacatctttttgtctgaggtcttctaggagctggttatgagtgctgagaactgatgcctggccctcacctgccttcaaatgatgtgtgtaaagaacatgtgtaaggaacacgatgcaagtgaggaacacgggttcccagaggacccagagattcaagcttcttaatacacttaataaaggttattaagtgccttcacttccctccttccaatccagtatatttcgtgtgatcattccccatattaattacttacacttgaatccttatctcagggtctgcttctgaagaaaccaagaaaactaagacccaaaggcatcatgaaccttaatggggaaaaacaattacttctctattttcataaatgctaattgaaaaaaacaaagtagtattggcagtacatatgattttgtctctaacagaatcaaagatgttttcatatcacatgacagttactgcatatttcaaagtattttttacactcatttctactttgaaattgttagttattggaactactactaaaccgcacatgattgcagtcttcctgtctatattgttcatgcaaccgttaagcaactacctctgtgccaactaactgctgagcaataaaacagtaaaatttaacgtttctacaactagagatcaacccaaaaagccttcagtgaattttgttgttcttggaaagcctaccctcaccttagaaagtgagatactgaaattttaattccacatacaatagctaaacacaattaaaactgcccatattttaagtgcaatttttgttaccgaatgcattaatttaaaagtacataatgtctctatcacaaacgtattttttaatatcttgaagctgtatttcaataatttcttttgtaatgctacgtattttattttatgcatttaaaaacatcatactacgaggaaagttattataggcttcactagatttgcaaaggaatacacagcacaaaaaaacttaaagcaactctggcctagaagattatgtaacataggaaaaccctcagaatctcacagtatgaaaaacttattaaataggactcagaaaaacactgatatatttgacattaaaatcaaatatctctcatcaaaagataccattaagagaatgaatgagcaactaatggagtgggagaagatctttgcaaaacatgtaactgacaaaaagctcatacccataataaagaactcctacaaatcaacaaaagaccaaaaactattttaaaaacaggcaaggaacttgcccagttactttcttttaaatcagtcatccaaatacccaataaataaatgaaaaggtatttagcctcattaataatcagggaaatgcactttaaaactacaaggaggccaggcacagtggctcacgcctgtaatctcaacacttagggagtccaaaacaggaggatcacttgaggtcaggagttcaaaaccagcttgggcaacataaggagataacaactctaccaaaaaaaaatagataaaacttagccagccatggtggtgcatgcctgtagtcccagctacttaggaggctgaggcaggaggatcgcttgagcccaggagttcaaggttacagtgagctatgatcggccgatgtactccagcctgggtgacagagtaagactctgtctctaaaaaaacaaaaagcaaaaaaaactacacggaggtggtacttgacatctaccaaatttacaaaagtttaaaagtcagaccacatcagcactggctaggagcaacaggaactattgtatactatgagagtgtaaattagtatatcaactttggaaaacagattggtattatctactgaaattaaagatacatataacatataacccagcaattctattcctatgtatatacccaagagaaatccacacaagagcctaacagacatgtacaagacatctgctgcagcattatttaatacatgtcagaaatggtatggcagatcaatggaaaaagaatgaactattcagtaaatgttattgagacaactttcatttggattagggacttaattataagagattaaaattttaagattttaggagaaaataaaaaagaatacttttatagcatcacagtaagaaattttcctaaacaagattcaaactacaattaactcactatatattgtggatatttttgtaaaatctttatacttcaaaagtagatactgaaatatttacagacgaatgacatcagtgacacaagcctaaataatccaactgggggaggagtagtacagatgaaacaagattggctgagtgataactgctgaaactaagtgatgggtacataggagttcagtacctttctgttcatgtttgaagaaaaatttttttaatttagggcatcataaataaagggaaaagagaccagcctgggcaacataatgaaaccttatttctaccaaaaaaaaaaaaaaaaaaaaaaaaaaactagccagatgtgatggtacacacctgtattcccagctgaggcaggaggactgcctaagcccaggaggtcaacgctgcaatgagccgtgactgtgccattgcacgctagcccgggtgacggattgagactcagtctcaaaaaaaaaaaaaagaaaagaaaaaaaagaaaaacacaaactctgttaagttcagaactgtggaaaactaaatattaccttatttgggaatttagatgagtgaaacttttttaaataaaataataaacatgaaaatcaggattctggttgcctggggtgggaggggaggaaggagatgcatggagaaagataaaggacccatttgttttatgttctttgtctcaagttgaggagtagggtacatgtgtatttgtttattctttattatatcttatataacatgttttatatatacttttttaatttatgaaatattttgtaatttaaaaaaaatcagagaattttaaaacctcttaaaaattaaaaatttaatagcagaaaaaaattactttgaagttacatctgaaaagtcccccagaaattaaaagaaaaagatgaataagtggacaacagtaaagggggaagatagtaaaatagagaattagtgtaaaagtatccatatctgaataagaaaagattcagagagagaaagaaataacacgaaagaaataatataatctctcagaattgaaagacatgagtttcagatttaacaggtcccccaaatgtcgtagcgttagttggatagtgtgctttggctttgattctgggtgagtgcaggagagtagtcttcatacaatttcttcaggtgtagtcagtgtcagtggtggctgtgagttactcattggcttaggctgtggttggtagcagaggctgtagtgaggctttgctgcagacagggacaccagacaggccagttctgaggcacccgtggtggcagaggcaggccaggcatgcaggcccttgggctcccaggcagcatacaagacgccagtagtcacaggtccaggaggaccagtccttgggcctacaggcagcttgctcaggtgccagtggttatggaaaacagtacggagttttctcaaaaaaacaaaactagaactaccatacagttcatcaatcccactaatgggtatttatccaaaaaaaaggaaatcagtgtatcaaagggatagctacactcccatgtttactgcaacactattcacaatagcctagatatagaatcaacctacatgcccatcagtaaatgaagggataaatgaaatgtggtaaatatacacagtggaatactatttggctgtacaaaggacaaaatcctataacttgtagtaacataaatggaactagaagtcattatgttacatgaaataagacaagcacacaaagaaaaagtaccgttattttctcaatcttatgtgggagctaaaaaaggagatgaagagaaattggttaattggtacaaatacacagttagatagatggaataagttctagtgttcaatagtacagtagggtggcaatggttaacaataatatattgtacatttcaattaactagaagatttgaaatgttaccaacacaaaaagagataaacatttgaggtgatggatatcctaaatactctaatttgaccatcattacacattacgcatgtatcaaaatatcacatgtatcccatatatatatcaattaaaaagtttattgagatataatatcgaaggtcagtgatttttcaacccaattctatgcccgagaaaatcaagcataagaaaaaaatctttcagacacgtaaggcctgaaaaaatgttttttcccattcacctttcttcaggaacctattgggggatatctccatcaaaacaagaaaaaaggaagataaatgatgctaagaaacagaaaatttaacaaaggagagaggcaaagagaatttcccaaagttggtaaaagaaaatccgaaaatggtagctctgctattttagactggtagagcaattaagctgaatgagagcaaagagaactcatgttcccagaatacctcctatgtgggattatactgagaaaagagtcaaagcagttctaaggatgaattaggtatatagaaaaaaaagcaaaccataaaacaaagcaattactatctccaaagtaattactattaagaataatctgtacaatcttaataacataaacaataacttctgatttacccaaaatcatgagatacctacatcaggaagataggagcaagtgaaatgaatatgtgtatatattagatgtgaagatgatgttggggatatcaacccctcacctttatcaagctaaagcctcagcttctacagtgggaaggcaaaaaataatatatataactcagggggctgggcagaatcaagaaatgggagcacctgcaagttattgaaggacatggaaggaaatagcaaaatattcaacttgacaaataattgcctcctggacacaggaattagcgttggaataatgaggcaagcagtacatcttttcattgtgaatccagtattattttactttttaagttatgtacatatgctatttttaaacacaaaacttagtttttaaaaacgcaaataagccaaggtcaaataagagtaataagaatagccattatttcccaagcgcctacaacctgtgagcaaaataccaggtcttttacaaacaccacttttattcttcaggccagctttgccaaggaggattatcccagttttacagatgagaaaactgaaaataaaaataaataaggaacattttaaattcttttatttgtttatttcgtatgtttttgtttgatcctttacctttccagcagtagcaaaatattcaccatcaggagaccattccatcaaatgtacagatactgaggttctaaaaaagagagagttaggcaattagcccttttaaaatctggtgtactgtatataaaaatggtcaagatgagatttttgtaacatcaaagtcagaatcctcagaataagactgtttttgcttccctaaaaatataaataaaatatttcacctccataaaaatgtaaatttattaaaactaatccaacattcactttgggaaaagaagaatgtaagtaacatgaatacagtatatctccacctacatgtcccaccaacatcctaaatataacatgttaaaagctgagcttatcatcatccctgactagtcttcgtcacataatctatatgactgttaatagtacatcttccacttgaaagagtggctggcaactttcacatcttccccctctccatccttacctcaatctattaatgagtatttcctatgtatcaaccctgtcaactcctgtcctggggctataactatgaaaatactttcatcctttttttaaatgattaactatagcacaaattaaagaatgctattatatgggttttggttagaaaaaaatctactttctaggcatctaaatgcaatggtaccatcaaaaaataaagatctttgtgaaaggaaacatattttaggaagcacttgcttttaattaatgaatataacaatagaaatagacactaacttgcactgccagacacacttccaatcatttaaaacaggaggaactgtattatcaatttcttcctcctcttccagaatatcatctcctggaggagcccacaactgaatagaatcagttgctgtcaacaatctattatctgaaaattaaagaatgttatgatgaatatgcaaatattatatagggaaataaatgcacatgggcttctgtttagatctgtaaactattaatattatgtgaaaagtaagcaatatcgccaacgaaaaacacttggtatatatttttttaaagtcccttataagaaaaaagaatcttctggacaacaaagattcttaaggaagatttgagaacaacaaagtaaagcttactggcaaagagctattattatcaagcaagtcaaaaaaactaacaacaaatgtattaatagaataacaaagtccccaaaactctgatatataccacataaaatgtcctcgagatataaggcataactacaaattaataaaatgtggttttacacatgaaatataaaaagaatccttattaattgtgaatataaaaagggacaacagctattatcattagaaattcctaatttttcaaaattaaagatagtaatttcctgatacaaatgataaaatgaggtgaagtttttttggtctctgttttatttccaatggtgtttcttagcaaatacaacaagagtaaagggcagtacacattaactaggaaacaaatcataactgcttcttgaaataaaacacacaaaggcaggggaaaaaacagaatagtaaattaagcattgcacaaagcactgtataccaagaaggaaaaattatattcatcaacaaaaagaaaatataatacattgatcattttcttattatgggagactatatcacattattatcatacatttaaaacaaatatttaatttaaataattttaaatacaattgctaaataccttgaggatcccatgctaagttgtatgtcacagaactcaaaaaaaactgcccagttttaagccactggcacttgagttgctgaaatacgtagacaaaaagaaataagaaaaaagaaaaagatgtttttcaaataatatcccaaaacactaccattttatcattttcttcaacttaagactttaagatctggaacaaagatgaaaatatttcactattattttcatatactgtttttaacgtaactttcattggttccactactatttattataccatattgagctccttgccatgcccaaacaaagcaggttctctcacgctttttctcatgcctataaataccttcttatatttaggatatcctattcctcacgtctccatctgcaaacccctatccttccactaagattagctaactcatcatctctgctatgaagccttctctgacatcctggcagcaccaataccacttttacattctgccattataacactgatcacatggaattagtattggtctatacatctgactctcctcccactaaattgcaactcttcaagggcagaaactgtgtcataattttgttatcttcagcgtttgtaatggctggcataaagatgttaaatgtttacatatttctttgtagtacataaatataaaatgtccttttgtgagaggacatttgtgaaaagctttgcaaagctatgttaccttaggcaagctatatgttaacggcttggcaaataatactgtttaaacggtaatgccattttgtgttataatattttaagaatatttaacaattttaaaatgtatacaaggtttcctgactacctcaaggcagaattttaaaacatagctgcatcccaacagtttgggaggccatgacaggaggattgcttaaggccaggaatttgaaaccagcctgggcaacattgcaagacccccatctctataaaaactttaaaaattagctgggcatgggagctcacacctgtagacccagctactttggaggctgaggcagaaggatcactttagcccatgagtttgaggttatagtgagctatgatgatcacaccactgtattccagcctgggtcacagagcaagactctatatctaaaaaaaatgtgtgtgtggggtgtgtgtgtgtgtgtgtgtgtgtgtgtgtgtgtgtgtgtgtgtgtgcatctgcaaaccctgcacttcattatccaaaaattatttgatattttataatcagagaaaatgctatttttaaaccctaccactgctgaccaaacaacaatcacaacagcataacactaaatactgttcaacaaatctattttagtgtagtaattaaataattcctaaaattatagacatccctaatattctttcctttagtgttcctcagagtgcaatctgtggagcaactaccttgaagaaatttggggaatgagacctggaaacctaaatgtttagtatgtgctctaggtgactcttaagtagtccaaaatttgatatccatttcacaatactattatagggaaagattaatattttaatttatactgttttgggggaatgtaaaaagatatattcaaatacatatatttaatgaaaaaataccaaaaccatttgttttaaggcatttcacttaaaaatatactttaaaaattatttgtaaatatatactcagcattcagatttagcatttgcaattttgattatttctgagtgatggtaaaaatgtaatgcatgcaggatgttttaaagggcttaattctaaccacattagatgttttgaacattaagtaagacaaatataatatagcacccagtatgaatctgaatggttcacaatgtggtatgcttaaccacttagctgagctggtaagtgagctttttaaactcctaacttcttcattcaaccaacatttaggaatacctactatgttccagatacttttttttttttttttttgagatggagtcttgctctgactcccaagctggagtgcaatggtgcagtccaggatcactgcaacctccacctcctgggttcaagcgattctcctgcctcagccttcctagcagcagggactataggcacgtgccaccacacctggataatttttttatttttagtagacacggggtttcaccatgttggccaggctgatctcaaacccctgacctcgtgttccacccgcctcagcctcccaaagtgttgggattacaggtgtgagccaccacacctggctgttccagatactgttctaagtactggggactcatcagtgaaaaaagcttcctacccttatgtacctttagataacattttacatagtaaacaataaataaataaatgctgtaaaaaaatttttaaatagcaagataagtgggggtacaattttttaaagggtggtcaaggtaaacctcattgacaaggtattagtgagcaaagacctaaaggatctatgggagctatccttggagatagctggaggaaaaacattcctgacaaagaaaacaaacaacacaaaggctcaaagagggaaggttaactgagaaacagtaaaaatgccaatgtggccagagtagaaccagagaggacaagaacttacgaggtgagctctgagacatagtaactgtgctactgagtagaagggaagttgtagtctacaaaaggcttttggctttttatctgaaagaaatatggagcagctgggcatggtggctcatgcccataattccagcaatttgggaggctgaagtgggaggatcacttagccccagagttcaagaccagcctgagcaacacagggaaactccatctctacgaaaaatttaaaaattagctggccatggtggtacatgcctatagtcgcaactacttgggaggttgaggtgggaggaccatttgacaggttgaggctgcagtgagcagtgatcatgccactgcactccagcccaggggatacagtgcgaccctgtctcaaaacaaaagaaaaaagagagagaaatatggaaccattacaaagttttaagcagagaaatgtcatgatctcctctgttgagaacagacactggggctgaaggcagcaggaaaccagatatcagatagatattagtaatccagacaagaaataacagtagttcaaactagggtagatctcagttaacacagtaaatgtcaatttgcaatattctagagacttgggtttctaaaagcactagggatgtatccgtagtgaatgtaaggatcctaacataaagcactagaccaatttttcactgatactctagtctattttcagcactagctcctaaggagctttttattaacatcaattggattctaaagttaactagattctaaaagtattctattattggttaatacttacacaatttcttttatgagaatttatgcccaagggctcaaatatacaaacagcattaccatatgaagctgcaatctaaaaaagaataaatacagcattaatatctagaaaagggtaaaataaagatatcttccttttcataataatgtataaactaattacatataatctcaatacagtattcatggtttatttccttccataaatatacctggaagtgtactggagttaagagtctctcccctgttatcaaaaaattcagcaggctttattttacatatcatatacaaggttgacctattcaaagaaatcatatttggatggacagctgccaagatggctgaataggaacagctctggtctacagctcccaacgagatggacacagaaggcaggtgattcctgcatttccaactgaggtaccaggttcatctcactgggactggctggacagtgggtacagcccgcagaggttgagctgaagcagggtggggcgtcacctcacatgggaagcacaaggggtcagggaatttccctttgctagccaagggaagctgtgagagacggtaccgggaagaacagtacactctagcccagatactgcacttttcccatggtcttcacaaccagcagaacaggaaattttctccagtgtctggttcagcgggtcccacccccacggagcccagcaagctaagatccactggcttgaaattctcactgctatcacagcatctgaggttgacctgggacactcgagcttggtgggaggaggtgcatccgccattgctgaggcttgagtagatggttttaccctcacagtgtaaacaaagctgctgggaagtttgaactgggtggagcccaccacagctccccgagacagagcacgtgggggaaggggcggctgcaggcacagcttcagcagacttaaacgtccctgcctgacagctctaaagagagcagcaattctcccagcacagcattcgagctctgatacaggacagactgcctcctcaagtgggtccctgacccccccgtgtacccagactggagacacctcacagtaggggcctacagacaccacatacaggagagctctgcccggcatctggcgggtgcccttctgggacaaagctcccagaggtaggaacaggcagcaatctttgttgttccgcagcctccgctggtgatacccaggcaaacagggtctggagtggacctccagcaaactctagcagacctgcagcagaggggcctgactgttagaaagaaaactaacaaacataaaggaatactatcaacatcaccaacattaaagaaaaaaggtagataaatccatgaagatggggagaaaccagtgcaaaatggctgaaaattcccaaaaccagaacacctcttctcctccaaatgatcacaactcctcgccagcaagggaacaaaactggatggagaatgactttgacaaactgacagaagtaggcttcagaaggtgggtaataacaaactcctccaagctaaagaagcatgttctaacccagtgcaaggaagctaagaaccttgaaaaaaggttagacaaattgctaatgagaataatcagcttagagaggaacataaatgacctgatggagcggacaaacacagcacgagaacttcatgaaacatacacaagttatcaatagccgaactgatcaagcagaagaaaagatatcagagactaaagataaactcaatgaaataaagcaagaggacaagattagagaaaaaagagtgaaacaaatgaacaaatccttcaagaaatatgggactatgtgaaaagacaaaatctatgtttgattggtatacctgaaagtgacggggagaatggaaccaagttggaaaacactcttcaggatattatccaggagagtttccccaacctagaaagacaggccaaaattcaaattcaggaaatacagagaacaccacaaagatattcctcgagaagagcaaccccaagacacataatcatcagattaaccaaggttgaaatgaaggaaaaaatgttaagggcagccagagagaaaggtcgggttacccacaaagggaagcccatcagactaacagcagatctcttggaagaaaccctataagccagaagacagtgggggccaatattcaacattcttaaagagaattttcaacccagaatttcatatccagccaaactaagcttcttaggcaaaggagaaataaaatcctttacagacaagcaaatgctgagagattttgtcaccaccaggccttccttccttagtgaaggaagcactaaacatggaaaggaacaactggtaccagccactgcaaaaacataccaaattgtaaagaccatcaatgctatgaagaaactgcatcaattaacaggcgaaataaccagctagcatcataatgacaggattaaattcacacatcacaatattaaccttaaatgtaaacaggctaaatgccccaattaaaagacacagactggcaaactggataaagagtcaagacccatcagtgtgctgtattcaggagacccatctcacatgcagacacacatacaggctgaaaataaagggatagaggaagatttaccaagaaaatggaaagcaaaaaaaagcaggggttgcaatcatagtctctgataaaacagactttaaatcaacaaagatcaaaagagacaaagaaggccattacataatggtaaagggatcaattcaacgagaagagctaactatcctaaatatatatgcacctaatacaggagcacccagattcataaagcaagttcttaaagacctacaaagagacttagactcccacacagtaatagtgggagactttaacactccactgtcaataatagacacatcgacaagacagaaaattaacaaggataccagggcttgaactcagctctgcaccaagcagacataatagacatctacagaactcaccacaccaaatcaacagagtatacattcttctcagcaccacatcacacttattctaaaattgaccacataattggaagtaaaacactcctcagcaaatgcaaaagaatggaaatcataacaaatagtctctcagaccacagcgcaatcatattagaactcagaattaagaaattcactcaaaacctcacaactacgtgcaaactgaacaacctgctcctgaatgactactgggtaaataacaaaatgaaggcagaaataaaagatgttctctgaaaccaatgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacatattcaaaagctagcagaaggcaagaaataactaagatcagagcagaactgaaggagatggaaacatgaaaaactcttcaaaaaatcaatgaatccaggaactggttttttgaaaagattaacaaaatacatagaccactagccagactaataaagaaaaaaagagaagaatcaaatagacacaatagaaaatgataaaggggatatcaccaatgatcccacagaaacacaaactaccatcagagaatacaataaacacctctacacacataaactagaaaatctagaagaaatggataaattcctggacacatacaccctcccaatactaaaccaggaagaagttgaatccctgaatagaccaataagaggttctgaaattgaggcaataattaatagcctaccaaccaaaaaaagtccaggaccagatggattcacagctgaattctaccagaggtacaaaaaggagctggtaccattccttctgaaactattccaaacaataaaaaaagagggaatcctccctaactcattttatgaggccagcatcatcctgataccaaagcctggcagagacacaaccaaaaaagaaaattttacaccaatatggctgatgaacatcaatgcaaaaatcctcaataaaatactggcaaaccaaatccagcagcacatcaaaaagcttgtccatcaccatcaaatcggcttcatccctgggataagaagctggttcaacatacacaaatcaataaatgtaatccatcacataaagagaaccgatgacaaaaaccacatgattatctcaatagatgcagaaaaggcctttgacaaaattcaacagcccttcatgctaaaaactctcaataaactaggtaatgatggaacgtatctcaaaataataagagctatttatgacaaacccacagccaatatcatactaaatgggcaaaaactggaagcattccctttgcaaaccagtacaagacaaggatgccctctctcaacactcctattcaacacagtactggaagttctggccagggcaatcaggcaagagaaagaaataaagggtattcaattaggaagagaggaagtcaaattatctctgtttgcagatgacatgattgtatatttagaaaaccccattgtctcagcccaaaatctccttaagctgataagcaacaaacatatgaaaaaaaatgttcgtcatcactggtcattagagaaatgcaaatcaaaaccccaatgagataccatctcacatcagttagaatggtgatcattaaaaagccaggaaacaacagatgctggagaggatgtggagaaataggaacgcttttacactgttggtgggagtgtaaattagttcaaccatttgtgtaagacagtgtgggaattcctcaaggatctagaaccagaaataccatttgacccaccaatcccattactgggtatatacccaaaggattataaatcattctactttaaagacacatgcacatgtatgtttattgtagcactgttcacaacagcaaagacttagaaccaacccaaatgcccatcaatgatagactggataaagaaaatgtggcacatatacaccatggaatactacacagccataaaaaaggatgagttcatgtcctttgcagggacatggaagaagctggaaaccattattctctgcaaactaacacacaaacagaaaaccaaacaatatgtcctcactcatcagtgggagttgaacaacgagaacacatggacactgggggaaacatcacacactgaggcctgtcagggggtcggggggctaggggagggatagcattaggagaaatacctaatgtagatgatgggttgatgggtgcagcaaaccaccatggcacgtgtatacctatgtaacaaacctacacgttctgcacgtgtgccccagaacttaaagtataataaaaaatatatatatacatatgggaaaaaatcatatttttcataagaattttatttttaatataaaataactattaaaaaatacatttcaaaagcatgcatctttgtcagaaactttataatccagtgaaaataatataaaatctatgagaaaagcatcaactaataacaggtcttaaaaatatttcaaataaaatggcctaattataccatcaaacagaaaataccaattgggacaccatctagaggaaggaatacaaaaaacaggctaaggagaagtcagggagccataaactgcacctgggggaaagagctgatgaagacatctccagaggactgaagcaagaaatttagggaccaggaggattttgttccaggtcacatacctggtaagaaaagacataaatccctctgttcccagaaactaccacagcctgttttccaataatttcttgaaggctatttctaagttcactctcctcttggtaagatggaattaactacagggaatagaccaaaaaccgtcctttctgacacctctgcaccctggttaacctttaaaactcaattaggtatatattcttttaaggcctgccaaaaatatcccctgtgattttaaggcactgttataccaaaaagtgattttaactcttatccaacatctaacattctttccaagaaaaatcataatccacaacagaaagctacttcaaatgacacttacgcaaaaagtgttgtgaataattccattcaacatgtcaatcaatgaatgaatgattataacagactaatacaaggtcaccaatgtgaaagttatcaccacaaggactgggggataaaaggactaaacgaagatgtcaataaagacaataaagatattataattttgccttatttacattaaaccatctcaagaaaagtagaaacacaagttgctctgtttcccatggtatgaataccaatgtcttatatacttttttaaaaagttttacttccagagaatgtgtgttcattgcgattatcaccagcacttgagttatttactaaaattcacctctgacaactatcatacaactttaggcaggcttaagctaccttgcttggcctagagagaagagcaacaaaaaattaaaaagagaaatctgacactccccatgttttctaaactaagtgtaagcaatgcttgagggtggggagtacctggggggaaaaattagaaaagcaagaaacaagtaccaggaaacaccaggaaatcgtgtttcaatactaggtcaaatgtatcactgaactgtcaagtactggtacatttacacaaatattaaggcttgatatgggcagtaggatagggcaggataaatggtatgataaagtaaccataatttatcattcagtataaatttgtatgattactatttatcaccatgaatattctgatttaacatactcttgatcaaatttgttacccaataaataacaatttctagaacactaagattgtttaaactgttacaatgattacaggtaaaaaccttattactctattctcgtagagacattcaactcggctacataatactggccttactgaattgctggagtatacagcaaacatcctatatttacttgacatgccaccaaaatttgatgtacattatgtttgaaaattgggggagaggtacatatgatgaaattttaactatttcaaaataaaacctctgttttaaagcctgaatgaaccataagactcttcactcaacaaaaaatctttcattatgttaacagactttacaaagcacttcctatatgacaagcatgatattagatattaacaacttgcagagtttcttaataaaactttgatgttatagtatgagtgatataaggggtgctaggtagagaagaaaaaagtttacttccccttactggcttaatggctgctagaagtattaactggcagaatatcagtatgcacaggattgtaaggcctacagatctttgaagacagtatacatacagctgtagaacaattatcaaattatcagtttaatggcactttacaatttgtataaacctatcactttgcaacttctgctaataatcacccaagcaatacataagaaattatacgcaagctttgcataaaaggataagaagattctgagattattaaacacatttttaaatgacattcagtaaagaaattaaatcccttactcttccttgttggttagaacactccacacagctgacttggatgtttccatgcttagcaccaggaatgatctgtacacattcaaagtcatttgccaaaataacaatatcacagcctgatccatatgcctaaaaaaaaaaaaaaaaaaaagttttacaatacataagatatgtaacttttgaaatcttattacatactattttatcttagattttattgccattataaagtataccttgggacattttacaaaatagttaatataatatcaatttctaaataagaacattaaaagtcacattaaaaaataaactgatgacactccatgcattatcattcaacaactgttactaataggaaaagggttcttccagttcttagaacagccactgttcctgcaggtcataagtcattctgtttagactttctctccaaagttcatctcagtaaaccctaaagtataaaagctccatctaaaaatactaagccactgaagactgtaactgtgttcccagggttcaaaccaggcttaagaaatatcaagatagaaatcaggcatgcattttccaacacaattccacatgccttaaagagctagttaaataaacatgaacaacaaaggcagaattacatgcactaaggcaatggctaaacttaaatgcatcaagactcaaatgaatccacaacgcagcctgcctccaacatccaccatccatccccaacatcatcaggcctgagggagaaaggaaaccaacccaaagttgttttaccaaaggtaaaaaagtcaaataaaatagaaaatgaatgaatttatatagaatattgggcaaataccactatatgatcttgaaaatagactacaacacagaattaaattgttgggaaaattcccatgtccaactctaatgagtaaaaccacacatttcttcctattgcaacacttcttgctgtatgctattcctgttttgcaactttgtgaattttatgacctaagggtcagagagttgggacatatttctttttcttccaaactacttatgattaaatattcaaaacaacctaacaacccaattctcaaaagaaaagctccattaaaagcaagataaacataaaacttatgaaatggtatttttccgcactgtttccacacccttaagcagtgtggttacgacctacaaaatagagatatccaatagccagggctgacatgtgatgacatctgaatcagtgacccatgccctgaagggatccatataaggctgctaatgaaagagggaaatgaagataaagaccagacaggaagacattaattctactaaaacttccaatgttaccaaaatcctgccataaccactatataaaacatcttcaacccatgtgtttataaaaatcaaaaagttcaccaaaagaaaagcaaagacagaatttcaagcaagaaaaatatggagaaaatcactcacaggaggaaatgatcacttacattcttatagacaaggcagacttggttataccatgaattcaggaaagccaaactgaaggggaatattgagtatatgcagaagaaatgtttggatcaccatgctaatttttaaagtatagtattaaaataacaaaaatcatcttactcttgaggaacaatttcaaaatttccaacgtgccttatatcattatctcagcaaagtggattcatggaaaaagcagactttatctagtttgaaatcacacacacagttttcagttttggttatgccatgctgtgctatcttaagaaagttatttaagttccctaagcatttcctcatggtaaaatgaagcaaataatacttgtctcttaggatacttgtgaaaattaaaatggaaaatttacacagtcatttaagaaacagaacagtgcaccaagtctcaagtctgggctagggactgagaacactaaagtgcaagacatggtcccagttactctaatggggagatgactaggtaaattactaattacaactaaatgacaaactgccatgacagagacagtcataaaatagtagaagacagaagaagtactcaacaagtgttggatcactctctctttatctttgcaacaaacctggagggtagatactatcactgtataaagaaaaattcaagtgcattaatttgcccaagattactgttactaaatgcaaagtgttcaaactcaggtccttacaattcttacattcttttccctacattatatatcaaaaagacataaaatattccagataaatattagtacactttgtttctctaaagatgtgccatccctagcaactagtgctacttaagataaattcactcttacggctcagtcactgaaaaggctttttactcttccctagataaccataattgcctgatgttttccagagaatgtgtactatactccatttttctgatccggcaatagttcaaattggatgcatcaaaatcacctaggaaacctgttagaaacacagactgctcagtcccacaccagactaaattaaaatctacatggataaaataatttggcaatatctatcaaaatcttaagtacaatataccttttgatcaaatattccctattttaccctataagtatatatacaaaagtttgccaaaatatatgtaggacattcagagcctcagtatttatagtagcaaaaactaaatataatcataccactcatcagtgaggagtagttaaataaattactgaattacactggaatactacacagctactaaaagttaagaggctgggtacagtggctcatgcctgtaatcccaacactttggaaggccaaggcaggaagatcacttgagcctaggagttcgagaatagcctgggaaacacagtgagacttcatctctacagaacatccaaaaattagttgagcgtggtgtcacacgactgcagtcccagctactcgggaagctgaggtgggagaatcacttaagcccgggaagtcaaggctgaagtgagctatgattgcaccactgcactccagcctgggtgactaagtgagaccctgtctcaagaaaaggaaaaaaatggaaagtttaaagaccactggtttagaatggtctcaaaccccctaccaaactagtaattcccatcaaaatggaacaacttatgtctggtgctagtttcctgttgaaccagagttacgcaatgcctaccattttatataataaccatgattactgctagaatggaatctcttaaactattgcacactaacagcttgaaaaagtgcacaggggcattttctaaagagtctaatgcataaataatccaagggtggaagaaaaagggactcatataatcagtcagtactgaatcacatgcattctgtaattgagggcccatgagattttaatggttttaaggcatgtttaatgtctgtctggttcccactatactgaatggttcatcagagcaaggaccttaccttgtccttgtttaccattgtggtcccaacacctagcacataagcagctgtcaataaatagctgtatagtaaataaattattaaagtcttcctaaccgaatgtctggctccagaagtctaagtacctagaaacttagtcaaagaacttggagttgaaacactgacactgccttgttgctaataatttggccaacctatcctcataagcttaagaaaagagggagagattctgactgattttccagctaacagtatcaataaatgtagaagatctactagaagagaatctaccaaagccttccttataattcaccatttactgaatacctactatgatcaagctgttttgctagggtctttacaaaaattatcattatcttcacaggcctgcttttgaagacagagaagctgaggcccagaaagggtaagtaatttgccctagttcactgaatgaggattcatttgcttcacagtaaagttcctgctctttccattgcattgccctacctctattccatgaagatcctgttggtgctagaaggagtgtgttcatttttgtaatcccaattaatttaccacatcatggagcacagaataagcattctgtaaagaccaacagtttatacaaaatctataatttactcaaaagattcccattctctcaattttagagagatcaaaagtgattttgttccattctttttcagaatctagttttaccagaggaagaatttatagtgcaggaggaaaacagggtgttcgttaagactacaagcaaatactaaattgaccccagagagtatggatgtgggctcctttgtgttagataaatgaaatacttctgactaagctaagttagtaaagttagtaaactaacctcttcacatgtgggagataggccacaggattattatagggaggcaaggaaaaggactgcaagccttttctggagaaatggaatcccttgaccggattatccctccttggattctttgtagagctgacctgtgccagagcacaatatacgagtgtactgctcttctaacagtactgacctataaaacactttatcttgaaatcaaggatatggctcagcccctacacacagagaaggcccaagaaaagaggaagagtcttagaaaaattgctttccttccattcatgtgggaggatttgttttataaaaggactaaactgtttctctgatgataaagaatgattagctgatattagtaattcacagctcagagataattctgtagcataagctgttacatccaaaaaaaactttaaaaatattaaccctcacttgttataatcctattcttatagaccaaatccatcctattaggaaagagaaaagtattctctgctttgaacattgaaactaaaagttttcaacctgaagtctaatagacataagtcatagatggcctcagtaggtctctgaactccgaaaaattgtatttaaagttgtgcgaatgtgtttcttttctttgctgtggtactattaccacaataaagatattgctgctttctttagagcaggggtccccaattcctactaccagtccatggcctgttaggaactgggcctcacagcaggaggtgagcagtgagtgagtgagcaatactgcctgagctccacatcctgccagatcagcggtggcattagattctcataggaactcaagccctattgtaaactgcacatgctagggatgtaggctgtatgctctttatgagaatctaatgataaacataatgtgcttgaatcatcccaaaaccatccctctccttcacccctcgctgtagaaaaactgtcttccacaaaaccggtccttggtaccaaaaaggttggagaccgctgctctagagggtttaatgtcctaatgaacaatgcaaattttgagatcactgacaaccactgacagatgcgtctaaatttaagagacaaaaaaagcactgataagggagtattaggcatgttgagaggtcttttaaaatgcagtgtgaagaggcataacacactcattcagtcttctctaactttagttttatatataattgtcttaactacattattttcagaaaagaaaactaatactctaatcccacaaacactgttctaatttctcaaatttcctttatgtctcagataaattgaagtggagagtaacaaaaggaaaacttttaaaaagcttaaacaaacatgaccacatttcctatgaaactatagcatacaatagattaattacattagcatttactatagaatagttggatgttttaacatcccggaagttacagggtcaaagtttgagatcattgacaactactgataagtgtctaaacttcaaagaccaaaaaaaagaaacaaaacctgataaatcaaggtgtactaagcatgttgagaggtttaacaaagtactataatcttaccaagaatactatatcaagagtgttactattaaactcccaccgctccctgggagtgagttttgatcaatgtaaatatgtctacttttctactgaagaaggtacattttattaagagttagaaaaataattacaagaaggaggtaccatttattaaaaacctactgggtgacaagtattatactattttcattctatattcctaatctttctttcaagactgccacaatcctagaagttggttattaatcccaccttaatatttttgaaaaaggaatttcacaggatttaatcaaattcctatgtcacaaggtaaatacatgactataattcaaactcagccctctttactgttttttccactttactaatgacatttttctatcgtttcgttttctgttgctcaaattttttgctctttattaattgcatttaaattcttcacttctgctgtgatctttgctcataaacaaaaaaactaacaggaaggcagggttgtctgggctttgatggttacttggctgtaccaagagatcttatagaaagtcttaagaggccagtgttgacatatgaaaaatcttacaaccaagaggacaaaacacagattaacaaagatttcccaggaaaacacccattccttctctccattttagtcacctaattaaaaccctagctctttatgatactctcagaattattaatttctaaaaaggacaaataggtttccttaatacgttcctgattaagcaagaaatttcacaagtcacatatacattgaaatcatgtacaaggtaaataaggcacataaaatgtttaatattaatgttttcagtaacaagattttctttttcatagaggaaatcacacatatattaaattttaaaattaaataagaaaatgaagtcaccttctcatccttttcacccttcttacccctcccctcctcattcccaggaagcaattacttaataattacctatgaacccttcctgaaatgttcaatatataaaagtatatcttttatatatcttcttttaacataaatgggatcatgctatacacaattctgccacttattttccacttagttaacaatgtatcttgaagaactttctacatcagcacagaggaaattacttcattcttcttttttttttttttctttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgttggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcgataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccacgttgtaggttgcctgttcactctgatggtagtttcttttgctgtgcagaagctctttagtttaattagatcccatttgtcaattttggcttttgttgccattgcttttggtgttttggacatgaagtccttgcccatacctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcatgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatattcattcttcttaatagctgcacagtattagtatttcatgttgtggctttgccataattaattttggttgtttccagtcttttactatttcaaacaatgcttcgatgaacatgtatgtatagatgatatatgcgtatgtgtccaagaatccctacaggataaattctaagatataatatgctggatcagtgattaaaattaattgcaactgcaaattgtcttccaaaaagattatagccccaagctgtataaaagtacctatttctccacttactcactaaccccaatcattatcaaatgttttaatctttccattccaacaaaacctgacatctccctgttctaatttgtatttttattagaagataagcatcttttcacatatttatcagccatttatatttctttctctgtaaactgactattcatattattggtccatttgtctttctgcagtttttcacacctacaaacaaacccttaccattattaactcccacccaccacaaggcaccgccaactccaagatacataaaactcctaccattgagatgtaagtccacactacagtaagaaaagcagggaaggggtagcatttgaataagttcttttgtccacatgattgagaacacactttactgacatgattcagttattctaactgcccaaagtccactcgagagtgctgaataagcaaaataaatacatgaaaaaggaactagacagtatgaagaaagcttacagcaaaaaagtttaacctaagtcaatgatgagtacggaaatgttggaaataacctaataacgactgcttgtgtggtaatcaaagggactgttcctcttagaaacaactcatatcagaaaatgcaaaattaacaaaatttatgcaagagcagtagaaaaacgcaaagctgtgggtgctatgtcgagggaaacataagacaaagcttgactacaaatatgtaaaaacaaaaatctatgggaagaaaaaaacaacagaagaaaacttaagaaaacgttctaagcgtttatgagtaagtggtaaaaggcaagatgatttcaaatttcttcctaactactccaaaacagcaactggcctgaaagaaagaactttctttataaaagtaaaattttaaatttagactttaaaaagagtaatttaatgttactaaaaaaaaactagccaattttgataatttactaatagatggagctataacaaacttctaagtactaagctaaagagaaacaaacttgtggtccaaactaagtctatttatatacctctgataaagaagaaaaacgtgtttttttcactggtggtagtaatatctgaaaggaaaatgagaccttgaaaagcaaaatatgcaataattaattatttgctctaattaaccattataaaaccaactctatctccagcttgcctgcattctcaataaaaggtagatccggaagtggaaatcaaaaatcttatatcttatattttatatgtcagtgcttttaataactatttatatgtcagtgctaagaataaaccattcaaagtattcattgtcaaaaatctctaaaaaaaaaaaaaatcaatactgtaaaaatcagtcccatggcctggccaacatatacaaaaacctacagtcaccttttagcctcaaatttattctcaaaagcttggagtatgtaacaatttgcttcataacaaataatgaagtaaaatactactttttaaaatagctacttctaaagaaataaaaataactttttttattatactttaagttttagggtacatgtgcacaacgtgcaggtttgttacatatgtatacatgtgccatgttggtgtgctgcacccattaactcatcatttagcattaggtatatctcctaatgctatccctcccccgtccccccaccccacaacaggtcccggtatgtgatgttctccttcctgtgtccatgtgttgtcattgttcaattcccacctacgagtgagaatatgcagtgtttggttttttgtccttgagacagtttgctgagaatgatggtttccagcttcatccatgtccctacaaaggacatgaactcatcattttttatggctgcatagcattccatggtgtatatgtgccacattttcttaatccagtctatcattgttggatatttgggttggttccaagtctttgctattgtgaatagtgccgcagtaaacatacgtgtgcatgtgtctttatagcagcatgatttataaacctttgggtatatagccagtaatgggatggctgggtcagatggtatttctagctctagatccctgaggaatcgccacactgacttccacaatggttgaaccagtttacagtcccaccagcagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcagatgttttttggctgcataaatgtcttcttttgagaagtgtctgttcatatcctttgcccactttttgatggggttgtttgtttttttcttgtaaatttgtttgagttaattgtagattctggatattagtgctttgtcagctgagtaggttgcagaatttttttcccattctgtaggtcgcctgttcactctgatggtgatgacccaatattgtttaggggttttttttttttttgagatgaggtctcaccctgtcccctaggctggagtgcagtggcacaatctcagctctcttcaactgccacctcccagactcaagcaatcctcccacttcagcctcccaaatagctaggaccacaggtgcaagcaccacaccctgttaattttttgtattttttggtagagatagtatttcaccatgttgtccaggctagtctcgaactcctgggctcaagtgatctggccaggagcgctgggattacaggcctcaacctcctaaagtgctgggattacaggtgtgagctgccacacccagccacaatactgtttctcaatttgttcttaatacattttacatttgaaagttttaaagttaattgtatattatgtcatatataccaacataaattaatatttatgacaacttcaaattatttttgtaactattggaaatttctggaaaaccatttaatctaaatgttgatattttgagggaaatagtcgtaacagtgtcccaaaaactttgctcaaatagtatgattaaactattaaattgtgattatactattaaactgtaattaaacttccaacaccttcagtatgatggaaagagcatattcctgagaatctagaggagctaacactgtaacaatgggtatatcacaatcttcctatagatgtttccttcagcagccaaatgaaagatttcagctagatcatttgagaccccttttttacactgtatttctgtggctgtacacaaatttgcttcaaaaagtctccaaaagattaaataatccagtgtgcactattttacatagagccgtaggtaagcaggcacagtatgttctttactttgtgatgtttcccctcctcacagatggcagaattagaggatggtccagaataatgactaataaccatctggaaatgacggtggctaataaccagctggaaaagatgagctaagccaatcaaagtctactccgggaaatttaaaccaaaagacccagagttaccagaaagagtggagctgaaaagtcatgcatattcagaaataaggcaactattaagaatcatgtgcaacttgaagaggaactcacaagtttcagaagcaaatagatcagatgcccaaagacaagaaagacctgtaagaaaacaatgcataaaatccctaaaacaaagcagttgatactaccagctttctatttccaattactctgaagtccaattgctcttccttgatggtttattgtgtatcttaaaataaaccttgctcttacttcagtacatttgcctcttgccctgactagaagcaaaactggtacaaagattagggatatacagagcagggcttcaaagaaaatgtggatttggccatgaaattagggtaaggagtacaatgagaattctgggaggaaagagagcaaaacaggatgcatacagtgatagcagttactaaagttatctgtgattgcttggaacccagaatatgtgattgcaaggcttttgagcattagatagctaaatgtactttttttcagcctttaataaagtatagaaaaagcaatgagctagagtatggtacagcatcaaaccatacaacttttctggaaaataattcgatattatgaattaagagactataaagagaattaaatagagtactttgattcagtaaatctctttttaggactcgaccctaagaaaacatccagacatgcaaacaaagatcacaattagtattaagatgtttattgcaccattatgtaaagcaataaaaaagcaaacaatctaaacaacacataatagaaaaattatgctttatcatgtcaaatgtattgttcatcttattcacaggcctttctagagaaaagtgccccatctacagtccttctgaaagagcagccctggcagaccacgtgatcaacagtataaaactgactggatctggcgttgacacttgattccaaagaccaagaatttaataccaaaagccataggctagccagcaagctatgatgtggtctggcttaaaagagtgaactgggtcagattctacttcctagatattcaactagtaaaatcaagaaatgtagcaggtattaacaggcactaaagccaaaatggctttatgtacacagaggccagggaagtcactgtgattctcatgtaagccagttttaatagacccaacacaaaaagaggaacagacactgtaagagaccacatagcccactagaaagagtaagcagtccacagaaatgagtccctgataactgaggctcagctgtactacaacttgtgttacaagactcttggaagatttgtctactattctcttttctatatccttacaataaatttcccattactaaggtaatctgccttgactagttccattttaattttttttttttaagagatggggtctcaatatgttagttggactcaaactcctaggctcaggtgatcctcccacctcagcctcccaagtagctgaaactacaggcatgccactgcacccaacttccattttaactctttattcaacaactattcataatacgataactgctaagcattaagtcaacaaatgtctgttgagcagttactctagaccaggcacacagggcataatgtggtagaaaatacacacaggatcctgccacatgtgcttatattttgctaggacaggaggagagagagagaagtggacagtaagtttttgtttgtatttttttaatttgtaaaggcttgagattctcattaaaaatagcagacaaggggggtggagccaagatggccgaataggaacagctccagtctacagctcccagagtgagcgacgcagaagatgggtgatttctgcatttccaactgaggtaccgggttcatctcactggggagtgtcggaaagtggatgcaggacagtggatgcagtgcaccgaacgtgaaccgaagcagggcgaggcatcgcctcacccaggaagcgcaaggggtcagggaattccctttcctagtcaaagaaagcggtgacagacggcacctggaaaatcgggtcactcccaccctaatactgtgcttttgcaatggtcttagcaaacagcacaccaggagattatatcccgcgcctggctcggagggtcctacgcccacagagcctcgctcattgctagcacagcagtctgagatcaaactgcaaggtggcagtgcggctgggggaggggcgcccaccattgcccagccttgagtaggtaaacaaagcggtgggaagctccaactgggtggagcccacctcagttcaaggaggcctgcctgcctctgtagactccacctgtgggggcagggcacagctaaacaaaaggcagcagaaccctctgcagacttaaatgtccgtctgacagccttgaagagagcagtggttctcccagcactcagctggacatctgagaacggacagactgcctcctcaagtgggtccctgacccccgagtagcctaactgggaggcaccccccagtaggggcagactgacaccgcacatggccgggtactcctctgagacaaaacttccagaggaacgatccgctgttcaccaatatccgctgttctgcagcctcagctgctgatacccaggcaaacagggtctggagtggacctccagcaaactccaacagacctgcagctgagggtcctgactcttagaaggaaaactagcaaacagaaaggacatccacaccaaaaccccatctgtacgtcaccatcatcaaagaccaaaggtagataaaaccacaaagatggggaaaaaacagagcagaaaaactggaaactctaaaaatcagagcgcctctcctcctccaaaggaaagcagctcctcatcagcaacggaacaaagctggacggagaatgactttgacgagctgagagaagaaggcttcagacgatcaaactactccgagctaaaggagaacgttcgaacccatggcaaagaagttaaaaaccttgaaaaaaaaaatagacgaatggctaactagaataaccaatgcagagaagtccttaaaggacctgatggagctaaaaaccaaggcacaggaactacatgacgaatgcacaagcctcagtcgctgattcgatcaactggaagaaagggtatcagtgatggaagatgaaatgaatgaaatgaagcaagaagagaagttaagagaaaaaagaataaaaagaaacgaacaaagcctccaagaaatatgggactatgtgaaaagaccaaatctacgtctcattggtgtacctgaaagtgacagggacaatggaaccaagttggaaaacactctacaggatattatccaggagaacttccccaatccagcaaggcaggccaacattcaaattcaggaaatacagagaacgccacaaagatactccttgacaagagcaactccaagacacataattgtctgattaaccaaagttgaaatgaaggaaaaaatgttaagcgcagccagagagaaaggtccacccacaaatggaagcccatcagactaacagctgatctctcggcataaactctacaagagccagaagagagtgggggccaatattcaacattcttaaagaaaagaattttcacccagaatttcatatccagccaaactaagcttcataagtgaaggagaaataaaatcctttatagacaagcaaatgctgagagattttgtcactgccaggcctgccctaaaagagctcctgaaggaagcactaaacatggaaaggaacaaccagtaccagccactgtaaaaacatgccaaattgtaaagaccatcgaggctaagaagacattgcatcaactaatgagcaaaataaccagctaacatcataatgacaggatcaaattcacacctgacaatattaaccttaaatgtaaatgggctaaatgctccaattaaaagacacagactggcaaattggataaagagtcaagacccatcagtgtgctgtattcaggaaacccatctcacgtgcagagacacacatacgctcaaaacaaagggatggaggaagatctaccaagcaaatagaaaacaaaaaaaggcaggggttgcaatcctagtctctgataaaacagactttaaaccaacaaagatcaaaagagacaaagaaggccattacataatggtaaagggctgaattcaacaagaagagctaactatcctaaatatatatgcacctaatacaggaacacccagattcataaagcaagtctttagagacctagaaagagacttagactcccacacaataataatgggagactttaacaccccactgtcaacattagacagatcaacgagacagaaggttaacaaggatatccaggaattcaactcagctctgcaccaagcagacctaatagacatctacagaactctccaccccaaatcaacagaatatacattcttctcagcacaacaccgcacttattccaaaattgaccacatagttggaagtaaagcactcctcagcaaatggaaaagaacagaaattataacaaactgtctctcagaccacagtgcaatcaaactagaactcaggattaagaaactcactcaaaaccgctcaactacatggaaactcaacaacctgctcctgaatgactactgggtaaataacgaaatgaaggcagaaataaagatgttctttgaaaccaatgagaacaaagacatgacataccagaatctctgggacacattcaaagcagtgtgtagagggaaatttatagcactaaatgcccacaagagaaagcaggaaagatctaaaactgacaccctaacatcacaattaaaagaactagagaagcaagagcaaacacagtcaaaagctagcagaaggcaagaaataactaagatcagagcagaactgaaggaaatagagacacaaaaaacccttcaaaaaaatcaatgaatccagaagctggttttttgaaaagatcaacaaaattgatagaccactagcaagactaataaagaagaaaagagaagaatcaaatagatgcaacaaaaaatgataaaggggatatcaccactgatcccacagaaatacaaactaccatcagagaatactataaacacctctacacaaataaactagaaaatctagaagaaatggataaattcctcgacacatacaccctccaaagactaaaccaggaagaagttgaatctctgaacagaccaataacaggctctgaaattgaggcaataattaatagcttaccaaccaaaaaaatccaggaccagatggattcacagccaaattctaccagaggtacaaggaggagctggtaccattcctcctgaaactattccaatcaaaagaaaaagagggaatcctccctaactcattttatgaggccagcatcatcctgataccaaagcctggcagagacacaacaaaaaaagagaattttagaccaatatccctgatgaacattgatgcaaaaatcctcaataaaatactggcaaaccaaatccagcagcacatcaagaagcttatccaccatgatcaagtgggcttcatccctgggatgcaaggctggttcaacatacgcaaatcaataaatgtaatccagcatataaacagaaccaaagacaaaaaccgtatgattatctcaagagacgcagaaaaggcctttgacaaaattcaacaaccttcatgctaaaaactctcaataaattaggtattgatgggttgtatgtcaaaataataagagctatctatgacggtctgtcatatcacagccaatatcatagtgaatgggcaaaaactggaagcattccctttgaaaactggcacaagacagggatgtcctctctcaccactcctattcaatatagtgttggaagttctggccagggcaatcaggcaggagaaggaaataaagggtattcaattaggaaaagaggaagtcaaattgtccctgtttgcagatgacatgattgtatatccagaaaaccccatcatctcagcccaaaatctccttaagctgataggcaacttcagcaaagtctcaggatacaaaatcaatgtgcaaaaatcacaagcattcttatataccaataacagacaaacagagagccaaatcatgagtgaactcccactcacaattgcttcaaagagaataaaatatctaggaattcatcttacaaaggacatgaaggacctcttcaaggagaactacaaaccactgctcaatgaaataaaagaggatacaaataaatggaagaacattccatgttcatgggtaggaagaatcaatatcgtgaaaatggccatactgcccaaggtaatttatagattcaatgccatccatcaagctaccaatgactttcttcacagaattggaaaaaactactttaaagttcatatggaaccaaaacagagcctgcattgccaagtcaatcctaagccaaaagaacaaagctggaggcatcacgccacctgacttcaaactatactacaaggctacagtaaccaaaacagtatggtactggtaccaaaacagagatatagatcaatggaacagaacagagccctcagaaataatgccacatatctacaaccatctgatctttgacaaacctgacaaaagcaagaaacggggaaaggatttcttatttaataaatggtgctgggaaaactggctagccataggtagaaagctgaaactggatcccttccttacaccttatacaaaaattaattcaagatggattaaagacttaaatgttagacctaaaaccataaaaaccctagaagaaaacctaggcaataacattcaggacataggcatgggcaaggacttcatgtctaaaacaccaaaagcagtggcaacaaaagccaaaattgacaaaagggatctaattaaactaaagagcttctgcacagcaaaagaaactaccatcagagtgaacaggcaacctacagaatgggagaaaattttcgcaaactactcatctgacaaagggctaatatccagaatctacaatgaactcaaacaaatctacaagaaaaaaacaaacagccccatcaaaaagtgggcgaaggatatgaacagacacttctcaaaagaagacatttatgcagccaaaagacacatgaaaaaatgctcatcatcactggtcatcagagaaatgcagatcaaaaccacaatgagataccatctcacaccagttagaatggcgatcattaaaaagtcaggaaacaacaggtgctggagaggatgtggagaaataggaacacttttacactgctggtgggactgtaaactagttcgaccattgtggaagtcagtgtggcaattcctcagggatcttgaactagaaataccatttgacccagcaatcccattactgggtatatacccaaaggattataaatcatgctgctataaagacacatgcacacatatgtttactgcggcactgttcacaatagcaaagacttggaaccaacccaaatgtccaacaatgatagactggattaagaaaatgtggcacatatacaccatggaatgctatgcagccataaaaaatgatgagttcatgtcctttgtaggaacatggatgaagctggaaaccatcattctcagctaactatcgcaaagacaaaaaaccaaacaccgcatgttctcactcataggtgggaactgaacaataagaacacatggacacaggaaggggaacatcacacaccggggcctgttgtgaggtgggaggaggggggtgggatagcattaggagatatacctaatgttaaatgacaagttgatgggtgcagcacaccaacatggcacatgtatacatatgtaactaacctgcacgttgtgcacatgtaccctaaaacttaaagtataataataataataaaaaagcagacaaacatgcacctacataatccctcataaaacctcacaaaacccactaagacaatgttttaaattcagaggtgtacctaaaacatcctccacaaagaataaattaaagtgagtacatgtgtaaccaccacccaagaagagaagagtatttccagcaactcaaaagattatctgtcccttccaaattacacttctccgtctcaagcaaaagtagccactaccctttttgggaaatcacccccttatttttctttgtagtttttcaacctctgtatgcatgcctaaacaatatggtttagttttgcctcccctctgaactttatgtaaatggaatcatactgtatgcttttgtgtctctttctctgaacattaggtcagaagtttatcctggtgtatgtaactgtgattcactcactttcatttcttattaatattccctggtatgtaccacaatttatccactctaatgttgatggacattttgcctattacatacaatgctgctatgaacattcttgtagggaaatctcgcatacgtgcatgcatttctctagaatatacacacaaaagaggaactgatggatcacaggttaggcgtatcttaaattttggcattaatgctaaattgttttccaaaatagttgtaccaatttatactgtcactagcagtgcatgagaattcccatcactggacatccttgccatcaccagatacatgtgagagtaagtaattttgtgcaaatctgttaggtatataatagaatctcctgatttcaatctgtctttttgtgattattaatgagctatggctccttttcaaatatttaccggtcatttagattttctcttgtgacgcacctgttcaaatatttcatccgttattgttatcattttcttatttgtagatattgttatattctggatactagtcctttgtcaaatatagatgttgcaattcttttctccaactccacaacttgcatttcacttttaatgctatctttgaggaagttcctaattttaaagtagtccaatctatcattaatctccttttatgatacagtacttcctttacttttagttttttattttgacataatttcaggcttacaaaaagttgtaaatttatacagttatacaaagttataaaaagttcctgtataccacattccccaaatgttaatattttacatctgctttacccttgtctctgtatacatacatatatttttttctggaccatttgaaagttgcaggcatgattcctttttattccttaatactttaatgtttccccttaaaaatgtcttatatgaccacagtacaattatcaagatcgggcaatggatactgataaaatactattatctatagagcttagatttcttgaactgctgcaatagtgtcctttatagtaaaagaaaattccagattaagtgtttagctatgtctttttagactcctttaatctggaataattcttcactctttctttgtctttcatggcattaacacttttgaagaacacagatcagttattttatagaatatcttaaaatgcaggtttctctgatgtttcctctcaattagatttaggttatgggtttggggcaggaataccacagaaatgtagcaatgttcttattgcattttatcaggtggcacttctgttaatttgccccatctctgatgatgtttactttggacagcaaatgcagatagtatcttccaggtttctcctctatgttgtttttcctttataattaataagtatactgtgggaatatattttgagattatgtaaatatcctgttccttactaaactttcatccattagttttagtactactatgatggctgccaaatggcaattttctaattccatcgttgcatcatttgtcagtttccctctgtaaagaagagcgttccttatttgtgtacttatttatatcagtaaaaattcatggatttttatcttattcaaagggttataatccactatcatttattttcatacccagattgtcccagatttggccagtggaagacctttaagctagctccagtgtcattatgacatgctatgaccattctttgagcaattccttactttctggcacaagaaattccagattcatctcatttttcatgctccagcctaaaatcagctattcctccaagaaatagtggttccttttagtggacaaaggtatttagaaaccaagatctagatgccagttgtgttcactgctacaggggtatcactgcttctaggcctctcagctgacagttaggaaaacaaatgtgtgtgtatgtttatgtatgtatctatagacagacacacacatatctattttcaactgtccactgaaagggcttaggatcaaagacacaccaatacaaacatccgtatcatatctacatatctctatacctatacatcactgctctatgtctgtttaaatatacacaaatatatgcatgtatacatacacacattattcatataaacatgtaatatattcatatgtgtatagacacatacacatctatgaggtcacactaatgcctctaatgcaattatattgacaaggttcattctggccttcccactttctctttttttgagatggagtctcgctttgtcacccaggctggagtgcagtggtgccatcttggctcactgcaaccttcacctcccacgttcaagcgattcttctgcctcagcctcccaagtagctgggattacaggcacgtgccaacatgcccagctaattttttgtatttttagtagagacagggtttcactgtgttagccaggatggtctcaatctcctgacctcgtgatctgcccgcctcagcctcccaaagtgctgggattacaggtgtgacccattgcacccggctgccttcccactttctacacttgtaactctcttcttcaataatgagaaacctggctcacaatatccaaaatatttctatctgcaattgtggtttatttgtgtagtgaattcctataattttaggttgccttggcattcgtttcaagtataagtctgactttctcattcaagaatcagggctcagtcacccttgacacagtttttagttctccatttcctcccaggtcctcaatgtggtcaatcaagatacctgccttttacaaccacctcctggttatcacctccttttaggagagctaggtagaatctacctgactcaccctaatgaccccaaaccctgcacagatatgcctcagtgaccacctcttagtcacagcatgactcatgcctgcttgctccaacctacaaattagaactcctcataggaaacttgcttggttaagaacaccctggaccccagtaaaggctttagttccctaggtcctttctctttcatcccatccactggttgcacttgcgtgtcctaggtggcacccctcttcctgttgaccttgcaaggtgtgctactttctcttctctctaaaatctgaaattaaaactgcttgttatttcatgcgttttgttttaccatctcctctgtagctcacctgaccaacacacctgaacctaattctccgcttggtcagggttctcctagagcgtggctgtcttggtcaaataaactggacacggataggacaagaaccacaagggtatctgccagtataagtttcctgtgagaagaacacctggccataggtctgacatttaagcattaggacatctaccaagataaaaaactatctcatgaaagacagactgtaaacatccatgaccatctcatatggtcatatcccagctccacaataatccctggagccccatcaggacagacatacagttaacagccactctccagagagtttacagacactctcaagaaagatcaaattagaggaaaataaaacaatttggccaggcatggtggcttatgcctgtaatcccagcactttgggagaccgaggcgggcggatcacaaggtcaggatattgagaccaccctggctaacgtggtgaaaccccatctctactaaaaatacaaaaaattagccgggcgtggtggcaggcgcctgtagtcccagctactcgggaggctgaggcaggagaatggcgtgaacctgggaggcggagcttgcagtgagccgagattgcaccactgcattccagcctgggtgacaaagcaagactccatctcaaaaaaaaaaaaaaaaatttgatgttttaagaaatcttttgcaacctcaaggttagcaatacattttcctctacatgtattcctctgaattctcccttctaaaatatgtattgttctgtcttgcacatctctaatctacttggagttaatttttatgtatggggtgagatagggaccaagtcttccttctttcctatgtagataacaagatgtcccagcaccactgattgaaaagatcaaccatcctgttactctaccatgccaattgtgatataaatcaaacatcaacaaatgtgtgggtctctttctggtgctgattttggtgtatttgtcctcagactgccatctcactatcttaatgactacaacttttataagtcttgagctggtagaagtcttctttattgctcttcaatattgccttatctattcttggcactatctagctccataaaattttagcatcattctatcaaattccacaaaattctcttaaaattttgattgggaatgcatcaaagatacataaataagcttggaaatggttgatatttttacagtagtgaatcttccagtccatgaacatagtatttatctcctttaagtctctcaataaagtttattaattttgcttataggagttttacacatatatcattagatttgttgctaggtcctttttgatggtatgaaaaatgacatcatagctccagttccaagtaaaataaagtaaccacagtgatgtctctcccacttgatgcagccataaaacataaacagaaagcacagaacagctatttgaggactcttaataaggtgaattatagcagataaatgcggtaagaagaatggagtttgaagttcactattctagcagagtttcccattttactgaactaagttaggcctggactgtcaggcctaaaccaagcagcaaaaacagagagctccaggagaagccatttacttttggctcaaggaatgggaaaggagactcttaatgttcacagaaagggaggaaaaattctccctttatcttttttttcccttttctctattttctgatatcacagcccccaaataattccacagttctactctgaggtgccatgaccccaagagagtagagtggatccacgttgctctttttctttctctacaggtactttggcactgaatatagacaggtacagtcacaggaagtgactggttttccagccagaaaaccagaaagtaccaggaaagtcacagaaagaggagtctggaaaggcaactcaacaaacttgcttgtaaactcccgggctcatccccaggctgtgcaagcataatcttaagcttaaacagcagagcaaagaccttgagaccactgcccaggttccatactggccactcagtggcacatcacaggatagagtatattcagctagcactgcaaaggctttgaaaatggaacttacatggaaactacaatatacagaaggttggtcaaacctttccatctcaacccagccagctctaattcctgctaaaacaaaaatatcaacattctccataggatttacaaaaggcccagagtcgcataacgtaatatttttaaatgtccaggcataatccaaaattactcatataaagaactaagaaaatctcaacttgcaagagaagagacaacaagacacagatgttgaaatcaactgacaaagatgttaaaatggctagtagaaaaatgtttaaagaagtgtgggcactccccaaatcaataacataggtttccatcttaatcaattagaaaaagaagagtaaaacaattccaaatcacatagaaggcaggaaacaataaaaaagcagatatcaatgatattaacagaaaaccaagagtgaatatgaatgaaatcaaaagagcaatataacataaaaacttcagcaagataggcaaagagaaaagacacaaattaccaatatcaagaataaaagaggggtatcagtactaaccctgcacacattaaaagtataataacgaaatgccacaaacaactctatacgcaaacctataaaaatgaaacagatgaaaaagaccaattcctctaaaaccaaaaacagtaaaaacacacccaagctgaaacatattactaggatagtcctttaactattaaataaattaaacgtatagttaaaacccttctgaaaaagaaaactccaggcccagattgtttcacttataaattctactaacatttaaaaaagaaataacacctattctacataatcctgagagaaagtagaaaaggacaaaatacggccgggcgcagtgactcacgcctgtaatcccagcactttgggaggcccaggcaggcagatcacgaggtcaggagatcgacaccatactagctaacatggcgaaaccccatctctactaaaaaacaaaaaaaaattagccgggcgtggtggcaggcaccagtagtcccagctagtcacgaggctgaggcaggagaatggcgcgaacccgggaggcggagcttgcagtgagctgagattgcaccactgcactccagcctgggtgacacagtgagactccgtctgaaaaaaaaaaagaaaaggacaaaatacttccaaactcatgaagctagtattacaatgataccaaaaccagacaaaaacagtacaggagaaaaaacataataaaaaatattcttaatgaacacagatgcaaacacactcaataaaatattagcaaatcaaatccagccacaaataaaaacaataatataccataacgaagtggggcttatactggtactacaagactgattcaattttcaaaactcaatcacggcaatccacacattaataatttaaagaaaaaatatataaccatattaatgcatacagaaaaagcacttgacaatactcaagattcctttatgataataactttcagcaaacaaggaataaaaaagaatcttctcagccttataaagggcatctataaaaaaaaaacctagtactgcaataaggaaaaaaaaaaaaagaacacatacattggaaaagaagaattcaaactgtctaatttgcagctagtgtggatatctacactgaaaatcccaagagatttacaaaaaaaaaaaagaagcctagtgctaataaggtcacaggatacaaaatcagaatttctgtgcagccatgaacaactggaaacaattggaaaataaaatgtttaaaaagataccattttaacataggtctgaaaaattaaatacttctaacaaaacatgtatcagatctatatgcataaacactgatgaaaaatcaaagaagatctaaataaatatagacatatgttcataattggaagactcaaagatgtcacttctccacaaattgatctacagatttaaaagaaaggcaatcaagttcattcccagtaggattttttttgtagctatggacaaactgatcctaaaatttaaatggaaaggtaaaggaactagaataactaaaacaattgtaaaaaaagagaataaagttcaaagaatcacactactcaattataagacttaccataaagtcaataatcaagacagtggtattgtggcaaaaggatagagacatagatcagtgcaacagaatacagattccagaaatagacccacaaaaatatagccaattgattttttacaaaggtacaaaggcaattcaatggagaaagggcagcttttcaacaaatggtgttggaacaactggatgttcatatatcaaaaaaaaaatctaatctgatattttacacaaaaattaactcaaaatgaatcataggatctaaatttaaaacacaaaaagcttcatgaaatatacaaaaaacatcttagcatgataccaaaactcgacaaaaacagtacaacgggggaaaaaaacatataaatatatgtattttttttaaacagcgtctcactctgtcactcaggctagagtgcagtagcatcatctcagctcactgccacctctacctcttgggttcaagtgattctagtgcctcaacctcccaagtggctgggactacaggcgtgtgccaccatgcctggctaatttttgtatttttagtagagacagggtttcaccgtgttggccaggctggtctcgaactcctgacttcaagtgatctgcctgctttggccttccaaactgctgggattataggtgtgagctacccggcccagcccatacagattaatattctttttttttttttttttttttttttttttttttttttgagacggagtctcgctctgtcgcccaggccggactgcggactgcagtggcgcaatctcggctcactgcaagctccgcttcccgggttcacgccattctcccgcctcagcctccccagtagctgggactacaggcgcccgccaccgcgcccggctaatattttgtatttttagtagagacggggtttcaccttgttagccaggatggtctcgatctcctgacctcatgatccacccgcctcggcctcccaaagtgctgggattacaggcgtgagccaccgcgcccggccccagattaatattcttaatgaacatagatgtaaaaacactcaaagagctaaaaaaataaaaaatactgtgaggaattagtgggccaaaatctaagagaaaaggagaacataaggctgtgctcagcactgaatgccaatttgtcctaacagcatttgctaatctaaaagagtgagggtaaaactgagctgcattttgatggtctcttggatctagaggaacaaaaatgaaagtgctccatctgacaaaagatgggactccaataaactacccaacactttaaactgaaatcttgaagattaatccacataacattagagacctagaattaaaccaacacacttatagagattttgtatgtgtgtgtgtgggggtgtggatgtgagatgggagttttgttcttgtcgcccaggctggagtgcagtggcgcgatctcagctcactgcaacctctgcctcccgggttcaagcaattcttctgcctcagcctcccgagtagctgggacgacgctatgcccagctaatttcgtatttttagtagagacagggtttcaccagttgaccaggctggtctcgaactcctgacctcaggttatccacgcaccacagcctcccaaagtgctgggattacaggcatgagccatggcgcccggccacttgtagagattcgcatctgtctttgcatcatttagatggtttagaaaatttcaagccttgcgcttgaattaatgtcttccctaaacagtaaaatccccaagacatgtcacctaattaaattaaaattcccttttgggtaagataccaccatcttgggccttaggttattcctaaaagtcttttttcaaatacacaaagtcaacaatatctatcacacaaggaaaaaagacctcatgaaagaaccagtgtaacaaccaaaactaagaacttacggatggctttaacagcaaattagacatggctgaatataggatttgcaaattgattagaaaaaaacatctagaatgttgcacaaaaggataaaaagatagaaaacatggggccgggcaaggtggctcaggcctgtaatcccagcactttcggaggccaaggtgggcagatcacctgaggtcagagttcgagaccagcctagccaacatggcgaaaccctgtccctactaaaaatttaaaaattagctaggcatggtgatggatgcctgtaatcccagctactcgggaggctgaggcaggagaatcgcttgaacctgggaggtggaacttgcagtaagctgagattgctccactgcactccagagcctgggtgacagagtgagactctgcccccaccaaaaaaaaaaaggccgggcgcggtggctcacgtctgtaatcccagcactttgggaggccgaggcaggcggatcacaaggtcaggaaatcaagaccatcctggctaacacagtgaaaccccgtctctactaaaaatacaaaaaattagccaggcacggtggcaggtgcctgtagtcccagctactcgggaggctgaggcagaagaatggctcgaacccgggaggcagagcttgcagtgagccgagaccgcaccattgcactccagcctgagcgacagagcgagactccgtctcaaaaaaagaaaaaagaaaaaaaaagatagaaaacatggcaaaaggtattagtcacagaaataaagtcagaaagtctgaaacatatttatttgttttataaggtcaatcagggcagaggcaatatttgaagaaacagctgaaatttttcaataaatgatgaaagatattaatttacagatttgaaaactcccaagcagattttttaaatgtatacatagaccaaacacagcaaaacttcagaaacacaaaggaaaaaaatctcaaaggcaactaagagaaaaaaatatataactttcaaagaaccaacagtaaattagcagtttacgtctcaacagaaacagtagagaccagaagactataatcctcaaggtgctgaaagaaaacactgccatgctctacctacctgtctacctgctaaaagacagcaaaacggcctttcaagaatgaaacaaaataggctgggctcacacctgtaatcccagcacttttggaggctgaggtgggcagactgcttgaggtcaggagttcaagaccagcctggccaacatggtgaaacccttctctcctaaaaatacaaaaattagccagatgtggtggtgcgcacctgtaatcccagctacttgggaggctgaggcaggagaaccacgtgaacctgggaggcggaggttgcagtgagccaagatcacaccactacactccagcctgggcaacagagcaagactcagtctcaaaaaaaaaagaatgaaacaaaataaaaacagaactacaattcaacccagcaatcccattattgggtatatggccaaaggaatataaatcgttataccatgaagacgcatgcatgcgtatgtccactgcagcactattcacaattgcaaagacagggaatcaacctagatgcccatcaataatagactggataaagaaaatgtggtacacatatgccacagaatactatgcagccaaaaaaatgagatcatgtcctttgcaagaacatgtatgtagttggaggccattatcctaagtaaactaaggcagaaacagaaaaccaaataccacatattctcatttataagtggaagctaaacactgagtacacatggacacaaagaagggaacaatagatgccacagcatacttaagagtggaaggaaggaagagggagaggatcaaaaaactacctatcgggaactatacttattacctgggtgacaaaataatctgtacaccaaaccaagcaacacacaacttacctgtataataaacctgcacatgtacccctgaaactaaaagtttaaaaaagaatgaaaaaaaaaggcttttttagacaaacaaaagacaacattacaacactaacagattgataccaaggaaattctaatggagattctccaggaagaaggaaaatgatctcaaatggaatgtaagagaggaaggaagaaacgaagagcaaagtaacatatgggtaaatctaagtaagcattgactctgtaaaataataatgtcttccagggttataaaaataggcttaccatagaaggatatattataagcaggaagggagttaaaaagcaatacaaaaggttcttgaattgtctacaaagaatgtaaaccctcataaggcttcaataagtgaaataagttaagaatgcatcctgtaatttctagagtaactagcaaaagaatagaaacagaatatggagtcttaggactagagggaaaaaactgaatgaaaaaattcatttcaaaagacacaagaaaggagaaaaaggagcaaagaacaaaaggaacaaataaaaagcacatagtaagattgtgaatttaaacacaaacatgccagtaattacattaagtataaatgaagtgaaagttctagtgaacacagaaattgtcaggctgtatttttaaaaatccaactatgttttacagtcatgtgccacgtaacattctacaacggacccggtctacaatggaccacacataaactatgatggtggtcccataagattataatgccatattttcactgtaccttttctacatttagatatgtttagatacacaaataccaatgcagtacaactgggtacattattcagtacagtaacaggctatatagctttgtagcctgggagcaacaggctataccatatagcctagatatgttctaggctatactatctacgtttgtggccgggtgtggtggctcacgcctgtaatccctgcactttgggaggccaaggaggatggatcacctgaggtcaggagtttgagaccagcctggccaacatggtgaaaccccacctctactaaaaatacaaaaattagccaggcatggtggtacatgcctgtaattccagctatttgggaggttgaggcaggaaaatcacttaaacccgggagaacggaggttgcagtgagcagagattgcgccattgcactccagcctgggcaacaagagtgaaagtcagtcttaaaaaaaaaaaaaaaaactatctaggtttgtgtaagtacactttatgatgtttgcacgacgatgaaattgcctagcaatatattgaatgcatcttcattgttaatcaatgcatcactgtatttggaagaacgatctgaaacgtaactatgcagaaaagttgaagtaaaaagataagactgtacaaatgccaaccaaagaaagctaataaaactatattaatgccagagaaagtacactgcagaagcactgttagaaatcaaaaagggttacttcctaatgatcaacagatcaattcaccaagaagatataataattttaaacttgtaagcacaaataaataaaacaaaattaacaaaaccacaagataggaataaatgcatatttatagtagattttaacacatctctcagcaaaatgaataagcagacagaaaagcggtaaagttttaggagatttaaagaacatgattaacaaccttgacctaaaatatataaaattctgtccaacaattgaagaggacacattttctttaagcacatatgaaacacttataaaggccaggcacggtggctcacgcctgtaatcccagaactttgggaggccgaggcgggcagatcatgaggtcaggagatcgagaccatcctggctaacatggtgaaaccccgtctccaataaaaatacaaaaaattagccgggcatggtggccggtgcctgtagtcccagctacttgggaggctaaggcaggagaatggcatgaacccaggagacagagcttgcagtgagccgagatcgcgccactgcactccagcctgggcgacagagcgagactccatctcaaaaaaaaaaaaaaacttataaaaactgaccaactgaaatttcaataaacttaaaaagactagaagtacataccgcatgccacttgcacacaatacagctatgctagaaattagtaagcatatttgtaactttaaaagtctcatatattcagaaatttacttccaaattacttatgagtgcatggttttaaaaacagctttgtagaatgcagagaatgcagatcttggaagaaaacgtacattctaaattcatctattagggagaaagacaaaaatgagctaagcatttagctcaataaggtaggggaaaaacagcacaattaatataatatagaagaaaggaaataataaattaagaaaaacattaataaaatagaaaataagtatataacagagagaagtggtaaagctaaagtgggttctttaaaaaagattaataaagttgataaacctttgctgaagaaaaagggagaggcacaaataaccaatggcagtaatgacaaaagaagcaacagagatgctgcagacctaagaagatattaagaggccgctgtgaacaactttatactcataaatttgaaaatctacacaaaatagaataaattattagcaaaataactacccaaaaatcattcaagaaagaaaattacaggtaaacattctcaaatcagtaataatatgagcttcctccatgaggcctcagtccaatttaccaaaatgttaagtggggttatctctggattgtgccattataaatgattttctctttcttcagcatttttcaaattatctacaagggcatatgttactttttacatcttgcggggtgggagggagaaatgggagctttgtgttccagtcttaattctatcacagtactaactaggtggccttcattaaatcatttaacttctcaaaagtattagtatccccatctatgaaattgagaggtgaagctagctggacttcctgggtcgaatggggacttggagaacttttctgtcttacaagaggattgtaaaatgcaccaatcagcgctctgtaaaacacaccaatcagcaggatcctaaaagtagccaattgcagggaggactgaaaaaggggcattctgatagcacagaaacagaacacaggaggggacaagtaagggaataaaagctggctaccacagccagtagcggcaacccgctcgggtccccttccatgctgtggaagctttgtccttttgctttgcacagtaaaccttgctaccactctttctttgggtccatgccatctttaagagctgtaacattgaccgcgaaggtctgcggctccattcttgaagtcaggaagaccacgaacccactggcaggaaccaattccagacacaaaatgaagatactagactagatttaatttgtaaagcagacttaatttcacgtaccaatttaatatacaagataaatattaatcctactacttttaaaaattgccttgttttctatataccaaccacatagagatagcactatttaatactgccaggaagaatggctatagttcaattattccataatcaaatcgtcacattagtacatgatccccaatttaactaatttatagctaataacaatatcgggggaaattcacccccaatatttcatataggttattttctattttccctaagtgtcggccagtctgggaaataaagggaaagagtacaaaagagaaattttaaagctgggtgtccgggggagacatcacatgtcagcaggttccgtgatgccccccaagccgcaaaaccagcaagtttttattagtgattttcaaaaggggagggagtgtacgaatagggtgtgggtcacagagatcatatgcttcacaaggtaataaaatatcacaagacaaatggaggcagggcaagatctcaggaccgggttgaaattaaaattgctaatgaagtttcgggcatgcattgtcattgaaaacatcttatcaggagacagggtttgagagcagacaaccagtctgaccaatatttattaggtgggaatttcctcatcctaataagcctgggagcactaagggagaccagggcttatttcatcccccatctatgaccgtaaaagacagccagccccaaagcagccattttagaggcctccccttagggacgccttctctttctcagggatgttccttgctgagaaaaagaattcagcgatatttctcctatttgcttttgaaagtagagaaatatggctctgttccacccagcccacaggcagccagactttaaggttatctcccttgttccctgaacattgctgttatcctgttcttttttcaaggtgcccagatttcatattgtttaaacaatttgtgcagttaatgcaatcatcacagggtcctgaggagacattcatcctcagcttacgaagatgacgggattaagagattaaagtaaagacaggcataggaaatcataagagtattgactggggaagtgataaatgtccatgaaatcttcacaatttatgttcagagactgcagtaaagacaggtgtaagaaattatgaaagtattaatttggggaactaataaatgtccatgaaatcttcacaatttatgttcttctgccatagcttcagcctgtccctccgtttagggtccttgacttcctgcaacataacaacatacaccaagtcctcttatacaacagtacacttcaatagctagtttatcctgtatgcacaatgtctaggtgccaaaatattttttgaataaaggataaccagtaagttatacgaattcttctgggaactggaaactttcagttttactttctatatttcaacactgttggaattataacttttttacaatgcagatattatattaattttttaaaccaaaaaaatctgaattctttggggtttttatttgctttttgcttctaatggccaaactgtgcttgtaattatgtctatataaaatttgtccagcataaaattatcacagtcatgtttgaattttccatttgtccacatattagcatattcttaaaatttctttaacagaatcttgcttctatccaagagtactcctttggttgagctgagattaccaccaagtagggtggccacctcaatcatgtctttgctaggctcctcaattttcaattccaggaccagctcagctgattgttaacatgtgttgtggactatattgtgtaaccccaaaattcatagcttgaaactctaactaccaacgtgactgtgtttggaggtaaggcctttcaagaggtaatataaggttaaatgagatcttaagggtggggccctataagactagcgtccctaagaagagaaaaagacaccgcaagtgcatgtacacaaaggaaaagccatatgaggaaataacaagaagggggcaatgtacaagacaaggagaaagtcctccagataaaccaaatctgctgacacatagatcttggacttccaaactccagaactgtgaggaaaaaaaatctgttgtttaagctacccagtctgtattattttgttatggcagccccagcaaattaatacaacatattaaactcctaaagtacagaatctctacactccaggtatttgtcaggctaatctctaattcattatatacttaagtctttcaaaagcaccactgaggaaaatttgagaaccacctgtcaattcctcctgatacattaatatatatccttggagtaaaccagggcagcacagctttacacctatattatatcaaagctctctgccttcatcgtataaaattgatttttctaaatatgacttaatgccactgacctataccaagaagtattataaaaaaatagccttatgaaaagatcactgtttttactatgtgtgtattacactaagtatcctttccatttactaatttattgagtacttttttgtaccaccttctgttttaggtgctaaagaaatagcaatagagggcattgcaggcactcaggtttttattctgagtggaaaaaaaagccacgtgaaagtctggaataaggggctaacaagattttatttgtattttaacaggagcattctagctactatgttgaaaataaactgaaggaggataggctagagtcagaaaaggcaggaagaccatttaagattcaactgccattatccaggggaaaaaaatgatgctgtcttgcaccaaggtggcagcagtagagataagaagtaatcagattctggacgcattttgaaggtataaccattagaatttgctaacattagatacgggacataaatggaagagaaaaggtagattacaaggaaagtaaagaaaagtggagttgctatttattgatttagggaagactggaagaggaaaatgttatgaggtctttgtgatagctattagaccttcaaggaggagatgtcaaagaaacagctgagtatacaaatctggaatcaggctgagaagaagcaattaagcatggtaggagaaaactaagaaggctaaatgaagacagtgtttcaatagagcagaaaaagcatttttatgagagaagggagaaactgctagaatcatgcacttgagtaggaaagagagatgcaaaccgtaaggtacaaatcagggtttgtcacaacttcagtactactgacattttgggcttggtaactcttcattgtggaggactatcccgtgcactgtaggacgttttatctaaatctctggcctctcctcactagttggcagtaccaattccccacctccagtcacagcaatcaaaaatgtctccagacactgccaaatgtctcctggtggacaaaatcacacccaatttagaacctaaatggaggaagtggcctttgctgaaaacattggttattcatccacataaaaggaatgatgggagttattatgggaaaggtacatgatgataatatgattacctcctgctgattagatcctcttaagtgtggatgcagtcaaggccagagatgatatgaagaagttgctagcacaaaaccaaaatcattactcctaagaaaatgtatggaattttgtttttgaactacagctaacggatgagctacatatatctgtgaaatgagtctaagccagaatgtttatgagttttttgtgtccatctatgcttacttgcaaaacacacttacgactttttgagtttctccttagatcacaagaagaaaacactactgatttagtacgaaccaatgggtttctcctaaaatcacaggaagaaaacaacaattatttagtatgaattaaattaaatgttattactcccaaggctcagtttttagaagacagtggacctaaaggaacatctctccaatgataatccatctaagagggtattatttattcccctaaaatcactcccaccaaattaccatgtatattatttagaggggcctaactctgttttctgtatctgaaagagataaatgataaccattacattttttaggtgttcaggactaggggtagatagcattaaaggaagcctcaggaatcatgaaatgagaggatttgagagtaaaacttgcaggcaaacgaaaaaaaaagaaatttaagaaaacaaaaacccacacacacaaaaataagaagtgcaggcaactggtttcatatttacatcaaattccaggattacatgagctatctttaagagagagtgaatatagtcatgtcacctttgttaagatgtacttgtccctcaataccaagttacatcatggatcagggtttcagagcactaacataatgcaaaaggattctacaaactcgaaaggactgaaaaccctaaaacttctactgaaatatttggcttccaaatttgttttaaaaaattactgacaaatggccgggtgcagtggctcatgcctataatcccaataccttgggaggctgaggcaggaggatcacttgaggtcaagagttcaagccagcctggccaacatcgtgaaatcctgtctctactaaaaatacaaaaattagcctggcatggtggcacgcacctgtaattccagctactcaggaggctgaggcaggagaatcgcttgaacctaggagatggaggttgtggtgagcagaggttgcaccactgcactccagcctgggtgacagagtgagactccatctaaaaaaaaaaaaaaaaaaaaaaaaactgacaagctagagaagtctgactaaatctgaattttagatattctatattatatcccattttaagtactgccttggtttcacagaaggaaattaaattggtcaggcatgacttgtttttctactgtgccattatggttgtcacccaacatcctgtgctctttcagataattaaatactgagactctgatttgttctaaaaatttaccaagatccaagttaagataatctgattataatttctaaagtaatattttaaatagcccaaatcctaagaacagaaactaaaataaaggcattgcacgggaaaaggaaagctgcgaaaggagaacctaaacaccatcacactggtcccatctcccacccaatactgtactatgacagtcgcaggcaactatcatctgccaggtgccaaggaccaaaacctaatcaagaggcttctcctcagctgtaagcccaaagactcattcctagacccactacttcataaatgctctgaatggcctatctactgagccagaaaggaggtcagactccccgactgtgaggtctgatcaaatcttgtaaatacaagtgagatctgatcaagtcttgtaaatacaagtgagaagcaatatacgataaagactccagacctacaacttcaacacaaccactttatgtttctagtccattttctcttttgacccctgaaaatctctagagaagtccatataattttcattcgtggtctaaatacttaaagaatatctttaagaacttcttttacagatcaaagacctaaacatgtttaagtgatttcaccaacaccatacaagtagttggtctctgacctcccatttttggggaagacattattcagaaccttaccagagtttctgagtagttgctaggagtcttcttgctacaagcaagaaggctaattaacaatctacgcagggacataagaacttataaaccctatattcacttactggttgacactaagcccaagcccacaaggttttaaatgtatccgtttaaacaaacaagaagctacactccaagaacaaaaaggccaatttctcttagaaaacaagtccattctaaattcttgacttctgtctttcactttcctctcagcacaggttaacacattaataaccagccagtacagaagcatgtttctaaccaaccccttgattcccctggccaaaagttctcttagtcttcctgaattcccacttaaatgctggtaatattgcacagctggcctactgtggttaggtatgtgtcttttactctcgtattagactaccaggttcctacacttcttcaataaactccctgaaatcaagactatgtcttgtaattctttttttttttttttaatacccacaaagcttagcacacctatgtgttcaacatttgctaaatgtataaactggttgatcattttcaaggtttggtgttaccataactctaggactgaaattttattctacaatagagttaagacatatctaaatgccataaaagaggttatacaacattattttctaatttttaaatgaatggttttccatttatttccaaccttttgttggtattttaatttaaaaaaaaaattgaatgtcagaataccaggtacgttttcctgaaaagctacaggtaatgtttgcatattatattttttcaacattctaagagtgtctgttatttaatgaagaagtcctgtgattaaaaagtaacttttgcaaagaaaacagtcactcaataatttatccttcgtattatgccattcctttgcttctgttgttcttatctttccaaaccttactcttccataaaacctcttcttgttttcccaactacaatctcttccatctgccttatgttataattatataaatcattttaatctctgccagtatattataaattccctaagagtgcaaatgacttactaatttttgtaaactttgatcaatgtgttgaaatcatgtcacactggaataatagtaactgcccctatacatctcaaaatagtctgcaagccttaaggccaaatgaatttttaatttaaaaaatcatcacgtatgatcattatttcaattaatattttaatatgtgcagtaaagtttaaaaaatagccaaggactatctttcagaaaagtaataacataaataatgagaaatttacaatatctgttgcataaaccctcaaaacattcactgaagggtagtaagaaatgtcttaaaggcaaaataaagtataataaagctcatacacgggagaagatcatctctttgaactaccagagatttgacttattgcaggataacatttcgaaaacctagatcttacactgaaaagaacaaaattgttcaaaaggtgatgttttaaaatgtgatatctacagctacatttacgaaatcacaatcgaatgtttaaggaaacagctgtatactgcctaaacacaagtgaaaagcatcatagcttacgtgataccactaaaaccacagacatcagctgagattgtccactacagactgcagtaccatgtcaatattgcacaaattgggacatcacgacatcaagtagtcattcacagccaaccaatcacgccacccaccatgcacagcaaaatatataacacacatttctttcaattattacactgtcataaactcaaaatccttttagaacaattctgttcttcaaagatgtatcaattttagactctgaaataaagtatgtattgtattttgaaaaggttctcaggctaccatgaaacacaacatcagctaagaatcatgagttagttgcaagacagtagttccttctacactatgtctgggaggccttccatccatccactaacccacctacgcacccacacaccctctccagagcaggcactctgatattaagaaggaaatactaccaagaaaagcccacacaatgagaagtcacaagaccttcattccaagtcctggctggtcccccttttaatcatctgatccagaactaaagtttcttcatctgattgctctaaaatcaagtgacaggctccatgaagaggagcttgctttttatttttactattatattactttattttattttactattattactatttattattcctatatttacaaacataggaacttaagtatttgttagttgattatatatagactgcttgaaagcagcttgttttttgttttgttttgttttgtttttcaatctgtttttcacaaagcccaagagatcatttctagttcatggcaaaattaaaactggatcagtgcgctcaaaactaaggtagttaaatgagatggtgtgcaaaatgggtttgtatttacatttgtcaaaagaccaaaataacagtgtcacaggcaggcatcctaaaccacgtaaattttgagtcgaatttggaaacccaaaaggactgtcttgttgcaacataaaaatgcagtttagagtaagaagatcagtatgtaacagaggggccaaagtgaggagtacatataattaaaaataaagtcaaagatggagaatacttgacaagtttacatttcctaacacagctattaaaaacaattacatattcttaagccaagagtaatatagtaaaatgacacttgaagaaaattatcctagcagcggtgtggaggatgaagaagttatcggacatgacagttttgaaagcttttatattaataccaataagattgtaaaataaggtggtggttaaggatatgaaaaggagtaaatctggtagacagtgcagagtcaactagacttcgtgaaacgctgaattagggaagtgcaagaagatttgaaaatgactctaagcatctggtcacaagtggcctacagcataaccacacctgcacagcactaacagttcttacacaggcttttccaggctgcatctgaacccgtttatttagttctacataccagacctgccgtgagacagcactccactttagatggaagcagaaaactaccaccaccattctagcaggaaaatataaccaaagattccagctttgtttcttgatgaaagaggcccactcttctaaccctgaggaacttcctatctgcactactggggaacagggaaatttcttctctctatccccaaaaaccaagattctccacacacttgaagacaaagctcagctctatatgaatattttaagtcacatgtacataaaacacagatgacaaaaggggtcgttctaaactggagctaggccaagtggattacactaaaaaattaaaatggctaaaaagcaatcttctggggttaatgtatcacaaaacgtcaaaaaataaattctgttccagaatgcactgctacataatgattctgcagttttgctgaagctttattttccgcagttttaaaaacactgttggaaagcagacatcaaagggttttccttgtctaaaaagcataccattacggaatttccagttttatcaagaagaacagtttacaaaatatatttaataaaggtctggctgcctacagttccttataaggaagaccatgtataaatttcattctttaaaaaagaactcaatttatgggagtctatctatgagtaaacgaagctccaaggcttggtttaaacatttccactctcaaaaaggactgatgagtccaatctccttgagaaacatgtctacttcatctagcttttaaggagattctaaaacgttatgtatacatacacttttctcaaacaagcactgttgtaaatttttcacattgccttactatattaaaaaaaaggctaccttacagattaaaatattatctaggaggattaccaaactacgacctcctgataaatgagacagctctccaagccactgtgactctaacctttccattctaaatctttcgggcgcggaggatgaatttttctatctttttgttggaattaagatcctgcattatcaggagatacagagtcaggcttaaagccacagactccagcagctcctcgctgccctagcacagcgggcagggggagccaaggcgcagcatcgcctccacgctccgagaccaacaccaagtctcttcacctccacgctccgagaccaacaccaagtctcttcgcctccacgccgagagcagctgcgaaacggacgctctggggtttcagccgcaccaccactttcctccaccgcagaccgaagggccgccctaggaggagccttctagtccagtcacctcaggcccgtttgcttggggtggagagtgcggtggattcctaagcctttcccctaacgggtgatttcctacaccagacgcaggacccacggtcccacgggtcccagggggaactaaaccccaaggctgcaaaggggccacgggtggggcccaccaacatctcacagcctcctgaggaggcgtgcgccctggacaggaggtccctgcccccgcgtctggcccctggtatcttcccctagggctcccggccgccgctcaccgtgaaggggacatccccgacgctgcccacggagtagcagttgtctccagggttgacagctccggtgaggacctgatgcagatgcatctccggagcccgggctggacagaatgcgcgggaggtgcgacaagctccgcgcctgaccctcctcgggctgcgagagccgtttccctctgtgcctccctcggaaacccgccccgcggaggctctggcttaactcctcgcccccctttcgccttccctccgcctcgtccctgccatgggagctcctcgaccgccgccgccgcccgggtcgccgctcagctgcggaaatgcccggatgttcccactgcctgctgcaccggcgcacaaatgcgggagggcaagggtgcttgtgaggcgggggagggcaccggggggaacgcgcgagccgggagcgtgcagcaagggagcgggccagcgcgcgcgcccaccgcgggggagcgaggtagagccctccccccgcggcaaagctctcagctcagtctttcttccccccatcacccgcgtttgcgcgtgcgcgcgccgtggtttccagggcaattgcgcgcgccacgccgacccgccgtcccgtgattgcgcgcgcagacgtgcgggagttcccttggagcctcccgggctgtagccgctgcggactggggcggaggtgggggcgggggcgagtggggtgcaggtcgctcggggccacgcagcagtcggacgccggggacgcgccacgagccggttttgctgtgttgaacgtattccagaatacagtgtgcaatggtcagtgccgttgacctcagaaggacacccgtcaccgggaatttccacctggagatatcttagatatcttcagtcttttcgaaagtgcagtacataagatattttattttacataaacaatgtaggcatcttgcaactatttagagaagccatactcccctgaaagctaattattttgctcccaccttttgtcacggttattctagacagcaaaaagccgccttagagacgggtgactcctttcgactttttttcatgagtaatttcatgaattagcagaatcgcctgattttccaaactatctgctaaactttgaatggttgataacaaggatcatcagctccctgccacaggccaattcatggcaaatgttctaacccatactatgcttaaatcacagggtaaggaagtaggggacaccaagacataactatctgtaaaaccaggcagaacgccaaaggtggtgtgattgagatataaaagtctttatgcaccacagaagaggaagaagaatgttgactaagggcgtggataaggcattatggagacataacctgacataaacgctgagtttaattttgacaggctgagatagacaagaaatgctgcaaatacagtacagaaaatagagggggtgttgaaggtacaaagattaatgtttgaggcagatgatttatagggtagggaaagtaaataatacttagcaagagatcaaggtatccaagtggtctaactcttggcctaccaaaacatattatggagagtcttgaatgctccaagaagcccagatttcactctgcatgcagtgggggtatatcagatgtttctgagcaaaaatttatataatcagagctgctttgggaagatgactttgtagcattttgaagcataaagggaagggtggggaagattggaggcaaagatctgtcagtcgttggtaatcttttcagtagaaagttgcaggaggaatgaaaaataatacctaatgacctgcggcattctctctctttctctctctcccccctccctccccttccctcccccccccttcctcccttcccccgcgccatatccaagggttcctttttgttactactagattctagatgagtctcttaatctttgaccttcactgcattagaaaccaagtcaaaactatcatcaaacaacaaattgtactcaggtttccaagagtgttactaattcacattatttaaaccatttcacatttggctcttgttttacagcattccatgaagttttggcccattcacacagttgtgaagttgtgagcctctttcttcctctcggtatcaaactcaaaatctgaagcctgtatccacctgttctcttccctcatgaatcctttaaatggcttcttgatagctgtatcttaaggttgcaaatgactaattaagtctcctggaattacagctgagccttttattgtccaatctgatcagtcaaaactcactccagactaatatggcaagtttccttggtagcccaccagggcagctagaccacacttttgactgtccacaatttcatctcttccttgttcatgcaaattttttcatggacctaaaaacaaattggaaattctttcttctaattttggaaagggctttcttttaaaaattagaaaaagtagcagttttgtatcattaacaaaatatgctaatcgaattgtaagatataatttatcatgtccacaactcttttttttttctttttgctttgatttgagatcccaacacaactcttaatagtacctttggggttgggtttaatggcccattgaatgtgtgccattaaatgtgggacttagtttcccagcagtatcacctaccgatgtgtactagttatcaattactgtgcaataaattaccccaaaatttatcagccaaaaataacagtagagattcattacctcacagtttctgtgaatcaataatttagtagtagcttagcaggaaagttctggttcagagtctttcatgagatggcaatcaaaatgtcagctacatgctaaataaaagaagctggacacaaaagaccacataattcgtttgtatgaaatcatttgtatgaaattttctgaaaagacaaatctacagtcacagaaaataggttagtggttgcctggggctgaaggtggaactgagagtgactgctaatggatatgaggtttctttttggcatgagataaacattctaaaattagattgtggtcatggttgggcagttctgtaaaattactagaaatcattgaattgtatacttgaaattagtgaattgtatggtaattaaattatactttcaataaagctatctaaaaaagaaatagccagggatacagtcatctgaagtcttgactgaagttaaaggccctgcttccaagatggcaggctctcatggctagcaagttgagcctaatagatagatggaggcctcagttcctatgtgttcctctccatagtgctgtgtgagtgtcctcaagacacggcggctgactgctccagcagcaagtgatccaagagagagaccaaggtagaaactgcaatgtcttttataaactagccttagaagtcacacgccatcatttccaccatattttattgggtgcacaggccagctataacttagtgtgggagactatttcccaagaaagtgagtgccaggaagggagagtcgtgagcagccattttggaggttgtccactacaccacggaactcaaggactttatcttcaagagtcaaggggcagccaggcgcagtggttcacgcctgtaatcccagagctttgggaggccgaggcaggcagatcacctgaggtcgggagtttgagaccagcctgaccaacatggagaaaccccgtctccactaaacatacaaaattagccgggcgtggtggtgcatgcctgtaataccagctactcaggaggctgaggcaagagaatcacttgaatccgggaggtggaggttgctgtgagccgagatcacaccattgcactccagcctgggcaacagaaagtgaaactctgtctcaaaaaaaaagagtcaaggggcatgacttgtgtcattattactcttacctacagaggtaactggaatttctactcataaatctacagcatcgtaatgttgatctttgatatatctgttattagttcttgttgagctatctatataatttaaatattaaattctcaagtgattccatttgtttgaggatctaatacctattttttaaaaatatttcttccagttgtggggaccttacagttttcctaggatgtctaacactttaagcttctggtttcttcagtagtatagcaatggaagccctgactttctgttaccagttcattttgcagtctattgtgttaaagcctgaaattgatgttgtaacaatacctgtattgcttttcagtcataaactatagcaatgatgcattttaatctaaaatatcataggtgtgaacctatatcagttatcactttaacaaacccctctgaaacacagtggcttaaaacaacaattattattatttcgtatgttctgtgaattggttgggaagttctgctggtttcactcatacaactgcagtgaactgtggtagaaggtccaagatggcctcatgtctagcagttgatactagttgttgtctggggtgcctcagttcccctttatgtggcatcttgccctccatagactagaccaacgtttgtacatggcagtctcatgcttagccttgaagggcagagtcacttctatcatattccttggtcaaaacaagtcacagagccagcacagattcaagaactaggaaaacaaatccacctttcaatgggaagaacagaaaagtcacattgaaaatgggtatagaagaagttatcggcatctttacaaaaaaatctgtatcacagcctcaaactctagctttgaccatctctgtggcctctgatttgttatatttgcttttgctttaggtaagaatgccacttataggatgaaaaacaaaaacttacgtatctgctctctttctctgctagaggtagcattaaattattgtctttttggtgactgtaactcagactcttagctatttctcattcattatgcatttggctttttatctctaatgtaagtgcattggacatggggcagtttttacatacctttctctggtgtaaaggtgaatctttatgcatcttataagcaggtgaatacaataagttttcatctagttagattattttgttgctaggctcagaacactgaccatttagaaggagtacagagaatattggttcatatttttgcaggtacctatttatgattgtactgtgaaaagtaatatgctctatgtatacaatttatttccttaatgatcactgattagcacttttataaactcatttaagcaagagcttaagtggtaactaattttttaaacattttatcgtatgaatgattatacagagtagaccagacacaaaaactattcacccttgcttatcttttcaacttcatctttcaacattcctgacctctaaatgtagggtacaaccacactagtatacagtaattcctttcaagcctctggccactggctaatttccctttccagaaactccctcactattatcattaccaccatttggtcgggcgtggtggctcatgcctgtaatcccagcactttgggaggccaaggtgggcagatcacctggggtcaggagttcgagaccaccctggccaacatgatgaaaccccgtctctactaaaaatacaaaaaaaaaaaaatagtcaggtgtggtggcatgcgcctgtagtcccagctacttaggagactttgcttgaacttgggaggtggaggttgcagtgagctgagatcgcaccactgcactccagcctgggcaacaagagtgaaaactctgtcaaaaaaaaaaaaaaatccatactctttgcctatttcactctttcactcctactcttccctaaaaattcagttcaggcacccccatttctggaaaactttgcacagtgtgaattagattcctttgttatatactcacagtattctcttaccttttctgcctagagggcagggactgtgtcttgatgttgacaatttctgattgccttacctattatctgttttctcctcatcaggaccctcagtttttagctgggaaatagatgcctggaataaagaatacatttcccagcctaccttgttgccacttggttatatggctaagttgtgatcaattagatgttgatcaaagcagaagtacagtagtttctggaaattttccttaaaaggtagctatcataccttttatgccttcttccttccttcctccatcctgtttccctagaacatagatgagatcactgaagctccattttggagcatgaggatgagggttcaaccctagggatggtggagtagaaaactggaagctgccgggttcggttgatcacacctgtaatcccagcactttgggaagctgaggtgggtggatcatttgagctcaggagttccagaccagcctgggcaacaaggcgaaaccctgtctctacaaaaatacaaaaattagctgggcatggtggtgcatgcctgtagtcccagctactctggagaccaaggtgggagttttgttggaaccccagaggtggaggttgcagtgagcccatattgcaccactgcactacatccagcctgggcaatagaatgagatgctgtaaaaaaaaaaaaaaaaaaaaaaaaaaaagaaaagaaaagaaagaagaaaagaaaagaaagagaaaaaaaaacaacaactggaagcttgtcacttgtcactgaattccaggcaactgtggagccttctcaccagccttggtcttctccatctggatttttacattagagagaaataaacttctatattatttaagccactgtgttttgtgtctctgttagagatgttgctaattctaactcatactcttagctgtgtgtgtgtgcgtgcgtgcgtgtgtgtgtgtgtgtgtgtgtgtgtgtgtttaattgctaaagcctggcaaagtacctggaacacagtaggaactcaagaaatgttaactaagccaagtagttattaactgtatcagggtacattatgtaaattttgtgaaaatgtcacaaatattttagaacttacatacctttccaaggcctcagaaaacaaaatactacatcctgtcgggagggcagatggtagttgtgggatagaaagccagtagtgttgagataaaggataaggactgaacaaaagttgaagttagttactaaatcaggcatggcctgctgggtagtcaacagaccattttgtgcatctgaagaaatgaattaattttgctggcatggtacttaagcaaaatacaattttaaagagagagagaaacaagttcattcggtgctagacttagagagaaaaatgaacttatgttgttctggttgctgagagaaaaatcagtcaacaatcaggcattgtggtgttgaaatcaccaagtattgcacagtactcttaggggtgggccaggatggtcacactcctaaagggaagtgagaggggagaggaatcagcacttcctcatggtgaagagatggcatccctgcctgcaggaaaaaaattgtatctgggggcagcagaaacaagcatgtgccagagggtctgggtccagtgtttgttttttgttgttgtgtggtggtggtggtggtttgtatttccctgcatgtgggtgtgcccacatgcatcaggtgttaaccaaaaaaatctgacgttatcaattgactctccttttaatctagttctatatactgcaagcatatttgtataggcatattcctgtgaccattaacccttttacatatgaagaaagattatgaaaaatgttcaggatagattaaggtttttattgcatttttcaaaaagaagattgtaaaaagagaaagctgaccaccaacatatgaatggataaattgtgctatctacatacaatagaatattattcagccatgaggaatgaagtactgacatatgccataatgtggatgaccttgaaaacattatgctcaataaaggaagccagacacaaaggccccactggctacacatttatatgaaaatttccagaataggtaaatccatagagatcttagaaagcacattggcattgccagggcccaggggaagaaatgaataggggtacagggtctccttgtgtagtgataaaaatgtcttggaactagatagagttaatggttgcacaacactgtgaatgtattaagtgcccctgaattgttcacttccaaatggttaattttatgttatatgaattttacctcaataaaaagaaacagtcattttttgttaattaacagaaactccatgtgtgtacaaagaaaaagttctagaaagtatgttaacagcactcatgtctagttgatagaattataaacaagtttaatttcaatttttttccacatttgtttccaatttttctgcactgaatatatatgagttgcttttatattgggaaaacaatgattttaaatttttaaacaaaagatggcctttctttaagtctatgaagaagtttaagaaactaggaaatcatgctcagattaacattatgtattccatatcagttgcaaaattaaattttaaatgaagatataaagttttatggagtatatttcattatttttaaaacacaataatttgtccacacttatatgtaaaatttcaaatgcaaatgcaaaagacatgtttaaatttgtttaaaagacaggcattgcagagggttcctaaacaagtctatgggcctgctgggcctttgatcttggagtggatgatgacttccatagctctacaacagtgtcagtaggcctacaacctcaaaatctcaccacctttgaaaagcagttggtaaggagccagtagtctttctggtaaacagagtccatgaaccccaccgtattaacagtttcttttgcctagaggtctttctcccttcccctcttcaaacacggctccaccccaattcaacattgtcttcaaagcccagctttaaaatcacctaggtaaaacctttcctcccaatgatgttaaataaatttatcccaccctctgttcccctaaatctttgtgtcttcactatgagatttatcttattacttatatcacaatatactttttcagtgagttagcagcacaactcccatgcaaatataaaatgaaattatgccaaagattttgttcaactcattccttgattaagaaaccagtaagatgttaaaatagttcaaataagaatttgacttatggagatttatatcttctacctgacagttcatttgcattgcttatgaaaatgagttagttatattgctatcagttttccaaaaatttagcttttattctcaatgtttttaaatagcctagttaatagcaaatcaatcaaataatatcagacaatccttaaaattctcctaggcaatgcccagctcttcactgaaggtatacttgacaatttattttgcctatttccaagtcttgaataatttttcttgacaattcatagcttagatctctgtctacagagtctgtttgctagagtatgagctcaaaagtatatcttcagagattggttaaattaaatactgagagcgtcttcattccaggcagcaacaaatactctagggatacaaagatgaggcaaaggcagaaaaacttctttccctgacttcagggacttatttagtacatattaaagcacataaacaaataatttatatacgatatgaaagagctataccttaagataaatctgtggcaagtacaaaatggaattgtaagagagcacgattaggattatttttagggaatcgatacacatattcctaatgcaaaaactcattcatgacttccctacagaaaattcagttcaagcacacacaaacattttggcacgtgaggaaagaggctataaagaaaaaaagataatatgataggtaatatttatggagcacattatctttaatgcttatgactacctaataacataggcagttttatgaacccctttttatagatgaggaaacagaagcacacggaagtcgtacaatgcaagactctgtagacagaaatctaagctatgaattgtcaagaaattcatgggaataggcaaaataaattgtcagatgtacctttggtgaagaaccctctaagaactgaaagtctaatgaagtaggaaaaatacaaaaatgatacaatcccatacaatgtaacaatggtattaagagtacagtgtaataattatgccaaatatagtggacacgttttgagatgccaatccaaatcatgccccctttgaaatttcctccatctatcatctctgctaaaagggggatcctaactgactatgtttgtcccatctgatctccacaaagtcctggatcagctgattgaattg

SEQ ID NO: 277 - DNA, 28923 bp, Homo sapiens
ctcagtggaagcagctcccttgcctttgtggctatacaagggcctctctttctgttttccaattcatcacctttttctgtcatgattagttcctgttgtatcctaagacttttttggctacttcaaggtcatgaaaatattctcctctgcattcttccagaaacgttattattttagctttcaaatttaagtctattatccatctcaagttaatttctgtgtatggagcgaggtggaagtcaagattcattttttcttcttatgaatatccagaaccattatttccaaggaccctcccctgtccctgccattgaacggtgagcacctatcctgaaagtcaagtgactatttgtgtgggtttttcggtaagttttttttttttttgaggtggagtttcactcttgttgcctaggctggagtgcaatggcgcgatctcggctcactgcaacctccgcctcccgggttcaagcaattctcctgcctcagcctccggagtagctgggattacaggcgcctgccaccacacccagctaatttttttgtatttttagtagagacgggattttaccatgttggccaggctggtgtcgaactcctgacgtcaggtgatctgcctgtctcagcctcccaaagtgctgggattacaggtgtgagccactgcacccggcctatcagtcagttcttactccagggccacagtgcttaaggactacagatttgtagcaagtcttgagatctcatagtgtaagttctccctttttttttttaagagagtgtcttggttattctcagtcttgattttcataacattatttcatcagtttattccaaaaacttgctggagtcttgcctgtgggtgcatttgatgtgacctctgctttgctcttgcttgaatctcttctgttttttccctctgccctcttaggacctgcctcatccagtgctcccggaacagctccaactgtgcctgggactttagcactgagtgttgctgtcttaggagttccactgccaccatggctgggtggccaccacgtcctctgggctcagcatcctggccagttaagtcactcttctaggcactgggtcacttacagtaaaatgttggtgggcctattctctctcatttccctgcagccacccctggctccttgggaggagttcagggagagtcattagctcctgctttcaactgtattttaaacctgtctgaggatgtgtctgtagctcaaaggggttttggtggcctctggtcagaccaactgccagatgcctgttacctggctgctttctcgaaaggttttcatctttcttcctcatgatctaatctctctgttcagggcgagaggcattccttccagagatcacccctccttcttccatcatcctcctcccctccctttcattcctagaaggggagcatagggaataccacgcgggaagtctgacggcaggaaacgaatggaaggaagacaggagatcaggctctggttccccttaaggacaagaatcagggtggagtggtggggagaactggggcttggaggaaggagagtgcctactgaggaccctcccagtgcagaagcatcacagacccagggatgcagaaaatagggcccgagaaagacagtgaggtgcggacctcagtgatgagtctgggactgacagacgtgtccacagggaagaggcaattgagacttggattgaagccctttaaacccccacccccacccctgctgagattctgctcccaaggtgataggagaaaacaccagagagatgaggtctcagagtcagagacatcagtcacagaaagaaagatggaaagtcagagggcagtgggggtctggggggctggaggcaccacttacctcagtcactggccctgtctttgtgccccaggtccgaagccccagaaggactctgtctcagactgggccattgtgttgatcactctcactttggtggcagcaattgtcagcctaatgtacggtatcaagaaggtgagcaatgccatggtccaatgtgtgggatccctgtgccagtggggctgggacctggtgccccaggattcagaggagaacagggctttggggaggggaatgacagcttgcagggcttgttgcagggagggcaaagagagcccttgtctcagtggccgagaaaaacaccggtctggcagggatagggggttggggccactgaaagaggcgggggagtgctggaggctgactggcacgtggaagcactcaactcagctctaggcaatgaaggaccagttctgtggagccacattcacctgggcttgaatccttgtgcaagttacttaatctgtctgtgctccggattcttcattaataataatacttaaataataataatattacatcgcactgattatgtgctaggtgtgctaggtgctgtacatattttagttcacagcaagccagtgatataggaaatattactcctcattttacagatgaggtaattgagtcctggatgaaatgagaatgatggcatccatctcaaagggtggttgggaggatcaaataagcttatgcaaagagagcactaatggtgcttggcatgtattatagtaagtgctcaatatacagccttattcattattattgctgtttttgctcaaagaggaatgctgagtgcctgggttgccaagaggaagcagcagttcatgggaagagctgggctgagcagcaggttcccgggtccctagattaacccatcgtaccctcccctcatctcacaggcctgccagttccggagggagatgagtctggggtgtggctgtggctctgtgaccccttacagcagccaccatgagggggaggctgccagccagcgctactcttgtcaaatgaaaggtggggctggggcagctgagcgcctaccctttggccttccttcttcctctcccagatagtctcattcccagactcccctatcccattcaccttagctgggaccatttcctgcaggtagattcctggggtcactggcccccccaggtctcttccacccacagcgtaaggaggagtctactgtcagtcacaagattctgctctctgtcctgccgccagccatgcagactgcgggaaggtgcccagcttctccgagggcagttttctcatctgtagaaggaaggaccagggctaagtggtctgcaggcaccttccagccctcacggagcccaggtctggacagctggaacccctgcccctcaccctctcttcctagtcccaccctcctccctgacgaccagagaagctctttagctgaggacagtctgctcacggcttcccttctcacttccctccacagggagccccctcaggctggctcttgagcccccaaggccctctgattctctcccctcagggcaggtgcaggaccctcctctgtggtgccccctcggtctgctatgggagggtggtgaacaagttattgctaaataaaatggcacttcctccacttgtctcccagatgctgtgggtttgcccaagtgcatgggcttttgtgtcatgtgggcccggaagggccaagtctggtctctgccagttaccagggcaagtcattccctgatccgaggctcatttatcctcatctgtaaagtgagggtgacaggtgataactcataggtgaggtgcttagtacattcttcagtacatagaaatgcccaaacaatggtagttggcagagttgtttcgtgactggcctctcagcctccagctcagatgaagcaacatagactgactgtaagagactgttttgggcctccacctacctccaggtttctccatcccagacatcagcgtccttggggtggagttgtagctcagagagaagggaagggggtgttcattcacaaacactggttagtgcttattctaaagcagagatcctccacttcagcacaattggtgtcctgggctggataattctttgctgtggagactgctctgggcattataggatgtcccacagcatctctggcctctaccccctagatgccagtagcatcccactccaaattgtgacaaaaatgtctccagaaatttccaaatgttccctgatgtgggcaaaattactcctccctgtacagaaccaccgtcctagaggcttgggtccctggggaaagggggggggggaaggggaccagtgaaaagggggactgtcagtcacccgagtctacatggagttgcagaggacagcctgtgtctgccttagtttctccatcctgcaggatatattgcctgggaggcaggctgcccagttctgagtagtcagtctttggcctgactccacggagcctcattaatctcccattaatcacattaataagcagttggcctcctctcctcttcccacctattccagccctgcccagggcttagggacaagtcacaccaagtaaggagaggaacccacatgtccagttctctagtcctctcatgagcccaaatgccctgagggcctggcctcctgccctcaggtcctggacctctctatggcctttgcctgcccccacttccctcagaaaggcatcctccggccctggcttccactccatccaggcggagtggaaacatttattgattgcctactgtgtgccagacactgtcctaggctctgatgacacagcagggatccaaggtgcttactttccatggagacccacagtgggcagaaaggggttgtgacttctctgtgctagagacccagggagtctgtcctcccctactccagccccaggcactgtcactggggagacaagggagtctctgagctaatgcttgctttaggcaggaagtgaggaagggaagggggagctctggggtgctcctaaaaatgagatgtctgcatttctgtataggagtgaatggggacttcgagacaaagagacagccgctgagctgaggtgggagggaagaggtagagtgaaagcagaagcccctgtacaccgagcatctcttggccaaagatcttggcctcggtccttctgggtggcctgacctgtctgtgtccctggtgaggggtgtgacatatgtccctgtggttctgtgtcttgtctctgtcactgcctctgcactctccacatattgttgtatgacctctgaacatcatgaagcacctttctctgcagcgagggtcattcgagggctttctctcgcctttgctctttcacctgatcctcgcggacagctccgcccaaggtggcaagaatgaccatgtgtgaataaggggtgtggaagctgggctgatgcgggagaggtgggagggtgcgcgtgaagctggacacagatcagaacgtgaaccccaccccatcctgctcccagccagagctcagtccttctagaactgagccatctgctccccacttccccagagccctggaggcgccaccctcacttccctccactggggctggctcaggtgcctgctcctttctggttcctctgccctgcccccagatcccacccctcggcaggcacccaggtgcctggctccatgacgcagcagctgcggtctcctcttatcagggctcccctgtgggttggggtggctccatttgtttaagacttagtcctgaggagccccagcccccatgacgtcaagattggctccatataaggtgaggggtccgcagcccatggtccccaagcagccacccagctccgacatggcccagccggtccacagcctctgctccgcctttggcctccagtgctgcctcctcttccttctagcttcttggggggcaggtaagatgcccacaggggatacagaagacagaaacagcttgtttcttagtgttcatagcgttggacaacaaatagaaatgaatgaagggggcgggcacggggctgctacagacagttgtctagagtgttctctgctcaagtttgctggctaagggacatgtagtaggagatgaaatccagcctgtgctctgctctttaaaacatggctcacagggctgcacccatccagagggggtttcttcaagtttgcataaagacactgtagaggctgccagccctggatggtgggggtaggcacctgacattcattgagcaccgtgcacggaattcacagctgctcatggtgatttctttcttcttcttcttcttcttcttcttttttttttttttttttttgagaaggagtcttgctctgttgcctaggctggagtgcagtggcacaatcttggctcactgcagcctctgcctcccgggttcaagcgattcttctgcctcagtctcctgggtaactgggattacaggcacctgccaccacgcctggctcatttttttgtatttttagtagagacaggatttcaccatgttggccaggctggtctcaaatgcctggcctcaagtgatccgcctgcctcggcctcccaaagtgctggtattacaagtgagagccaccgtgcccagagactcatctcatttcatctcagcatcccctgaggtggctaataatatcccatcttatagttgaggagagtggattcacaatgattatgtcccatatctcacagctagagggaggtaagcagggattccagctccactgcccccagccctggggggacaggtggagcttctctcctgagagctctgttttgtgcagacctagcttccagtcctgactctgacccatttgcctactctggccttccacaccatctgtaaaatgggctggatgctgctgcccagccgtaccagtatttgatgcctacagagcatttacactgcaccaggtgttgctctagggacttcatccacatttactcatttaatccacatggagactcagaaaagtgtgcgtcaaaggctctgtccctgtcttacagttgggaaacatctcaggactttgatgggaaaatgactatggacaagttcgacgaacaaaacataccctaaagataagatgaaattatgaaattagttcacttagtcaagaaacggactgctactgaacccggggagcagagatgctgaacacaggggcggtgtggagggcctgggcaatttggaggagggtctccacaaggcagatgtagaacagcagattcagagacactatctacccactggacagtcatccaaggacagagccatccacagggtgatattagaggcagtgccccttccctgagcacagtcaggttgaggccaggggtggaggcaggggcaggtgggtggtgaatggcgatgactgaggaatctttgagctgcctctgaaaggtctcagcagtgcgtcctgtctgtgccctgacttgatgtctgtctcccctaccttgagggtctggagacagaggtaccacagctgcccaacacctcccggccccatctctcccgcctttccttccccttcctctcaggcggattgtccactggctgctctctcctccttccatcttgcagcttaaggaagaggaacctgcagggggcggaagggaatccactccatacacagtcgctctgagatttgcttcagggcggagatctgaattcctgagattccgatggggccatgtgggcgtggtctcggagaggagataggcgtggctgggcggcatggagggaggggtggggaggacaaggggagctggctgctcccattctgcagattttgaagacaagagtgagtgggttacaggtggggagggcttgaggctgggctcgggttgtgatgaggtcgggtggaactggagtgtgaatcagagctggtgcatggctgtgcccagcagagagagaggccagggcaggaagggaagagggacaactgggatggatgaagccctttagtctaccattctggtgaggagaccctgacgtttgtccacaggaccagtcaacacccagacagataactagatcctggaaccccagagtctgcatcatgcagtcacagaaccacaggtacaatctagattaaatcatccgagggcagcacaggtgcagtccagattaaatcatcacagagaggcataggtgcagtccagattaagtcaccagagggaggcacaggtgcagtctagattaaagcatctgagggagcacaggtgcagtctagattaaatcatctgagggagcacaggtgcagtctagattaaattatcacagggaggcacaggtgcagtccagattaaatcatcacagggaggctcaagcgcagtctagattaaatcatctgagggaggctcaagtgcagtctagatgaaatcatctgagggagcacaggtgcagcccagatgaaatcatctgagggagcacaggtgcagtctagatgaaaccatctgagagagtacaggtgaggcaggagatgggaattggggctggggtccttggaagaatctaacaagaacattttcctataacaaatgttatttgatttaatttctataacacaaataatgtatgctcattgtagaaaatggaaaatagaaaaaataagaaagaaaaataaaatctctgtatactccctagtccccaagcaatcatttgattatatctccctttagctttccttttttttttttgtagagacaggtctcgctatgttgcccagactggtctcaaactggtgatcctcctgcctcagactccctaaatgctaggattataggtgtgaacaactgtgcccaccagcttttctttttctatgtctgcattttaagccacttattgaactcatactgtataggtattttaacaaacatttacccacattattgcaaatggagcatgccatttatgggggtaaggataccaggaaacactagagatgctcttttgggacagcgtgccctgacagcgactccaaggcatgagttgcttagcaagatattctttctcccttccttccttccctttcctttcctttcccttccttccttccttttctttcttttcttccttttctttccctttctctttctttctttctctgtctctctttctttcttctttcgacagagtctcactctgtggcccaggttggagtgtagtggcatgatcttggctcactgcagcctctgcctcccaggttcaactgattctcctgcctcagcctcctgagtagctgggattacagggtcctgccaacacgcctggctaattttcatatttttagtagagacggggtttcgccatgttggccaggctggtctcgaactcctgacctcaggcccacaatggcctcccaaagtgttgggattgcaggtataaggcactgtgcccagccgatgtcctctctttcaaatgagtgaacaaagcagatggcggggacctttggcactgtgcatcgttttgatgttgtgggatttgttcttattcttttatcccagctgagcatccacctacagtgtcttgtgctaaagttggattttcctctctgcacctcctgcctattcttcagtgaccaaaacagttcttttcgggctatgatggttgtacgtggaatgaatatctcctggtgaaaacttactagggaaataagtcactaccaaagtagatcgtctggggcagagatgctcctcttgtcctgggggtttacactgatttgcctcttggctgtgtcagggccaaggaatcccttgagctttacctcagctttttacaatctatggttccacaactgtttgatgcagatctaaaattctaaaatcttgttatctgagtctagttatggactgtgatcctgtggtttaatgacaactggtatcccagaattggtgggccagaggccttctttcaacgtcttttaatctcagagctcaattactgaacagcggaagtcgcccttggtcttccagcctgtggaggtcacaaatacatttggtttttacttaacgtgcatgatgaaatgttgttggcaaggcttttaaggagttttcatcagtcttattctttcattcattattcaacaaatatttacaaagtgcctcctatggatcagacactgttctaggctggagacagcgatgaacaaaacaataaaaatccctgccaggccaggccaggccaggccaggtgcagtggctcacgcctataatcctaatattttaggaggctgagatgagaggatcactgaagaccagagtttgagaccagcctggccaacatagtgagaccctgcgtcttaaaaaaaaaaaaaaaaaaaaggtgaggagggggcatactggctcacatttgtagtcccagctgacagggaggctgaggtgggggtactgcttgagcccaggaggtcaggactgcagtgagctgtgaccatgccactgcactccagcctggtgcagagtaagactctatctcaaacaacaacaacaacaacaaaaaccccggccggatgcaatggctcatgcctgtaatcccagcactttgggaggctgaggtgggcagatcatgaggtcaggagatcgagaccatcctggctaacacagtgaaaccccatctctactaaaaatacaaaaaattagctgggtgtggtggcatgtgcctgtagtcccagctactcaggaggctgaagcaggaaaatcacttgaacccaggaggtggaggttgcagtgagcccagatcgcaccactgcactccagccttggcgacagagtgagactccatctcaaaaaacaaacaaacaaaaaaagccttgccattgtggaaatttaattgtatttatcacatatcagaaagtgatgagtgctgtgttattaaaacacagcagagaaagtggcccaggaatgcagaggctgctgttttcaagaaggtggccacagcaggtgagaggtggatggagcaggcaggggggtagggctactgctcaggctccccttactaccaggagaaggacagggcaaagcacgagattatttcagagactacaatgtggattcaacaaacatttaaatagcttctgtgctccagagtcttccatggtccatacttcctttaatcctcacattaagctggtgcagtcagcatcatggttatttacagtcgagaacatggagcttcagagcacttaagagacctgagcaagaatgcaaaaccgctgagggaccgagcctggatgtcaaacctgtcctctgattctttaaggccagtggaaaatgccctttgcattgctgccagctcctttattcactcaatagatagtcattcatcccttatcatgtttaaaaacatctggggcacagtgaaaagtctaattttgccaattacttaacctctttgcgtctcctttccccacctgtaaaacagtaagatcacactcctcacttcacaggttcataattatttgattaaataaacaaatatatgaacagcacctttcagggagtccacacatgtcagtgtctttccttctttaaaagactgggctgacctattggctgtgcactgtggtcttaaccagcaatgatctgggcccgggaccccaggatgtgtgttcagattctgtctcgacctcttacttgctgggtgtccttgagaagattacttaaccactcagaaccttgtttcttcatctataaagtttggagaataggatagttctcaacctcaacaggttcttgtgaaaagtaaataagttaatgtatgccctcacttgtagaacctgcctgtctcattgtagagctctagaaacgttgcccattgctattgttgtgggactatgtacaggtcacttttcctccgtgaaatgtaaatttctcagatgtaaaataggggaagttgaccgcttctaaagagccttatggagcattgggagatcaatcaccatagaagagaatccagaaagagaatgtctgtgaggccaccagccacatcctggggccggggaaggtgtccaataaacaatagctattactggtattgctgccaaggagatcaggtaatgggattgggacagtggagtgcaggcctgatcattcagcccccttctctcccctcattctcaattcctttcagagacttgggcttctctattaccctcacacccttcttgtcctgcccatatttctttcaaggactaagctccccaggccgattctgcccatcagcaggcaggtggactgtggtttcttgtgattgggaataggtccaggttccggttgccgccttgagctaacagggaccagaaacctcagttatgtaatgacactatctctttcactctttggtgatctcttggccttcactcttttggctaggtatcagagacatctcctctgtctccatcaggttgtttttccatggaattaaggcgtgtatctgtccactgataggggtgttttctctcacaccctgtccttaaacatagtcagtccctaccacaatctagttgcctcgtttactcctgtcaggacccccaagcagatatcttttcctttcaggatggcccctttcatctatccccagttggctttaaatgtgtgaagagggggacccagtggggtgaccataagggttgggtcatctcatccattcccctcatccaactttatcaccgaaatgaaagcttcccatctccttactctacccatcctccattcttcttatacatctctcactcacaatttgtgtctacctgctaatccctatgggaagttctgccagaggtcttacctcaatttctcacactgttacatttgggatggtgttagaatgttatggaaaggtgaagagtctaacgtttactcctggtcttctcagctatgccatagaaagaagactccattccataagttacagaccctaaaggggcacctgcacagtaaaatgctagtccatacatgccctcaaaaccttaccattggataggcatggcagggagtggaggtcggcaggcacgcaaacaactgtaacgtgaagttgaaggtaacaggacagaatggtgaataaagaccttttcaagcactgaaatgaagctggattttatctgcttagacggatcagaaaagatgccttaaagccagaaggccttgagatggagagttgaggagatgtggaaggggatgaggtggcatgcttgctgaaggcacagcctgagcctaggggctggaggtgagaatggggaatagatatcatagtattcagaggagactggctggggagtcatatcagggggaacaaagagatcccctagagaaggaggtgggaagggggagttggagaagaacatgggggaagtttcttatttgcctctctccctccacaggtgctactacattccaagaatatcagaaaactggggaactctcaacatccgatcacatatttcccctcactccaggccttgtttatagtatcccttttgatcacattgttctgcattcaggacaaagacctccagagctccctaaatctacagaaatccatgagcaaaaacgccactgcaacaccacacgccattctaagccaactgacaagcctacaggcaactccaaaactatagaccacaaaagctctacagataatcatgaggctcctcccacttctgaagaaaactccagcaaccaagggaaagacccaatgatccggaaccagcgctctgttgatcctgctgactccactaccacacataaagaatccgctggaaaaaaacatataacgccagcacccaagagcaaaataaactgtcgtaagtccacaacaggcaaatcaacggtaacaagaaaatcagataaaactggaagacctttggaaaagtccatgagtactttggataagacaagtaccagctcacataagactacaacttccttccacaactcaggcaattcacagaccaagcaaaaaagcacatcttttccagaaaaaatcacagcagcctcaaaaacaacatacaagaccacaggaaccccagaagagtcagaaaaaactgaagattccagaacaacagttgcctcagacaagctcctgacaaaaactacaaaaaacatacaagagaccatatcagccaatgagctcacacaatctctagcagagcctacagaacatggaggaaggacagccaatgagaacaacacaccatccccagcagagcctacagaaaatagagaaaggacagccaatgagaacaccacactatccccagcagagcctatagaaaatagagaaaggacagccaatgagaacaccgcaccattcccagcagggcctacagaaaatagagaaatgacagccaatgagaataccacactattcccagcagagcctacagaacatggagaaaggacagccaatgagaacaccacaccatccccagcagagcctacagaacatggagaaaggacagccaatgagaacactacaccatccccagcagagcctacagaacatggagaaaggaccccatttgccaatgacaaaaccacatcatcctcagcagagtctacagaacatggagaaaggaccccactggccaacgagaacaccacaccatccccagcagagcctacagaaaatagagaaaggacagccaatgagaacaccacaccatccccagcagggcctacagaaaacagagaaacgacagccaacgagaagaccacactatccccagtagagcctacagaaaatagagaaacaacagccaatgagaagaccacaccatccccagcagagcctacagaaaatggacaaaggaccccatttgccaatgagaaaaccacatcatcctcagcagagcctacagaacacggagaaaggaccccactggccaatgagaacaccacaccatccccagcagagcctacagaaaatagagaaaggacagccaatgagaagaccacaccatccccagcagagcctacagaaaatggagacaggactcctttggccaatgagaagaccacgccatctctagcagagcctacagaaaatggacaaaggaccccatttgccaatgagaagaccacatcatcctcagcagagcctacagaacacgaagaaaggactccactggccaatgagaacaccacaccatccccggcagagcctacagaaaatagagaaaggacagccaatgagaacaccacaccatccccagcagggcctacagaaaatagagaaatgacagccaacgagaagaccacactattcccagcagagcctacagaaaatagagaaaggacagccaatgagaagaccacatcatccccagcagagcctacagaaaatggacaaaggaccccatttgccaatgagaaaaccacatcatcctcagcagagcctacagaacacggagaaaggaccccactggccaatgagaacaccacactatccccagcagagcctacagaaaatagagaaaggacagccaatgagaagaccacaccattcccagcagagcctacagaaaatagagaaaggacagccaatgagaacaccacaccatccccagcacagcctacagaaaatggagacaggactccattggccaatgagaagaccacaccatctctagcagagcctacagaaaatggaaaaaggaccccatttgccaatgagaagaccacatcatcctcagcagagcctacagaacacgcagaaaggactccactggccaatgagaacaccacatcatccccagcagagcctacagaaaatagagaaaggacagccaatgagaagaccacacaattcccagcagagcctacagaaaatagagaaagcacagccaatgagaagaccacaccattcccagcagagcctacagaaaatagagaatggacagccaatgagaacaccacactatccccagcagagcctacagaacatgaagaaatgaccccattggccaatgagaagaccacactatccccagcagagcctacagaaaatggagaaaggaccccatttaccaatgagaagaccacaccatcctcagcagagcctacagaacatggagaaaggaccccactggccaatgagatcaccacaccatcccgagcagagcctacagaacatggagaaaggatagccaatgagaaggccacaccatccccagcaaagcctacagaacatggagaaacgacagtcaatgaggacaccacaccatcctcagcagagcctacagaaaatggagaaaggaccccactggccaatgagaacaccacaacatccccaacagagtctacagaacatggagaaaggacagccaatgagaagaccacaccatccccagcagagcctacagaacatggagaaaggacaccatcagccaatgagaagaccataccatctccagcaaagcctacagaacacgaagaaatgaccccatcggccaatgagaacaccacaccatccccagtaaagcctacagaacatggagaaaagactacattggccaatgagaagatcacactatccccagaagggcctacagaacatggagcaaaaactacgtcggccaatgagaagatcacaccatccctagcaaagcctacagaacatggagaaaggaccacatcacccaatgacaagatcacctcatctgcagcagagtctacagaacatagagatagggctacatcagccaatgtgatcacaccagccccagcagagcctataaaacatgcaaaaaggaccacattggcccatgagaagatgacacaagtcacagaaaagtccacagaacacccagaaaagaccacgtcaaccacagagaaaaccacaagaaccccagaaaagcctacgctatactcagagaagaccatatgcaccaaagggaaaaacacaccagtcccagaaaagcctacagaaaacctggggaacaccacactgaccactgagaccataaaagccccagtaaagtccacagaaaacccagaaaaaacagcagcagtcacaaagactataaaaccttcagtcaaggtcacaggagacaaatctctcactactacctcttctcatctaaataaaactgaagttactcatcaggtgcccactggttctttcaccctcattacatctagaacgaagctgagttctatcacatcagaagccacaggaaacgagagccatccatacctcaataaagatggctcacagaaaggtatccacgctggacagatgggagagaatgattcattccctgcatgggccatagttattgtggtcctggtggctgtgattctcctcctggtgttccttggcctgatcttcttggtaagggacagatgtgccccacagaaatcaacctatgggatagggaattgaggatacattaggggtcagagttacagggaataatgagtctaggaaaagagacatggcagaagtgggaggaacagtaatagagggagagttttggtgaaaactaaggagaaagacaataaatacacaggaggtaaaaagctggaattggggacaaggctgtggctgagaatgaaagggtgtgaaagagaaagtgtggggggtggagagtctggggtatgagaataggaggtgtaaagacaaggagaatatggtagagtggggaactggagatggagctgggactcattgtattggacctggagctggaataaacatcaaggtttggatggaatcttgagaatagaatcaagacctgaggtgagtgttgtggaaaacaaatcgcagatggttctcattcctcctttctcatcccaatcacaggtctcctatatgatgcggacacgccgcacactaacccagaacacccagtacaatgatgcagaggatgagggtggccccaattcctacccggtctacctgatggagcagcagaatcttggcatgggccagatcccttccccacggtgatcttggagtaggcgcccagccctggctcttccatgctctgcccctttcctggatgaggaaccggactcacaatttctatttccgggactacaggaagggcagagaatactgacggttaccagtattaacccttcatctgttcttgaaactggttggggaatgaggtgataagcaaggagggtgtaagtttaggggacaaagaagaaagaatgaataatacgagcagacattctctgtagaaggtaatggtctgagaatgaaaaggtgtttgatggacatgttgtgggggcaccaatgcagaacactgcactgagtcctaaaggaaggacaggagccttataggcaatgccccagactgacttgtgagtggggtttatggggaaagggagggactgagggcagagtctctgggtttcaggacagcattatgttatttccattcactattacttaagagtttgtgtgtaaacaggctcatctctgagttctcaggacccttgcccccacccccatttttttaatgaaaaaaaaaaacaaaaaaaacggatccaagaagaaaagagaatttatttccttctccactctctccatgccctggagaaaaaaaagtccagaagaaatcataaatatctctcatctacatggttgcttcctcttcctcccaaatcccttagttttcctaaatgtctacagtggacgccctgttggtttggcttgctgggttgtgggtggacacgcaaggaggggatttttatttggccagcagtctcacccactgatctccaccccagaccttccctgattggtgtctcagcatttattttcctgtctcttccaccaaaagccagctgtagctttatctcgtaaaagttacccatcttctctactgtccccattctctctcctcccaccttcaccccagattcaagttttcctccttgtaggcatttcatctgtgtgtgttttctggattttctctctctcttcttatggccatttcaccttattactgattgggtagagggggaaaaggagaatgatgatgatagtttccttctgtctattgaccttttttataataaagtataacatgtttataaagggcatcatagttattagactatccattgggagaaagttctgactggcgttcctggctctggctgagaccttacagaagtggaggagacagaggagctggagggcaggactggcaatctatggagggtcaagaaaggggaggctgaatttctattgctccaaaaatggctcctttctgggtttaggtaagagccagcctcagtccaggctgggtttatttgcatggtgacaaaatgagtagaaaaacctgtcaattaataagcaagtattttaaagcaactattatatactctgttgaggatataaagaagtataagacatagttctcacctgagacacaaagacaggaaaattaaaattaaataattcaacaagagttgtcacaagttaggtgctatatagaataaaacaacaccctaattcattaagcccaactccgtgagcatctactatgccccctatttatgttaggacaccagccctgctccaaaaccgttgtgtgcccatgtcagtcccaacagaaacctcccatcacccatgcagccttggctctcttaccagagtatggcatcatcactaattgaacaggtgccccagtttgctgccaggctcctaaacgtaactccatccagaatcaaacagcagggccacaggtcactcgctatctgctcctttgggcatccccatttgctgaaagctggaaacctatcatggtcagtaatcccaaccctgacactgatgtcactgaactatctggccctggctgggctgggaaggcccttattactgaatctcccaccagagacccgctctgctaaaggcaagattgaagcttgactctcagaaagcagacatgccagatgccagagggacccagacttaggcccctggagaaaggaggcagagggacacctgggttctggaaggggctggagagccctcgagaaaaggaggaagatgcctggattttagttgtctgggtagacggtgactcagcctgtggcatctgccaggacaggagtgtctctctgccctgggagggatgcagaaacccctaaactcagcctggaccccaattcaaaaacaaaacgaaataaaaacatctctgcctctagagtcctaaacatccaaccggacagacccctcccctatcaagacaccaaaatgcagcactggaggtcaaagggtgtataagggggatggggaggttcttcgcccggcaaaggcggactgtgggccctggggcgcggcgggtgtctccctcccactttcctctctattccccgctaattatcactttgaaatctaggcggaaatcctttaacaagctccggggctgggccctcattagggataattacttaatcagtaggacgggagggaatgcgctcccccagccctcggggagtacacctcggggggagcgagtgccccgagggcaggaggctgccggggcgccggaagctgctgtcccggcggagtcgcagcgggggctccggttccccgagactgcggccctccctcgttcctccaggttccgctttgcgggcggcttctgatctcttgcggacagctcagattagtggctcgaggccgccgcccccgcagcgccccagccctactgcgccgaatcccctcctcccagcccccagcccccagggaggggcctggactgacgggcctgggcgtagctcctacccccgtgacattggccataaaactgacacccgtttgtgctgtgctttcacgtacatcgcacctgtgatcctccgatcaccctgcgagttacgaggcctgctttacaagccttataagaagttacagaccttataagagttcttataaagcttgctttacagatgagaaaaccgaggctcagagaagagccctgttcaaacccacacggctcctatggaacagaaggcttgctttattttctccaagcctcaatttcactttgttcctcagtggagccaggttctctgacaccaaggcagccccacctggacgggtgggatgttacagggaccacctaaggaacagggtgtaattgagatttgcacgagggtgtccagccccttcttccagagtccaggcctccctttccagctccttgaacgtccagagtcttcttctggcctcactgccagtatcccaggtcagggttttttctgccagcctctgtccccggagacacattaactggcctcatagtcacaggctctgcatcctcccctcacagtgcccagctgtccctggagaggtgctggcaaagtaagaagatccaatgatttgggacacagtcaccttcatttttctcccctctgcctcctacaaaggcctctgtcccagaaatgagacatcccagagaaaacaggtttctgctgacctctggctgggagggtgggtctcctctcctcccacagatgtgattcccttgttctctcccgctccctccttcttccctcatattgtcatggccttaagatacccctccctggagagggagcgtccagaagttacggcctcccctgcctggtggcaactataaatgccacagctatggtcaagtgagaaaagaaattaagccagacatattgtgggagcaaccctcagaacccaggaatccagcattcccagtccccactcaccactgtcttggaacctaccccaactgatcttactcctcccagaaccctgcccctggcaagcttttaattcttcctgcaacttcatgtcccattgagacaccaggcatcaaggccccctctggagcccatctgccctctagaacccaggcattctagataacaacttcccacatggattatttcaagatgaggtgagggaaattacctcccacctcctgcatccaggtgatgcttctctttggaatcttgagactggtaagtgaattatccatcaatcggagaagacactgaggccacaaaaagtctgaaggagacaagggttcctgtcccaggcattctgtttgcttttcttattctcattcttttgcaaaagcaaaaagcaagcaaagatgatgaacttcttttttgcccctttctgcaaaagccagtactaaccttaacccccactaaccacgattttgacccccaacttcaccttgcagcaaacccaccttcatcttccccttccaatgctccgctgtaagcatgaacacaaataatagctgtgttgtatttccttagaatcccgggtttaacggctgctcaacaaatgctttgtatctaacttgaaaattctagtttcaatatcatctttaaatatttattagagctaggctccaagtctaaagccaagtgaaatgaaaatatcacttccagaaatactgcctaaattaaaatcctcagtagggctttcataatccccggatagagacagggagggatccttcggatcccagggatacgggaactgtgggtgatattagcctgaagagaagtacaatccaaattcctgtcttcctagccatttcacctgacttctctccacctgacttctctccttggtcccttcaatgtttcaagtttctctgcctaatgactacaacccaatgtcaggcagatttataaagccccttcgcttccactgtaggatggaatgccataaaaagggagcaaggagacagttgtggaattggaataaacagaaacagccctaggctgaatgaacaggaggctgctttgtggtggcttctttgatgtctgtttcctgcatcctctctctgctctcttatcccaggcactctcctggagaccctgccttgcacatcctgttcttttcctcctccctgcgtctctgtgagcttgttcattttaagaggcccaaattattactgcaacaggcaacttccaaactcatattaagtctaccttggctctgaaatccagtcctttattttcaattttttttcaataatatcttcacttggatgtcacatcatatcaaacgtgacattcacgtgttcatctggcaaacattttttgagcatctactctgtgctagttctgaagataaatcagtgaacaaaacagcaacaggccctgccttcagggagctcacagttcactaggaaaggcagagatcacacaaagaaggcatataataaaagagaggcacaagtgtgcaaaatactgtcaggacccacctcgtcttcccaccatcaagtctaaaaagccgccttcatcagcatccattctcccctgctaacattggagtgttcgtgcatcttggctctggctcccccatcccacacctcctgccttcttcatgggcttcttccccttccagtttttccttctccttctacagggtccttcccaacaccagccaaataagccctaagcagtgtgcacaggaagcacccagaggagagtatttttaaaaagtagatttctaaagacccggcacggtggctcatgcgtataatcccagcactttgggaggctgaggtgggcggatcacgccaggagtttgagaccagcctggacaacatagcgaaaccccgtctctactaaaaatacaaaacttagccaggtgtggtggtgcacacctgtaatctcagctacttgggaggctgaggcaggggaatcacttgaacctgggaggcagaggttgcagtgagctgagatcacaccagtgcaccccagcctgggtgacagaatgagatgctgtctcaaaaaaataaaaaataaataaataaaatggagatggccactggatgcagtggttcaggcctgtaatcccagcacttttggaagacaaggtgggaggattgcccaaagctaggagtcagagacctgcctgggcgacattgcgagacactgtctctattaaaaaaaaaaaaaaaaaaattaacaagttccccaggcactcctgatgtggtccagggacacactttggaaagctctgctctgctggcagccatcttcacagacccccacccacatcttctcagccttgcccccatcagctccccttcatcaccaagcctcttgaaacaatcccctacaaacactatcttcatgtccttatctcctactctctgtgtgtatgtattttctctgcaagttttaccagagcaatccatgtaaatagtttaaagagtccaatagttccatagatttattgcaaaaactagcacggatgcaccctcccccttttcatgtccaattcctgttctccagaggagacgacttttaacttttagctttttatcccagtatttgcaagtgcagatttaaacatcatgcccatattgtattgcaattcatagattttttttaatgagaccttaaattgcgtcttttattggactaaagaatattgtaagtctcaaaatagcttcctgtcccaatctcacctctgaaaggacttactaatttaaatatatctactatgaactgaacagtgtcccccctaaatatgtttaagtcttttttctattttttttttgagacaggggcttgctctgtcatccaagctggagtgtagtggcacaatcatagcttgctgcagccttgacctcctgggctcaagcgagcctcccatctcagcactcacccctcccagaggctgccaccatgcccagctaattagttttgttttaaattttagtagagaccatatctcactatgttgcccaggctggtcttgaacccctgagctcaagtgatcctcctgccttggcctcccaaagtgctgggattataggcatgagccaccgtgcccggctcatatgttgaagtcttaatcatcaatgtgactatatctgaagatagggtctttaggaagtaattaaagttaatggggtcataagagtggtgcccgaattcaatgggactgtggccttatcaaaggagaaagagagttctttctgtcttcactatgtgaggacacagcaagaaggcagccatctgcaatccagaaaggagccctgacaaggaaccaagttgtccagtaccttaaccttggacttcccagccttcagaactgtgagaagacaaattaccattgtttaagccacccagtttgtggtatttgctatagcagtccaaggtgattaagacagtatccaatatcatggagggataaattttcttttcaaaacaaaactaaaaatattttttaattctaatttttaaaaatcagtaaacttcattttagcagtaatcataaaataaaatgcaaaggaaattctctaagttacatgactcgagagaaaatatccatatctattgtttctgttgtttaaaacataatttatctagaatttggctcataagttttaaaacaaactgtatgaaaatatgacagtgcatttactgttaactcctgcttatgttttagaaagctcttatggaaagaaaaaaaaaatgctttccaggtagcagacacagataggttatttggggaattgataactaaaaattagagtcttattttttattttttatttttttgagacggagtcttgttctgttgcccaggctggagtgcagtggtgcgatcttggctcactgcaacctctgcctcccaggttcaggcaattcttctgcctcagcctcccgagtagctgggattacaggcatgcaccaccacacctggctaattttttttatttttagtagagacggggtttcaccatgttggccaggctgatcttgaactcctgacctcaggtgatccaccgacctcggcctcccaaagttctgggattataggcatgagccaccatgcccagccttagaggctttattagcattcaaaaccatggatgcaatgaagtgtggagtactcttaaacaagctccaagtccatgaaatgccgtgtcagaatttttcctttcctttttgcatagcaaagtacttgcacaatcccaaatatttgtcttcctgagcagcagctacaaagatgatgccaccaggcttggccagggtagctgctgattttcccttcttcctcctcctcttctcctcctcctttttcttctaattcttcctcctcttcctcttctctctccctctctgctttctcctccgccttcttattttcttaaccatgataaaatatacataacttacaatacatcattttagccatttataagagtaaagtttagtatcattaagtacattcatgtggttgtgcaaccatccctggtaatttcttcttgattctctgtcccggaactactaaactcaggctgggtttagcataatcgttgcctgtgtacttgaaaagtggagagttgctgacctctgatgggtagcttggtcttgctgggcaaacccttctggaagctgttctagcacagctcagccaccacttgcacggactcctgctgtgctggagctctcctgacacagctttcccagctgcacagtcgttgctatgtagaggaactaatacttgagcgactattttcttatagttggataactctgtttccttataaatatttttctttataaatagagagtgctgtcccatcaatcctgcatccttatactagcagtcctgaggcttttcctaactgttcagctgcctgttgaggcattccacatttttaaatgcattgctgtttgttggtataaccgtacagccttttctgggtctacattttctctgagctttccagcttgctccaatgcctctgaggttgctgtgtcagtgctgctgttttttagatccatcaaaggctgggatttctgcatttccttcaacattgtgtcaactaggttgggcgcggtggcttacgcttgtaatcccagcacttcgggagactgaggtgggcggatcacttgaggtcaggagttcatggctaacatggtgaaaccatctctactaaaaatataaaagttagccgggcgtggtgacgtgtgcctgtagtcccagctactcaggaggctgaggcaggagaatcactcaaacccaggaggcggaggttgcagtgagccgagatcacaccactgcactccagcctgggcaaaaagagtgaaactccatttaaaaaaacaaaacaaaacaaaacaaaaacaagaaaacattgtggcaatttgctcagaagcgctacttttccatattcagaagggcactgtcacagtacggcttccattttgaaaaaccagtctgcaggtatttctttgctttgggcctctcatttcttttttggtcctgcacatggtcctgcatggaggacaggagggacttttccttttggcccctgaaagagtcccagtcagctatgcataggtttttcatttcggacatcatccatttacttattcatggtctctctcccttatttgaatataagctctgtatcaacttttcaatcactgtatcccatgcctggcacatcatgtggcccacagaaggttcttaaggaatatgtttgaataaatgaatgagaaggcctggatgcagagagtgtatatcagagagaaacccagactaatcccccagattcttctctaatccattcccagtgctaccacttaatctagtatgttatactagaagagtaaataaatgaaagtaagaaagacaggaaggaaggagggaaagaaggaaggaagggagggagggaggaagaaggaaggaaggaagtaaagaagggaggaaggaattaaagaagaaaggaaggaagagaaagaaagaaaaagaaagagagagaaagaaagaaagaaggaaagagagagagagagagagagagggaggggggaggggaggggaggggaaaggaggggaggggaagaaatcttcccaaggacttttccccctagtatctccttgtgtctctttacaaactgcctaactcatcaactttcaccacctgaagaggctggaaaaaagctggcctcctgtgaattttacaccccggtgctctcagatggtggatgagaacctgcaggctcccttcaggcagggatcgtgtgctgaacgtcccaaagagtgatgggggacttgcaccagagtgtctctgctcaagctgccctcctatgacctccttgtcacttccacccagacaaggggattcttctgatcagtccagatgacctggatgaagttttctttctttctttctttttttttttttttgagacagagttttgctcttgttgcccaggctggagtgcaatggcacgatctcggctcactgcaacctctgcctcctgggttcacgcaattctcttccctcagcatcctgagtagctgggattacaggcatgcaccaccacacctggctaattttgtatttttagtagagacggggtttctccatgttggtcaggctggtctcgaactcccaacctcaggtgatctgcccgccttggcctcccaaagtgttgggattacaggcgtgagccactgtgcctggccctggatgaggttttcaaacaacacactttcccctaatctgatgagacccaactatccttagtgttataacacacacagagataatgtggagcctccttaacataggttagattttatttcacctaggcaagtacagttccaaaaaacattatggcagaaaggacaaggtgccaagaagatcgatcaaatgactcatgcactacagaagcacagctgaatcagcaaccgggcccttagctgcggaggaaactgcaaatgctgagcctctgaaatacatgattccaaataaaaggtaacgacaccagcagttctgctgatgtaaaggaaacaagaaagacatatgcacgatgctcctaattaaatatcaaaaatgtaaagtaggtgtcgtatttgactaaaaattgatatttttcaggaaggactatgcccccagggcccactgtagcctttgagaccatggtggagtctgtgtccacaatggcctcaaccacaggctctgagagtacctcaacctctgagatcatcgccatctccaccatggactctgagacctccataggctcagaagccaccacaactattgttgcagcctctg

SEQ ID NO: 278 - DNA, 244863 bp, Homo sapiens
attctgaggcctttaaatatatgaacttaaacctcacaacatccctgtaatgttggtactatcattatatacattttagttttgctttgttttgttttgtttttgagacggagtctcgctctgtcgcccaggctggagtgcagtggcacgatcttggctcactgcaagctcagcctccaacagtcacagagagattgtgcaactggcccgagtgcacacagcaacagagcctactttttgaccaaaagaggccgaattctcaaccactatactgtagagcctctgtacatgatagaagcaataactgaacctcagtaactctgtggaagtgatttgtaatttgcatgtcgtttcaagcacactctatatctatattttattctattaacttcctaagtctttttaatgaatagcaaaaaaagtatatttcagcattatcaatttaagttaatcataacatctaataggtgacatgtttattttttcatgagttctaattacattttcaagttaagatcactgacttattccctaagtgctcgatctaatgttctgaatcacaggagtatagatgcattattcaccaatattgtttacttttttaaataagattttttttcatggtagaatcatcatatacattcaaaaaggtagacaaaagagagacactcacagtgtcactgttaccaagtgccaggacagatatcagtaaggcaccagcagtcatttttagtgatcaaataccaaacatggtaagataccagagtatttttcacatgacacccaaaaacatattctctgctatcgtggtagagcagaaaaagaacactttcttttcattttacagtatattacgaacctgttccacgtcattaaatattcttctaaaaacccaattttggaataatattctattttattcatatactgtaatttagctaatcaatcttgtatttttgaacatttaggttttttccaatttttatcattataaaaaatgctgtaattaacatccttatttgttcatgtccacatttctttttatgaaaattcagagaaaggaaatgtctggaccaaatggcatgtacaatattaacacttctgttatgtggtttcatattctgcagaaatattactgccacttctacattgtacaagagatctcatagccctaaacatttgctttcatagataattttctgttttttagaaatcttttgtctctttggttatagaaaaagagaacctctttttaattttattttttaaattactagtcaggttgaatgtttcttgttcctaggtcattaacagtttttattttggcaattgtctacagcccatttttctgctgtgttcattttctaatcgaattatgggatttatcttgtaaaaagcctattaagcctttttcatactttacacaagagatcacatctacttactttaccttaaaataacatttacttattttcttataaaagtaatatattatgtttgaaaagaaaaataatatgcaataatatacaataatatgtataatcataatagacaataataaaaatgaaaaaacaccaaccagaggtaattaacattaacatcataatattcttccaggctttttcagatagacaggtaggtaagtaggttggtaggtaaatagatagatagatgatacatagagagagatagatagataatttaaacaaaaataagatcatactgctacattacttcaagccttgcttttatcacttaatatatcttaaacatcttctacatgaacaagtattcatgtgcaacattaattttgatggttgaatagtattatacagatttatcgtaattgacataactattctactgttagacatttggtttatttctatttttccattataaaatgtaatgtttggatcatcctgttgctaaattttgtaagcatttatcttaagtgatttctttagctataactcctagaagtgaaatttctagattaaaggataaatgcacttttaatactttttaaatatattaaaaaattaccttcctgaattattttattaacatgtacctctcctagtcagataagacagcccatttatttcagtctcaccaatactgagtatagcattttaatcattgccaatataatagctaatagcttaaagttatttcatagcttatatttacacttctttaaatactaataaaattgaacattgtttaatgttttgaggatacttgattggtgatttgcctcctactattatttttctactgggtatatctttttcttgttgctttgtaagagcactttatatattaaggagttaaattttgtgatatatgtttcaactacttttatcatgttaaaaatatagacttctatttgtcttttattgtaggttttatcaatcagaaaagaatgttgacttttccgtccattcagatgattgtggcttttttccctaatggatttgttaatatgttcaattgtatgaatttatttcctaatgtagcgatatccttgtcttctaggaataaactttttgggcgaatcatatcaatcttctacttaactaccaaattaatttacatatatttgcatcaatattaagttcataaaattaaaagtttatcattttcatctctgttagagttttgtattggcattagcatttgtattagcattgtattaggaaaaactcaggagtttttctctataatcttggttagtttatttttaaataattgttatttatgaaagtaatacataaaaatgttgtttaaaaaaactcacaagagggtaaaaattaaaaaaataataaaagttcccttcttccttttcatctctagtcccagcctaagtgctaaccacttcacccatttatagtgttagttcttctggtgattaccagtgcaattctaacaaataggtttgcatttctctttctgaattgatcaattttttaaaaatatgcagcactctgactcaaactccctttctttttcctgagatatgttaacttctaatgttatattgtttatcacaactttcacaaatatttctaaataaaggttacctactgattctggattgtgctacataaaattagagcttccaaatttccctccatcacttctccctgctctctactctcacaatcagtcaactatacacctatttctacgctgtcaactatatgttcatttctatgaatctgtaatatttgcattttgttctggaacaaattaagatttaggtgctttgactagattgattctaaacatcaaaaaacaaaaataaaatatctgcaattatgtgatcatgtatttatgcattgccaaataatggtattccattattttaatttgataagataaatttaatatacattaattcttatttcctctattttatggaagaaatatttttaaaaatcacaaaacttttacattcgcttctcttcctgatatttatttttcctttttcttctgcctctcttctttcgtgcccttttttccgaaaattattttgatgattttttttattcaccatacataattacaaatgaagagttgctctggttcgtattggtagtagaagtggggtccctttgctgttttgttggtatattcacccagtgtgacctcttttccgtgggatggctacctctgggctctgattatgtggctcatagggaagtataggcagcctgagtcagaatccccacagttccaaagtgatggaagactgtactctgagatacaatattttgacgtatttcactcccagggagagctacttgctattctttcactgcttccattacccaaaagagtatgatattctccccattttctgtattgcctcacacctaggacccttcaaacccacaccaacgacctctcaggcaaattgatctattcagatagcagtttacagggatagacatgaggcctcttggcccacctgctctatacacaatcttctagtcgaccatcctgattgacaacccacagcccacccctgtctctgtatttgctgactcagagcatggagactttatacatgtgaaatcacatctcccctcccctcacgcttggcttgtgtgtattgcaaaagctgcaatttagtttttcctgtgccttgtcttacccatggataagaacactaagatactttccgctttttgaatatttgtcaaagtgatggcacttggattggtttcagcatgtacatagattgattcttattcatatacatttactgtcatattggggaaatcttgaggggaaaagaaaagcctcttactaccatgttcatcaagagtcctctctggaatagttgaaatagtttaggagttatcggttcactccttcgtcttgtttgcctccagatttcttttttccttcttttcctgtttcttaatgttggaacagcccacacctcaatccttggatgacatctcccttttatctgtattcatccctagtgatctcttctggttgcaaggctataaatgccatctgtatgctgagatttttttatttttagttcaaacctctctccccaactttacactcacatttctaactgtgtgttatagatgatagctttagattctcctcctcaggactaggctttctgcttgatctaggagcaaagctgaaaactgctatggagcttggtgttgccttgataccgaggaggagtctcagagcctctccagtgcaaatacacacttgcagtgtcctagtgctgctgacttacgtactcattctaaagagggtagattgtatccattttaatagctctcaatacccttgcccattcccattacagctggcagaaattccccagctgcaaatgggttgcatttatctgttacccattcctgatttgcagcacgattgactgtttccttttctgcgtggtctatgtgtcactccatgagaatctgggagaggagaactcgatatggtgctcattccatcattttaaccatagtgttctttattgtgaagaggtatcccggttagagtggagtcaaagctttatagcaagtgtatttcaggtaactattcttttacttgtttcagatctatttcagtagcacagccaccaagatagaacacttataagcccttattttggtatagatcaccagagaaaccactcaccactcgcacttggccttcagtactgagtcattacatattggaaggtcagaaactacatcaacaggaaagacccataggtgtgggggtctgatatatttgccagtacatttcttatcattacaaacaaagatttatgtgtgtctagatgtttaccttgccttctaagaggtcatgtcctctgaatgaagcaaaatcaaggtaagcctttacctgtaagccgttacatgtcttctttacagaatccctcttaattaaaaacttctaagagattcaacagggttagtttttcttacaaccttcatcgtcagacctgtaattatgcaactggccagcattgctctttcaaaccacagtctctggaaagtacacaccgtatatagcattttgcccataagaagagaaaccacctgtagtatctaaggttacgtcagagagatgttaaccacaaaaaaacccagacttagatacacactatcattttctgggtgtgttcttgaccatttagagctgtgattaaaattagaagtgttggcatgacactgctttctgactttcttttttagccatgttgacaccgtggtggttagtgtgatgctccttcttatttcaattgatgctttactcaagtatggatgaaacataatttaaagtcacctcttcttctgctatcttgatttttaaaattatttggatgcattatatttaagaatcttaagacagtccattagtattatgtatttatcttctcttcactcgtttaagtcactttctgactcagatcaccttctcaggagactctcagcatcattctgcctgacatcactcagttgctttgtttatggcaacctaaaaaagcagctgccctaattttagcccattcccagagtaccctcagaagtgacaggtaagaaaaaataaactgatcaaagatgagagaaagacttacagaggagtgacactgagagagcaaaaaaccacaaataaatttcatttctaagaacaaagcaaagatgaccaggaaatgcctgaggaaacacattttttttttttttttggaggcagagggtattatattccttttttttcttcaactttcattctagattcagggagtacatgggcgagtgtgttatgtggacatgttgtgtagtgctgatgttttcagtacaactaaacctgtcacccgggttgtaagcatagtacccaatagatagtttttcaacccttgcctcccttcttcagagacctcccccttcttgtattccccagtgtcttttgttcccatctttatgtccatgtgtactcaatgtttaactcccacttatacttgaggacatttagtatttacttttctgtttctgtgtccattttgctgcaaaggacatgattttgttctttttggctgcatagtattccatggtgtatatgtatcacatttactttatccaatcaaccattgataggcaactatgttgattccacatcattgctattgtggatagtgctgcaatgaacgtatgggtacaatgtgccttttggcagaatgattgattttcctttaagtgtataccaaaggaaatgggattgctgtatcaaatggtagatcaactcttatttatttctcattcatttctcaaataatttctcaattatttgagaaatcaaggagacactttttttttttttttttttttttgagacagagtcttgctctgttgcctgggctggagcgcagtggcgtgatcttggctcaccagaactctgcctcccaggttcaagcaatttggagacataatttttaagacatttttaaataataaacctcaaatattttagggaaaacatctttatctctgtttctataactgtcaacctctttctaataagctttgcaaagctatatgaaactagtttttaatttttgtatacttgagacaattttggaagaaagtaggtatctactcatccaatttcagagaactctgagaaaatttagttattcttatgaaagatctattttcttattgcaataactgtgaatttatctggcacttggccaaacttagcattaacaggtaatacattatattcacaacagaaactagaagatgattccagaacaacacagccctaaaggaaaaatcattaattgtttgacataaatattctacacttcaaaaatctacacttagattttttttctaagattgttttgtattatttactaacctaacagctttccattaacaataaatttagaacttttttatattttaaatatcaatgtgtgcattattttggtgatgacataataaatcattagatgttgcatacatgttatcaaatgtatatggaggttgcgtaagtgttatcaagacaggcagcagatggagtgttgaaatatatggactcagggctgagtctgctgcctgtcaaatcctagcaatttacttaacccctttgtgttcaattttcctcatttatgaaaagagaataagaatagcaccaagctcataggttattggaaagattaaatgatttaataagtagaaaaggcttagaaaggtacctaatacacagtaaatacttccaaggactttgctaatataattgtgtctaattttttgcaattatatagaaaactgacatactatagctaaatcattacacagatctttttactatttcctgcagatacagcaatagaactaacataattaggtcagatgcaataaacctttttaggaattttaatatatgttacaaaattaccctccagaaatcttgcaacaatttacacaaccaatagcaatgtttgaaagtgcttatttctgatacttcagctaatttagcatgtcatcaaatttaattcttagccagtttgataactgagaaactttagctccctgtttaaatttgatttttcttttaaattcctgcagatattgtttgcttttcagattttttaccagctgtttttgggcagtttgtgaattgtcaagtatgttctactgtttgtcttctactgattgttctccacctggactgagtgtggatcctggaacagtctagtttttcttgggaatcctgttacaatgtatgttctagatctaccctccatatttattatctttagcctcattgtatacattttatatcaatttcttctgagataggtaaatgtcttaatctgattttgtaattcattacatctcctatctgctttttactgttttcattgcattattttttatttaattatttttaatagtaatacattcacttgggtcaacattcaaagatataaaaatctacacagtagacttctacttataagaagagggggtggatgtgctttttcctcttccttccactaaatacaactaaaaacccgaacatcacatagaaaaccaacgtggaaaagtagagagaagtagacagttcatctaggaagaagacagagtcaaggaatgacattctggtgagctctctgggttttctttgggcctcagctatctcaaacttgaagctgaagaagccagcaacacagaaacgccagcgggcatataccaaaaaaaaaaaaaccaaacaaaaaaaaagccccaactaaagcctgctatctttagacaaaacaccaggaaaagggcacctagcaagacagaaaccttttagacaataattgctctcttctagccaaacaccacgcgcgcacacacacacaacaaacaaaaaaaatggcctcacctccacccacgccagcaaagaccgagtgtggatcctagacttctccctcaccaggtgtaataaggagctcaaacttcccacaggtgtgagtcagaaaagtcctcttccacaactcagactttcatgcctctgagctctaaatgcatatagaggaaatatttaaggcaatatattataaacataggaggctaaagcgatataaaaggaggtcctttctacactttgtttgaactggtaaaatgtcgacactagtaactgtgataagttacatacgtactgtataatgcatgtataatgtaatccctagagcaaccataacaaaactccacaaaaagatacacttcaaaacactattggtcaggtgcggtggctcacacctgtaatttcagcactttgggaggccaaggcaggtggatcacctgaggtcaggagttcaataccaacctggccaacatggcaaaaccctgtctctattaaaaatacaaaaattagctgggtgtggtggcacatgcctcccagatacctgggaggctgaggcaggagaaaagcttgaactcgggaggcagaagttgcaatgagccgagatcacaccactgccctccagcctgggtgacagagcaagactgtgtctcaaaaacaaacaaacaaacaaaacccactatagatatatcaagacagaattctaagaaatgttcaagtaacccacaggaaggcaagaacaagaaaacagaaaaaaaaaaaaaaaacagagcaaataaaaagcaacaaataaaatggcagacttaagccttgacatagtaataattacattaagtataattatcgtagaattttaaatgtttagatgggcttccagtccaagatggagagagagcatgtgtttgcctcaccacctggggtctcaatggactacggatttggataaatttctgcaaaatggaaaacacatggcatcatactaacagacaagactcacaggaaacaaaagagtgatacaatagaggtagaaaccatctgtttggttctatccttgagaggctaaatagagactatttccctagagctactaactaaaatactatcacctggcaggaagcagtgggggttgggaggaggggcggcagtgaactcaaaatagatgattacctttctggtgtcagtgcctggtccatacccctcactcctagcaacagttcttcttctccgtttccttccttaaaatcctccattaattttttattcattcatttgaccaatacttagtgattagctactaaatgctaggcactgtcacagttgctggggaaatactagtgaacaagataagtctgatttgggggagttttaattctactaacgaacaaataataaatatgaaaacaaaaatataaacagatcattttaaatagcaatgagttctatgaaagcagagacattgcaggaattagtgtatatccttccacctgctcatcacaaataaattcattagcaactgcactgctacgacatttcaaaggctgttgaaattccacgtctccaagggctggagttctcattgctatcagcaaatgatctgactccagaatcccaaccttagggtatgcttcctaggactactcttaggatacagggttaggtcatgtattagtccattctcatgctgctaataaagacataccgaaggctgggtaatttataaaggaaagagatttaattgactcacagttcagcactgctggggaggcttgaggaaacttacaaacatggcagaaggggaagcaagcatgtccttcttcacatggtggcaacaagaagtactgagcaaaaggggaaaagaccacaccatcagatctcatgaggacccattcactatcaggagaacagcatggaagtaactgcccccatgattcaattacctcccaccaggtctctcccacaacacatggggattatgggaactacaattcaagatgagatttgggtggggacacagcaaaaccatatcaggtcaggttcttgaaaaaccaagcctgagataaagattcctgtgcaagtggtttatggagggagtgctctcagaggaaatgcctctgggagtgatagaaggaagtttggttagtgaaggagctgggcaaaggtgtgttatcagcggaagtgtgacctcagcttgcactcacagagagctctggagtatgagttataccgcaaagattgtcctacccagaggcaaagaagattgaattcttatacccctgctttgcctttggatatgagccaccctggggcaagggccagaagtgggtaacctctcaggcatctccacatgagacagttcctgtcattcaaaggcaatcctttcaagaagggtttcttaacttcccaactttcaatttgggaagatttcttattgtctagcttatttttatagacacagtcatcttattaaataatagtgacacactagccttatatgttgaagacttcccttaaaactgctaacagatatggcataaatcattgtaataaaatcaattctttttggttgatccaagattccattttccttctcgttgaagaagtaggtgaattttaaaggaaagaactaactttccaaattcaacctgagctagttacaaaataaataaaacagaaactgcccattctaccttttttatgcaataataacaatacacacttagtccactaattaagtcttcccttcaagaaagattagtaatttatttagtaattaattactaaatattaaaaaaatttagtaataaaattagtaattttattacattagtgataaaatatgtgtgccaggtgcagtggctcatgcctataatcccagcactttgggatgccaaggcagaaggatcatttgaacccaggagtttgataccggcctgggcaacataggaggaccccatcactacaaaaaaaatttttttaaattaaaaattagctggacatggtggtgtgcacctggagtcccagccactctggaggctgaagcagggagataccttgagcccaggaggtcaaggctgcagcgagccatgatcatgccactgtactccagtctaggtgacagagtgagactctgtctcaaaaaagaaaaaagatttctcccaggcttttggagttctcagagtgtcacaaatgctaagaacagacaaggaaagaggaagaaaaagtacagagaaacaatcttctatcccctttagtatttgcaaactatagtgtgtcccttatttgtttcattgttataatctggattcttggcatttaagaagaaactgagatttttctgtaactctgatgaagaacattcccggaggccaatgtctctatgtgctggaaaccagaaaggggaagtgtcccagctagagtctggtaaaccataattcttcctattgtcaaggatttcacatctttgctcacacatgggaaagttctcaaagtagatttgacaatatttcacaaataccacaaaaggaccatgctcagcaaagacaattccaggcttggcactaagcaatgtaatctatcaactggcaccagtgagtctcacttggtgtgaatgttccacagcacagaccagtaccactcttagatctgggcaagaggagactaacttgggcactgtgattaagaggatttcactctggtctttctccaggcaccatccttctcacagggtgagggtcccaggggccaaagggctatgcctacctagaaactgactcccttcttttaaaccatatttcagatatgaggggccccagaatttcagctctgccactggcccttttctgagtccctctacccttgagtggacagtgcctctggcagtcatatctttaggctgggggttgtccaaggagcagccattataagaagaatgaacacagatgtgttcacaagacctttcatgtgttgggcaaactcagggtgggaaaagagagtagaagggctgtgatccagggcctagctcttcccacaccaccatacttcagcagagacctcagaagagtcctaaaactctctatataaatagtattcagtttaggtaataattgagttactatgtggcaggcacaatcaggactggcaggcactattctcagtatcatatatgtatacacaaatatatatatatataaaatatgaattataatatattatatataaatatattcacttaattttcacactaaccttatgggaaatatgcttacagggagattaaataacctgcaccaggccatacagcaagtggtgggcccaagatttgatcccatgcagcctggttccaaaacatgtactcctatttcaccaaatacaattttgcatccctctgtgaatttctagattagataaatttgacgtgtatcacaatcttccttggaatttgctttgcaaaaaaaaaaaaaaaaaaactaaacaaaccaaaacaacatgatttttttggagaaggcaacttgcttagttaaaacaacagggtggatccggtgctatatagagcagtttgctgcaagaacacacagcgtagggaacttaacccagaccatggaatcaaggggcacttccagaggaagacagtttctgaaataagtctgaaaagataggtccaagttaggcaagcaaataagatgagagcaggacagtccattctagcctctagtaggagaacaaaaacaaataggaaagagggccctttatttttttttcatgggtgggattttattaaaattgtacatagatctcaaatttaaatttaaaaatgagcatttttttctagtatcaaaatagttattttaaaaataacttggaagccgggcgcagtggctcacgcctgtaatcccaacagtttgggaggctgaggtgggcgaatcatgaggtcaggagtttgagaccactctggccaacacggtgaaatcccgtctctactaaaaaaaagaaacaaaaattagccggcgcagtggcgggtgcctgtagtcccagctactctggaggctgaggcaggagaatcgcttgaacccgggaggcagaggttgcagagagcagtgatcgcgccgctgcactctagcctgggtgacagagcaagactctgtctcaaaaaaaaaaaaaacccttagaaaactttaatacaactttgttatatattaaatattcacctaaaatctcaatcatttctctcccatctctctctgctagaatcttggagggcccttcatttataagtaactcactgcaaacactttcaagacaagagtgaggggaaggtgaagaggttagagctgaagtgtttatcatatctctaagtccatggcttttaacctaaaagccacctctgaaaatttatctggaggaaatgaaaaacctgtgtcactactctgaaaattcagattttttaaatattcagggatagatttatagaaacttaattgtgtataaccttaccttgtgggcaagaaaaatgactctcaaagatgataaaaatcagtagttgtcgagagtatgatcttttgattcaaagtagaaattcacttttattattaatctttattgggcctactcactcctgccagagtgggtcatgcaaaggctctggggtcttaagcagagtacagtatttggtaagaatgttctagggtttggtttacactgaccaccactgagatgcccattgcgagtatatgtagtcatttgaagtttgggacttctgccatgtctatgccacacttggacattcaaatcattacagagtcagtctaggaactcctgtgcctacggttcggtctccttaggtgctctaagcaaccatttgccctgggagtcatgccgtttcaccagggcacctagagagtgggttcccatcaccactggaatccaaagacctgtctcctcagccttagagaagcgtctccattctgttgctacttttttatcctgcttgtttaaaaaaggcattttcctctccctagtttcccttttgagacctttaacatattctctccaattgcttttggcttttctaaatgccaaaaagaaagcttgtattcaagcaactcaggctttaggcactgaaaaaacatccatagcaaaggaacaaaggccttaaaactgggaacaggccaggcacggtggctcatgcctgtaatcccagcactttgggaggccaaggggggtggatcacgaggtcaggagatcaagaccatcctgggcaacatggtgaaaacccgtctctactaaaaatacaaaaattagctgagcgtggtggcacacacctgtagtaccagctacttgggaggctgaggcaggagattcgcttgaacccgggaggtggaggttgcaatgggctgagattgcgccactgcactccagcctggtgacagagtgagactccatcttgaaaaaaaaaaaaaaaaaaaaactggaacaaattccagaaggacaagcatctcaaatatctctgttttccagcagcaaaaataataataatgattcaacgaatgattatataggatatttgaattgttatacattttgcatcattataaataacactgtaaaaacttcttatatggtatttgtattcttgggatacatttcaaatagtaggagcacaatatatcacttgaggtacctgcttacttaagcaaatgtaaggtgaggtcattaatgtcatgactgaaagacaaaagagaagctttttgtcagttgctggagtccacttttcccatgaataccttgttatactctgaaggtgagacagagtaattttcaggaagccattggtttcctggaggaaactcagctcctcgtgcctaagattcaaagttagaaggactcatcagaatggactgagatggtctcgtgcaagttcccctagcaagaaagcaagcaaagtcccccagaagcactcaccagaagggaaaggaagtttgggatggtactggagctcaacacaaggtatgaaaattgggaagcagcatgaagctaaagtaggaagccccttgccaaagcccttgcctaagcccttgccaaagcacaggcatgagattggactagataagagatcactgcacagtgaataagcatccaccagtctgcatagaccaggtctccagcagcaagagtgttgtgggcaataactacagcagtagagctgatggactgatttctccttctagttccttgtctcctctgggatgttgaagcacagctagtcttttttgcctggggtccttggacaattgaggatacagaaggagagaacataagaggaggaattggtgggtgtttgaagtagtaattgaaaaaattagacatgtgaacatgcttgtgtcccaagctggaaaaacaggtcaataaatacacatactatcagagtcacagtaaatgcatgtactgtcagagtcacagatttgtttacaaccagagaaaatacagaaaaatgtagcttctttgttgcttcttcaagtattctcacctgctgtgtagaaaggaaatctatctttgagcttactacagtaaatttggtccaccaactttatttagcagtccttgtagaaactcagtcatctcctataaaattctgtggctctcagatttttagatggagtgacacatcctctgtccttcttcaggatgggatatgggcagtggtaaaatgattacctcaccttatgagagcaacaaagaggacccaagattacatgcagtgcctctggattcttgctggtccttacagcagaaatcttgtctgtgtgtctccttgactgtgaccactgaggcagaggctactggtcacaaactagtatgtatgaccagagaccacagccaaaggcatttggccctgtcccaaagtctctacctcctacctaaggtgtacaaaaaaaataaaataggtcaattgaaaatagctgaaatattgagggatatttagagtacaagagtactcacagcagtattgcaattacaatgtgtatacgaaggccttattgacttgatttacatttttttcttctttcaatatgttctagttagttgaacagattcccaaacaacccaaaatatttttggtttaagtactaggaattataattatacacctttcatgaatgaatggtcaaacaaaattcctgccagagataagttttccagtgttctgacaaaaggacatgctatcaagcatgtgttgacagccattacaatgacactgtgtacatctagtcaagacgttttttcacttctccaaagccagaaaaatggagaagcctcccaccaaaacttcaagagaaaggatgagagttgctcaccctccctaaactttaaattcaaagaagggggcaactaaactggagctttgtgttgttggacaacccctgtctgtggaccagcagtgcaggatgggcaatttgcctaagcagctgtgagcctggaatctcttgggcagaatcattggcttgagaacagtttatctccaggaaatttctttgctgggggcaagtggaggggggcagaaaggtctactttacttgagatgtttctcagcagataagtttccaaaaatcctcattcatatctaaatatgtcttccctagagagactgaacaaggttctaagagctgtagaacagttttagaagaaagtgctcaaagttaggctaaacctataattcctacaggcaatttgctcctggaatagttagcaccaaaatcacataggggggttttatggatgtgtaccttttgaacagaaatctttaaaactaattcttttttgtgttaaaaaggaaaacatgaatagtaacatgctaagatataaaatggacgatgttacatataaattgatttacttatgttccttaacttgaagatttagtgcttggtaatcttaatttgggaggggtttattgtgaggtttttcattttagataagcttccagttcaagatggaagaggaaacacatgtgtttgtctcaatacctgtggcctcagtagactacagattgaaaacatatgtggaatatggaaagcagattggggtcaggctgacagataacagagcacaggaaacaagagaacgaggcagtagaagccattcttcatggctgaacccttgataggcttctggctaggcagaggcaggcatagagagtagaaagggaaacagaaagagaaatctccttcagccactagaatgcctgctctgctcagccagcctctctgttccaggcccctgactatacagaatgatgggtggcaccaccatttaaccaaagtagaagctattctctaaaatagtaaataatttatttgggtaggattatagttacccttggtgatccaggtacttcagagaacttcataggctttagtttagagagcaaaagtgatgagcaaatagccaaacaccaaaatgaggattcaggagaaaggcctattgaaggaaaaatctatagaaaaagctcacagctgtgcctgagtttcaccaatccattccttcacgaagagagactcaagcattagcagatagccaagacaaatcacgacaccagtgagaggaatcaaatgagcacattacaaaaataataatgacccctgaggaaaaagcaatttttcacagaactgagacgatctaaggaaaaaattctgatttgtattctcagggaagcttgataggatattcagatattgcatccaaaactataaaaacaggttgctatagaaaaggagaaaaaaaagttttcttttaaagtttaagtagtttagctaaaagagaaaagtcaatatgagaatatatggttgtcagctgggtggccatggaaatgcttgagtcacaccttccccaactacaggcagtgcagcttgcagctctaggagaagctccttccctgtgcttaaggaggggagagagaagagtaaagagaagtttgtcttgcaacttggataccaactcagccacagtaggatagggcacttggcagagtccttgaggcccccaattcagaccctaactcctgacatttctggacacaccttgggccagaagggaatcggtttccttgaagggaaggacccattcttggcaggattcatcacctgctgactaaagagcccttggtccccaaataatcagcagtggcagccaggcagtactcgctatgagccttggatgagactcagagccctgctggcttcaggtgtgaccaagcacattctcagctgagatagctacggggagaccccttctacttggggaaaaagtaaaggtgactttgtcttgcaccttgggtaccagctggaccacagtggggtacaatacctcatgggctccttgtgtccctgattctagaccttggctcttggatggcatttcaggacctaccctgggccagaggggaacctaatgctctaaaaggagagactcaggcctggcggcaatcacacaagctgactgactagcctttggtccttgagtgaatatgacagtagcaaggcagcactcagcacaggccttgggcagtggcgaccctggtagagacttctctgtttgagggaaaggaaggcaagagtggaaaaaactgtcctgtagtttgggtgccagctaatcttcagtagaatagagaggatcaggtagatttcttttttttttttttttgaaacagagtctctctctgttgcccaggctggagtgcagtggcgctatctcagctcactgcaagctccgcctccagtgttcataccattctcctgcctcggcctccggagtaactgggactacaggcacccgccactgcgcccggctaatttttttgtatttttagtagagatggggtttcaccttgttagccaggatggtctcaatcttctgacctcatgatctgcctgcctcagcctcccaaggtgctgggattacaggcgtgagccaccgcgcctggccagtatcaggtagatttctaaggttctcgactccaggctctggctcccagatggcatctctggaccaccagggcaagggagaacttgccagcttgaagggaaggacacatgttcggctgaatttgctacctgctgattgtagagcacttgggccttgagcaaaagtaggcagtagccaggcagtggtcactacaggccttgggtgagacccagtactgtgctgactttaggcctgaccccatgctctcctagtggttgtggtcacaggggtgcctatatcatccctctcccagctccaggcagctcagcacagagagagactcagtttgtttggagaaaagtaagggaagagaacaggagtctccttgtaatctagggaattctctctgatcttacccaagaccaccaaagtgatacctctacaagtctgcaagagccacagcattactgggcttggggtgtcccctaaggtggatatggctgcagtgaccaaagacttagatcacaacacccaagttccttcaaatatttggaaagccttgccaaaaaagacaggttcaaacaagcccaaactgtaaagactacaacaaatatctaattcttcaatgcccagacaccgatgaacatccacaagcattgggaccatccaggaaaatatgacctcaccaaatgaactaaataaggcaccagggatcaatcctggggaaacagaaatatgtgacctttcagacagagaattcacaatagctgtttcgaggaagctaaacaaaatccaagataacatggagaaggaattcagaatcctatcagataaatttaatgaagagattgaaataattaaaaagaatcaagcagaaattctggagctgaaaaacgcaattgacatgttgaagaatgcatcagagaatctcaccagcagaactgatcaagcaagagaaataattagtaagcttgaagacaggctatttgaaaacacaaagtcagaggagacaaatggaaaaagaataaaatgcaatgaagcacacctacaagaactagaaaatagcttcaaaatgggaaatctaaaagttattggccttaaataggaggtagagaaagagataggtgtaaaaagtttattcaaagagatagtaacagagaacttcccaaacctagagaaagatatcaatattcaagtacaagaaagttataagcaccaagcaattttaacacaaagaagactacttcaagacatttaataatcaaactcccaaagatcaaggataaagaaaggaccctaaaagcagcaagataaaaaataataataataacatataaaggagctttacatgttaataataacatataaaggaacttcagtacatctggcagcaaacttctcagtggaaactttacaggctaggagtggcatgacatatttaaagtgctaaaggaaaaaactgttatcctagaatagtatattcactgaaaatatccttcaaacataaaggagaaatagacttttccagacaaaagctgaggtatttcatcaataccagacttgttctacaagaaatgctaaagggagttcttcaatctgaaagaaaaggatgttaatgagcaaaaataaatcatgtgaaggtatgaaactcactggtaaagttagtacacagaatgtcataacactgtaattgtggtatatgttgagtagaaagactaaaagatgaacctatcaaaaataataactccaacaacttttcaagatgtagacagtatagtaagatataaatagatatgacaaaaagttaaaaagctggaagataaagtttaatttttattagttttctctttgcttctttgtttatgcaatcagtgttaaattgtcatcactttaaaataataggttataagatagtatttgcaagcctcatggtaacctcaaatcaaaaaacatacaacagatacacaaaaaatataatataagaaattaaaacatatcacctgagaaaatcaccttcactaaaagaagaacagaaagaaaggaaaggaggaagagaagacaccaaaacacccagaaaacatcatacaaatgtcagtggcatggcatatgtaaatatcagtatatcaaagagatgtctgcactctcatgtttatcacagcactattcacaatagccaagatttggaagcaacctgtgtccatcaacagacaaatggataaagaaaatgtggtacatatacacaatggagtattactcagccataaaaagaataagatcctgtcatttgcaacaacatggatggaacaaaaggacattattttaagtgaaataagccaggcacagaaagataaacttcacatattcttgcttatttgtgggagctaaaaaaaaaacaattgaactcatggagatagagagtagaatgatggttaccagaggctgggaagggtagtgaggatggtgtgggggaagtggggatgattcatgggtacacaagtatagttagaatgaataaggtctagtatttgatagaacaatggggtgactacagtcaacaataatttattatacattttaaataactaaaagagtgtaatttgattgtaacacagagaaaggataaatgcttgaggtgatgaataccccatttaccctaatgtgattattattcattgtatgcctgtatcaaattatcttatgtatcccacaaatatatatacctactacgtaccaacaaaatttaaaaataaacaaaaagaatatatggtagattgactgtattaatgatcccatttcttcacccttcactttatccaagtccttcattatttaacttcctggcacttttcctctttgcctctgagctcatccatgtgaatgcctttaaccaatgatgctgcaaatgtgacacaggaagaatctagaaaaatgtgttccttctcttttaccttagtcattgtttgttttctcgacatatgtaagagacacatggagtagagcccaaggggcagcctgtagactctcaaagacactctcaagcctgacagagatcagaaccacccgctcaagtgtcagctaaatgctcccctccaggaaggcttccttgtcccctccacctaatgaaccctgccttgggcaataatctcattaattttatactgctgtggggaaaagaaagatcagactgttactgtgtctatgtagaaagaagtagacataagagactccattttgttctgtactaagaaaaattcttttgccttgagatgctgttaatctgtaaccctacccccaaccctgtgctcgcagaaacatgtgctttgtggactcaaggtttaatggatttagggctatgcagaatgtgctttgttaaacaaatgcttgaaggcagcgtgcttgttaaaattcatcaccactccctactctcaagtacccagggacaaaaaacactgcggaagcccgcagggacctctgtctaggaaagccaggtattgtccaaggtttctccccatgtgatactgtgaaacatggcctcgtgggaagggaaagacctgactgtccgccagcccgacacacgtaaagggtctgtgctgaggaggattaataaaagaggaagccctctttgaagttgagataagaggaaggtatctgtctcctgctcgtccctgggcaatggaatgtcttggtgtaaaactcgattgtatattccatctactgagataggagaaaaccgccttagggctggaggtgagacatgctggtggcaatactgctctttaaggcattgagatgtttatgtatatgcacatcaaaagcatagcacttttttctttaccttgtttatgattcagagacatttgttcacatgttttcctgctgaccctttccccactattaccctattgtcctgccacatccccctctccgagatggtagagataatgaccaataaatactgagggaacacagagacctgtgccagcacgggtcctccgtatgctgagcgcagctcccctgggcccacttttctttctctatacttttgtctctgtgtctctttcttttctcaagtctctcattccacctgacgagaaactcccacaggtgtggaggggcaggctaccccttcatactgccttcacagcacccattgtattcgtccattttcacgctgctgataaagaaatacctgagaccgggcactttacagaagaaagaggtttaatggacttacagttccacatgactggggagtcctcacaatcatggccgaaggcaagaaggagcaagtcatgtctcgcatggatggcagcaggcaaaaagagggagagcttgtgcaggggaactctttataaaaccatcagatttcatgagacttattcactgtcacgagaacagtatgaaggaaagtgcccccatgattcaattatctcccactgggtccctcccacaacacgtgggaattatgggagtataattcaagatgagattcgggtggggacagagagccaaaacatatcacccaccattaatgaaattatcttgtttatatcattgtgctcatgtttattgtttgtttcctctactagaatgaaagcaccactggatcagggaccttgtccatattattcactagtgtttctctagcatctgcaacaatgcctagccattagcaggtaattaggaagcatttgttgaataaattaaatttgaataaattaaatttgaatgaattaaaaatgaataaatgggttggtggaaggaataattggaatgaagattggtattaggatagatgatcaaagaatttactaattgatatgccccagacacggacagattagaaagactgtcatccatagaaggcctggaggccccctcttgccagatgacattttagtggacccaaggaagacccagaggatccctgaaatatttcaacattttaacaactggtctgtcccccagtgcataccatttaaacaccactctgctggctaggacaaccatgtaatgtgctatggtaacaaagtttcacagactggacaaatacatgaaatggctcatttttgagtgctcggtaacatcatcttagtgcccgcaaatcacgtatctgaggctatgtaaaaataagactgatcagctcgaatgtcaagctctcaggcatctttctttgctttgtgggactgaaatcatttaaggaaaggaatgagatcacttacactttctaaagactgagggacgccctgagcttcccagttctcctacccacatttctctgaagtcagtgaggcactacttctgcttggcaacaaagaatctgccttctcttatttcccaaagtccccctttttttttgccaagataatctttcccagacagaggcattcaggagaaatagaagtctcatgtcccaagaaatggggaagggaggcgggaaatcacacagaaaaggccctggcggtgcttagtcaaatgagttcagcatttggatagggaccagcagctgacacacatatgagaagattaggagagtatgtgtactgaatagttcaccaaaaccaaagaaattaaaattgtaaggctgtgggaaaaaatactagttatgagaataaagcaattaattttccttacaaaatatctgttaaccacaattggcaaattaactaatccccaaaataatcaacactataaaacttcactcggttgtttgagaaaggagaaagcctgttaatcagagccaatttttaatggctgatttttctaaagcccttttagtgctcaaataagggtaactactaagagtcttttggaaaactactatcaggaatgaatgagaaacattcttaatgactttagattgctatattcattagttgctagcatacttaaaagtagattattattattgtattaagtatcctgtcttgtttcttagaaatattttctccacacatgttaatatttaaaaaatcagtccatgcaatgatgtgatgattagaaccataaatagtttggacactagttaatgaagcttttcatttttaggaaaacagcagaattatctcagaaaggctatcagtgcatagcttttaactctacctcctgctgtccagggatgttaaacattggtaaacagaaagtgaacatggaggaaagattttctgattgatgagggcaagtctttcaaaaagcatccaatttaaaagatatccttttcctggcggaaaaccaaagaagtctctaaccctctcccaccacaatgtcagtaattttttagatggcatttttcctcagaataattaacattatacagcagacagaattctatcaaccctacaattcacagatagcaaaaaataaccctccaaaagccagaataatggaaaacatggatgaaatcataaagtcacagtaagaatttccatagagagtaaactgattccgttgcaagccagggagttctgtaaaattatcttgtgttgtctaaaatagagaagtaactaagataggatattccatgcaacatgttgtccagggtagaacagactagtagtgatcactccaggctcaagatttaaccaataacctagtaataaggatgggtaactaacaatagaaacacaccgcagaggtggcggcgcctgtaatcccagctactcaggaggctgaggcagagaattgcttgaacccaggaggcggagcttgcagtgtgcggagatcgcgccactgcactccagcctgggcgacagattgagactccgtctaagacaaaaaaaaaaaaaaaaaaaaaaaaaaaaaggaacacaccaggagaaaaccgtctcccttctggctccgccatccgctgagagctacttccactcaataaactttgcactcattctccaagcccacgtgtgatctgattcttcgggtacaccaggcaagaacccaggatacagaaaaccctgtgtccttgtgacagggtagagggtctaattgagctggttaacacaagccacctatatgcacatggaaaggggtggtggtagttgtgatgacgaaggttactaaacacaagcgctttactttactccttagtttgggttgactcattgaagggggaaatgttcccttgtccctcccacagggcatgcgatgtgggtgtggctcgcttcttgagtgccctgctgctcagacctctagaggagcacacacactggcaggccgtggggttccgatcccacggcagtgtctaggggtgaatgtgtaggctcctgaagccccagtaggcctgtgttacagggtgctctcttagtttgccgtctataggtggcttgtgttaaccagctcaattagaccctctaccctgtcacaaggacacagggctttctgtatcctgggttctggcctggtgtacccgaagaatcagatcacacgtgggcttggagaatgagtgcaaagctttattgagtggaagtagctctcagcggatgggggagccagaagggagatggttttctcctggagttgaggggctcgggggccgctctcctccgactgcccaccgaactccactggtcccaccggtggatgcccggccggcgggccggtgcctgtgtctgttctatatgctcttctgccgacgtgctcctctcaacgtcctctcaacgaccagccgcttgcgtcttcttcctccaatgtgctcctcaggacgtcctgccgcttgtgtctctgccttgctagggtctcatgtttttataggcccaggatgggggcgtgacgggccagggtggtcttggaaaatgcaacattagggcaagaaggcagaagtgctagtactcacctaggtctgcggggatggagccctaaccaggggccacccccgtctctacccagcacatctgttcccccattccttatcatttaaagggaccacactcttacctttccagcactcctgtatcatcattgttttataaaatcacaagctgaatcatttgttattataagccaagaaacctgaaatgagacccagctggtttgcatccttagtatcctagggcagagactggtagccccaaaccagaatgatgcttgaataaatcctatttctcttttaagtactccacaccaaaacgagtaaaaaagctcctttctaacacttaccctaattatggggcggggtggggggagggcagaggtcagtaatttattctgagaatgaatggaattgaccaatggaatttattttggaatcaatggcatcaaagaaaaaaaggttttaaaagtcactaatctctatattgaagcagtagttttagacactttagtgataaaatgccagatacagcttattgctaagcaagtatgaacaaagcccaaaactaagatcagacacctgggagaagacagacagaatggcaaagtgtaaacgttggccaaactgaggacaggctgaagctgaaaattgggagctcagaacaccaaatgactacacagggagcctaaacaccagggtcaaagaggaacataggtagtcaaggacgtagaatttggaagaatatatgatgggtatccatggcaaaaaaaaatatgaacagacaagtacaggtaaacagaaccacaggggacaaagacatgaagctgaaggactaagctcttgacacttctcttatcctggttctaatcctgtttcaaagcccagttgtaactctgctattggattgcctatgatacttctgcattcttgtagtaaactctccaacccctcttctttgttgtttcctgttaattgtaaccaaataatttttattaacatagcatttgtacattacaaagatgtggaagcatattgccaagtagttctccagaaagtacatgggattcatttacccaatgacaggtgcctgtttccctccatttttactaacttgatgttttcattctttcaattctttacaaattcttttttatattctaataactggtgtactcagaaatagcacactgtctttgccacagaaatatagaaaggatggatactaccaagagatctggactcagagaacaggggctcctattgatataaatttggattctcttccattggaaaaaatgatgagatcatttatggctaaatatggaacagtaagatcatgctaagcaaggggatctttgaatgaatggacagaaggatggataagtttgtgctgcatcatagttgaaaaggagcagagcatggtagataccttttaggtctgaaggaaactgcccaacccataaagatttcttgaggatcccactggtgtccaaagctgatccatctaaaggacacctaatctaccacaatgtattaatcataactttacataataagatgaggtttaagaattataatggaggaaattatcattttatagaactgactacactgctagccaatgagtaactgaagattatgaaacatcaaagagttcaggtgagtaggtagttaaaaataaataggtaccattcaatatattctaaataaagcttgttaaaatatatatattatgttactctcaaagttacaaaaaatctgggaatgatcccactggtgagcatgaaaataaatgtgtaagaagtatataattagcaacagcaaccccaaaaaagccccctaaattttaattataaaagtaaaagtggtttaaatagagaaagatgtcttgagatgggataattgatattattagatgtatgttatttcctgaacataattaaaattcagcaaagatatatctagaacttgacaaaatattcatctggaagaaaagcctatggggcttataaaaggttggattaatgggggcacttaccgaaacacattttaaagattaccataaagctacagtaatcaaaaaagtgtagtactggcagtagaataaacaagaaaaagtcagtttttaaaaacagattaatatgataaatctgaaaggaatgaagtgtggtaaagtttacatttcaaatcagtgagaacaagatggattagtgaattatacttgggaaaaaataagttagaaccattatatatctgtcaaggtcaattgcaaaaacccggtgtattcattagctagtttaagcagaaggaaatttattacatggtactaaagggcttacggaatcattaagagaaatggaaaaaaaaaaaaaaaaagaaaaaagagactataggctgtacttccaggaacagctcccaaagccacatggtaggtctgggctaggaaagttggtgccaacttgctaaatttcttctgcagtggctaggtctgaagccacactgcccttgctagtttctgcacaactcatttgccaaatcaaatctcactcaagtacatttgatccacaaaatctaagtcacatcagccacactagttacacagatgtatggaaactgcaggtttcagttttccagcctgtgcagtgcaaggaagggcattagaaggaggaggactagatggtgagctgaccaatttacacaaaccaaaataatccccagataccttaaatataaagaaccaaataataaaatagaacaaaatatagatatgtttaggcatttaaactgatattttttagtatttgaagtattacgctatatgttagtatggtgtgtaataacatgcattggaaacaccctgaagttatcagtatataattgcttgttaattatggcacatcacagggactgtcactcattctttaaaagaattagaggatatttaatgatacgaaaagatgttcacaatagatcactgatttttaaaatcaggtaatacaagttatggggtacaaactcattttgtgaattactcctgtaaattgtgttatattcagtacacattaatagatatattacatgtaatatacattttaatttataacatgtaacgaaacacataacacacacatatatttctgggaagaaagagaatgagagtgagaaggaaaaagcctataaaaatggtaacagtgactatttcagaacaatgtggttgtgggattatttgatttcttgtttggcttataatttcttaagcagatacacaataatagagtatctcctttgttacaagaagagattatttttaaaaagcaaaaaacaaaagaacgaggaaccaatataatttagaaaaaaaaaagattttaaaaaaattttagaaaaaaagaaattttaaatcctaaatgaatgttacccaacatttttaatgaaagttaacgtttactagaaacttgctatttgacagccactgttcttagtgctttaaatgtattaatatatttgtttttcataacaacccaaaaggtagacactattactattttcattttacaatgagggaacacataagaggttacgtaaattgcctgacatcatacaactagcaagtggttgagcttactacacaacactgttataaaacccaagctttcaatcacaacattaaatattatcaatattaatattcttagctaatattttttgggcatcaacatataatacaatgcaaccatttttaattgtacaatgcaatggcttttggcatattgacagagttgtacattaatcaccacagtcaattctggaacactttcatcaccccaaaaagaaatcccacttccttgagcccatcaccaccccatcactccaggcatcataccaatacttcacttccgtaatctattgtattcttgcaacaatgctgtatggtagaagtgaatagccccactatacagatgagaaaactgaggtagagagaggtcgagaaacttgcctaaattgtataactagtaaacagtagaattgggacttaaattcaggcaatctgtcttcagaatacagtctcctaactactctgctatgccaccactacattatattacaaaaatgaaagttcatgaataagtagaaattactccaggaatataaagattgttcaatttgaatatatctagcaaaatgacatatcataccaataataatagcgaaaaaaatactatccccaaaagcactcagtatctatctctagcagaaaaaaatagatggatgacccccacaagtaaacaagaataggagaatgtgtacacgtctatctgaaataactgtaattaacacctaacattgacacaagaaagacatatgtaagtaataaaaaataaaacatatctgttaccattaccctaacttaaatttattctacatgttttaactaaggcagtcagtaagtaaaaggaaaaatgaggtttctctttaaaaagaaaatgcaaaataattatttctatataatagactgtataaatagaaaaataaaaccaacttcaaaatcatctttagtaatacaatatttcagtaatccaagaaacggaaagtctgtgaaaaaaaaaaaaagatatacgtgtgtgggagtggcaatgggagtggaaggttagagctcaaattcatctttcaggctgaacagtccccatgaactggaaatcattaagtcctgtttcacctcccgagaatgcataccagttaaattctttacattctttttccttgcctactttgcctggaaaaatgcttgaaaccacaatgttggacagatagtttatttttgtgtgtcagtattttaactggaaggaagaggagaaaatttttcatggatctttaggttataatgatttgaccttttattagttataggatttattgcccacatgaaaaaaaaggaagaacttttgcaaaggaagagtggaaaagctaagggccaatatcatgtattcccgtcttccctgacctactattcaaaacctccagtaatgtggagaaaaaagaaaggctccagagtcctttgaagtctgtgtgacttcaaggaaattacagaataaaaatgtcatggagcatcttgcaggctgctggagaccccagggctctaggctgaagggagtcttcagctttgcagatccaagagcccagatgaatctgctcaactaagggctattctgggatgtccaagagctgtgactaaatgaacttaccagatttttttttatataaaccagtcatttatgcatctttaccagcctccttcccacagaggttttggtggctaagatgtcagcccattaatttatctttagaaatacatcagtagctgctgaggtacaccagatgaaaactgacttggagtcagaatccctggtccaagtctcaaattagtcatttaaatattatgtgtgatcctggctgagacacttagcctatcactccaccaaaattagctttatcaatgtcaccaataacctgctggttcccatgtacaatacactcttttattaaaatctcacttaacctctccatggccttgtaccctgctgatcacctttcctccttgagttttcatggcaccacctttctggttttctgcttacctgtcagctgattcttctctttattcttcatctcatcctttgcatctaggatctgtctttcatactcaactatttgggtttaaatccctttccttgagtagcctcatccagatccatagattcaagtcccagacattgatcctaagacccagaactatagataagacatttccacctgaacaaaccttggagacctaaactcaacaggccccaaactgaactaagcgtctacccttatgccttccccatactgtccaaatcagaaaattaactcctcaggtgaagttgatgctattaatctatgaatgaccctttgagtagcaagtctgaaaagcaagaacttttttcatgactccaacactagattatcaagtcttccttgtttatagcccctcgctccgcatcatccccacctccattgccttaattcaagagggaatgacacctccttcaaaacagcctctatgctctctctactgatctccctgactccttgctgggccatgccaatttttcttacatagtcctcccataatgacctttatcaaaggccagtctgagactcccaaatggcttttccatagctctagagttatttaagcttctttgttttgtatgccggcccttcatggtctggctttattctacctctagactcacatctgcaatcccacatcccttgcatctcaatcattacctcgattttcccaaacacatcatgctgtttcatgtatcactgccttcctacaatcatttcttctattggaatgccattccaaacctcaaagcttattcttttctcatccttctaggatcagttcattcattcctttcaaaagaggtctaccctttccctggtgtgatagattgcatttgctcaccactctttttgccatggcttcatcatgaccaaagtagactttcccacacttgtgccttactgtggccaatagcacagaagcggaggtaataatgtgccagttccaaacccttttaaacaaacttaatgacatccctatgagaagaacctgtctgagcctgtctcagaatgatcatgagaaacacatggagaacttctctaatcagctgaccctcagaggaccaaaagacgtgtcagataaatccttactggtatgtgcagttttgaggtgtggttgcttcttatgtggtgtgttgtatattaaccaaaacatttagtgtagtttatttgtccttctctgtcctcccatagccactctgtatgctttaggccagctcttctccaagacaaatgaggaagcaaaactggcaccttgacctgctgccattcaaactttagtcataggggaaaaaacatcctctctgcattctaataaagtttcttaaaaatgtaataacaccctgccttgtactattcctccaaataaatgaagacttcagcccttccccttaagttgttaattctctaaccaaaataattttatccttgacttttataaaactgatgcctacatatatatgtgaacctttatttactgatatgacaatccagtgaagaaacatctgattttctgccatgaacaaaccaactttcaccttgtttaattcagggatcccagctctcttaaaatctggagtaacttgaaaaactatgcaagtagaaataattttattttctcaatgcgtttgtctgagttttgttttgtttgtttgtttgtttgttttttgtttttgccacgagcaaagtttgaggcattaggtgccatcaagtgctcagcattctagaagcctatgtcttgcaagcgtgatggtagctcagggatttgtctgtgagagaagaaaccagaaaggcactgtcttgggaagacgctaaaataaaaagactggcccacagtccaaactcatcgccaaacccagagaaacaggcaggctgtgaatcccactataagtgccaagaaaggcaatttgggtatccaattctaatactcatgagaaggtattactgccgttgtttagaggaccattcagcctctggcataggtgacagagagacaggctgacatggaaaacctctattgcaaaacttttcacatggtgacacagaaagtttgtgtataattcttttatgttgtttatacaagacaagctttttgatacttgtgtggagacattacaaacaatgattctgagcctgactgggctgtataggacatgcaaatgatacaatgttaagtgaaaaaacagaaagcaaaatttttttgtacaatgttattttataacatattcctagaaaactgattgatagaaaatacatgcctgaccaggcatggtggctcacacctgtaatcttagcactttgggaggctggggtgagtggatagcttaaaagcccaggaggttgaggctgcagtgagcccactgcattccagcctgggcaacggagtgagacgctgtgtcaaaaaaaaaaacaaaacaaaacaaaaaaaaaacagataagaaaatacatgcccaggccgggcgtggtggccgtggctcaagcctgtaatcccagcactttgggaggccaaggcaggcagatcacgaggtcaggagatctagaccatcctggctaatacagtgaaaccccatctctactaaaaatacaaaaaaaaattagccaggcgtggtggcgggtgcctgtagtcccagctacttcggaggctgaggcaggagaatggtgtgaacccgggaggtgggagcttgcagtgagatgagatcgcaccactgcactccagcctgggcgacagagccagactcgtctcaaaaaaaaaaaaaaaaaaaaaaacaaaagataatacatgcccaaaggggtttagttgagtgaagataagagatttttaaaaatatttctattttacaaagcattttatgtaagaatataactttatgatgaaaaataataaatgtctcacataaaataatatctacaaacaaaagctgaaaatttaaaaagaaaggtttttcagtgagcactgaatgagagcaaagcagcagggaaatgttgcccaagtattcctatagggatattctaccaaggggtccactattcattccagtccatcacagttccctctccaaactgggttggagacacatgaatcactctttggctttagatttctagactccacacagactacagcccttctgatacatgacaattgagaagattactgtttacttcaattatatgccagttatatatactcctgactggttttcttgattgaacatagaccttggtcatttgctgaagagttagaaatattttatcagcaaacacacttcacttttttattgagtgtttgtatgcctagaagagaaggctcatttttatttcattttcagaggataaattttcagacctcatctccaaattcaaggtttctatcctatttggtagcctcatatacagcctgttataacttttaacaaacatgagtgaaaacagcttgtccctatctctttcctatcttgttcagaataacccttcagacacttgatgttaaaactatccatcagctttaattattcaaattaacccaccttctctgattaattttggctttaccccgatgttttgttttacaggaaaaaaaaaaggaggggagtttttttctggatacctgtgcatatctcctcattggttttaaattgaagacctctaaaaggaacactctgtattggtacaaatatcaccagcattgcctgtactgtaaagctgaatgtaaggtgggtggggaggggagaggaggtaagcaaagacatcgtcctctaccaaaatcaatttatctaataggaaatcacaaatatgcatgatgttttgcaatacatacaatctgtgtgctgataggaaaaaaaggcctagaactagaaataatatgtttatggaatgaccagcttctaataaccaagaaatcagtatgggattcctataggaataaccaaatggcaggagagctatttagaaaatattctgttcggatgctaatgaaagggaatatacaggtatacagctttataaaacagtaagacagggatatgccccttgctctgcagggctgacagaatgatttaaacaggaacactgggagtagactattggaagacagcatcagggatgggattggtcaggaagagtttagagatgggttaagatactaaaatggcgaggtaagggtcaagtcctttccatcatagaaatggggaggtcagagtcagaggttcatgcactgaggcttggagagtccattcaaaaagaggcagaattctggactcgggttagggatcagcagcgagggggatatggcaggtagagctgacactctgactattatgaatcacggatacagtgggcctagctcttggatgatgtcacattcaaggaagcaccatcagaaacagccaaaaaaaaaaaaagatttttttttcaatcttcaacatgcaactctcaaaaacaacaaaaacagtaaatggcacattcaaaactcttccttatattctctctgagttactatagagactaacttcttttttaaaaaaacaattttattttatttgaagttctggagtatatgtgcaggatgtgcaggtttgttacataggtaaacatgtgccatggtggtttgctgcacctatcaacccattacctaggaattgagccccacatgcattagctatttatcctgatgctatccctcccccgaccccctcaacaagtgtcagtgtgtgtttttcccctctatgtgtccatgtgttctcattgttcagtccccacttataagtgagaacatgcagcatttggttttctgttcctgtgtcggtttgctgaggacaatggcttccagtttgatccatgtctctgcaaaggacataatcttattcctttttatggctgcatagtattccatggtgtatatgtaccacattttctttgtccagtccatcactgatgggcatttgggttgatttcatgtctttgctactgtgaatagtgctacaattaacatacgtgtgcctgtatccttataatagaatgatttatattcctttgggtatatacccagtaatgggaatgctgggtcaaatggtatttctggttctaggtctttaaggaatcgccacactgtcttccacaatggttgaactaatctgcattcccaccaacagtgtaaaagcgttcctatctttctgtggagactaacttgttatctctctccccagccaccatgctcccttccccatcagctattcctgtgcctttttctgtgtccaggagctggtggggcagagagaactgttcctcagagggcagtggatggagattaccccaggtaggaaaacacctttctcttggggtagctgggatgcttaagtgacttatacagtttaataatttttattacgtctctctgccctctagtcaaaaattactgcccgccccccaccccgcaacatacacacacacatacacatacacacatagaaaaattcttattttaagtggggatcccagaaactctttatttacagtctaacttccccactctttttcttctactggggatacctgtcatggcccttgtgattgtgcctctggcatcttccagctggatgaccacagccccttcttatcaaacttgactgagactaagggacaggcaaaatcctaggaagcaaacgcagtcaattccgtatttaatcggccctgacttcatagctccattccggatatttggcacggaagtgatgtttcctggtaagagtcctcctggttgcagactgccactagatgtccctcatcccctcaacctaaacagaggaatgagtcttcacctcaccgcaaggtatgtgacaagtagggggaatgagtacctgggtgggcagaacctcctcgtgagtaatcagaagtgcagttctgagtcagagcctggctgccatacacggttctttcaggggctctgtcttgaaggagtggaggggagcctgcacgctgtgtcccagcattaagttctgaacttcattctggaacgaaatcctatgtccagagagcttttcatgttgactgcttttcctccttaattctattcttcttcaccagtagacagacttagagggtcctcagagtagcagtaaagttctggatgggtttgataatttctgactataaactggcaccacatgaattttatctggctgctttctagcctccaagtttcattcattagcccctcagaggagagctctgacagtgtaaacaaggtggatcttcccaaaagtattaagaattagcatagatatgagtcctaatcacttttcctgttggtcaaaggtaatgagatgtttctgctcagaaaagtcagtcattgaaagactttgtctgtgatcattccatttgggaggcccagcactcacacaaatagcagcatttctctgcctctgaacgtgaccttccttatacatttttgtgacacgttctaaccacacccctctatccctgttacattatatccagtcatatctcaagctgttggggcaactggccagtcccaaatgcctccaaagctgatatgcaagtccatgaagtccctgtgtgtgtattgggggtgagggttgggggtgaaagatgaatctaactccctctggtaaaggcaggctaagccttgaactaatcaaggcaggtcagactctctctgaattcctctcacagtagctcattgaaaaacgtttcctagatgaatcctttatgacccaaagggaaaatattccaaggctttccaagaatattccaagaatatcagactactatcacaactaccaaatttaaaacataatgaaggcagtaaacaatagaagagatatttcagacaatcttaaagtcaaattagaaactcaagccatacttaaaaatgttggcatgtttccctaaaatttcctcaagcatgattttcactgtttctcccaagtttaactggacatggttttgggggaaacagggaggcacatggagagttgacatggatctcctggaacctagatggtccatagagcaaaacttttctcttgtctggggccacctgtgatagcaaaacaaagacatagggcttatgtgagagtagcctgttgatatggtttggctttgtgtccccacccaaatctcatgttgagttgtaattccaaatgttgaaggtgggtcctggtgggaagtgattggatcatgggggtggtttctagtgatttagtaccatccccctagtgctgtctcgtgattgagttctcatgatacctggttgtttaaaagtgtgtagcaccacccccttcactctctctccctcctcctccagctgtgtcgagcatgcctgcttccccttcatcttccaccatgattgtaagtttcctgaggcctcccccagccatgcttccagtacagcctgcagaacaatgagccaactcaaccccttttcttataaattacccagtttcaggtagttctttatagcaatgtgagaatggattgatatacctatccataaagaatttgggatgagattttcctaatgggttatatgagagtttcagaccttctcagagtagcagtgaagttcagtgaagcctagtttgagtcatcttgcaaggtctctacctgagaaattggccagggcaaggggacctcagtgataagagctctgtagtcttaacctgagaagcagaagctgacagtaacaagacatcagaggtggcagatggagactgcattactaatactagggagtagtgccagatcaaaaatccccagataatctgcaaagaattcataaaagtgacccatgaaagaaaaacagtaactgagaacctaacaggcaggaggttccagtgttagattatggcacaaaagccacataagccattgtccttttcttttaatacctctcacacttccacgatgccccaaaatcatgaaatagcagtcagtgaacaaaagagcacaaagggaaagactcttcaaaactttcaggggcatcaaaaaaaaaaaaaaaaaagcaaagcctgagaaactgtcacagtaaagagaaggctaaggagatatgataactgaatgaaatacggtatcttaaataaaattcagaaacagaaaaaggacattaggaaaaactagtgaaatctgaataaactgtgaactttagttaataataatgatcgatatcaattcattcactataacaaacatactatagaaatgtagagtgttaataatagcaaaaaccaggtataggggatgtgggaactctataatcttcctaagttttctgtaaatccaaaactgttctaaaacatcgattttatttttttttcaaaggtagatgagggataccagttaagaggctgttaaattaatttagaggctgatgataggaactgggaccagagaggtagcaactgaaatggaaagcaggtatttgaatttgagttacattctagaaataaagcaggccacacttgctacaggattgtgttgtgaatgaagaaaaggaggtactgaaggtgcctctgaatatgggtcttaagtgactggatggctaatagggtgtgtttgttgagataggtattgggataggaaaaggtgatggttattttggggcagcggaagagaatggatgtgaagtgatttgttttagatatgttaggtttgaaaggtctattaaacagcaagatgaagttgtcaggtagtttgggattcaagggagggcacagggctaggcacatatatttaaaagacacgttggtatatttaaagtcctattataattgacagaaatcagtgagatagtatttagaagaaggcccaggaccaagccctggggcactacaatatttagagattatgaagaggaaaaagaaccagacaggccgacattgaaggtgcagccatagaagtaggaggaaaacaatggaagcatttaattatggaagcctagtgaagaagatgtttgtcaaacccatcaaatgctgctgagtaagagaagataagagaaatgaccaccatatttagaaagacaagagtgcttttaagagagaggtagaaataaaagcccgattagggtggattaaaaagaaaatttttaatgtcttttttaaaaatttgaaaaggtggtggctcacgcctgtaatcctagcactttgggaagccaaggcaggcagatcacttgaggccaggagttcaagaccagcctcgccaacatggtgaaaccccctctctactaaaaatacaaacaaattagctaggtatggtggtatacatctgtaatcccagctacttggggggctgaggcatgagaatcgcttgaacccaggaggcggaggttgcagtgagctgagatcgtgccgctgcactccaggctaggcaacagagcaagactctgcctcaaaaaaaaaaaaaaaagaaaaagaaaagaaaagaaaagaaaaatgaaacgaaaatgggttgtaaggaagtggaaatagtgactcccaacaaaatctgagaagttctgtagcaaagcagagaaacaaaatgagagaaccataagagataaggtcaaatcttttattttttagtaagccagaaactctgaaggaattcaaagaaaagagaaagcataatacaagaaaagaaataagaattcaaatcactaaaatctttaaaacactcttaaataccataaaaaaaaaagaaaagaaaaaacccacagaattttgccatccgtctatggacccatgcaattttctgcttccctcaacactgggctcaatctaagctttagtgctaagcaccaaagggaatctccacccatttactatacccagagaaaagcttgttctcagactcctgcagtcagtagctagtcaggttgagtcatcctggggaccctaaaaagtgacatatgttattgctgaaagggctaacatcagttccagtataaatcaagcttacccttcactgattaaaaaagaagaaaaaaggtagattcatcaaaacgccttgctatagaaaggatcactagtttagtgtcaaagcccctcctctcacagaaaaagagataatggaaaaaataggaaaaaaacttttctaaaagatcacaatgcatattttcagtgcagtttgacaggctttagggatgcatgaaagtaatgtatatggctatgggaaagtaagaaatcagagaatagaatgggttcttaagggaaataataatttataaaaaatgaattaaaaaggccagaaatagcagaatgaacactatactgctgaaaaacaaattagaacagcaacccagaaattcactcacctattcagtaaatattatttaagtacctcctctgttctctattctggctcatatgtaagcatttaatatataataacaagaaaataaattgcagtcccatggagctttcacccttgtgagaaatattacagaatttggtggagaaaaatacattgatataaatgataagagaaattgtaagtaatatgaacaatagataaaggtgatacagtatttatataattagttattccagaagaacactagagagcaaatggaggaaagaatagaggaaaatttctctgagctgcttgagatttacagcaaaaagactcgctgagttctctggacacacgataaagtgcattcaattatattaatatcaacttttaagatcatgtaaattaaaaacattattagatataggaagcatcaccatataatgatatacaatttaattcactaggaagataattttaaatatgaatactcctcaaaatatatgagacagaaattcatagacccacccccagagaaaaaatgacaaatgcaccatcaaagtaggagatatcaatatatctttctcaactgtagatagaaaaagcagaaaaaagcaaaatagctaagattttcaaacataatcagcaggactgatctaatgaaaacatatagaattttgcatccaaccattggagaatattagtttttctcaagcctgcaagagacatttagaatatgggtaccaagataaaaactcttggcttctgaattccaaaataaagattaaatcctacaagataatgtactagactagcatcatttatcactgctgaaacacttaatgctagaaataattaagcaatgttttaatatttcttaaggaaaatattattacacaagaactataaactcagccaaaaaatgttcgtgtaagaggaaaaatgaaatatgttttcatacatataagcagccacaaagtatgctttctggggaaaaaagtcattatggaagccaaaagaaaaatgattcagcataaagagataaagaaagaggaagatgggagaaaaaaaaaaaacctaacaagcaacataaccggcaagctagagttatctaaggacttcttggcagatgttagcaaaaaatccttcaaagaaaaacatcattaggaaaaaaacaaaaaagcggatctgaaaataaatatggagttgtttcaatagatgaggaattttagagaaaagaataggaaggacctacaactctggtaaatttctgaatctgaaaaagggaaacacacacatataatctcatgattaatagagcttaaaatgtttttggaaaatactttttaaacagacaacttcaaagtaactggaaaaaataatttcaagatggcaaattagaacaaagaaaaacaaggatgtacaaaagcataataaagagaaataaaaaaacaactaaataaccctattatgcaaagccttatggaatgaaaaatagagcaaaaacaagatttctgctgtttataagacatatgcctagaacaaaataatgtagagttggaaaattaattttaaaagaggagtcttggagataccaatatttagagaaatctaaaaccaaataaacaaaaaatgcgattgcataataaaatgttcaaccaatgtcaatctaagtcaaaagcatttagattggccaaatcacaatcataatgggagatcataagaaaactatattaacttcataattaaagtagaagagaataaattaagatatattaaattaaacataccatttccaaactttatagaaaagaaaatatagacctgtatacccagcaaaggtcttacaaacttttcaagttttagggatttgacatattaattctaaattgtaaatggaacaaatgtgtaagaatacctacaaaaatattgacacaaaggaataatatgagtttccatttcacatattaaaatatttaacattatgatgacttaagaattatattaaatgaatgtaaaattataatatgtaaattgttaaactgaaagagttgagatcaacaagctactttttctttcttcttctttttctttctccagatgcacataatctgtaacacacatttacaaatattttaaaattctgtaactggtgttaaaaaattggctttttgggggaaaaaagatacattttcttacaacatacttgaataaactgcactgaaattgaatacttagtcactaaaaataatagatgcacaaaataaacaaaagaaaagatagtcaaataaatttaaaaatcagagggaaaagcatgtctaatcttgtctcaaaattcagaaaccatcaatgaaaattacacagaattgattaacaaaaaaatgaaaaatttttttttgtagccaaagacattatattcaaagctgaaaaaatatataagaaagatgaagagctagtatgttaacaaataaatagcttccaaattaacaaaaacatcaactcataaaaataaaagatatgcacagaaaagaataaacttatgaaaaaaccctcaatttcaccgataaacaaagaactgaaaactaaaataaaagtgagaaataatcacataccagtttggctaaaaatcaaaagattgctcataaccagtattgatgaagacatgggaaaatggtctctctaatcactaaaaatcttgaaggacattcaatcagtagtaacaaaaactgaatgctcatacatgtagcagcaatttcacttctagaaatttatcttagggaagtaataattgcacaaagatatagattcttatctcagcatttttttaataagaagaaaaaattggccaggtggtgcatacctgtaatctcagcactttgggaggttgaagtgggaggttcacttaagttcagaagttcaagaccagcatgggcaacatggcaaaatcctgtctctacaaaaaatacaaaaattagctgggcttggtggcacacgcctgtagtaccagctatttgggaggctgaagcaggaggattgcttgaacctgggaggttgaagcttcagtgagccgtgactgcacctctgcactccagtctgggtgacacagtgagaccctctctcaaagataaaataataaaataaaataaaataaaattataaaacctaaattgccaccaaggaagcattattttaattacagtacatgaacacaatggaatttcacgtagcaatttaaaacctgagatgcatatatatgtgtatgtatgcaaagttgccccaaatttgtaaaatacgaaaacagaaacaaaaccaaaagcatattacaaagcatatgtacgccaagatccaatttttgaatgatgttgattaaaatttatagttacatcttttaggtacaatattctaactttattgatttaactgaatttagccttcttataaaaccctatttccattcagtggtagaaagaaaaatcaatctcactcatgcagggtaacttcgaaaattattttaaaacttggtttcttgaaggttaacttggtttcctctgggaaacttgctcctcatgccatttttctcctttattttatcttgaggactctcattcaaggcatctgggtacaagggaagctcatggctattatggtgttggaacaaggaggctctggttggaaagaggatgctcccaaggactccaggcttgttccatctggtttaacagcttctgccctcgtgtagcaggtcctatgtggcttttgagtgtttgcaggatgaacaactgctgtctgtggttcctagaatgcccctaggccctgaattcctatgaattccaccttccctatccctgacccccagccttgtcccacccaccaacaatctctcagcatttatgcaatacaacgtgtttttcaaggagatgatagtgccaagtgggtattttttaagaaataaaatcatgactcagatacaaaaataaaatgaatgcatatcaaagatttcgttcagctcattaattaatgagggaaccagtaagatgttacaatccagttcaaagggaaattttaagtacagggcctcgaattcttcccaccaatattcagatgatgtagagcaactgccacgaggaggctccaaaacacatttgggaggagacagtgcttgtccacacagccaaccccaggaaatctcagagtgctccctgccttgaaggtttgccttagtgtagcatttactgagcatgtacatatcggaacatcatttcattataaattaatttccttttatatattgtccattatattataattgattatacttttttttaaagatatgaattaattaggttgcattatctaaaaatctcatttcaggataataatactttattaaacaaaaacattgttaataaaggtaggcattggctccgatagaggtgagagccactgtattccattccatttcatcttggaacctatgctctggtcactaaggagagaaaatatctccagtggaatcaatgacgttgtgctttagttagatttgacttaaccatgatggtgagtcctgaaacccttcctcttaaatggcctgggtggccatttgaggctcccaatgcctcattaatgtctatggtacttgaagtttatcatatcacttttgctccagtatacttcgataaattaatacagggaacaattagggtatttttaacaattgttattttccaaaaataaaaattcaccaaatttatccacataattctgtatagagatattaaagcaaataaagtcaaatataataaaaagaggaaaaattacgatcatttgtagacaggatgattatcagtctgagaagcctaagtgtagtggacatttgctgtttttactgcccagtatcttttttctcttcttgaaagtaccccaattacatttaaataattacctttttccttctggatacaaactatgatcagcagccctgccttgccctgtccttctctaggccagacattgagatatgtaacccaagatacaggtcttgattgaatctatatcttgaagagaaagtcaaagagaccaaaaactgttagaatccatccatttccacagagatattctgaccagattgtttctgctagaagagaaattctgtaattcctgctacccagctcagtacctgtttatttccaagactaactttctaatcttttaattaattttgtgaactcttaattttctatcaattaattccttttttgtttaagttagtcagggtaaaattttattaatgcaacaaaagaactctaactgatgcctcaaggtgataaatttaaaagtttgttaaaagaaataagaatgcttactatggtgaccaatttcaaacaaataagaatgtttactatggtggccaatttcaaatacagttaatactttttatacaggaacaataatcagttaaagaacataatggggaaaacgttctattcaaattatcggccacaatataaaatacgtaaatataaacattgtttattaataacaacattgttaggaaaaacatgaaaaaaacccaaaatgcaactgaaagacctaaatgtaacaaataaagagaaaaacataccaagtatttagatgtcaattcttttcaaattattctactataaatgcaattcctgtaaacatttcaacacaatttccataaacattccttttttctcagaatttcataaaatagcacagggagagagaaaaatataactcataccttctaaaaatgtaaattccaaatgatttcacatttttattgtattataaaagtcattagactactagcaggaaacataggtatatattgacataacctaagtgtaggaagcaaaattttaaacaagctattgaagctaggaagttcaagtaaaagattggtgtaataaacaccgtaccttttaaaattatgtaaagtgaaacagatatataaataaataaataaataagcaagaaagttcatttattaaaaaggaaaatgataaccttcatagcacatatggaaaagtattaatatatgtactacatgaaagctttcctatatattagttaagaaaaaacaaaaatatcccttgcctaaaacttaatttttcttctaatatatgtttcaaaataattgcccctccattttctcatcaaaataattttctgttcctccttgcccaatgtgccaattctcttgcttctctcaaacatttttgttgtattttctagagcagagcttcccaaaatttaatgtacacacacatagcctggagatattgttaaaacacatgttctaattcaggaggcctgggtcacccctgagagtctgcatttcttacaagctcccagatgaaacagatgttgctggactcaactacatgttttaaagatggacacatttggccatatccttcttcatttcttcattgaactcctcacttttataaaacttaagtacattaggaatgggagtggggagctgatcattgacatcctcctcattccctagggctgcttctagacatgcaacgctgcctccttctaccaaaaacttccaatacttcttgttgctatcatctactggcccccaggatgtgtctcctgatccccctgattcattgaagactggctcccgattcacaggcttccattccaccttaaatacagccagcatcctaacaggaccttccactttaagtccagccagaatcctaagtggacctttcatagttcacgtggacttcccggtcatcactccagacattcagtctcttgatattttcctctccatgaatcttgtcttcctgtctacctgaaccaccaattctcctcacaccttagaatctgaaatggttccaccctccaaatctctttatgcagatattctactctctgagacagaccataatctcctatcattctaactcggtggctgaatttccccctaaaggctggtttcacggacataagatcagtgtagtcagttgcacagggttgtacacttacaagagactgcatgtggtttagtgctctgctatgggtgtcctgatattcttaatttttgaagaataggctccacatttttattttgcactgggtcccacaaattatgaagttggtcctgcttctcctatgatatgaatttttaaaaatctggattcatattattttattatttatttatttattttgagatagagcttcacttttgttgcccgggctggagtgcaatggcacgatctcagctcgctgcaacctctgcctcccgagttcaattgattctcctgcctcagcctcccgagtagctgggactacaggtgtgtgccaccacgcctggcttttttttttttcagcagagacaggatttcaccatgttggccaggcttgccaactcctgacctcaggtgatccacccacctcagcctcccaaagtgctgggattacaggcgtgacaccacactggcctgtgttcatttaaaatacaggaataatatatactcattttaacaaatttaacaatatagaaatacagcatttaaagtcaaacattctcccaccaattacattccataaaagtaagtaccattaataatgttctgtatctttaccttgtctgtcagtcaggatagggtgcatatgtgtgcaggcatatatttttagtatactttcattattaaataattcatatcaaatatattttctgtaatgtgtatcctagacatcttaacatatctgttcctctgtgtctacattatactttttaactattaagtggtatatttcattgcatgactgcaccataatttattgtagcacctggatgtgttagatccagacagagtagattcagataacttaggacctccatcatgaactaggaaagtaaaacaagaaaaaaaacaacttcactcagtcacgaaatagaatatattttcatctccagtgaaatgcctctattgagtgtagaacctgccaaactgctctatacagacctctttacagagtccacacccagccctgtacttcagacctgcacacttgcagaagaaatccatgtcaggtaacaataccaatctacctggacccttactcttaaatatgaatgaagaactcaaggtcatcaggtattaaagaaaagcaaacgatgtggaaaaggaataagataaacacacagaactgactgtggagaaaacagaaataatgtaaaaaacagattactactacctatatttgttttttgttttaattctttatcttattgacactttcattgcattggccctcttagttcctccttattcatcagcacttttctgccttcactttaacccttgttagcttagaatttttccagttgactattgctgtgtaataaactatctcaaaattagtggcataaaacatcaatcattgtattatgttcatgattctatgtgtcagcattttgggaaaggcatagtagggatagcttgattcagccctactctctctggggacctagttgagtgactagaaatggagggcctatttaactgggcacatgtgtctgaggcttcatctgataatgttctatatcacacttctgacaccaaatatgggagaggacttctcatatcaactaagtctccaactctctctacacaaacttggtgtcccacaattcagttcatttctgacactaactacaaatagttagcacagactctgctagggctcagtctcacaaggtctgcatcagtttagacaccaatcatgtgtctaagccacctatacttttgaccaataggctataagtcagggggctcactcaacctcttcctaaggtttgataatttgctatgatagcccatacaactcaggaaaacaattcacaaattattactgggttatcgtaaaggatacaactcagaaacagctaaatgagatagatgtatagggcaaggtatggctgcaggagcttccatacccagtctgggcacaccaccctccaagcacttcatcaatgggctcaccaactagaagctctctgaattccaccacttgtgtgtttttatggatattctattatgtaggcatgattgattaaaccattcaccattggtgattgagctcaatctccagcccctctcctctccctggaggtctgggggtgagggctaaaagtaccaaccctcttatcacatggttaatttctctggcaaccaatccccatcctgagtctatctaggtgcccatcaagagtcaccacattagcataaactcaggtatagtttaaaggggctttttatgaataacacacgtcacttctctcactatctcacaggaaatttctagggctttagaagcccttaggctaggaactgaggatgaaaatcaaatataaatttcttatatcacagctgtggctattagctgggttgcttggttttcttccttatggtgtctactggagctagaaagtctaagatgacttcttcacttaacttgcctgactgttactccttcacagggcctctatgtcctatagagtaatctggatatcttccagtgcggctcagagctaagcccataactgacacagcatcatttccaccacagaatccaaattaagcccttcaacaacactcctgaccctttcattaacatatgctcttgattcatatttctgtctttttgtgtcacttgttggtatcaattaaattatctgccttctttggcctactctgagatgctgcatattttgaaggaaaaagaaaccataaccagaaaactggtgtactgttactttgagaactaatcatgataatgaaactaaacaaaatatttcaaatcttcctgacaatcctacaaggtttttctagtcaaatcgcttacaactgtcttccattgtctttattcttctcaaaccttatgctccactaaacgtctcacctactaattgacaggaaagatagaagtcatcagtggtgagctattcgactttacatcacaaactctacacacctacttgaatcttacctaaataagatcatttattctacctgtgcttaaagtcattttctcctcctaatcaacaattttatgatattgtgtaatccccagctgagtcatcaactgtttcttcctaccagcatttaactatattcgaatcacagatagatagataatccatcaaacacctgtttctttcattacaaccattttcttttcttcctttagatatcaatctttttaaagttggctatatttgctgttttcaatttttcacctttgatttacatcacaacttaattcaatctagattctttctccttaatttttctgaaacttttctcaccaatgacaattttgtaggtaaatccagaagctatatattttttcttatcttgtataacctcttgggaacatttgacacgatgggattcctcttactctcttcccccttttttgccactgtgataattttcttcagtcttttttgatgaattcctttctaatcataaatgttagcaattctccggggttgctcttggctttttcttttcccctcactctgcatgctttccttgagaaatctcaaacatgctcatgtttccagagccatctatatgccagttatagatttttatttcaaacttactcctttcttctaaagcaagtcctgtatgtgcaattgctacaactcaacttcctacacaacctcttttcttggatgttccagagatacctactaccatacacatctgtaaatgaacttatattcttccccccaccctcaccccaaatctgttccttctctaaaatttcccatcttagtaaatggcaacactacccatgcaattgcttaagccaggagcaagaggattttcctattttttcattttttcttataaacctcattccatcaatcactaaatcttcgctggttttacctcctaaatatatctaaaatacacccacttctttccatgcacaccaccagcatctcgctcaagctaacttcatttttcatttcagatacattagtagcatccaattgctctccttccaaccactcatgccccatctaaacagttatctaaatagcaagttttgaaattgtccatctcatcatttttctccctatcttgaaacttttgagtggctcattgccttcaagaataaagaaaaaaactctttagcatgaattatagggtcagcctaatatagttaagaataattatcccaactccagcccctgttttacatgctccacatatgtaaccattcaagtccttaaatactgctttaaaaactttacacatgacattacctttgcattcccatgtgcccctttcacctaaataacttctacacagtcctcagctgtaaactttaaaatcattttctcaggcaagccttgtttgcagccccaaccccattcttagacaaggttacctcatcctcacttgcaataattactcacctggctgatctcatttcgcagaggtcaacccactctctcctttccaagagtgtaaaaaataataataataaaataattactttcccaatggatgtcctttctagactgtaagctctgtaaggataggtgccatatgtttctcgttttaccactttctcaaacatgcggcatatgtttagcacagctaaataaatgcttcactaggaaccacagaaacattcaaaagaagtttgaaaaaaagaaggtaaagtatgatcctatttttgaaaaacacaagtagagatctatcataggctataacaaatgtataaacagaaatgcactcagctgtgattaacagaaatgtgaaaaacacattagtgattttacttttcttataacatgaagaacattaatgtagggagtccagagcctgcacagctgtcacaagataatttgatccatcacgtctacattccagaaagaaggggaagggcaaagagcaaaacagtatacatcatccgagttagccccctttaaagaactttcttaataactctacctagcagattctccttaaatctcaaagatctgaactatgacacatgaccaaccttatctgtgagggaggattaggaatttcttagcaaaggagataaataaatggatactgggtggaccactagcggtctctacctcgactgtagaggtagagattatacctcaaatgcagcccaaaattttatataaagagtagttctaccatagctggaaaaccacaagtgatatttattttttgttttattttgaaaacattttattattttgctttcttcccacttttacattttcctacattgaacatctgttatacttgtaatcagatgaaatgttatatatgagtagccagaactattatactagagatataaactaattcagagggattagtcctaccaggtatcaaataatgttttaggccgggtgcagcggctcatgcctttaatcccagcactctgggaggccgaggcatgtggatcacttgaggtcaggagtttgagaccagcctggccaacatgggaaaaccccgtctctactaaaagtacaaaaattagtggagcatggtggtgtgcacctgtagtcccagctactcgggaggctgaggcaggagaactgctctaacccagaaggtggaggttgcagtgagccgagattgtgccactgcactccagcctgggtgacagagcgagactccattcaaaaaacaaacaaacaaaaataatgttttaaagttttcataaacaaaatgaacaatagtagaaaattgatcactagtaccaataaaagtttcccaaaacaaatatatatgtatgtatgtgtatatatacatgtttgtatacacacacatacacatgcacacatatataaatgtactataaggcaaaattttaaaaatagtttattcaagattgataagtatctaaagtataacaatcagagctacgaaattttagaaaaataatagagtttttaaattatcacggaggggaagaggcttctttaaacaagacaaaaaacaaaacaaaacaaaacaacagaagccataaagaaagcattgatgtgtatctaaacaaaaactaaaaacacagtcaaaaggtgtgaaatttgagaaaatatttgcaatattttaatagacagttatttcccctaatataaaatagcttctatataaaaatgaggacaattttgaaaatacaataggaaacataagcctggagcccaagagactacacaggattagagataaaaatttaagagttgtcagtgtacaggtgtttttaaaatcatggaactagatggaagtacatagtaaaaatgatagaaaaagatgagaataggcatgggaatgaacttcggagggctccagcagaggaaactattcaagatattagaacactgatggtttggctgtgtcaccacccaaatctcatcttggattgtagttcccataaagaactcccactgagagggacccagtgggaggtactttattcatgggggcagttatctctatgagttctcgtgatagtgtgccatgttttcataagatctaatggttttataaggggcttccccctttgcttggttctcattcttctctttcctgccatcatgtgaagagggacatgtttgctttcccttctgccatgattgtaaatttcctgaggcctcccaatccagcataactgtgagtcaattaaacctctttcctttataaattactcagcctcaagcagttctttatagtagtgtgtgaacagactaatatagtaaattggtaccaggtagtggggtgatgctgtaataatacccaaaaatgcagaagtactttggaactgggtaacaggcagaagtttggagggctcagaagaagacagcaagatgtgggaaagtttggaatttgctagagacttgttcaatggctttgaccaaaatgctgatagtgatatggacaataaagtccaggctgaggtggtctcagatgtagacaaggaacttgttgggaactagagtaaaggtcactcttactacgcaaagagactggcagcattttgcccctgccctggagatctctggaactttgaacttcaaaagagatgatttagggtatctggcagaagaaacttctttttttttttttttttgagatggagtcttgctctgtcgccaggctagagtgcagtgttacaatcttggctcactgcaacctccacttcctgggttcaagaaagtctcctgcctcagcctccagagtagctgggattagaggcatgtgccaccaaacccagctaatttttgtatttttagtagagacagggtttcaccatgttggccagaatggtcttgatctcctgacctcgtgatctgcccgcctcggcctcccaaagtgctgggattacaggcatgagccaccctgcccgaattctggcagaagaaatttctaagcagcaaagtgttcaagaggaggcagagcataaaagtttgaaaaatgtgcagcctgatgatgtaatagaaaagaaaaacccattttctggggagaaattctagcttgctgcagaaatttgcaaaagtaagaggagtcaaatgttaatcaccaaaacaatggtgaaaatgtctccagggcatgtcagggaccttcccagcagctcctcccatcacaggcccagaggcctaggagggaaaaatggttttgtgggccaggcccagggcctcccagctgtgtgcagcctagggacttggtgccctacatcccagctgctccagcagtggctaaaaggggccaaggtacagcttgggccattgctttaaagggtgcaagccccaggccttggcagcttccacgtggtgttggtcctgcggatgcacagaagtcaagaattgaggtttgggaacctctgcctatatttcagaggatgtatggaaatgcctggatgtccaggcagaagtttgctgcatgggtggagccctcatggaaaacctctgctagggtggtgaggaaggaaaatgtggggtcgaagccctcacacagagtccctactggggcacggcccagtggagctgcaagaagagggccaccatcctccagatgacaaaatggtagatccactgacagcttgcaccaggtgcctggaaaagccatggacattcaacatcagcctgtgaaagaagccaggaggggagctataccctgcaaagccacagggtagagctgcccaaggccatgggagcccacctcttgcgtcagtgtgacatggagtcaaaggatgtcattttggaactttaaggtttaatgactgccatagtagattttgaacttgcatgtagtctgtagcctcttggttttggccaatttctctcatttggaatgagtgtatttacccaacacctgtaccctccttgtatctaggaagtaactaatttgcttctgattttacagactcataggtggaagggatttgccttgtctcagataagactttggacttggacttttgagttaatgctagaacaagttaagactttggcagactgttgaagggtatgattttgtttgaaatgtgaagacatgagatttgggaggggtcagggatggaatgatatggtttggctgtgttcccacacaaatctcatcttgaactgaagttcccataatccccatgtattgtgggagggatccagagggaggtaatttaatcacgggggtggtcactctcatgttattctcatgatagtaagttctcatgaaatctgatggttttataaggggcttcctccttcacttggttctcattcttctccttcctgccatcatatgaagaaggacctgtgtgcttacccttctaccattgttgtaagtttcctgaggcctccccagcacctgtggaactgtgagtcaattaaactgctttcctttataaattacccagccttgagcagttctttataacagtgagagaacagactaacaaaaataccaaagaaatgatcatgtgaaatttctaagccagagttgtaaatgacggactttaaggctgctactggtgaaaaattaagggaaaacaagaaaaatgatatcggaaactagaaggaagggaaatccttttcaggtgggggcataaagtttagcagtgctgacacctacagtaacatggaaagtaaaagaggtacctataaactgagtggttttgctaaggaaatttccaaatggggtgttggaggttttttctacctgctttttgccatttatagtaaaatgcaagagaagatagaagagctaaagaaagtgctgttaaatataaaagatccaggaattgtttggtttgaaaactatccacttccaacaatggaaaatgatgctaagtaaaaaatagcttcaggcaaagaacaaattgagggcgatttcaagaaaacatgatctaaaaatgaagctaagtttgtgactgtaaaacattttgttcagatttggaaaaggtctaagttgatgcctccaagaatcattcaaacagtagggcttctaagaaactaaaagattctgtttctcagcagcttcagcaaaagccaaagataaaaaggtcttatttcaaagggatctgttatttagtggttgacacttttgtttaatggagtaaacctcaataaaactcatagaaaacccacaatgttttaaggtaaatatattatcgaatcattgtcaggtttaactgaagtagacacagcaaaatgcaaagcacgtttgaatgcccagacttctacagtctgaaagcaggctaagaaaacaacttagtagcaaacacaagctaactttcatagagaagatagaaaaactaaaatgacaaaacaagaactcagaatgtggcactaataaccatggaaaatcattaccaagttttaagttataatcaaggaactgccaatagctctcttgttggatagcataatggattccctacgtgtgtcttccatttctctcctttattgaatgtctatagtggttctttttatgcctgtcccatcagttatttgatttgttggagatggggttgggggtgtggacacagataactatttctccttagttcacaggtcttcatattgagagaaaccctgttgaggggttgtccttaaggaaccacagtcaaagagcctcatccatatgtagaaacacaaatggttagatcttgtactttgatgatgctgtaaaaggagagactattgggtaccctgggaagggggaagaagtatgttttgcatgtggagaaacataaatcactggagagcagagtgaaaactgttgtagccagacttctagatggcacccagtgatctttgcctcctggtatttctgccttagggtgattccccgcacactgaattagagctgaccatgtgaccagtggaatattatggaagtaatagagtgtgatttcccgaatagcttgggaaagacacagccacttctgccttggtttttttggattactagccttggagaaagtgacaaaggctctctccttgactaagctctactctagtcaggctcctctgaaccctattcttaactaggcctcgccctatagacatgacagattcttaacacaaacgatttcatccaccatcaccaccatccccacaaacactaagagacctggacaaccatgtagacttttcagtttggcttcctttatttagtaatctacatttaaattatctccatgtttttatatggcttgatagctcatttattttgagtgctaaataacattccatggtctggatgtgccatagtttatccattcacctactgaaggacatgttgattgtttccaagtttcagtaattatgaataaagttgctttaaatattctgtgcaggtttttctatggacataaattttcaacacattcagatagataccaaggagtattattgctaggtcagatggtaagagtatgttttgcaaggaactgccaactatcttccaaagtggctataccattttgcattcccatcaacaatgaatgagagttccaattgttccacatcttcaccagcatttgttgttgtcagtattttgggcttttttattccatattagttatagttatattagcttattagttctaggagttcgtcagtttcttcagattttttaggcaatcattaaactcagttttatttttcctttctgaaacttatatttccttttcttaacatattttattagataagacttccagtatgatgttgaaaaggaatggtgagaggggatagccttgccttgtcccttatcttagtgggaaagcttctagtttctcaccattaagtatgatataagctgtaagttttctgcagatgttctttatcaagttggggaagttccctctctatccctagttagaaagtttttatcatgaatgaatattaaattttgtctaatggttttcttcatctattgatatagtcatgtgattttcctactttagcccatagatgtgatggattacattgatttttttaatgttaaatctgccttgcatgcccaaattaaaatccacttggtcatagtgtattttcttatacatttttggactcaatttgctaatattctgttgagaatttttgtatcaatgttcatgagagatattgttttcattttaataatatctttggtttgggtacagggtaatgctaacttcatagaattgagttaggaagtattttctctgtttatgtcttttggaagatattatagagaattggtataatttcttctttaaatgtttggcagaattcttcgctagtagacccacatgggtccagtgctttctgttttgaaaggttattaattactgatttaatgtatttaataggtataggttgactcagattatctttcttcttgtgtgagttttggcagatgtctttcaaagatttggtccatttaatccaggttatcaaatttgtggacatagaattgttgtttatagtatttctttattaccttataatattcatgggatctgtagtaatgtcccctcttccttttctgatcttagtaatttggagactttctcttttttccttagcttggctagaggtttattaattttctctcttttcaaagaaccagcttttagtcccattgatttttctctattgacttcctattttcaatttcattgatttctgtctaatttttattatttttctttggcttactttggatttaatttgctcttttaaaaaagttccctaaggaggaatgttattgattttagatctttcttcttttctagtatatgaatgcactgctacagatttccctctaagcactgcattcattgcatcccacaaattttgatgttttatttttatttagttcaaattttaaatttattgagatttcttctttgacccatgtgttatttagaagtgtgttgtttaacctacaagtcttttggggtcttttggccaaactcttttttaattaaagaaacctaaaagactgacagtatccaatactgatgaagagatgggttaaaaggtaggctcatacactatggtactataaactggtacagtatttttggagtgcactttggtatgctttacaaaaaataaaaaattaaatgtccatttcctataatcaggaaaaggcaaaagtcaattttaatgctcatcaagactgaatactatttatcagttgggataagctatgttgcagtagcagatgaatgacaaaatctcactgaaaacagagcaggtgcttatttcttgtgtaaatcagaaattatcggagacaattctcaatcaatttagaagtttattttgtcaacattaaggacatcccctgaagaaaggaacacagaaatcacagaaacagtctgtcctgtgtgcctttctccaaagagaaaaaggcttcagtatttaaaggggaaacgcagtttggaggggaaagagagaaggtgtggtcacattactgaatccacgtgttgcacgagaaaaggagcaggtaggggaaaagccaattatgtatttgtctggtgctcagtaaatcagcactttacataagataaggtgaacatagagtagctacctgtggagatatctggccttttatctgcagccgtgtgcttagggacaaaaggaagagcagtttcttgcatgacttagatttcagctgaatttttcccttttggcatagtgattttcatagtgaaattttattttcctttcagacttgataatgctgtccattcaatatgagacatcagggagtttgctctacatagtcactcaagctgatggggatgtcactctcttattctgccgcctctatttttggcttttggaaggtggagggggagagaaaaaagatctgaaaactagcatggggtattttagttcatcaagtctagaaatgacagatgtcacatccactcacagcccactggacataactagttgcacaaacctgtctaacagagttgtagctttccaagagtccaggaagaaggggtaaacaaaacattgatgacctgtaataatctctacttcaactgcagagcaaggcagacacatacttaaaccttggatggatatctataatgtattatcaagttaaaaatcaaatacatggtacataaccttattttgttgaaaagaaacagcttcacatgtttctggataatacattcagatattaagttctgcttttttttatttctccttgttttagctcatttccttcttcttattcaagcagatcgaggctgtgtgcttctcatcttagggaagaatatagcaagatggcagcagaaaaaaatcagactccaaaatctaagtcttcagtccagggatatatcctgagcttcaagtttcacatagccaccttcctaccacaaaattctcatttgaaggctctactcattatcttttctctgtaaaattgctcttatgttccttatctcaacgtatcacatgtccatccatccagtattcgaggtcataacttaagaaaacatctttatccaaacaatcaccgtgtcccaaacacccctgaatccattcatctctgcacctccattgccaccttcatctttcgtctcagttaatgtgacggcctctgatcctatcttttgccttcagtctttcttctccaatttattctgaagtgtaaaccagattgtgtggtttttttttaaacttaaatcctttagcttatttcccacaattctcaaggataaaatcacttccaaaatcactcaagtcatcacgccagcctgcctttcaagcctcatcctcacagtctatacctgcccttctttcccaaatggcatgctttctctcactaagcatttacacatcttgtctgaaattcctatctgcatatgctaaatgcgtgccaatttttctaatgggttgttttgacgtgaactgattaccagagtgagtgcaagttcaagagcttgacaggggcacacctctgtgcaactcaggctcaaggtgagtggctttgacaggacagttctcattctaagacagagcattctaaattatcctttcaaagatagttcctctccctatcttccaccatccattttattttcctttaatttctatgtcatgccattgtttccttcataactcttaatacaatttgtacttttattttgaacttattttcttctccttcgctgcaactaagttctattaaagatcttgcttatcacattcacagcaacatcataagagcctgatacacagaagactctgaaaaaatatttgtagatgaataagtcaaagaatgagtggtagatagcgataacatcaactatcacatctaattatggtcataaaattttcacttaagaactgttgagtgacaccatatttctagttttgttatagtcattggtataataaaaaagtaatggaaagcacaagattatcttactctcaaatattactaacttgttttctagcttggaatataggcatgcctgcaataatatgaacaccgcacagcacagttcatgcacctgttaatgacatcatgttttcttctcttacttttactgtgctaagttctttgagggattaaaaaatatataaaacatcatgcctcttctcaaggaactcataatttgtttggggagacaaaatagataaatatatataaggaattatcaattgcaatataaagaatatgtaattagccatcaaataatgctataaacaacaaatattagacccccagttttttctttgagactgtttcctcatgtgtaagagttaccacaaagatcaaaatacaaattatatgaatgttttatgtgagctataaatcccataaatcccattacccacgcaacacagtagtgctattaaaatttttcctaaagcatagcaaaataagttgactactcagaaaacacagacacattggtagaacacatcatcgaaggatttaagcttttttttttcttttacattattctgacttaattttaactgtaatattcttaaatgtgaaggaaaccctttatcaggattgtggaattaaagagcatttcttcattaagcatgcctttacttgtagttcacgcatttcatttacataaacaagtgttaagtactactcagcactatatgttcttcataatagaaaatacaaagattcctttcatgaaagatccgagttaaaagatgcaaattataaacaatgtcacacatgaaacaaaatgaagtctggctttcctgatgccaaagagacgttgagagttccacaaaacaaacagaaatgtaaaatcgcagccgggcatggtggctcacacctgtaatctcagcactttgggaggccaaggcgggcggatcacgaggtcaggagatggagaccgtcctggctaaatggtgaaaccccatctctactaaaaatacaaaaaaattagccaggtgtggtggcaggcgcctgtagtcccagctactcaggaagctgaggcaggagaatggtgtgaacctgggaggtggagcttgcagtgagcggagatcgctccactgcactccagtctgggcaacagagcaagactccatctcaaaaaaaaaaaaaaaaagtaaaataactttgtgaatgtctgtttatcaggttgtgtgcaacagattatctgtggtctaacttccaaactgtaggggagacttccactttctactttactcatttctgtgttccttgaaatatttgtttgcgtggtttctctctggactagatacagtctatagttcatgtgtatagagactctctcttcctgtctgttaactctagggaagtatcagcaccacatccattgttacagagaagtcttatgagttttagcatgagaaaagtatcaaatgtaattgaagaaatgaggactagattagtgaatgctaggagtcagaatgggggtaagggagttggatgaagctataaattgcaacatgaggaatctttgtggtgatggaactgttctatgccttgattatatcaatgtcaacttcctggttgtaatgttatgctatggttttgtgagatactggccactgggagaaaccaggtaaaagatatacggaatcagtccatattatttcttagaactgcatgtgaatctgcaattatctcaaaagaaaagatttaactggaaagcgacagtaacagtataagtaattaaacaaaacaggaacccatgagttcataggggtataaatgagtgaataaatgagagaaaaagtttctcacagaagattgctaatacattttgaaaagagaattagaaattcatcattaggcaactatcaatcagaataatgattaattcacccaagaaatatcaatggatgctaaaactagacattaaaatttgatgtggaacaggatactcacatagtcccaattacctctctacagggtgcttattacaaaggataaaaaaatgattgagggtatgtgtgcaacaggtatctgttttcttcatagtggcaaacctagtagacatcaccttaactacataatcaaagtacataataggacaaatcaacatgatgtactgcttgatgggatgtagtcggaagaaacacagcagaatttctctcttgttttgtcaaagataaatgatatatataccattgaaaatgtcagacaagccaagttgagagacattctaaaaaatgacctgtgatctttaagtgacaaagtcatgaaggtcaagaaaaaactaagagactgttgaagatttaagaagactcaaagagagataatacagccagccagcctggattaggttattttgctataatggactttattggacaaattgatgaaggttgaacgggatctgtgaattaaatgatagttcctgcatcaatgttaatttgactttaataattgcattgaggttatgaaagagaatgtccttatctgtggaattacataaaaaagtattcagggctgatggggcatcatgttggcaatttattcacaaaatctgtaaatttggttagcttttccataagttccaaaatgcaagttatctttaacataaaaaattgggttgagaattctctctgcaggctagagctagattaaggaatcttgtgcccaatttctccttcttcctcttctaatgaacatccataatcaaatgaggatagcatgattgaaaatggaaacttttttttttttttttgaaaatggaatcttctaaatcaaggattggaaaactttttcaataaagggccagagagtgaatatcttagactctgagggccattatagactctgttgcaactactccactctgcgctagtatttaatgatacaaaagcagtcatagggaattaataaactaataaggatggctgtattccaataaaactttatttatggacattgacatttgcatttcttataattttcatgtgtcacaaaatattttcccaaccatttaaaaatgtaaaacctgttctcagctcataggtcatacaaaaataagtggattcgactgatgtgccttagtttgcaaattcagcatattttcaaatggtcattacatgtcacatcattaaagttcatattcagagttataaagctcatattcatagactatttgctaataatttatgatttaagtttataatttaatattttgttaatagtctatgaatatgagctttataacattaagggaagaattagagaatttgctgtgtagactacacaagatgcaggtgaatgctagaacatgaacagcccttgcttaggaagattaacaatacatcctggctcctagttacgtacatctcttctatcatgcagtgtccaacctcattcacaaaccaccattctaaacccacaaataatccctaattcttatggggtttggaatcaggtgaagctcagttgatatgaaacaattagcactttgtttcaaaagctcttttcattaaaatgttctgtttactttgttatagtgaagggatgtgataaaagaggtgtttctacagtttttacctagcatgagtgcacactctgggttttaagggaaggagctagaagcagtatataatatttcagaagctgagagaattctggaataaactggaagatgaacagtggaacctaaaacaatagctaactgggaaggagaaaaggaaggctgataagattcattaattatacgttagttgcggttttaggtcttgaaaattatggtttcactaatttaaaaagaggaatatatgtgaggggtggctaatttgtaaagaccagttcaaagatatttgatttctaacaatcttatatccacctaaaattaaaggttcagaattctcttccaaatcctcattgagacattcacttgaataaatattttatctttttccaacaccttagtgatatactgaaaatgttataatggttatatcattggaagatatatatataacttttatcttgttggttattaaacctataagtagaaataccaccgtgactttataaactagtgagagtgtttcataaagttgtcaaaattttttgtaaaatcagtctttcaaaaagaaacccactctaacggttatcctgttgagctaaagtaccatcttaataaattgtctcctctcaaggaacataaactaccacctcccagacattggcaagatttattactcagattgaaaaaaagcagttgtgggctgggggagcacacggttgctccgcctcagggttaagcagcccttgttacagagaaataaaggaggtcatagtgggaaaaacacccacgcaatgcaagctggaagactctcgaacaagagaaatagcactgaccagaaccacacattaccaaacgctgattgaaaatgatttattaaagtccaattagtatgcttttcatttcaaataatccatatagcctccagaaaaatatgcacatgtgtaaaagtccacgttcatttctttcacttccaatataaagtattctgtattttgtataaagtacgtgcaaacacctttctgctaatcgggtccccacattcttttcactacaggtactttacaagtctgccctctgctcaaacactaaccgtgcactgacatcctccttcctagacagccattcatctcccggacttctttctctcagacatcctcctgacctcccctgacctgcttcaccactgtgttacctcactggttacttgttacagcaaactgatgcaactactagtctacctggacaacatattaaacaggtatcacctaatagggtggcagcctatcggggtgattcctggcgaatacacagtaaccaaccacatactgacacactcaacccatttgctacagatggacccacactaattgatatgacaatcctttattcactcggcacatttggtttctttgcattttcttccattttacattgcaggtgtggctaccaagagctggataacgagtccctcaaacaaagtttggaattgcgagatatattggggtaccttgattcttgagacagttgaattcttctagttgatcttgttgtattaaaaagtcactctcaactgaagtgaccactgcatttcttttgtaaaaaggtcatttgactggcttttcctcacaactgccacccatgcagtacaaaagcaggaaatcccttttcatgaaaggtgtaagtacaagatgacatttcacatttttttaaaaaaagaatccttcatgggaatatatcctaataatcaattatatggagacagttttatgtacaccaaatttctgcaactttataataatgaaaattagaaacaacctaaatagttaacaacatgggaatggttaaataaactgagttgcatccattaaatggaatataatatagccattaaaattatgtttttgtaaaatttttaatgccataagaaaatgtggcaattttgcaatgaaaaagatctacttataaaactgtttacagtatgactccaattatgtaaaaaaagtatacaatacacatataggcatacatgggggttgctttttaaaggtggttacttctgggttgtgatattatcagtaatcatttttgcttttttatacatttctgcatttttcaagttttctatgatgagtatattattttacaaagactacgaaaattttcctctgatatactggtaattagaatgtacttgggtattttaaatatatgggaacaatattatagtgcttcatcttctatgacttttttggaatacatatcactttggtaataaacttacattccctgttttatacttgttacaacattttaattaaacagttaatattgtgattagagcattgtttgcttcatgacctaaacaaatactggctttgaagtctaggttctatttcctagaagatttaacattagtatccttttaatctttttaagtaaggcatactgcatacatacattacatgcatgctttctaaacaaaagataattccaacttacagttttcctatgtaagggaaaaaatggaattatggtagtttaaaagcagtccatagtctcatccatcacaaacatgctgataggcataaacgtgtttattaagtgaaacgtatcctttaaaaataaaaaagggaagcctgtatataaatgaagttgtggattcaactagccagaatttattctgacttgcaccaaaccacacaaaatcttttaaaagtctagttagtgtagtctaaatggacactccagagtctgttcttgaattccattgcaagagctccaacttcctactttcagaagggatggggatcaagatgagggttgtcacataagctaattttcaatatatatcaagtcttgtggggtccaggaacaaatactgtcattggttagtgtttaagtacatgagttgacttttctcctctctcacaccccaccttgccctggcaattgggtagggggaggctgtttatcctccaagagaggacggctggttcctcatctcagtttccgttctaaaccacagagtggtcattgctgtgaactccagccaagatggtgtggttgagggaggaagccgagcggtctgagccttctgtggggccggtggggttctcactgcgctggcagcagaggatctgcctaaaggtggcgctcatttctttgtcgcggtaggagtaaatgatggggttcatggcagagttgaattcagcaaggagaaggaagaatttctcataggccagcacgtcgcactgtggacagcacacgtctagaagtaacaaaaccaatccaggagtccagcagatgataaaggcccctacaaggacaaggatagggatcagaaggatttttaaaaagagaatgaaaaaatattataaaacatgcgaccataaagtgaaatgatttcagttcaatataaaaatactgaagttggaagccaccattgtcgcaaatgaaatactcatttcctgagaaaatcagaaaaaatttaacgatagtcaacttaaaattttattttggacgttactaaaatcaagcaattatgagacattgatgattattattttgagcaaaacacaaagagtttgataagcaattgagatatgaaaaactgcattcaggaaacacttcacctcacataacaacatggtttttaatagcagtgttattttcaggcaaaagataagcacgaatgataagtgtcctttaatgtttaattaaggcatagtttctggattcaggttgtctgggcccaaatctttgtttgacatgtaataaactgggtgaacttaggcaaactactttctttccttaattttcccatctgaaaatgcagatgattatatttacacctcataaggtttgttgtatggattaaacaagtgttaaggaaataatcactcaatctgtatctacaataacaataataattattacctgctgagtagcatgggcctgtttggaaattgtgattttcaatgacaagatctatgttttatttttattcaacaactacccacatagtgctgtcctatatgctttaccagtaataatttattgaattttcacagtagccatatgacatagaaactaatatccccattgtacagatgaaggaactgagacccagaaagtttatataactggctcaaggccacagtactggaaagcagaaaaatcccagagtttctgttcttagaggctgcctccagagttcaagctctagaaaatattacatttctatatcttgaaaatgataacattaaatattttaaaccaaatttactatttcagatgttctactaatttagatcaactttgttctctttcttcccccaattattctgaatcattacaattttactataactgtaagaggaatgaaaatatagatgagatgcttaattctatttcatttagtttctgaaatcactcatcatttggatcccaggaaaatggaggttgtaaaatagcattaaatcctaccactgtgttactccagactctgctggggatcttctactgaaagaacatgagccaacagcggtgggcaccactgtgtcccattacacctcacctaatgggccccatatgtgtaatcaggcaggctacatatgtgtaatcaggcagagcggaagtaggagcaaccccagaagggcatttgcatcttcagatttaaatggcgctggctttggtggatgcaggcttggactggggtcatggatttggtccagcctcaaggaattagtttcacaaaatgtaaacaaatgagatttagtctccaaacagcccacttttgaatctgagctttcttttgtgaaacttttcagcagggaaatgaaaataaaggagaaaagtacccccataaagctctttgttctacaacacaaatgtgtattggttttaaactgctgttcactttgaagattggccaaggtacttcattttctaataaatacaacaccttagactttccttggagagaaaaaaatatttcaaatatcaggagataatagccaaggagcaatttgaacttcaataaaaatgttaataaagcattcattccaagtccttgaatttccttgcttgaaaatcactcagaaagctaaacataaaggaaaatcaaaggaatgcctcttgggtttcagaaataatgcattattcattgagaagccaggaagggaattattctcaggatggaaaatgcttggatggaaaatgcatggtcccattatgccatttacttggaaactaaaaacacacagtcccttcatgaatggaacagcattctttcaagtttcctttccccttccttttatcaaagctctaattgagttcaaattcagaacttgattagacacaaggaacatgcatctcaatagctagattttaaataaaatgatctttttctccttctgggcaacagaagggaatatctttattctctcatacttaagctgcttgactttgctcaaaagtgagagaattcaaacactgtcatttgttgtttataatttcttcccatgttaaaatttaaaaggtgtaagatctttccagaaagagcccataagccttacttttagaccaagaaatgcaaggaaccctgctagactgaaggcaggaagtgggaaacaccacagcctgacacaggagcttctatgtatggatgcttcattgaggaacctggattcctctcctttatcttcttcactgaaaggaactggtttttgtactaggattaagcccaaccacacagtcccaacactctgtgtttggatcttcaagactcaatccaataatttcagtgactcacagtacaggcctccgaaatcaacatctaaaaccaatcatatggaaattctgcgcccccctccccctcctttctatttcacagaggcctcaaggatcaaactgaccaaaagatgaggatgcactacagaagacgaaaatgggggctggaaaattgtaagggatgaggttcctaacccacaatgaatggatattctgaaataaattttgctcaaattaaggatttccccttgagcttctgaaaacaataataaaccacacctaaacccctttaatagtaaggagctaaccataattcaatcaggttacaggacttgagatgtgcattgtggaccccatcaacatgtaatctacagagagttcagcgtacacctgaaaggttgataagagttaaaacacctccatctcagcacctctgaagtggagaaataatagctccctgcctcctccacatggcacagtgaggatcaaactgagatacaacttgtaaaagccctctataaactgtgcatctacctgaccaccatgacttacgtgagtggcacgctggcgttgcagagccctaggatagattctccaagggcagaatgtgaaaatgtgttttggacaagaaagagctggcatgtcaaaaggctctgagacaatactatcctgattataaagagattcctaggacttgcagttgggtatgaagaagataacaagagggaatagagagacaacatagggaagcaaatcattttggaggttctcatgggtcaatgccatcacctaccaagatggggaatgaaatatagtactcagtagtcatagtgctttgagtagtttgtatatttccagcacatttctgatagaagaatcccacaaacccaggcacaacaccgatgaatggtatgcaacagtatgaaagtaagaggaagggcccggtgcgggagctcacgcctgtaatcctagcactttgggaggccgaggtgggtggatcacctgaggtcaggagtttgagaccagcctggccaacaacggtgaaaccgcatctctactaaaaatacaaaaattagccaggcgtggtggcgcacacctgtggtcccagctacttgggaggctgaggcaggagaatcacttgaacccaggaggcagaggttgcagtgagccaagctcacaccaccacactccagcctgagtgacagagcaagactccatctcaaaaaaaaaaaaaaaaaaaaaaaaggatgaagaagtgtggttatttattgtaacatcagaaacagaagtagcagaagataagatgtccaaggtcacaaaggtcttgtatatctggctatttgaaatttgtccagtccagcatacattctcaaccctagccacacattacaatagtctgcagagcttctttaaaaaataaagaccttcacccacacctcccactatgggattgtaatctcattggccttactggtcagattttcatttaagacacaacattggtgacagagtggaagaagaaaataaagtaaaggcaaaactatttccaaattccagaagagagataatgaaagccagaatcaggacagcagcactgggaagagatatagaaggactggagaagtatttaggagacggactccatgagatggatgagacagagaagtctagaatgacttctaaattttcactttggttgaaggaggaaacacaggagaaaatgtttactggtgttttgtaagggaggtaaggagaagaagacagctgatgagctgggttcagtatgtgtttagtttgaggtacctgcaagacatctaatggaaatgccttaattacatctaaataggctcatggcaatttgtgtcatgggaaactgtctcacagcacgctgaacaaaagtggttatattgtcccctgatttgccaatattacaagtaacatggggtggaggatattcaaaacagatccgtgggttgttcttccttgaacaagctttattcctccctgatgcatctgtcaaagcaatctgtgagaaccccaatgcccacaaagatggagggagaggtgctggaatgcagacgcaaaaggcagggaggaatgaggctgttttggaacaacaggtcacagctgcagatcgagatcatattaccacaccttccctcaaatctatccaacctcatcagctgaataatgcttaccatctggtctcacaattacagtctttttttctagaatgactttttcctaactagttgaactttgcttacatatggaatgcaagaaccaaagttaaagaggaaaacagtccttgccagagaagacctctagagacagtgtccaagatttttgatgaaaaacacagaaagcgtttctagtctggctggcaaagttgtgtttttacaaaagaaccagacatcccatagatccaaaacaagtcaaggtaaatcaattctacaacagcactgtgcccaaggtggcctcactcttcttgtttttcaaatgaggatcccagaaacagtcccatctcagagacctgcggtgggaatcaagggagaaaataaatgagtgcctaagttgctttttctgttttccctaaattgtttattccctcaggtcaggcagcgtggtatcccagaatctaatcaaattttagttcatctctgtagttacgttgtgatttctgctattaaggtacacacatactacatagttagctaggaaatccttcaatgctatgtatcttaacagagcctatgtcagaaaaagtggccacagatgcaaagcttattcttccccagtcttgcagctaagggttcattataatgggggtgtatgtggatggctttttgagattaacgctttttctaaaagaataacccagattaattaaaaaatcttttttcctgactattgaaactatataatttacctgaggtatctccacagtattattgttctatattatttccaccctgataccaattttactccatctagtttggtgttcaacactgccattccttcctggtcacagcacatgttgcatacatttaaagtttcatgatttcatttattgtatgatgtgctctagtattttcattactcactcttgagagcaacatttatcttttagagaaggataataacaccatacagagctctaaagcagagcagaatactcattatgttctctttttaacattcctgggtgacagttttagcttcattagactctcctgatcaccacaatgctactttcctgtgcccaagagaatgccaaagctgccttccctctggtgtactctccttaacattaagtagtgtgtattgcgcacgtacaagttccataccctacaacagactctaactctcatcctgcaactgtaccttggaaagtccacattgaaatgacttgaatgctagtgccattcttacagaccattcaggtgctgaaaagccaggtaaaaccacttctccactgctaccatcctagccaagtgagcaataccttttatctgccaattgcaacaggctcttaaccaattcctcttcctccacactgcttccctaaagtccagcttgtacaaaacaagcataaatcaatttgcactaagtcactctcctgcttaaaaccctccaaagtcttcctacttgaaatccttactgctatccataatgccctacacatgactggccctgctagtttcttggatctcatctctttccactcgctcctcatttacgaggttccagtcacacagaccaagcccatttctgtctcaggatctttgcatttatagatccatctgctgggattactctctctgcagctttttatgtctatttacttattaaatgtcgctttcttaaaaaggctatccttggttatcctagccagagcaacagcccaccaccatcaccacattctcccattttattatcatcacatgctgatatacccaaatgatatatcctttatttatacccaaaattattgtatttattggtttacatgtttattgttttatcttccctcaacaagaatattaacttcatgaaggaaggaatgctacctctttcatgtctgtatctctggaatctagaatattgcctggcgacagcagacactcagtatcttccattggatgaattagcaagtcatagctaagcgcctagtacatatatcccaaacaagaaaaattaataagtagaaatgtcattaaattacgggtggaaaataaacattaacatctaccgtgtgtaaggtctttaaatggatgctataggacattcaaaggggcataaggaagaccctggaagaccaaattctagaatggtggaacaattcctacacacttttgaaggttcagaatttgtatcctataattttaacctgtattacctggccaaattatttttaagtgtgagggttttttaaatgagtgcacagatacataataaaagtgcaagcacatgaatgagaacaagcagcagcaatttccggacaacttctgagatgacaggcaggaggaaggagtaggggacggtgctttggttatatctacaattcttttcagagacctgaagcaaattatgtaaaatgttagcatgtttgattttaatgtttggtcattagatgattgccgtattactttttgtgctttttatatattcaactcactcatattcagatatttataaatttagaaattttaacaacaagaaactagaagtcttgatttttcttaagtaaaaggtaagaagaggaggcagaagagtagaaagtttgctaaaagttttgtcttgtttgggggctactgtagaaaccgaattatatcttgaattttattttattttacttgagactgagtctcactctgtcatccaggctggagtgcagtggcatgatcttggctcactgcaacctctgcctcccagattcaagcgattcccttgcctcagtctcctgaatagcagggattacaggtgcacgccaccatgcctaatttttgtatttttagtagagttgggctttcaccatgttggccaggctggtcttgaattgctgacctcagctgttctgcccaccttcgcctcccaaagtgctaagaatatagccatgagccaccgtgcccggcctatatcttgaattttttaaagtacgtttttaaaatttaaagttagccactattaaaaatagatattggatgtaccactcaaaccactaaagaaacaaacaaaaattttttaaaaaggaaggaagaacaaaacagtttgaaaagaaaactcaatttatcaaaaggaaggaaaagaaaagacagaagcaaaagcaaggaaatgcacacacgtaaatagaatgtcaagaataagcccaaacatgtgactagatatcataaatgtgatgcccttaattctcttactaaaaaacagattcaacaccatgacttttgaacagatttttgttttcccttgaacttctaactgctttttctttttattctctcttttgttacagataagaaacacacagtttattacagcagaagcatgccacagatgtatttccaactttttaattatacaatttatccccaaagacatttcctgcagcccgctgacttactaacccaatcgaacccattgatttctaggcctgcttctcagcttccactgagggctgcttattttacatacctaggtggcacattgtttcttctaacgtacatcttttttttggaatctcttttcttctccctcccccacccccattttctagagtgtatccatgagcattctttctagaaagtttgcataagcttaaaatcattttctctcagaacactgtcttctagtatttagtcttgcaggtgagaagtctgatgtatgattcccattctttttgtgtaaaacacctgcatagtacgagtccttacttactcgccaagctttgtcttgcactgcatgtctgctttctggacatattagtttttccattcctttcagtctatcacaatccccctaaccatgggcctttgtacgtgtttgctctctcttcctgggatgttacctgctctcctcgcaatctaattcctactcacactttacttaccgctacttctgggatgccttccctgattaagtcaaaaatccctttgtaatatgctctcagcactataaaacactccatggtagaagttatcacaggtgtaatttatttttatttataatgtgattattgtttacttctgtcatcagactatttttactccactgtgtctattattacctaacaaaatttttggcacatagtaagtgctctataaacatttgttgaatgaataaaaaaaataagtgaaagaaagaacaaggatctggctagctagctaccaacctaggccattaaccaaatatttttctcatcctctcctacctgaaactgtcacaatgtctttcattaactttgggagatcacagatatcactagaatataatgtcttggctttgctcataattcttgcttggcccttgattggcaattttatctatagtctcacattcgtctttagattaaggaaatatcctattactttgagtaattttctttccattgtttctgttcatctgagacttcttttacaatgaatgttggatatttgggaatctacatttaaaaattgatggatccttgatgtctcttaatttttcatttgtatttttaacactttactttttatttggtatcctgggtgatatcgtggacttattttcaaggtcaaatatttgatttttagctatatccatttcactacttggtagtggcttttggtttgtctgtttattagtaatggataaaggagggcaggcgatcagatttttttattttcaggaacactgttctctgaatgatacttttgcatagtaatatgtactaatttagtcaatacagtgtcttcttgaatttgtgaagctattaattagagtttatttgacgttattttgtgtttcctatactatcactgtttccatgtaagatgttgctctacattcaaatgcagtgggtggggggtcatcatgcttcaaggaatgtctattcgttatgcaggaaacattcctgaatagaggaccctcttaatttgagaagacagtataaagaactgccaccaaagtcagcttttccctgtacctaaaacatttagccatgccctctgagtaggcaaaatgctaaatgagataattacatggggagagatgtgttcctctgaatgttcttatctacaaatagaacaaataaagtcagaataatgttccaaaaatatggaagcagcacaaccacctaattagatccaggatgtatgcacacatacttcattgccaatggtagctactattctcaggaacagaatgtgacccctgaggtctataagcatacaaaaaaggaaaggctttaatttactcgcaatcaaacaatacagtctaaaccttaagatgggtcactgcctcttccttttttcctaattcttgtcttctgatttctacccagctctgtcttagggtgaagtaactaaggttaagactgacttaccaggccgggcgtggtggatcatgcctataatcccaacactttgggaggctgaggcggatggatcacctgaggtgaggagttcgagaccagcctgaccaatatgataaaaccccatctctactaaaaatacaaaattaggctgggcgtggtggctcatgcctgtaattccagcactttgggaggctgaggcgggtggattgcctgaggtcaggagttcaagaccagcctgaccaacatggtattaccctgtctctactaaaaccacaaaaattagtcgggtgtgatggcgggtgcctgtaatctcagccactccggagtctacggcaggagaattgcttgaacctgagaggtagaggttgcagtgagccaagattgcaccattgcactccagccggagcaacaagagcaaaaatccatctcaaaaaaaaaaaaaaatttagctgggcgtggtgacacatgcctgtaatcccagccactcaggaggctgaggcagaagaatcacttgaacccgggagacagaggttgcagtgagcaaagattgcaccattgcactccagcctgggcaacaagagcgaaactccatctcaaaaaaaaaaaaaagactgatttaccagagcattattacccatcaataaccaaaggaaaaaaaaaaaaaaaacaatgctactccaaggcctacaaagagattatctggtaagcccttacaattttcaagtcactgatattattttaaacttgtaaaactatatatatacacatatgtatgcatacacatataacacataacatgcatgcactatgcacactcaggatcctcagtcttcactttgctgtatcataaaaaagacagtaagatttgttttcttttacataatgtgcactatgagacccaatcaaaaacaatggtaccacatatattcttcacatagaaaataactcacagttctcaaaatggtgaaatctattttgcctcgtaaactaagtgataaattgcaaaagttttaaaaagcaaaatttcccccttatttaaaaaataataaattgtaaacttcacagaaaatcaatgttgtcaactccagaccaacatcatctaacttagaaagtgatactaaactaattgcatgactgtggtccaactgttactaaggtgatttgaataatatttatccctttaaaaggataaaggaaattccccttagaatctttccctagcaaaagttcaacattaacaggaagtttataattggttttgcaacatatttaattttttaactacaaattaagattctcccaaaataatataaatctaaacaagtactgaaatctggctgaaaatgctcatagaatgtagctgatgacaaaatcctgtggattttttttctttgcagttcatgaatcacaagatatgtattacccaagacagaaacttcaaggatagagaaacgtaatggaaattttatttacaattcattttcttactatcaaaatggggaaaatattaaaaatttaatctaaaagcgaattcagaaaactttgtgaattatttacataacctaaaaatgtttatatttatataaatataatttttaatagccaaaagacatgaaaagaagaacagtataaactgtaaatgtggtcactgtcattctttttgagattagttacatctcctatagctgccaaatgccctggattgatctttaggaagcacagattcttggcagagcagaaaggaggtacggtctgttctaatatgatagctatgtgtctaagatatctctctttatcaaaaactttttctaaattaaaaaaatccttaaagtaaggttataaaaacaattattcaattgggaagtgggtgcttcggctacagaattccagattcacaatcataaacatacttttttctacataaatttcaattattttaagtacaagtgtagagtaaaaaagctagctgataaaattgacaacaccaagtctaaatattgcaaagcaaattctgactagcccgtaaatcctaagcaaaagtcaatcagttctaaagctgtctaaataaactgcaacaatatcgctgatagaaacttatcctacagatatatttacacacaatacaattatgcatgtgcaaagatttgcagtattctttattttaaaagctgtaaataacttaaataagcataaatagagaagtaaaataaggtacactgcacccataaagtagaatcctattcaattccatcagtttaggtattctggctttactgataccaagtcatcagatgccctacagtaagccttaatggaggataaaattcaatgcctctaacagtgtttagaacaacaaatcataaaaatgatactttaaacatcttatttaaaaatataaatttgtattcatttaccaatgttttgacatagagtcaaggctttttatttgaacacaggtgcattgactggagttctgtgtcatattcgaagcaaaagcaaccccaattaagcatcccatactacttccaatttggctcctccagaatagagtcagaacttaaaattcttgcaaagccatttcagtgaaaaaccctgtggagtgtttttatggattctccaaacttcgacagttgttttcatcagttctttttttcccccaatttacattaattgaatgttaacaaagcattcacctaattttcatagaaacgatgtcttctttttgtacttattttattagacaatgtaattatttcattagttatgtgactagggatgcagcaatgaacccagcagaaaaaaaaaaaaaaaatctgccttcattgagtttaggttctaagataaatgagaaagacaatcaacaaaatacaaaataagtaagatacattttagaggggaataatatttggagactctggaagagcaagtgtggatacaagaagagcagctagaaactcacgcagtaaatcagacaagagataatggtggctttgaatatgggaaggtggagatcatagacacattttgaccatacagctgatatgtatggctaacagactggatactggagagaatgagaaaagtaaaaaatacctgaaaactgaaaaaatgaatttagtggcaaggaggacactgatgacagttcagtggagtcatgagaactcctgacttggagtaacatcgagagagcaggaaagaaactgaatactgcaaggatatacaactctttgaagcagtttcactggaagagaatagaaaagtggctatgggcatgaattagtatgttttacaaaactattgttaacacattggccgggtgcagtggctctcacctgtaatcccagcactttgggaggccgaggcgggcagatcacgaggtcaggagatcgagaccatcctggctaacaaggtgaaaccctgtctctactaaaaatacaaaaattagccaggcatggttgggcgcctgtagtctcagctactcgggaggctgaggcaggagaatggtgtgaagccgggaggcggagcttgcagtgagccgagattgtaccactgcactccagcctgggcaacagagtaagactctgtctcaaaaaataaaaaaataaataaagaaagaaaaaaccacattaagttggtgaaaagaaaagtcaggtaagaataggtgcatatactcagtgtgtatatgtagatacacacatgccctcccacactcacttatgcttatatatgtagataattttaaaaaattctaaatcagaaattagtattgccatggctaaagattgaggtgagaaggtagattcactgtgtatttttcactactagaatttttgtcacaaatcattactttaaaattaattgtaaaattgtaattgagtttacaactgttaataacaacaggataccagctgagctgctggaaattcaaagcagctttaggcttgtttgctgtacaaatagcatattgtggttacaaaataatcactattggttctagtaatacaaatcacataccctaattaagtgattgtgttatatccaaatggaatatctaacagactagaaatccattaacagcacagttttgcattcagaggccaaaatatttttacaaatgaatacaaataatgagaaagaaatgaaccatgcatttaactcaagaagttgagcaaaaatatataacgtccccaaaagcaaaaaagaaattaaaacatgttactgaaatagtaaataaaaaagaataaacttgattaagacaacaaatctggtatttaaagaaacaactaaagagacaaatgtcttataaatatgaccaacaaaataaaaacagattacgaagaagagataaccatagatgatgaagttcacacaactagaagaagttacatgaaattatttgccaataaatttgaaaaaatggctaaaattgatgtttttctaaggaaacaaactatgacaattgatgtaatagtttgataatctgaatatacccaaaacaaaaaacatagagaatataatcgttaaaaaagttccttcacccccctcaaaaggcaccagattcagatggatttgtggatgaaatttatcaaaccactaaggaacatattacttcctatggaatttatattgttccccaagtattaacatttaaaaaaaattccaattcattctaagagactaaaataaactataaaaaaatagacaaaacaaatctcccccccacaaaactacagattagtttttctcagtgggattggaattggctttggggatgaaaagcttctttgttgcattaactgttccatgaattccagggtccttagcaccctgcccattgtggccagcaaaaactactccctcacattcccaaatgtccctggagaatagtcagcaggaagtaccacctttctttgagaataactgtatagaccagtcaactttatgaatataattgaatctgacattatattagcagaatgctatgatccaaccaaaaagggttaacactaggaaatctcttaatgcaattcaccacactattaagaaaaaatattagcaccaatgacttgcctggtaaaattcaacatttacttttttaaaaggaagataaaacaccaccaccaacaaatcaaaatataattacaagtacaacacttagtaatctgggaatggggaaaactacagaaaacttattagaaaccaacagaaatcttatttaacaacgatatactagaagtattccactaatataagggataagaaaaggatatccatttgtactgacattctagtcaatgaattaagctggaaaagaaaaaagtgataaacaattgaaaataagttgtcctcagattgcctgcttgttaatagaaaaactaaaatacctgataactattcaatcaactattagaaaaaaatttgtaactcagaaaagtgggcatatataaattaaagtacaaaactaaatggatttcttataataaatatttgcaagataatcatcatctagcaaaagtatgttattcttcaataaagaacattacataacttttaagaaaaaatacctaaataaatggaactagtaccatattcttgaaggggaagattcaatacttttaaaataggaattctttcaaaattagtttgtatattaaacgcatttgtgggggcaagttaatgaaaggggattatctcattaaaacatgctataaagtcacaggtttaagctagtttggtactagcaggaggataaacgagattagtggcacacattaaaatctaaaaacggatctctgcataacaaaatctaacacatattttaaaacatgaagaaaagatcaaatgctcaataaatagtcttggaataatttgactttggggtgagggagggatataaaagtcagattcccattacatatcagtacaataataaaatgaataatccaattaaaatgtaaaatagtttaatagatgcttctcaaaagaaaatgtataaatggcgcattaagcacatgaaaaggcgatcagcttcactagtcatcagggaaatgcaaattaaatccacaatgagatacgactgcacacccactgaatgtctacaatttagaagagtgaccctagcaaatgttgacttggatatagtggaactgaaactttcatcactgctggtgaaaatgtaacatggtattaattatttggaaaacagtttggcagcttcctcaaaagttaaacattcacatatcatatgactcagccattctactcaatatttatccaagagaaaggaaagaatatgtccacacaaagatgtgtaggaaatgcccagagcaaaatatttgtaatagtcagtaactagaaacaacccaaaagtccatccacaaatcaacaggtgaatatacagtagtatttccaatcaatggaatactagtctgtaatagaaacaaactatcaatatatgcaacaacatgttatatgtcaattatagttcaataaagtaggaaagagagaatgacagagagagagaatgaggaagaggttgaccaacactagaaaggccagcaccaactatctttagtttcttcttctagtttcctgtagaaagtaggtcatagctcaggccggcacggtggctcatgcctataatccaagcactttgggaggccgaggcaggtggatcacgaggtcaggagtttgagaccagcctgaccaacatggtgaaaccccatctctactaaaaatacaaaaattagccaggcgaggtggcgtgtgcctgtaatcccagctgctcaggaggctgaggcaggagaatcgcttgattttgggaggcagaggttacactcagctgagatcatgccactgcactccagcctggttgacagagtgagaaagaaagaaagaaagagagagagagggggaagggaggggaggggaagggaaaggaagggaaaggggaagggaaagggaaagggaaggaagagggagggaggaaggggaggaagggaaggaaggaaggaaggaaggaaggaaggaaggaaggaaggaaggaaggaaggaaggaaggcaggcaggcaggcaggcaggcaggcaggcaggcaggcatgcaggcaggcaggctcaaaaacactcaataagcttagtggtgcaggctgcacccttactggggaaacccatgattgtccagcaatatctgtggctgggtggttgagtctgttgatccagggatgaaatgttagcaagcgctttggcttcagaactaaagctcatcagtattaaatgtgttattctgatcttaaaaagaataggtagcacagtgggaaagatttaaaatgctcttactagtgacataatggtaataaataaatggacacactcatatactgttgatagaagagtcatttgaccatctttttgaagggcaatttggcaatatctatctaaatgtacaatgtcctcttttacctaacaattccattttagaaatgtgtcatccagatatacttgaagaagcatataaaaatacaaccacataatgttcaatgaaatatttataacggtagaaaattagaaactatctcaatatccactgatagtatacataagtggagtagtaagcagccattaagcagattggcactgctctatcatatttacccacatgggaagatacgcacattacattaagtctataaagttacctcatgtacaacaggtcacttataaaattgctataggtacttatatgtatatataccctatgtgcattacaaaaaatgtctagaaggatacacaccaaatcattggcagtagttaccttgaggaaccagaggcagttgcatggactttgaattttaatgtaaacattgtttttgtaactttttttggtaagaaacatgtttttctaagcctgtccaggacagggtggaaactgatggaaaaaaagtcctggaacccactgggacacaaacgtggtctcaattcctgctctcatccagggcaagtgtttgtaaccaaaagtggtatgcgactgtctgtttcatgcacataatcttcccacctgcttacacgtagcctcagtgtgctggcctgcatgatgttcatctactatgctccctggtctaagacggaggaaaaaagaggaaggacagacagtagactttgataatgatattgatgtagataaccaaccctaaattattacttttctttattctttggaaatgcttcattagaataaattagaaatgcttcaatggaaagaacttcattaaaaatgtttttaaaataataataaaacctttattaaacattatttaccagtttaaaacaaaacatgtttaataattaaggaaatgaatgacaatattcacatgggaacttaagaagctagttagcggggaggaagaaaaatagagatatcttggaaataaaatttattttaatctccgaggctgggtaacttggaggactttaaaggtatgtattcatcttttataggaggaaagagacagacagacctgaggtcagatactgtttcttttccttactgcatatgggacattggacaagttattcacttttgcccagcctcaatatccttatctgtcaaatgaggatatgatctactttcagcactattgtgaggactgaatgagacactgcaaatggaatacgaagcacagggccacctaatgggttcccttcatttctttcctttccttcttcagtgaatacgcaaaggataagcctccaagaaatgtggatattttgggtgaactgttattggttctcctaacctagagatagcaaagtgggaagctgtattccctactatgccattaccatagtcacagagtgacaccaggctgtcctttaatctgaaacaattctgaagtaacccatcagcatttcttgatgacttcttgaacttcagagtcagtcctctttttgcttaaaattaaaaataagggacaggtgcagtggctcacacctataatcccagccttttgggaggctgaggcaggaggatcgcttgagcccaggagttcaacaccagcctgggcaacgagctgaaaccctacctccagaaaaagtaaaaaaaaaaaatcagccagatgcagtggtgcacacatgtcccaacgacatgggaggccgaggtgggggaattgcttgagcccaggaggtaaaggctgcagtgagttatgattgcaccaccgcactccagcctggatgacaaagcaagacctagtcttaaaaaataaaaaaagaatataaaatgaatatttgcttttaatttcttaattttagacccaatctcatttgaaaaagaatttgaggtaagagtcaagtttaaaagtttaaatggtcctttattttactatccttcaagtagaggggaacaatttctaagaggaatggactatctcagcctgctaaagtaccacattctggaaaagaatgaaatccttctggctttagagagcctgggaagacagggtgtactggacgccccactctgagcatgctcagagttgcatagccagaacagctgctacagccaggcatagccagcaaaggttctgggtggctggctccaacctctcctctctggggcagacactggggcctggccactaggctgggtgggctgcacaaccagttattgcagcacggggccccctagtcagggcctaaggcagaggccagatcttcttagccgggaaactaggggagacccacttgttttttaatgacagggcctgacctagttgagatgtttgaggaaaatagataagccagggagggaactctttagggagtgaacacacaggcctcatatttctatttttcacaggtcacagttcaggagggtctgttggagacttatcagacaacagcactgactggggggtgttcggagctggatgcactctggccacctcggtaagattggaccccaccctccagaaacagctgggcagctgggcaaaggccagcgctgagagaatttcattgcagaacagttctggctaaaaaacaataaaaataattttcctaagaaataaagtagcaacaaaagagaaccagatgcagcccagaggagcttcatgttggccccacgtgaagaatggaaagacagcctttgggacacctgggcatttctcttgcttctcatgccatttacccatccatttcgtattcatttcttagtcaaaaatcttaatcagatcaggcttacagagtgaaaaacttagttagggaagatgtaagctgggtcaattcctttgtcttcctttagctgtaaaccagtaaagtgctcgcttccagtttagatcagagggagaaatgtacttgctccatttaatccaggtatatgatgctaatgaagaacctcaagtcctgctcataattattcttgttaccacgacagatttttgactatgctgcgtactttctagggccctcattatattttcaaaaacattgctgacaattttctttttgacagttatttttcagactcctgctatttattcaggtcatttgtggccttttgatttttaactatgtaaagttttgaggtgcaattacatcttttaaatgcatttatatgttatctctttatgatgcctaattaaatttatcaggggcaacccacacttgaaacatttaaaaggcaactcagaatgttttttatttgcttagtctgattgttactgaattacaccttattttgtgttttgcacttaagtatttgatttttaagacattccccattgtactactccatggtatgatctagaaagtaaccctacacttaagtaggcaagaaaaacaaaggaaaggatccacaagaatagtacactaaggattacccatagtgaggttactagattgaagactaggatttaagcaccgtatgaacttgtaataaacacataatacactgaagcatgacttaaaatttgggagggggtgagttaagtgacttgtatttgaatatgcaactatttagtgaaatcttttttttttttttttttgagatggagtcttgctctgttgcccaggctggagtgcagtggcgtgatctcagctcactgcaagctccgcctcccaggttcatgccattctcctgcctcagcctcccgagtagctgggactacaggcgcctgccaccacgcctggctaattttttgtatttttagtagagatggggtttcaccgtgttagccaggatggtctcgatctcctgacctcatgatctgcccacctcggcctcccaaagtgctgagattacaggcgtgatttagtgaactctttaatcagacagagaattttattttcctgaatcctgccttcctacctgacatagtttggctctatgttcccatctaaatctcatcttgcagctcccataattcccatgtgttgcggaagggaccccatgggagatgactgaatcatgggggagggtcttgcccgtgctgttctcatgatagcaaatgggtctcatgagatctgatttaaaaacaggagtttctctgcacaagctctctctttgcctgccgccatccatgtaagatgtgacttgctcctccttgccttcctccacgattgtgtggcctcccagccatgttgaaccataagtccaataaacctctttcttttgtaaattgctcagtctcgggtatgtctttatcagcagtgtgaaaacaaactaatacagtacctttcaacccccttagcatgctggaaaagttcttatgcatcagaactacaaacacatcttatagggagaaacttttgcatccattcatctgtttatctgaatgtggaacagcatttggcttcctcttccataagttagaggcatctgtgttcttcaaatcatagcatccttactaagctccatcactctgtctttgaagataaaacaacataaggtaaaaggaaaaagacaactggagaactaattctagaaagatagggagaaacattgaaaagtagaaaaaaataactagatatagactaaaataaggcctttgatttttttttttaatgagcagatatctatactactgttgtcaaggatcattgtctctgcatcactttgtattgttgaattttcattatctggggattatttcacaagggatacataaaatcctcaaacacagaatttctggaggaaggaagaaaatatttaatagcaaaaacagtgagctcaagaaaccctagtaattagaatcatagtcttgacaagtcagattttcactggtcttcagatacgtatttcaagagctgagaaaactagtgactcatttctgtgacattggtgcctctgggaatccagtgaaagccatggctctatcctgaagggtaaaaaggaccttaaaacaacacaatgcttacaattccaagcaatacaaaccaatatttctggaccaagttattttttccagtgctagttttgcttttagaaatttaaaaaatatgtgtctgttggacttttcccagtagctttggaattacaaaactattttatcagagaattaatataacttggcacttttattcatctacatatgaagtaaaaacttttttatgtagattaccgtgtgcaaagaaacatgaatttaaatctaacttttgtactagtattgtagtgacagcttccatccacctacccatccttttctccagacagaaatagtctacagagagtcagtatgaaactataagaacgctatatttagagtgggagaaccggatttaaaatgtttcaaaagttgcaaggccctcaagggtcatcgggtttacagcacacgttcacgagatgaagacagctatgtttaaaagcaagcctccaatattgtcctttccacaaaacatgcaacggtttgatcttttgactagcaccaacttctctaggcctcaaattcctcatctacaaaatgaaggagatcacttacagcctgagaaatctctggctaactaaactagaatttttaatttgctccttttctgtagcagtgaattcttatttttgctgtaagatgcagtattcataaaatcaggcctttcacgtaatgtgtgtcaccttaactccaaaacatcctatgagtgttttcactgcattcgtgcaaagaaaaaaaatgagataattccttgtagttgtaaccatcatataaagtaacagattttgataaataccaaaaacctgataatccccttaggttccttggacaaacatcggctaattcttttttaaaaatacaacacaaattattccattacacaaatgattgctctggagaattaatgttaagaatggaatgttaagaatggaaatactggctacattttgttacacatcaagaatcagaatataggatatttaggatgagttctcttcttcacactgtgaaatcattaggaagcttcaatttactatgaaatttctaggtatttgaaatggctatcttttttcatagttgacactctaggaaatgtttgaattcaattacaaagtaaaaatgatggcagccatccattcagttaaaatgaaaattatctacatcaagaattttcagaagttcattcgatccataaataatatcaagcagctattttgtgcaatgcaatgtagtcagtgtctttgggagaatatagagatgaaataatacacagacctggcttgaggagactagaaactgaagctgggaagaaaggcatttacgtagctaaatgggaaccgtaagtgcagggagtagcaagggaggagaaaggaaatgatagggagaggaagaaagcaagagaaagtcacctagaccagtgctttatcaacttcaatgtgtacacgaatcacccagagatctattaaaatacagattctgattcagtaggtctggagtgggacctgagaatcagcatttctaacagctgtcaggtaatgctaatgttactcatccatgtacagcactttgggtagcaagagtatgctttgagtacataaattaacctagctcagaatttctctattttggctagatgattctttcttgtgggactggtcattccattgtaagatatttagcagcacccctggcttttgcccactcagtgccagtaatacaccacccccatgcccccatggtgaaaatcaaaaatgtctccaaacattgccaaatgttttcctaggggcaaagtcagtggtgtagataatgcttttacataaaaagttatatgagacaaatagcaaccctcttaaaaataactcacttatttgtattcgttttctatttctgctgtaacaaattatcacaaaactttgtgactcagaataatccaaatttattatcttataattctagaggtcagaaatctgatgtgagtccttgctaggcaaaaatcaaagtgttagcagggctgtaattctttcttcaggatccagggaagaatcagtttccttgacttttccagcttccagaagcttccactgctcatggacccttcctctttcttcaaagccaatgatccagcataaaacctccctatctcaaggcctttaacttagtcacatctgaaaagtatctttttgttccagggataaggatgtgagcatctttagtggtccgtatttctcactcccaccatgttaaaataaaaattacatttgtaaatgatttcatacctagaataatttaagataaagtttctcccccaaaatcctagagaacagggattttcttctgtgccgcaagtactttcctacctgagaacatttcatagcatttctagtcacacataaattcatctaaggaagaaccaagtttttctacttttaatgttacagtttctggcaccattcccaagctttcttgaccctgttgctatcactagtataaaattacattttaaatgcccaacaaatgaggaaatatgattcatttctgaatctttgggtgtttcctgaaatttaagaattctatttgtattttacagagttatatttactaccttaaaaattttcttttagatttatctcaaaagtgaaggtagtatttggctacttgaaccctcatccaaaaccttcatcagcaccttccctgtgttttttagatttttgctcatatgtgccaagggctagggcatcttaagttacagaatacttagtgacaaatttaattgaatctaattatcgtgctgaaatgtttaaaacaaatcttttcttcaatctgttcctataaactgctcttcagagtgaaagcatgcatctgctcaaagtgattctgagatgggggcggatgagtaaataaagccagatggcatttacacttacagtttctttccctttttgagtttgacatataagatttgactaactgtctttaaaagctcatttttcccagcctgtgaagttaagcttggtgaagttgacaagaggcgattaggaagaaggcagaaggagaagtcgtggcctaaagatagagtatttgttgactcacgttcccactacgacaagagtagcaaaactgaaggtgaggctttaactcttcctccacgttcctaaagatgtaagaacttcagctcattgaagcccatagaggcagcatgtattagtctgttctcatgctgctaataaagacatacctgagactgggtaatttataaaggaaacaggtttaatggactcacagttccatatagttagggaggcctcacaaccatggtggaagagcaaggtatgtcttacatgcagcaggcaagagagagtgtgtgcaggggaattgccctttataaaaccaacagatctcgtgagacttattcactatcatgagaacagcatgggaaagacccacctccatgattcaattacctcccaccaggtacctctcatgacatgtgggaattgtggcagctacaattcaagatgagatttgggtggggacacagccaaaccatatcacagcatgattacgaagtagggggaagagagagggcaggtagactgcatttcagttttgtttacagggaactatgaaaggtagaaaaatagagaactttctactgaaacaaagccactaactaaattcattttttctataatgagtagtcttaagggtcttctccgaccccaactctacccaaaaatagtccctgcacaagaattctggactggacaagatggtacagatactttttccctgtttctcccagctaagtataaatataaaccctagaaaaaaaacacaaaaggaagccagagaactccaaaaggtgaaatggttagagaccctacaaccagaggaatgtcacagtgacagtgtcttacaacccacaacctcacagaaggtcacccaagcccagtgtttctagagcctcaatctcgtagccagcccaaataggctcattcccactcagaccaaaggggagtcccaatgatactaccaggctggccagcggtactagccagggaaaatggagcaggagccatgctgatattgtttggctgtgtccccacccaaatctcatcttgaattgtagttcccataatcccgcgttgtgagggacctggtgggaggttattgaatcatgggggtggataccctcatgctgttcttgtgatagtaagttatcacgacatctgatgggtttataaggggcttttcccactttgctcagcacttctctctcctgctgccttgtgaagaaggacgtgtttgcttccccttccactatgattgttaagtttcctgaggccttccaagccatgtggaactgggagtcaattaaacctctttcctttataaattacccagtctcaggtatgtctttattagcagcatgagactaatacacctgctgaccataagaagacaggaaagcactctccttactcaccaagcctaagactcccttcctccaatgagaaacagcaggtggcttgcagcactagcaaaggggatcctgccacaaaaaaaggctccacctgggaagtgttttccttggagagaggggcagtcctcagcactagtgcctgtctccaggatatctgtttgtattccctctacctccatcagaggcatcatgaggctctactgaagagctccaccccttcaggtagcaccagcagacgccaggaggaaccctagcagccccagataaaccaagaagaccaaaatagcaccacaaagtctctgaaaatgcaattgtcattggatgcacggcccacaaaattaggccaggattttcttgctaaacctaaatgggatgactgcctactaaaacaaaagatttaaatcagactctgagtctcctaacagcatagccaaattccaggatagaatgaaaaattacccaacaaaccaaaagtcaggaaaatcacaacttgactgtgaaatgacaactgacactaacccagagatgaaacagaagaagaacttattgacaaagattttaaagcagccatcctcaaaatggtgtaatgagtaactgtaaattatttagaaacaaatgaaaaaatagaaaatctcagccaagaactagaagttattaaaaaaagaaccacggtgctcacagttcagcagcaaatacactaacattggaacagcatagataagattagcatggcccctgcacaagggtgacatgcaaagtcgtgacgcattccgtattttttgagaaattaaaaaaagaaccaaatggaaattataaaactaaaaagtacaacaaatataaacttagtgggttcaatagtaaaatgaaggtgacaaaggacagaatcagtgaacctgagaacagatcaacagaattaccaaatttactcactatgaacaagaagaaaatagactaaaaaccgacaaaaaacagaccctcaaggacttgtagcacaataacaaaatgttcaagattcacatcatcaaaggtccagaatagagggagaaaaagagagtgggcttgaaaaattgtttttaaaataatggcttaaaattttctaaatttggcaaaaaaatataaatctacagattcataagctgtataaatctcaaacaggataaacccaaagaaatccataccaggacatttcataattaaaattttgataagtgaattgcaaaaaaaaaaaaaaaaaaaaaagtcttgaaagcactgagagagcaacaacacattacctattagggaacatcaactccaataacagcaaatttcttacctgaaaccatataggccagaaggaaaaggtgcattttccaagtgctgaaaacaaagaattgtcatcttcaaattctatatccaggaaaactatacttcaagaatgaagggaatatagaaacagatgaaagaaacaaaaggactgtgttgctggcagaccttttaaaaatggctaaaataagttttttgaacagaaagaaaatgatggaagatggaatcatggagcattaggaaataaaacaacaaaacaagctgaaatatggctacatacgatagatgatcctcctcatgagtttcataagatatattagatgacttaaacattataacaccatctgatactcaagacaataatatttaaaagtgggaaaggtaaaagcatttaaatggaaataaggcccccatgtgtcactcaaagtggtaaaatgttgatatcagtagactgtgataagtcacatgtgtattgtaatgagatagcaaccaaaaggaaaactattcaaagaggtatactcaaagacatagtaaataaatagaggtataatcccaaaagtcctcaatatctatttgggattctgcatatcaaatgactcaatataaataaaagtattaagttgttcatggcaaagtcctagactaggagctacctcattctgagacagaactagactggagcatgtttctgactcttaactaggaatcaggatcaccagaaattcctggaccttaactgccacatctttgaaataggagtggctggagaagtaggtctggcagacaacctggaccacacccagtgataattctatacattattacaggttttaattcttctcatccatcccgtgttatcccttatgattcagatgtctttcaaagtgctctgaaaactgtaagaaagttcacaatccaaagaggatattgtatgacacactccaagctctcacaaaccccagagtagagaggagaggaagtgacagaaggaagacacttcaaatgtagcataaacctactggagcatggaccatttccacttagaggaattattcatttctttcccacctctggtagggaacaccaataagcaaagcagggtcacctatttactgctgttcattcggcatccttttagatcaactataacaaatccttggaactaaaggaactatatgaaaattggctgatgccaatcatggtccaccaacttaacatgctctcacttcttcctcagtttaccatgctatcctattccaagtctgcataggtggcaagataatttgtccttgagaagtgctaggtcatatatggatggttgggtacactggacaatgaaatgcatttaaaacaaaatatgcctttgcttttttttattatttttttttttttgcagaaggggtctcgctctattacgcaggctggagtgcagtggcatgatcttggctcactgcaacctccgtcacccaggttgaagcgattctcctgtttcaccttcccccagcagctgggattacaggcgtgtgccaccacactcagctaattttttattattattatttttagtagagatggggtttcaccatgttggccaggctggtctcgaactccagacctcatgatccgcccacctcggcctcccaaagtgctgggattacaggtgtgagccacggcacccagcctgctatgttttataaataagtataaacaccttaattgcaccatttaccacaaaagttaaagggcttgcattttcttatcagtaatatgtaaggatttaaaaggctctatacatttcctcagtctcttatgttctatggaattattttccctagacagatagtggtgaacatacctgggctagaacatgccagtgtgtgcacttgctggctgcgtgtcctggctcaataccctgaggttcagtttcttcatttgtgaaaaggatatggtaatacctaatttacagcagtgctataagaaccacatgaatttctgtatttcaaacacgtgacatgtaataagctttctacagtagctattataatccaggagcatgctctttgtcagaaactttaccataggtagcaatggatttggaaacaaagtaaaacatttcaagaaatcagattagtaaaggttatggcacaaaaatacgtcaagttctatggacaagatagatgttacctctaaagccaaaattctccctgcttatgtttgggacttctaagatccctggaactctagaatcaaccttctgactacattgctggtccattctctgtcttctattatatgtaggacaatgttaacccttcccaacttggtgtaatgtgtttcattaaaaaaaggaaaaaatcctacttcttaatttgtataatataatgttgacactggtgatgtttttaaaaaacttatttcaagccatgtgttctttgggtgaaaacttctgattaaagacatataatcattaagagtatcatctccataattttagcctatgctagaaatgcaagctcatcttttcattttttagtaccaacccaacacatgccaaaatggtcacctcaaaatattatctaataaaagtacatattctgatcattgtgtggtagaatattttttcatattaaaatatttttcttgggtttgactcttacacttagggaaacaaaatgcttcacaacaataatactattatggctcataaccagttatcaaaatacttttaaaacagctgattttcttctagaatgaaactttttaaattaaaatgcttttccacataaaatgcatatagtcagcaaatacaaaacataacaaatatatcacataaagtaaatgaactatatatttacttgtaaaaccaaagtttctatggagtgacattggatatatatgctttgaaggccaacttaaggatgaaggaagtttctaaaaattatgatataaaaatcctttattgatgcaaaagggattcagattaacattttaattctgtaacttaaaaaatctagaattaagaacaaaacaaattctatgaatgtacattttctggtattactacatgcagctaatttcaaaagttgatatatatttgaaaaatgttaaaaattacattgatcgtattatcactttaacaaaagggagaaaaggataatactacctctgagaaaggactaagtcttatttaagaatttgatggccctaatgtcacaaacaataaatattccttataatattctgtccggcaaaaaatcaagagaggaacagagagaaactaagatgaacagaaatgtatggcgaacaacctagaatgactcactggagacttgacagaccctgagccactgatggttctaatattcttagctctgtaaaaaggcaaggggtaatcgttcttggtctttaatggaacagactctggtgaaagaaagagaacagagaataaactataagaataaagacacacaatcacctcagccaaaataaacaggttacctgtaaagggagcataatcagactgacccccgacttttctgtaacaatgttaaacatcagggtccagtaaagcaacatctatatgagttcacaggaactgttttgattcattaattctatattctctcttgacattcacatgtctggacaacaggaaaatctcagataaaggatatgtgttgtctttgcatgggagactacaggttactattttctttctttgattcttaatatttcccaatatatctgtactaatcatatgttatctttatagaagaaaatgatttttattaataataatgcacagattaaaacagaaaaagcaggaactacagagagcataaggatggtaaggatggcttactattcaaagaacagtaatttgatttacatcggtttaattgttctaactttcacatcaaaaaagaaagacttaacctttgacaaaacacacacacacacacacacacacacacacacacacacacagcttttctgatttcagggaaaagctaaaacagattcataagaaaattacactacagaagatggaggctaaggctcatatccatcccaaataattctgcttctcatcagttgcttcttgtttaattgttctttggaaataaataatcagtgtgtttttcttttcttttttttcccttatgcatattttaggaacatttttctatttaaactaggaactaaagtattattaattttaaatatctaaatgtttataaatagtaagcaattttaaaatattttacttaaattattttaaaatattaagacatttgtttaaatgcttttataattcattaatgcttaataaactattaacaaattaatattaattaatatattataattaactatatattaaattgatactaagttattgtctagatgttattttattaaaatttaaatgtactgaattataattattttcatcataaagtattaaaacagaaaattaatactgaaattagtctcttatcacatcttatgttcaagagaaatcaaaagggaaatataaagcagaataatcttaaaggaaaaatacattttagtaactgcattgaatggaacattctggtctttcagagagattcattagttagtgaagttacctaagcactgtgaggaagtaccttttcttctgtggaccagaaattccctgaaatgaatacgacttcctaggaggccttgaaaatgcaaagggccagctcttggagttgcccttgctggaaagaactatattgaagggaaagggcaggtgtgaccagcatcctttcagaagaactggtctggtcacatagagaaaaatgttcaaggagtcttatagtttccatttcagaagggacacgagaactaccaatcagatgccagggaagtattgaaaccaaccccatcgttccatagactgttcttttggataaacatagaaattgaccttttttgtcttaaagcttgaaacttatatttattttatctgagttcctttcttgggaaaggaccttcaggcctctcaaaaaagtatcaaagaagtgaaactcaccagatcactgtaccaaatgccatatccctcactcatcatgactgcttcgttgcccctccctagttcctatttcttacacattgtgactatttttttcccttctatataaacccgtggttttagtcagtcagggagatggatttgagtctgagctcccatctcctcagctgcagcacccaagaaaagccttcttccttggcaatgcttggcatctcagtgattgactttctgtgcagtgggcagcaggacctagaccaaaccccgggtgtttcagtaacagtataagttacatgatcctagcaccttcttgtacaggagcagctcatttcactgtgctcacatttcattgattgacatcacattggcatctcagtgattgactttcagtgcagtgggcagcaggacctagaccaaacccctggtgtttcagtaacagtataagttacgtgatcctagcaccttcctgtacaggcacagctcatttcactggctcattacattttttagaaattgaaggtttgtggcagccctgtatcacacaaggatagtggcacctcttctccagcagcatgtgctcacttggtgtctgtgtcacatcttggtaatcctcacaatatttcaaacttttcattattatatctgttatggtgatctgtgatcagtgttctttttgttttgcttcatttattaaataaagtatttatttatttatttatttatttatttatttagagagagggtctggctctgttgccctgactagagtgcagtggtgtgatctcggctcactatgacctctgtttcctgggctcaaaagtgatcctcccacctcagcctcccgagtagctgggactacaggtgcctgccaccatgctcggctaattttttgcattttttggagagacagggtttcatcatattgcccaggctggtctcaaactcctaagctcaagctatccacctgcctcggcttcccaaagtgctaggattataggcatgagccaccacatctggcccaaatgttatttttagagcaggttagtttcacaacataactgaccaataagtgcagagagaaaattccacctaagactttcatagctggagaggaaaagtgaatgcctggcttctaagcttcaaagggtaggctgactctcttgttaggggataaagcggctggtgtgtctttaagcagaagccagtgctcatttaccattccaaaaatcctacagcccttaagaattatactagatctactctgcctgtagtctataaatggaacaacaaagcttggataacacatctgtttatatcatggcttactgaatattttaagcccattgttgagacctgctaagaaacaaagattcctttcaaaatattactgctcattgacaatgtacctagtcgcctaagagctctgatggacatgtacagggatattaatgttgtgttcatgactgctaacccaatatccattctgcagcccatggatcaaggagtaattttgactttcaagtcttatttaataagtatattttgtaaagctagagctgccatagatagtgatttctctgatggatcttggcaaagttagttgaaaactttctggaaagaattcaccattctagatgccattaagaacatccatgattcatagtaggaggccaaaatatcaacattaataggagtttataagaagttcattccaaccctcatggatgactttgaagggttcaagacttcagtggaggaagttgctgcagatttgggagaaagagcaagagaaagagtcagaagtggcacctgaagatgtagctaaattgctacaatctcatgataaaactttaatggatgaagagttgcttcttatggaggagcaaagaaagtggtctctggagatagaatatattctggttgtcagtgttgaaatgacaacaaaggattgaaaatattccatcaacttagttgataaagcagcattagggtttgagaggattgactcagattttgaaagaagttttactgtaggtaaaatgctatcaaacagtatcacatgctactgaaaaatcttttgtgaaaggaagaatcgatcaacgtggcaaacttcattactgtctcattttaagaaattgccacagccaccccaatcttcagcaaccaccactgtcatcagccagcaaccatcaacatcaaggccagaccttccaccagcaaaaagatcatgacctgtgcagggcatggtggtgcacgcctataatcccagcactttgagagaccaaggcaggtggattgcttgagcccaggagtttgagacaagcctgggcaacatagcgagatgtcatttctacccaaaatacaaaagccaggcatggtggttcacacctgtggcccagctacttgggaggctgaggtgggaggattgcttcagcctgggaagtagaggctacaatgcaccaagactgtgccactgcactccagcctgggtgacagaggaagatcctatctaaaaaaatagtggaggatttgaaaaaaaaattaagaagcagacttaagatactttaatttttttaatttaagaaaaaatattttcaaaagattatgacttaaggctcagatgactgttagcatttttaaagaaataagctgtttttaaattaaggtatgcacatacttttttaagacatactactattgcacatttaatagactatattacaaacataactatcatatgaaccaggaaaccaaaaaatttgtgtgactcactttattgcaatatttgctctattgcagtggtctggaaccaaatctgcaatatctccaaggtatgcctgtatctttcccatatgcctatttcccaactgagatcagaattaacacttataatacagaaaagggctgggtgattgttttaacggccagccggaaagcagaaaggctagggagacagtatctcagtctaaagaaaacctaaaaggcagaaacccttgggtgataggaagtgaaggtaggtagatagaagaataaacgtctgggttactgagggctgtgggagggagaaaggaaagcacagtatcaatgcagaaacagtgtgactacatcacagtttttaaatacttaataatagaaaatggaaagaaaaacaacttctttctaagcacatcctacttttgaccacccatgtggccagatctctttgctgtgaccctctccatcatcgaggtgactagaagtacttcacattacagaattgtgcaacttgtgagcttgaacattgccaggaatctccacctctcaaagacaattctgatttctttacaaatgcaaatatttgatccctgacccagagatagaatacaaaactttaaaactcttatcttctcatgacagttttaaaaaaagaattagtagggggcaaagaccttttggctgactacagagttttctcatttttttcttctaaaagcaaagagagaagaggaaacaccaaatgagcttctcctttcacaataaaacccgttttcagacattcgtcattctgggaacattgagattttattaatggagatagtgtttggatattcaggctttcatcaactatagaagctggcatggtctaaatttgaacaaactattgaaatatagccataaatttcttgctggagacagcgtctccatattacagtttttttcatgacgcaaacagtgtccaaggagaagggctagagattccattctaaatgccaccaggacattctgttcttccttcttcaccctccagatgagaagggttcctttcagttcaaaggatgctaatcttgcctctcttgggactgtcccaaataataaacaggctgaccttagctaaacagagcaactggtcaaacctgggaagatcagattttcagcctcagaaagcactgtcatacgaacaaggttgggaggttaacagcattaagccagttactctttagcacatcctatgaagtggtgtcatgtgtgctatttgtgctatttcccagaggaggaacttaaacttgaaagtaattgacttgtcaagctccattcaaactgaagtctgtattcaaatccagatcttccagtatattccctgacctagaaaaccatctgggatataatagataccatctatctaggaatctagctatgtatctacgtagatacctcttgtttacataactgaggcgttgagctgtctgactccaaaagtgtttttctgccagaccatgctgcatagaaagtacagacttttagagcatctgttagattaaatacaggtttccaacaggtagtatttaccactactacaagtcagccaaatcagaaaggttcattatcctaaaagaaattaaaatcagtgccaacctgtcataatatacatacacacaatttgtttctaaaagtctctaaatgaaagttttgcaaaagtattgatgaaaggtatttatatatatatgtatatgtacacacacatgtgtatcaagttcattttaataagtatatatatatatatccatttttagctttagatattacaaaactatgtaataatcagagtagaccagcagataagcctaattaagtatgcccacaaacaaaaagcacattctgaatggaacaaaccaagtgaagtggagttatggaaaataagactaaaggacaggctgcaatgtgattttggaaggacgagaacattagggtaagagatttctgctttccttcttaggcagtggggatccatttaaattgttgagtaggaagatcaaagtggctattttgtagaatgtagatgaaaggttacatgctcaaagaggagagaacatctaagaagttcaatgggtgcctgctatatttttccacaagaaagctggctattaccagactgtatgaacaagacacgtccaagcttgacaagcatcactgacttatttttggcaggcgatttgggacaaaaagaagttccctcattgcttttttcctttggttcctgtcctcaaaggatgacagcatctcaaaaggcaactcttcccaggagaaagcaagctccacacccaagaacttacaaactcctttgcctgattctaatcctgtttccctttgtcttatgtagctgtctccctaacttttaaaccattttatcactgtgtacacaaatgtctttgtgttaatctgttttcatactgctaataaagacatacctgagactggataatttataaagaaaaagaggtttaatgaactcacagttccacatggctggggaggcctcacaatcatggtggaaggcaaaaggtacatcttacatggcggcaagcaagagggagaatgagagccaagtgaaaggggtttccccctgtaaaaccatcaggtctcatgagacttattcactaccaccagaacagcacgggaaagacccacccccatgattcaattaactcccaccaggtccctcccacaacacatgggaattataggagctacaattcaagaagagatttgggtggggacccagccaaactatatcagtctttaataaatgtgtttccacaaaatctctagaacaattctggttgtgaggataattcttggtttccttctttcccaggctgagagtcttatcgaggaaggcagaatgctgatactgacatggaagatgcctagtacagtatgcagagacaggcctctttttatctcttttcacttcctttcttcattaaagactcaaggggggaaaaaaagcttattttgcttgctgagatgatacttctgtgttttacctttcctgcttcaaaattaatgttttagctctcgagctaagacaactgctaatctcatactcaaaaatgaaacctaaccttagttctagccacttggcttgaaagaaacttgaataaaacagatttcgcaagttaaaaaaaaaaagaatttaatgatcagaatgatagtgagggcccctttgtgcaagctgcatgcacttgcagtctaggaggtctctcatttaagatgcagacattgtccttaaggataattttgatggtttttaaactccctgtataattgtactctctaaagtgtgcttatgattcatagtttttctttatcttctttcattttaaaaacagtaatatttattgctattttatgatgatgagaataagaagtacatattgtagaatatttgaaaatgaatatacaacaggtcgggcatggtggctcatgcctgtaatcccagcactttgggaagctgaggcaggcagatcactggaggtaaagagttggagaccagcctgaccaacatagtgaaaccccatctctactaaaaatacaaaacttagccaggggtggtggcatgtgcctgtaatcccagctacttggaaggctgatgcagaagcagaagaagaatcacttgaacctgggaggtggaggttgtagtgagcagagatcacgccattgcactccagcctgggagacagagtgagactctgtctctcaaaaaagagaatatacaacaaaaaagtatctgtaattccatctctagaatttaatctgtgaacatattattcaaaatgtgtacatgtatatatacacacatacatatgtccacatgtgtatgtacacatataaccacaatcatatatttgtacatactcatttttcttagaataaatttctggaattatgaagatgtaaatggatatgaatggtttaaattccttagatgtagattttagctatttttccatacgttatcatcaaaaacgaaacactgactaccctgagaaagaagaaaaattgaacgagtgtgccttcttttcctctcttgcttacttctgagtgtcttacttctcacttctgtcaatataagttatcaaattatcaatatgaaaatcatggtaataacatgaatgactaaaatcaaacaaacaggtaagtatacagtgatataaccttatggttaaaatgttagatgttaaatttaaaggataagggaaacttgagtatgatatcaattatataatactactatatacatttaaatgcatgtatacacacatgtagcatgcaatagccagtatctactgaggtctgtcatataattggcactgtgctaataacctcattgaatatacttctcatgtagtccctggcaataaccttacgagatgggactgcctgtattttacaaatgaggaaactgaggttcaaagaggtcaagaaacttctctgggcaatacagctaggaatgacggagctgggatcttactctaaatctggatgcctccagaggcctttgttcttagccactatgctatattggcacaagaaaaaaatacactggatggaagtatgtcaaaatggtggtggtcaagttcagaatcacttttgtaaccttacttaaatgattctgtatactataaaacattgacataggatacgatttacttttataaccagaaataaattagtgaataataagtattgcatgcaggctttgtgactcagacccaggtggcctggatcactcagaccctccgtaggaagaccattattattatgcagaaacccttgggttggccatactttttttcctcttctgtcttgtagctgaggtggaacagcctcctaatgaggcagatgtctttttaaagtcctccagttttctctagagaatgctaattactcccaaaccaccccctaaaaaaactccactcactttaactagaaattataaaaaaggtatatccagatgtcagcaacaaagataatattttttaaacttggaaaaaataactgtaacaatatgcatggaaaactatataattcattcttttggataggccaaaataaagtcttttttttttttttaaggttgttgagggcagattaactagtgctgagtgtgtatattgtcaatattgtaataactttgtagttggaagataaaataacttcttttcaaatataagctaaggtatgaaaaaaactttaaaatgttcttggccgggtacagcggctcacggctgtaatcccagcactttgggaagccaaggcgggtggatcacctgaggtcaggagttcaagaccagcctggctaacaaagtgcaacctcgtctctactaaaaatacaaaaaaaaaaaaaaaattagccaggcatggtggtacatgcctgtaatcccagctacttgggaggctggggaaggagcatcacttgaacctgggaggtggaggctgcagtgagccaagattgtgccattgcactctagcctagatgacaagagcgaaattccatctcaaaaataataataataataaagttcttaagcttttcaggggcagggcaatacgtttttaataagactaagaaacactatgctaaacctgattcttgagggagccaaccaatatattagaaagccacatgactgggctatatctttaagccccacagaattgctttcattgaactgcactttggttacagaccaccaaccttcactgagaaatgatatggcatgactttatgggacatggtactgaatgtgccataaagaatgtagagctctccagaacatcacatcatagctgatgcatccatcacagagcaatacccaaatgagaaatgtctctttggactcagtacttagaagggttatttctcctgattttactttatggccaccaaatcatgaacgttattgtgttttacatcttcattaactgctagaaagtatgtctttacctgactccatgtcattttcttagatttctttttccctttccctcctttttcttgcttattttaaactcaactttgtcctctgaactgaatgcatctttttaagctgtcttaaatactttgttttgagactgggtctcgctctgccacccaggctgtagtacagtggcacgatcacagctcactgtagcctccacctacaggcctcatgctatccttccaactcagccttccaagtagctgggacaagaggcatgcaccaccatgcccaactaacttttgttttttgtttgtttgtttgtttttttgtagagatggggtttttccatgtcatcaggctggtctcgaactcctaagctcaagcaatccatccactttggcctcccaaagtgctagaattataggtgtgagccactgcaccagccaaatccttttttaaataaaagattaagtataaataaacaggcacatactctgtacacttctgtaagactgtttatgtaagactgctattggacataagaaccacccaacatgaatgaaaccagcatgtttcctataccaaaaagaaaataaattttcatttatattttaacagtgagattgaaacaatctaaggtctctcacccacaggccattctgcagacactcaggttacaacctgaacccaacagagtagctggcttatgtacaggctcatgattacatcatgattatgtgtttccatgccactgtgttcaggaagtaagcggtctggatataagatttctagccatccttgaggtgagtggacagaaggaactgtcaggttagagatgcagcatttcaaaaacaaacagaagggatgaaggaaggggaagtgaaggaacaggtaaagagatatgagactcagagaagagtaatgtctctgtagccaaaattaaagaaaacttcaaaaagaaagtactagatgatacattctttaacagatgactaatattcctggcaaaaactttttaaaaactaagtatacatttaaatacataacattccatcctttagccttcaacctaacaacatcaattcctttaaaacagcatttttgaaaagctggtttttttttttccatctgtactcaaaatggtacatctatggtggacacaccctaagatgttccaaaatgagtcacactcttgtgtagtcccccttcccctggtgtgtgagcagaacctgtaacttgcttctagccatagaatacagttataggatgccactcccttgattaggttctgtcaaatagcaaaagtgaaggggttttgcatatgtaattaaattgacaataaattgctcaaaagggagattaccctgggtcagttggactgacttaagtgagctctcacagaggccagagactggaagaagtacagatttctctctctctccctctatctctccctccctctctccctctgcccaccccctgcctccgcccattgctggccttgaagatgcaagttgccatgaattctacagtcacaaggaaatgaattctaccagcaacctaaggaacttgaagcagatccttccctagtcgagcctccacatgagaatgcaacccaactggtacgcagacttcagcttgtgagaccccaagcacagaacccagctaagcatgcctggacttttaacctacagagactgagagataattcatgggtgtgttttaaaccactaagtctgtgacaatttgcgatgtagcatagaaaatgaatacaacacctaaagacagagacaatttgcatgggaattgccttttaatccactaaacagaaaaaaatgtaacggaaacttcagactcctctcttaacttctcacatcacttagccaagttctcccacattagatgttccagatacttaaactaaagcagctgtcaccatatccaaaatgcttcgctggagaaccatcacatgacaccactgtgggagtttcaatgcttgctggcccaaggaaatctgcctccaataaaccaggaaatgtttaacccagacagcctgtaacttccacaattttctaatcagccaccagagagtcctctttagattgtcatagtgactcagcacacacacatcaatgccttcaaccccaaagctgcacatctatgtacgtagttgttctcccttcacctacttgggcatgaaaatcaccaaatgagcacagaatcagcaaactttgtataggccacaaaggaggaggcaacgtttcatttccattttagcactgagatcaaaacacagccaaaggccaggctattcagctgagacttgattccataatagcatgttctctctgccctgcacaaaattataccctgattatgtatttccatgccattgtgcccagaaggtggttaggcagcaacagctctagcatgggtggaaggtttaggcatctgaatatttggaaaagtagagaatggggggaagggaaagtttgtctctttttctgaagcatttttctgtcaactggaaatcaaacttaccaatgcttacattatacttttctgagtgatgaatacaatgctttggatgcatagttcaagtaaggtcgataagcaatttatcttttgaaattatttctaatgagagagcattggcaatttttttcaactgttgtgatttttatgcactaattaaaatcattataatacttatatatactagacacagcagaaatagcaaattttcattgtttaaaaagacatcagagaataacaatcttcttttcctttttttcttcccttcctcttttgtttttaccttttgaaatactaaaggcaacaaaatagcaagtaatgagcaccagcattgaaactacaagtcctaggttagggtatggggtctagcaaatacttaatttccttcagtaattcacgtcatctctctgaatctgttttaccatctctaaaatgggtaaaacactatctgcactatcatacctacaatttcataaaaatcatcacagataatatgtctacaaagatattgtagtatatataaaccaaatgtggccaggcacagtggcccatgcctgtattctcagcactttgggagactgatgtgggaggaatacttgaggccaggagtcccagaccagcctgggaaacataatgagaccccatctcaacaacaacaacaaatttttttttttttaattagccagacgttacggcgcttgactatagtcctagctgcacacgaggctaaagtgggagaatcccttgagcccaggagtttgaagctgcagtaagcaaggatcgctactgtactccagcctgtgtgacagagcaaaaccctgtttcaaaaaacaaaacaaaaaacaaaacaaaacaaaaaacagggtgaggtaggacgatggcttgagaccaggaggttgaggctgcagtgagctgtgatctagccactgtactccagtataggtgacagagcaagatcttatctcagtttaattaaaggaaattatatgaatgtatttttcctttcaatatttatgtttcctctcatgaactgacaaactaaactttaagagccagtagtttattactctgttcctaaagacattaaaatagttaaaagtaaattacgaaattactgtcagaaaaatatagtaacagttaacatttaataaatgtcagacattgactaaagggcatcacataacttttcatttgattctcacatgaaggaagtcaattatctctattttacagatgaggaatctgaagtttcaggaagttaaagagtaagtagtaaacctatgataaaaaaaattaagcaggttaatccggagtccacaattaaccactcaactgtttcaaatacattttccgggttgatactccaagaaaaggagcgatgagatgtggtctcagcatacaggtggtcttgttgttataaagcagagtgttcctagtgagctaggagacctgatgtggaggacaagcccacccacattgcagggagaccgccacagacagaagctaatggccagccacatgaaaggcatgccattagggcaggttatgatggacgtaatgctccctggagttgtgaactgaagaagtcctgtagaatttagaacacatcaattgacctacagccagctaccaaaccacatcagagcctacggggctgcatctaggtctgcaaaggtccagaagttacagagactgctgctgcttgatggtgagtatgcagagagcggacctgagcagcggagaaagtaaccagagagctggaaccaagaaataaaagtaggaactggggaagaagagtcaatgagatgaaagaaaacaaaactgaagtaaagccagaaaccagaaatactgtaagactctggttcccaaactgtgcccccaggaaccttggggtgccacagtgaattcagaggaatgctactagatatttttaatttgagggcagctaacactcgacatctctcagacaccctctgaactacgagcataaagtagttcagcgcttcaacattaaatggcattacattcctttcaatgacatcatgtccttgcaatatgatatctgctataataaaaatgaagtgtaaacataaaactcagtgtggaacagaaaatgaagatggtggtttccaatctgaattcaagttttgaaaagttgtgcagtgcccaacaggtgcatacataccttagtaaatatgaaggattagataaaaatgataattctttcaatttatatggttttgttttacaaaatggctactaatttatcaggacctatatacgtattaagttgaattaactaattaagttgaatatacttattaagttgatttaataaatgaaactgttaggtatttcttttagctttggggcactgtaaaaaaactgagacagtatgagcactgaactgagacgtcatgggaatattacttagggattaaagttgtctagggaagatagaaaagtaaaggatctcagcagtgagttgcatatctgttttcaaggtcttattattatattattattattattattattattattattatactttaagttctggggtacatatgcagaacgtgcaggtttgttacataggtatacacgtgccatggtggtttgctgcacccatcaacccatcatccacattgggtatttctcctaacgctatccctccctcagccccccaacccccaacaggccccagtgtgtgatattctcctctctgtgtccatgctttgacatggcaacaccactcaatacaaaggagacttgccccactgagtcctagaagcatcatgggtcctgacccttgtggtctggtcctgctcaagacataataaagatctgccacaatgaggattaattcagggactttagatttcagcatggcaatatgataatctgatgaaaacaagttatgtatcatgtattttataatagtacctaccaagtacttataaacttggcatcttatacagacggtccctgacttacaatggtttgatttaggattttttgactttatgacagtgtaaaagtgatacacccattccttagaaactgtactttgggtacccatacaaccattctgtttttcactttcatttcagtattcaataaatcgatgagatattcaacactttattgtacaataggctttgtgttagattattttggccaactgtaggctaatgtaagtgttctgagcatgtttaaggtaggataggctaagctatgatgttccaaggttatgtgtattaaatgcattttcaacttacaatattttcaatttacgatggatttatggagatgtaaccccaccgctaagtcaggaaacatttgtgtaataatctcacttaaccttttgaggttttactgtttctgctgtgtctctcatttaacacgcaaggaaactggagcttgcagccattggatacattgctcaagcggactctgctggtatgcagtagtgtcaggatgagaatccaggaagttgggacttcaaaagtaacactgttaatcaccacgctgtctttttcagctgttaggcctttagatttctaaagaagtaaatatacactagactttcacatggaacaaagtacttcaaaggagtacatatatttttatgtggccacatacattcctatttttgtttatcttggtttctaaatccttaaaaagtttccatctcttttttaggtttgctaatgtttatcatcatgaataaagataacacaaatggttgtaacatagtgccactaaaaaaaatccaatattgtcatgaatgtgacaaaagactcccaatccccttgtgataaattggcacaagctttctgaagaacatttaacaataagtcattatgattcattactctgtgaggaaggaatcataagagatatttatcttaatgttattataatagcaaaaaaaaaaaagaaaacgtaaatgtctaatgattatatatttcatcatatgaatgtactgaactttgggtagaaaaatcacactttcaaagattacttaatggcataataaatgctcaagacaatcttttaaagaatctataaagtggtatgcattatatgaattgaataaactattaattagcaaaggactagaaagaaacagtatattcaacttaatattttggttaattatggaaggtaaaattctaaatgattttcttttttttccttaatgaatatgcattagtttgctaatcaaaaaaagagtaagctgggtgtggtggcatgcacctgcagttctagctactcaggaggctgaggcaggaggatcactaaagcccactgagttcaattccagcctgagcaacatagcaatacactatctcttagaaaaaaaaaaagaggaaatgtgatgtgattaaaataagattcagtacttaacaaggtaaatgcagtctaatacttcattccctaaacatcacctgtatgtcaacagccaagtcatacataaaattcatttacataaagctttcctgattttacttccaacaagatagtctctctcctctaaattctcatacagctttatttgtacttcttttatggtacttttgtcaccttttgcctttctcaataattatctatgtatatgtgccatccttcctaccagactataggcattggcatgtcacggccagatttgcttcataattacatctgccatgagtctgactcccattctccctgtattttagtcatatttgtaagtgaatagggattatacattttggtatttgttttcccatcacacaacaggcaatatgccacccacgctgaattggtttgtatatagttgcagtgctctttatggcacccaaggagacaaataggcttagtggatggcaccccaaaatacagttttttcctgagattttggatatagatatagatatatgacataatatatatttaattatatatatataaaatagtccatatatataaagattgtctggcctcttgggggatacattggtccgtgtatccaagatgcttgagcagatgctgaaaaaccacttatcattgctcccatatagacaattcaagcctggctttggaagattgtatgaacatcatattcctgatagtctcataatcctgatagatgacagtttatagaatcctgctgggattctacatcattgattgaatgaatgactagaggatgaatttctggataaatatacaaactaacgagtggaatccccatatagaaccttcagatcaccttgtacaggcagagaatgggaaaatgccactcatcattatacaggcctataaaagaagctagataacttcaaggaatgcccatcctgggaaggcagctccaaccactaatcacagcaggccacaggtggccctttcatgtatgtgagccacaggtaaagtatgagaacattacattcaccgcagcatgtgccaggcagcatgctaagcacttgaacaaatctaattttctcaacaatctcctcatttgggagacagtactctacccagttatagatgggaatagaagctcagaagggtcaaatatactgctctaggtcacacaattaacatgtcatcagaactggtttttttttgttttttgtttttttgagttggactctcgctctgtcacccaggctggagtgcagtggtgcgatctcggctcactgcaagctctgcctcccgggttcgcgccattctcctgcctcagtctcctgagtagcttggactacaggcgcctgccactgcgcccggctaattttttgtatttttagtagagatggggtttcaccatgttagccaggatggtctcgatctcctgacctcgtgatccgcccgcctaggcctcccaaagtgctgggattacaggcgtgagccaccacgcccagcccagaactgggtttttgcacacaaggacatgtgagtccgactcccaagctcttcagattataccatgctgactcaggaagaaattaaagcctatgaacaagcaaatgattgatttaccctttttctacaaaagtttccatgcagacacatacaattgtattaggttaatgcaaaaataaatatacattgttgctccatcctcattcttgggggaaacaaatggtttctcctcaggataatataaaatcatatgcctacttgaaacattcttagataccccataatttctcaagataccttttagtagatcaggtgattttcagacattaatttacaggtgacaaattttcctagggtgataaaactaattagtgtggatgtttcaaatattttgagaggaaagtctatttagtgtgaaacaatctattttctttcatagctcttcaagagccaagaattttgtccgagtggttttgtgttttttttcccctaactctcctttcctttccttttcccttctgatcctctcccctgtaaagcaagtgtgcaaactcacatgcctggggcaatcacggatactcacagtaccaaaaatgtgcccatttcagtggaaaaggtgaaaagggttttaaaattgagcaaggacaggttgaatgccatgtaatttaaaccaaagccggcaactcctcacacggtcattgttgaaggtttgtgtgacgtaagtactgatgcctgaatcccaacacaaagattctgtttcaatagtctgggctgaggcccaaaaatcagcctttaaacaagtgtcccaggtgactcagatgcaaggtggcccttggaccacacctggagaaacactgacgtagcgaagtccttcgtggtacagataaagaagttgtcgtaaaggttaagtggattgcccaaagtcaattcaacgagtaagtggcaaatctggaattagaatacagctaacgcctttgcaactacactacatcacattttttacttagcattccacacttttttttttttaatttgggtcactgctctataagtagcagctgcgaaaacattcataacttacatttgtgtggcacttcctataaaaagagctctcacattcattatccaatatgatcctcaccaaaatatattttctgtatttggcagatgaaggggctgaaattcagagagattaagattcttgctcaaagttatactcaatttgggacaaagtaggacttaatgagttctgaaaactagtaaacactcaaatgttaaccattattattatattttctttttagaaactctcagaactaaaaatattgacctaggaaaagttaagaaaagtaggaaaaattgaaaacaaaactgaaaacagccaaactgcacgcaataaagtttattacatattagaataaatttgatttgattcaaaaatgaatcaaatcttttttataaaatttagctgtaaaataaggccaaggaaaagtaaacgtgagaggaaaaataactcacaatagtagatggtttagttactgcaatttggtatgttaaaaaactaatcaataagttaagccttcatacacaaatctttgacatacacaaagattttagtcgtatgaaaattttagctatatctgaaactcgtagcaaactagaaatattttaactgtgctatatgttgaagggattaaagtgaattaataatatatactctagaaatgtcttctcaataaaaatcaatgttactgtaattctgatttaaatatccatatttataaagatagtacaaaaatgtcctcaaagtttaatcaaaacaatgggtctaaatgtcccatgatctcaataagcttcctagtaataaagctacatctgttactattaaagttataaatcagtaactgcagaaggacaatacactgaacatgtaatattttataatttaatggtagtaaatcagttatataatatagatagagcaatacatagaaatgaatattttttgtttctgcttctcatttcaatgctttttaaatttacaaatgctttcggacagatttcctgccttaaagtattaatactaatttagattgaactgaagcattaagaaattccactaaggaattctattaatgttactatctcactacgctaatataacataactacagttagaattactcatattttgtttctatagcatgctctgccactctaaataagtagttctcatctactggtactctagaatatatgtatggtgccttagaaatagtgtttttaattaaaacatcttcacttttcttctagaacattagaatttgccaaattaaacaaagccagtgctctaatctctaccgtctgatcgttttatacacacgcacacatacatatacacacacacaccttttaaagaatgtctaaatagagcctcttttgctttagttcagaaactcactgattccagctcctcaatttatagcttggcctttcctctcagactggaccaatatacaaaggagtaccacgtgcttggcaaggttagcaaacccaatcccttcagcataaaatggtgaatcacttgctggctacagcaaaaccttctggactgttcacttcatccatcttttctgcatgttctttaaggctaggctcctaagtggctaccttctctctcccaagagaaaggaaaataacttgagtgaatgagttcatgcctgcaatataaatatgagaagctttttgaagcacagaaatacctgtttagaatgaactcatggaaaacccaacttaaaatgcagtgttctttgtgtcaacaaaagtctacttgggcagaataaataagtgaagccatgaatttccagtctcccaatgccagattaaatcccatttcttcaaaaagaccctgttattgctgtgtcaccctattagaacctcatatttgctttggatcattataataactcctctatgggtgcaggagccctgccagggtttaagtaaagccatgaccacattcagtctagacactatcatcttcactaaaatacatgaacagaaagtagcttctcagaggcacaggctctagttaggcctcaaagaaaaacaatatcaaaggtaccaacagaagaaaaaaattgtttatatgaaaaaaacaaatttcattaaaatgcttttttcaaagagcatgacaaagactatgtaacagaagggaaaaattcaattttgacacagaagtttacaacattacctgttcataagcaagcaaaatttctgagaaaacaagattctataaactgaatacaatcctttatttcaaggcaactcaaaataaaatgcagaaatagtaaataagtgaaacttcttgtatagttaaattgaactccaggataatatggaagcctataagacaaaggagaaaatccatgtaatatagaattgattgctatctaaaatgctgtatttcccagccaataatgtgtgtgtgtgtgtgtgtgtgtgtgtgtgtgtgtgtgtgtgtgttatagttgccagataaaacacaagatacccagttaaattttaatttcaaataaaaaagaagtatttgttttttagtataagtatatcccatgcaattatttttattggctaaattcggcaattcatatgtgtgcctcctatgttcattctcattttttcaatctgtatcaggaaatcagaaatgatgcttcgagttgcaaagaacgtaaacccctcaaaaacagaactatacatttccagatgaaacagctgcctgtgaattctactgctgtaacaataacaaaaaacacctgaagacattctgaaacctcaaccaggccattacagactgtaaaacaccatagaaaattatattctcgttatgtttcaggtataggtgtcgacttttcctggcaatgatctttcagatcctgaaacacatacacgtcactgtcaatcccttcttcttctccataggatgttaatctgacatatagaaatgaatccctttccaccggacgtggtggctcacgcctgtaatccagcactttgggaggctgaggcaggcagattacctgagattgagagttcgataccaccctgaccaacatggagaaactccatctctactaaatacaaaaaattagctgggtgtggtggcctgtaatcccagctgctcgggaggctgaggcaagagaatcacttgaacccaggaggcagaggttgcagtgaggtggagattgcgccattgcactccagcctagacaacaagagcaaaactccatctcaaaaaataaaaataaaaataaaaataaattaatccctttccttataggtcagtaaccattcaaaacccatttacttcataaccagtttgatgatgtcaaattgctatctctagtcaattaagaaagtgaatattgggccgggcttggtagctcccagcactttgggaggctgaggtgggtggatcacctgatgttgtgagttctagaccagcctgaccaacatggagaaaccccgtctctactaaaacttcaaaatcagccgggcgtggtggcgcgtgcctatagtcccagctaccccggaggctgaggcaggagaatttcttgaacccgggaggcagatgttgcggtgaaccgagatcacgccactgcactccagcctgggcaacaagagcgaaattccgtcacaaaaacaaaaaaaaaggtgaatattatgccagtgcaaaatgcagccagaaagttctaagtaaatattgtctgacaattctggaagcttccctttccactctaaggatttatacaagatgtacatgcctaacaacggctattgtcatagctaagtgaaatactaattacaatacaagaaaagtaattgaatatttcattcaattcagggtataaagaatatctaatagaaataattcctttgcctaggcttacttagcaaacttctatacatcatctaagatgaaattccaacatcaatttcatcttgaagtcttttccagacattgcccggtgaaatacagcattcacatagcactttgcctgttttgtcatattatattgtgtttatttaccatgttatattgcacttatttaaattatctgtcattatctgctacagtgagagcttcttgaaagcaggatacatatttttgttgatctttgcagtcatactcattaacagagagtctagaagacttcaatgcatgtttgctgacaaaataaactattattaacaagtttgcaaaaaaaattctgatggtagtttcttttgctgtgcagaagctcttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaattgtttccccatttcttgtttttgtcaggtttgtcaaagatcagatggttgtagatatgtggcattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgcgggaagttttcactggaacttagccttaaaaaaagtcctgagaggcaggagttgtagctgcttaattataacgaccttatggcaaatatccctttgaatgagatccactatcaaatcgcattgaatttttggctacctgggtatattactattgtaactaggcaacctgtaaaactcccaatccagaacaagaggtatatttcatgtagtcattcagcaaatatctagagtgccaggacctattctaggtgctgggaagtaagataaagccctggcatcatagaacagccatgatgattcttcacagagattcatgaggtagcagtgagagattaggagttattaataaatagcattttctttgtaagtaaatgacgatgaatcccagactaaaggattcacaggtggtcaaactgtgaagctaggaccggctagagaacagcaatcaggtctcatgaacccagccattcgtcatttcttccatacatgccagacatggcccttcactgctgatcaaaaggaaacagaataacagaatggtgccttagatcaggggttcgaaatccccaggccatggaccagtaacagtccatagcctgttaagaatcgggctgcacagcaggaggtgagcagcagatgcgcaagcattactgcttgagctctgcctcctgccagatcagtggcggcattagattctcataggagtgtgaaccctattgtgatctgcagatgtgagggatctagattgcgtgcttcttatgagaatctaactaatgcctgatgatctaagttggaacatttcatccctaaaccatcccccctcctccaacccatctgtggaaaaattgtcttccatgaaagtgattcctggggccaaaaaggttggggaccactgccctagatgatgcctgggctttcagctgtgccttaagtactgcagatccatctgagggagctcatgactttcttatagacattgacaaagtggcctgttacattccaaagttcattttaatagtcaacaccatttaaccaactctgaagagtcagcagatcagaactattagcatttcctgtgatgctaacaggatttttcatacatagggctgaggctcaacaagtagggtgtaggcaaagctgcagtaaaagcaaaggccattcattcgggataaaaatttacagagtataattcgagccaacagctgctggaacacaatagtaatttcatactatgtcatagaaatgaagcaccatctcgcacatcaaattatacgtggacttggtgtgtaggtagatgtgaatggatgtgggtgtgtcaaaaaagagaaagggaaagaaaaaggaggggaattctcatgaggacacaacctaagagtaatgataatacttgctaccattaagtgtcttctgtaagccacatgtatgtgctttacataaatcagttcatctaatgctcacaaccacttgagaaaggccctatgattcttactttgttaattctgaaaccaagactcagagaggttaagtcagttatttgggactatggaactcgtaagcaaggagccaggatgtgaacttcaaactctggcctatcttactccagatctaaactctcaacccctaggaaacagtgattctcagtggtcaccacaattcatttaagaaatctttgcatcatttattacctttaacgacaaggaaaagtaaatgactttccaacattcatatttggatgaacaagagtctcggccagacaaggcctgaatcactctcaacagacctaaaataagagcttcatgttctggttcctctgtccacacttcaaaaggaactctgttaggttcatgtggtatttttggtttctgtttctgtttaaacgtttcttctgagaaaaaatatttgaatggagatgggcaacaaaagggtataaagagctggtgtttgaaagttgttttctgttttgacccaagcccaggatgtggggtctgggaagcactgtgggacttttgcaaggactgtctcctggccaccacccatggtgccaagcagcctaatggctggccaaacaatcgaggctctcatggatattcgctcaggttcttcctcaaagaggcctttacagggatgccactgggacctgaggagacatggggtagctttagttccccttcagagtaacagaatgtgtagccggtcacctgtggccagggaataagagactctgtgtccattccctgcccctagcaacaggaccaattgggaagtcttcccttcctgccacatggctctcccacaggaaagtaaagcccccagattcatctctttgagaggatcctttatacactcgccactccctttaatgggggatagtgcatctaaaagcttattatgagagaaggtaatggctggtctgagtgcagggacgtgtacaactaattgattataaccaattacagatttctttgttctttctccactcccactgttctacttgactagccttaaaaaataaaaaagaaggtggaatgcaccgttcatacaaagaagaatcatagtcccttatttttgtcccagtcccctttcaagttttcctctagaaagctctacatggttgatccacagtagttactgtccttataattttatttacagaataaatagaatcctaagtaatcttggaaatcaaattggtcaccttatcatacggaaaaaattaacacagggaaagtaacttgcccagaatcatccagatagttcttgtcaaagagtagattccagaggtgccctgactcagtgaatataactgaacacacacacaaacacacacacacacacacacacagagagtgagagagagaggagaggagagagagagcacaaacttaatataaaaaccaagtggaatgaaaaatagtaacataatgctgttgtcaagaaagctaacaggatgctaatatatgtgaaaagctactatatgtgatgctaataatgtacaagcgattcagtttcagataacttttttcaaggtttaattagggagggagattaccaattggttataagaagacctattcaaggaaactcttcctttgagaaccagttaccttcacagccacaatgtttacacctaatcctggctagccacataaatacatggctgaagttcccaaaaaaagatgaagatggaaagtgtggatgggactgaacaaggcaggggcagtaaaaatagcaccttagtggaagtcaggaaacttggatcctggcttggatcaggagctaactaagacctgaagttctcaattaacctgggggtctcggtctcttcatttgtaagatgtgggagttggatgatataatttttagggatcctttcaagttctaagaattctaaatctggaccgactccagccttaaaaaaaaaaaaagccaattatacacagcaatacaagtccagtgttgagagctgcatttgaaaaactaaaagagaacctagaaaaaaatattggctgggcatggtggctcacacctgaaatctcaacactttgggaggctgaggtgagcagatcacttgagctcacgagttcaacaccagcctaggcaacatggtgaaaccctggctctaaaacaaaaaaaagaacaaacagagagcagagccttggaggagggtgaccattcatcctaggttgccctaaacagtcttgatttactcctgttatcccagattcccaacagttagtgcctgttttcattcccaaaagcatctcagtttggatgatacattatgtgaggactctgcctataaggaattggtgttcatttgatcttggggaacccttcatcgtctcccaactcccacagacagaagctcaaacttctcagtatgttataaaggttttgaccctcttgtcaaaactccatctggcatacctactaggtgctaatcacacctgactactttcagttcctcaaaggtgatcatcattgctcatgaactggtcaccttctcctccacccaatgctacagtgaggcaagctcctctacatccagcaagactcagctcaagattgcctcctctgggagcccctcccatcactccactcgtcatcactctctgcccatacctctactagcacatgaacccgagtgctttgcagctcttttttagtctcctctactacatcataagctctgtaaagaattttttctcttatcccttagcacacaattggcactcaacaacatgcttgttgaagtaaactgaaaagagaagcacatatagatttgctaataggacagtagccaaattaaatctttcatcagagtgaataagaaaactatggtcttaaacttatctgactcctgccactttcgtcaccactggtgacagtcaccatggtatgtgaagagtcagtgtcctgtggccaaaaggcatggtctacaagaatctgacagctgatttccagttctgccacttacaaaaagaatgatcttagacaagttacttaacctatcctaattcagttccctcaacgtaaaatgaggaaaatgtaactccttgatgtaagagtataaacaacacaggaagagtagggccgcatactgaccctagtacagagaatgtaagacataaggagtaatttagcttccatggtgatcgtttccaaccagaacaaactagaaaaacagtgtctccctcttcttccccaaagaggtaagccacacctggattcattttactttatgtctctccccaggactcagatgtaaaaacttcacatcttaaccatgattttctcttttcaaattctggatctcctcctctctaagtatcctggacagaagtgtcatcacaaagaatacagccaaaaaggaaaggacttataattcaagacatgccatggtcaaataaggaagaacatcttgacggccactctgactcaatagtggaaacgactcagaaggaattcttggtaaaatgtcaagtagggagacttcaagcctagggagggattacatgactttatgctagggcaatgaaccttcaagttaactataccttgaacaaaatcctccctcaatcagaagccatcagttagtgctgctgcaacatgaaacagtggaaaagggtggatgaaatgagggtcatcagaagcaaaaggaagaaaagattgctcccttaaaagctttctctgcccagggaaacaaagcccagtcagcacagctaggcagtttcaacagaaacaaatgagatcacagtgtttcaatttaatagcacacactgcttgctgttcaaatgttataactaaatacagcatgtgctgctagttgttttgattaaagggaagtagaataacatggaggggacaaacacatgggttctgaaacccaagtgcccaaccttgaatcccagctcctgaccttgaatccccgttcctatacttcctagctgtgtggctgtgggagagttacctaacctctccttacctcagtttttatcaactggaaaataaggataacaaatcaataacagtacctatacgccatagggttgtaatttacaaatactaatttctaaggtagcacatgatttatgccaaataagtatttcacaactaaaaataattattaagatccagtactcactcaaaagcagcttaatacaagatcatgcttaaaaaccagccattggtattgcccattattaatctcaaagatgactttattttaatataacttgactcataacaagtcagttgctgaccaacaaattcttcttttgatcatgaagactgaataggtctaaaacccagggatcattttgatgaagtgaaaatggaaactgagtaatcattcccagaataaatggaagtaaaacaaacatattatttactgagcacccattgtagccaggagttttccaggctgttgtattttagaaggcatagaacataaaggtgtcgctaggtttggctcccacatagctgaataaagtggcatttactgtagtgaattcactacggctctggtcttcagttttgaaggcagagaaacttggttttgtcatcacatgcattccctcagcatttattgactacctactttgtaccagatagccgtgacaggcaatgtggcaacgtggagaaaacaaacaatcattacaatcctgcctgccctcacaaacctggcaatctggcagtgaagacaaatactaaaaaccaaatgtacacaaactaaagtaaaataaccagattatcaatggactaatttacaaagagaagaacttcgagtagaccagaattcttgttcctactgaagtgggagaccagcaggacttgttttcacaacgctgctgatcaaaacaggatgtagcaaagaaaccaatccaaaccagcaaggaccaggaatcataatacatttgcattagacattcctaccagcaccatgacggtttacaaatgcaatggcaatgacttggaagttaaccttacatggtttcaggaactccccaccccttttccaggaagttcatgaataacctgtttaattatatttagcattaagagtgggggcccaggcatggtggcttatgcctgcaatcccagcattttgggaggccaaggcaggaagatcactggaacccagaagctcaagaccagcctgggcaacatgacaaaaccccatctctacaaaaaaaaaagaaaaaagaaaaaaaaaaatctgggtagctgggtgtggtggtatgcacctgtaatctcagctaattgagaggctgaagtgggagaactgctggagcctaggaggtccaggctacaatgagccaagatcatgccactgcactccagcctgggtgatacagcaagaccctgtctcaaagaaaaagaaaaaagaatgggtataaatataactagccagcaatccattagtgctgttctgtgctaccctgcctatgagatagccctgctctgcctttggagtggtcacttggctgtacactgttacgctaacaaacttgctttctttcactgttggttcactcttgaattctttcctgggcagagccaagaactcccccaggctgagccccaattttggggtttgcctacattatgacaagaccaacccatgtctcccatgtaaccgtgcctatctaaggatggacacttacaattcaaataggggagcatactgtaggaatggcattaggcaccacgccttgaaaaacatctgttaggattgtgacttccccattctaaactttccaaccactccctgcccacatcctgcccattctcttattcttgctacttttctcaaaaaggctacggtccatttaatttctgtttcctatattacaatcttattcccatctttcttcaccaaataccttcacctatcaccgtgacggggttttccatgttctgaaagttcttccatctcacagctttaaaaatcatgctctttattccagagatgtcaactgcattcgatctttgtggagtatactagtttaaatattatttctgttattttaaagttagtggttgtgcagtggtagtagttgggcatgggaaagtggcatttagggcaaatgtacactgaaacactagctcctatagcctcaaaatgattatttcaacctgaaaaacaacccaaagaggcacaaaagtatgtgaatcattcagtacattgcacactggaatacacaagatattatacaaaggtcaaaattaaaacaagaacttggcaggttaatagtccaagttcagtagtcatttgctgctggcaattctgcaaactatgagtagcacttgtcgtaatagaaaaagttcatgcatataaaaaatgtcaaccaacatttaggtcatcagcaaataaatatttgagtcaatacaggaaaaaagtctcatgttatttaatgtctcatgttttatttcatacaaaaatagcatccatggtaaacaaagatgtgttttatccacatcatggaaaatgtggccttgtggcacaggtgtgcttaaggtcctgttaataaacatacagagaaaccatttttgtagttctactaatcttcattggatgcaataagacaatctcatatctgaggtgatggggtcctcagtgtttcagttagttaggcagggttttaggtgtgtcagtgatcccaaggcttagttgctattctcacaggtctacaagagggtcaacaatgagtatagctgaaaatgatgtccatgatgcagtcatcctaaccaaaacagacgagacctatgcatcaatctgaatactactttatataatgatcagcaggaccctgtctccttccagtggctaaaattaaggtaattcccagagtttcagaggagccacataatcccatgttacattcacccaaaaatgctatataaattggagcacagagaattataggaactttccattgaatttctgtggggaaagaggaggtgataaaatgttttttttcaatttccatagggaaagatgaaatgataaaaggttttcaaaaaagattttttaatgtgatcaaacgttaacctgaatatagtctatggagaatgtataattccattgggtaattattttaaaaaactctcactctactctcagctccaaaggaaatgtctgtatctgtccttttcatggagccagcacagagcgtagaacatagtaggtgctctttaactaccttctacacacataagtgaatatattcttcttgatcactactatgaatttttcatccaagaaaaacaatgcttatttaaaagcagaaggtatttgagtctacaaatcttgctcttcaccttgaaatatgaattaacctccactactacaaatagaaaattaatagaaaataaggaagttttcatgaagatgactgtcagagaatatcattaattccaatctgttttgttcagtaaatctatataaaaccttgatatactacctataatgtagcaacaattacagaatagactaacaaaaataactatatatggaagcatattcatattctacaaaagcactttctgtctgaaaatatgtaatacagaaaccacaatgcaaaagtttcacaatttaggctgtaagaaaaatgaatgagtttgactggtaattctggtattttcaatattagatagccaaactcttcaatgacatcttttacatcatcatcatttatactgcaccactgggacccatgtttccctaacgctaattctataattttaggaagactcataagctgacatttaatataaaggtgcctcatccccttgtaattcctggtgaattacctggtgaatattcatactgttggttacctctgacataaaataatgtggtttatgttagtcactgagaatctataaagtaagttacagtcaagacagaacttaccaagcacaatgaccacagtcttcagaagactcatcatggtatcccgattccgccggggtccagaactatgccgagacattctcatagtcctctggcgaacatagccaaagatgtgagcatagagaaccaccattaccacaaaggtcaccaagttgaaaatggcccagaagactaagtaagagtcactgtagaggggtgccatgttggaacaattttcaatatcacagatacagttccagcccacactgggtatagcacccataacgatggccatagtccagatgaccacaatgaccaccactacccgccggttgctcatccgtgtgtggagctgcatgcggaaaaccgtaatgtgcctctcgattgcaatagccagtaagttggccacagatgccgtcaggctggtgtcaatgaggccctgacgaaggagccatgtgctaacagtcagtctccgagtattgggtcctgtgttgaacatgagatagaagtaggccaacccagcaaagaagtctgcagcagccagattagccattaggtaataaataggaaaatggaagcggcggttgacatagattgccaccatgaccaataggttggccaacatgatgaagatacaaacagtgattccaagtcccatcaccagcttgctgactgtgttccattctgtggcaagatgctttccacttcggttataaaagaaggcaatggactcgttgtagaagcactgtggttcattcatggctgtgaactaaaagaaaaaggagaaaagatgatgaaaaagaaggcacaggtccaaatttaaagcttatatagataacacaagacttttatagtacatgcaacagaaaaacaaaagcaaataatttgaacatttgatcctgcataccatcttgtgattatgttgaaactccaaggtttctcacaatattactgtccttaagattaaaggcagttggagttaaataaatgacaaggtctctgcttagtggttttatgtcattgaagtctactacaaaagccacatggccaagaaatcttgcttaaaatacatgagacagacaaaaattttgcagaacattgcaattggaatatttaccatagtaaaatctatttgacctgttatttagggaatctgtaaacacagttggtttctagatagggtatcattgccctattattctgcatttctattctcacacagtatgttccatgtgggacagacattttgtaatgcaggttcccacaaggaccatcattccaaacatttcaaacaagtcactgtgcatcaaaggttttttgcccaaagccagcatttgctgctcaacattcctgtggtcagcactgcctacccccacaactccttaagttcagaataggacttgtcaaccaatctatgacatttgagaattttttttctttttggaggacccaacgtaacctccaaagagtaggtgaccctttgacaatgttctacaagtaaaatatacttagattagatgcagcatattttttaaagtgtggagtgaaaatgctttataacatgtttacttattcttcaacatcattgataagaatatatttgcttattatttacaatatttataataatcactttaaaaaggattgagacagtttaaaacagaataatatatgtttatttatctatcataatatataatatataattatatataattataatatgtaattatatataataatatatttaaacaaaattagaaaataagtaacaaactagaaattagaaaagtatacatcacatagagtaagtcattcttcttgaagctctaagtttacctgggacccctaaaattaaaaaatatatcttgaagacggttcacattctactttttcatttttattttgctttgaatctaataaattacccaaaacatatgacacttttaaccactatttttgatcaaatattctactgaatatccataggttgtacactaaaacttccaagaacaacgtgaaatacttaagtggttagtcttctgacttacccaggcatctaaagtctctttccttatctagactttaatagcttttagattatgcttcaaatattatacttaatacattgtataattatttatctctttacttgtctgcttcttaaagagatcacagtccagggcacagtggctcacatctgtaatcccagcactttgggaggccaaagtgggtggatcacttgaggtcagaagttcgagaccagcctggccaacatggtgaaaccccctctctactaaaaatacagaaattagtcagacatggtggtgggcacctgtaatcccagctactcaggaggctgaagcaggagaatcgcttgaacccgggaggtggaggttgcagtgagccaagatcatgccactgcactccagcctgagtaacaaagcaagaccccaactccatctcaaaaaaaaaaaaaaaaaagacaaagttgatcaagctgtttccccactggacatgttttaagggcttatgagtgcacgttagataaaagtctaaacttttcaatcatcttatcagaccttacttacctgcctctccagcctcaactcaagatattaatgactccaaactctcagcttcagctctatttaatgtgctgtgctctctctctcaactctggttctcaacagtgaaaacagtggtttcttgtatcagaattacctgagagtttgtaaaacactgattgctgacataacccgcaagaacttctgattcagtagatctgaggtagggtcccaagtaatgccaaggctgctggtccagggaatcactgtatcataattgcttaattatctgttgatcccctctacactaggctatgaaaccctataaacgcagagattctagcttgcttattcattgttgtatagtatccaactgttctatggactacatgctaaatacatattgatttccttaataaattaaagatatttccaaaaatgtttaaactttacaaattttctttctgcaaaggatatttaaaactttgtcaagacaaatataaaagtctgttcttttcattagtctctataaccatctaccttctctgaatcaagaaatgtttaaaccaaatatcaagcgtatattatttcccagcattccaacttctgaacaccaagtagcaacaaagttaagcagagatatatgcagcttcttagcccttcccacagagaaaaacgataaagttaaggatggcaaaattaagaagtataaattatctctttaagccacaatgtacaaagatgagtaaaactgacagattttctctaaaggtagagaaaagtgccctgtcctatgccatttcttttctctcaacaattgactgtaataccataaaaaccatacatatttaatgataaaacttaaatgattttcgaaactcaattttatcatctgtgaaatgaggaaattggactaacttatacataaggtctagttcagatttaaaatcctatactaagaggattctggataagaacgctatatttcatgaaaattagcagctaaatattgaaagagtagaaaatacaccaggaattaaaaattgggagggtataatatgcctgagaagaagtgagaggaatttcagttagttttatgacaataggactgaactgatagaggaattaaacctcctctcttattgtctgcagaaagcaacaggtcaaaagaataagcagtggagaccctgaaagcacctccaatggcagtaagaagggcagtgtgaatgggctttcctacttcttcaggagccgacagacttaggcagaaaacctacatggttcagagagaatccaatttaactgcaattggactataggccaataagatagtcagggctataatgacagaaaaataattatggaacataatggggaaaaatgtaatcaaaggaggtggccacttatctctcgccaaagaagaaatcacctcccactgaagcagatgtatgggaggggaaaaaaagaagagatagaaagagaaaaagattaaatgatgggacatctctgatttgtgtcctcaatgtgttttgttaacatagtaacattgaaaatagaacaagccattatgaagacaaaagaaatcagtaaaaacatcacaaaaatagttttttattgctactttaacaaattgctataaatttagcagcataaatatacaaatttattctcttacagtcctagaggtcagaagtccaaaataggtctcacaggactaaaatcaccgggaaggcaaagctctgtttctttccaggagctctaggggagaatccgtttccttgtcttttccaacttctagaggctgcccacatctcttggctcatggctacctgtcatcttcaaaagctagtaatgactagtcaggtctttctcacatgactgacactcaatcttctttctcactctaccacatttgatgacccctgtgattacactgagcccacccaaaaatctaggagaaactccccatctcaacatctttaactgaaacacatctgaaaagtccctttctctatgcaaggtagtagccacaggctctgaggattaagtaatggatatctttggaagccattattgtgcctatcagaacaaactgaaaaacaatttctgtattaaaaatggcaatgcaggtaatgaaaggaagtataaaaattccagaaaactgaaatggcaggtagaagactaaggaaattcacccaacactcagaaaagagtcagagatgacaagaacaaaagaaaagaaggcacatataggaaaaaaattcaagatgcaccaggggtccaagaaagattagaaggaacctgaaaaacacagctccaaacagaagacaagtaattgcctaaaaagaaaggtctcagattagtgatttaaatttatgtagattacaaaacaaagttaattaaaagcaactaaaatgtaggtgtatcttgatgagattttgggatctcaatggtaaagaaaaattgtaagagtttagagaaaaaaaataacaagtcaaatatctaaagacagagagaatcagaacagacccattatacagagaaattttttgagatacatagccaattacattgatgttttcatacgaggacaataaagaacagtcacagaaatgtgagtattcagaaagaatgccatctacatttcatctacacttccttcgtagagaaagtgtatatagtatttaactcttgagaaaagaaaaaaataaatacacacacacacacacaataaatacaagaccctggcagcaagcattaaaacccacagaacatgattctaaataattgttcttcatagggttataaaacttaaagcaaatatcaaaaataattattgaaagaagctatacctattaataaaatagcaatttaataataatctgggattaaaattacttactgtatagataaaaacttgaaatggggaagcagaatgtaaacatattaattttctcttattactcaagtaaaaatgagatgatttaaatgtgacaagttttcaaaaataaagttaaatatgctgattcaaaaaccactgaactgaataatacactaaagcagaatggcaactttttgtattactggagaaaaacagagtgcaaaataggaggaaagcataagcaatacatagaatgacaattttgtaaaatttatgtaggtgagattatagatgattttttcatctttagaaagtagctcatatttattgcaagaaattttgggaagaacaaaaatacactcatacaaagtccaataagtacttttccaaaaagctcattataaaatccaaatcaccataattagaaacttctctgtaatacgaagttatagaatttcaccctgcccaagaaacaaaaacataaataagatagcattattcccaaattcagttgtcctcaaaactgaaaagagaagttcatattcatgcccttttctcacccatcaattattttgtcttaggatgatagggttcgagggaagtgatctcactggctgctctatagagtagatgttacaaatctcagaaatttacctcaccttattgtgtgatctcaaaataagttataacaaatctgtcaagcctaaacgctaaagagtcacatatgttgtttaccttcaccatgcaattcattcatccatgcacacattcttgaacgtttataggataccaggttgggcatggcactgcattatgccttctaggagtacgactgatgcacccaagtgcctggcatggagccactcacagtacatctgatgtgttcttccatctcttgaaagacaattacatactcattggccaagaggaagaaggaacagttggcataaactcacatgctagtaattacaccaatgtgatttagtatttagatatgaatgtaaatatgtactctactgagatactctaagggagactgtaatctatgctgataaagaactagtaataagatataaatcaaatcaaaccaacttacttcctccacttctgttaaaatacaatagagtgagccggggcgggggcctgatttgtagctttggtttagcagatctctttctgattctcattttcaactagctaatttgtttttcaataagttccaaaactgttctgaatctcaattgtctcatttgtaaattaaggtaaggatgacctctaagactttttaaattcttattcttaaattcaaaataatcaggcctattttctttctccaaaaaagattagaaaagagacagcatagaatttaattaaattccattaagtctctattaacaagaaaaaagtcctcacccttcttagagcttcaaattggacattttaaaaagtgagatgttttgtcacaataactagaaaatgggccacaaaacaatactgatatccactaaaaatgattttaaactagaatacttaaaatcgctgaagaatatgcaactagtaaattttaggaggtttatctgaaaaagtacataaaatgctacttcttataaaataataatgtatatcaatgtgatatacacatatgcaaaaagaaactgtgcaacacataaattgtaagttaataaaagtactttttatctattatagcccattgtctaccatgctgagaaaaggtacacatcatcatacttgtcaaatttccaaagagaattctgtgtcagtcctaagaggaaggaatggaaaaattcactaaaaacactaagatgtgctggataaagtataataaatagtccttagatgcactgctaagctaagagggaacttaaaccaaggtgaaaggctgtccaggcagcagattgtcagagatcatgaggacagggctttaatactattgggaaacagaagatgagcccttgggcttgactgaggcagtgagttggaattgagacccacccaccaagctagcagtctctaagatcttcgtattggtaagtgtgtagatcaagaaaaaaaaaaaaaaagatatccctacttgcactgggaagaacaaggaagttttgtcaagctcaggctccagattggaaaataaataaagagtcccttaagaaatcatgactctagtcccataaatcacacaaggctgggatttgaacttagactacctgtcaagtctgagaaccctcaggagaagaaattaacacaaaccaaggtcctgagttggtgatatccccatgctcctcccactcaccgcctaacactagcaaacaccaaacttctctggaggacgagacctcaacacagccagccacacgggattctctcaaaccagcctcactgaatataaactcatcttccaaaaggaaaaaaacacaggaggatgccacatgtgagaatccccagaacagttcacagcaggattagacccaagaatgtcagataataaatgattaaagacaaaacggaactgactgcattctcccttttccacttctattggttcaagagttatacattgtttctattctttaatgcttagtcttaatattttaacatgcacacttgactagaagtctgaaggtaatcctcttcccttgatatgttttctctccagtgcctccactcccatcttacatgttactgtggctcaacattctacttccatttgttctgaagcctacctaaaattacttgctattacttattttcccagtttatttggttaccccataagaagccagtagaatcatcttacaagaacaaacaaggagagtaagaacaacatgaattatgagttaatctaatttaagaccataaatgagagtttctaaataaaatgcaagtaaatcaaatatgtatcttcaagatacacacaaacacacagaagatggggtgtgtgtatatatgactaaatgggttgtatgtatatcaatttcttacgactaaatagggtttcctccagaatgcaaagatgatttaacatttaaaaaatgtggttacataattaaccactctaacaaattgaaagagagaaaaaaagccaatgatcatctcaaaagacatggaaaatgtgcttggcaatttttaatacactttcatgatattctgacaatctataattagaagataattaatttccctaacttattgaaaagtagctatcaaacatgtacactaattgtcatatttaagcattcactttcaaaacattcatatcatatttaaatatgacatgaatgtcatatttaagcattcactttcaaacagaaacaaggacaggcgtggtggttgatgcctgtaatcccagcactgtgaagggctgaggcaggtggctcacttgaggccaggaatttgagaccagtctggacagcatggcaaaatcccatctctactataataaaaatacgaaatttagctgggcatagtggtacatgcctgtaatcccagctatttgggaggctgaggcatgagaattgcttgaacctgggaggcggaggttgcagtgagcggagatagcatcactgcattccagcctgggtgacacagtaagactctgtctaaaaaaaaaaaaaaaaaaaactggaaatttttaaaaaaccttatttttaaccacacataatataatcagttacacagaaaatgcaagacacctataaacaaactgtattaagagagtttaacaaattttctgaattaatcatcaagccatatgaatcaactgctcctataaaaataccagaaaaaaaaattctagttattatttcaagaaagaacacatttacagtaacaagagctctaacgtatctaggaataagtctgactttacaaaagcatacaagcaaacctaaataaatgaagaaataaaatatttttgtgaatagagatgtaaagatgtcaattttcccagtatcaatatataaatttaacatgataaaattaaaatcccaaaagggtttctcatggaacttgacagactccctgaacattgatatgaaagcacaaaagaacaacaatacccaagacaactagaaaactaataactagatgcgttattgaatactacattttaaagtgatggtagttaggacattgtgatattggcatagaaatacatggatagcccaatggaacagaataaagagcctgaaacacacatattataacttgatatgagagatatgattttacccatcaattgagaaaatgacgtatctgttcattcatgtaataatacttaaaaactgaatatttattttaaacacagaaatccgtttcaggcaatatgaaaatacacatataataaaatataattttaagaagaaaatgaaaaaatatatttataagctctgaagaggggaatatttctaaatatgaccaaaaagcatcgataaaacttgactaatcaaaattttaagacttctgtgctgcaaaatctaatgagtgaaaagaaaaactaaattagtagaaactttagaaacacacataagaaagactttctctacagtgaaatgtaaagacttcttacaagtcaaaaagggaaaagacaaacaatccaacagaaaaaggggcaccgatgtggataggcaattcacagaagagaaaaccttaagagccaataatcacaagaaaagaaaattacatttacagggaatcagagaattaattacaaactgcagtgagatccaatttatttccatcaggttggcaaaaattaccaagttggaaaatgtcaagagtcagtgaggtcagtcctacagtgctagtgaaagtaaaatttagtacaatagctttgaaaaacagtttggcaaaaactactaactatgaacatgttcatacactagatcaaaagattctaaccctagtttaaaaaaaaaatcacacatgtgcctaacgagagacacatgaattccaattgccactcttttaaaatatcaaaagcaacacaaatatttatcaactggtgaaggaataaatcacaatattaccagaaagatataaagcagttaaaataaacaaagtatagctttaaatatgctaatgactaaagcaatttgcacaaggatgcatgcagtacattattcttgtgaatattaaaaacttgcagaagccaagacggctgactagaggcatctggtactcacctcctccacaaagaacagaaatagcaagtagatagtcacactttaaacagaccacctaaaaaagagtactagaattcaacagagaagtgacaggaaacacctaaggcaaggaagaagagggaagcaaggcagcctgctgttctgggactggcgagaagcctggaacagctcttcgatgtagggaaaggggaagtgacctccagtggtccacaatcccaccagactccaatcctagccacaggagagcccctcaacccaaaagggccctgaaactgatgtagggagctgcctggagaccatgcaacagcgttactccagagacagagctcatgccaattcccaccttccccctcaccctctagtcctaagcagctacagcaaagcaccactttgagaacccagcccccaccaaactgcatctacccaaggggcccaagaccctcctctctccacatatctgaagctacactgacaccctctgcttacatctaccaccacagctgactgccattggcagcaactctgctgcccacgatagcagggctacaacacacttaaaagtgccctgaggaaaggctactctgcttatagctgctacctggggctgaagcatgtgctctccaaccacctgtctgtggttgctgccactgaaagcaaccccgccctccccagcagtaggaccacagcacagccattgccacccccaccaagcattccactgcagaactgaggatcaccccgcccctgcctaccacagctagcaccagcacttgggagcctgaggacacgtccacctggcccagctccactgtctacctccagtgctcaagcatgccatccaggggccttgggatcaccctgccccaaccaccaccactggcacctgagcacacttcctggggatctcaggatgggctcacccaaactgccactatcacctcagttggcacacagacgtatgtgccaactgcaggcctggcgactggccctcccagcctgttgcagccactgtcaacacagtatggaccacctggatcccacagggttgccccatcactaatactgctatctcccacaccacacctgacactcagagggacctaaggacctacccacatgcctggcccactcaggcaagcctggaggctcaagaatcagcctgcctggacctcttacactggtaccagcatacaccaagaacaggcatgctcagcctgcaactgccactactgaggctcaggactgacccatctgacatccccggccccagcaaacctttgccacagcctccacaaccaaccacacccaaagccacttaaagaattacagacacatagtccgggcgtagtggctcatgcctgtaatcccagcactttgggaggccgaggtggacagatcacctgaggtcggaagttcaagaccagcctgatcaacatggagaaaccccaactctactaaaaatacaaaattagccgggcatggtggcacatgcctgtaatcccaactacttgggaggctgaggcagaagaatggcttgaacccaggaggcagaggttgtggtgagccaagatcgtgccatgtcactccagcctgggcaacaagagtgaaacttggtctcaaaaaaaaaaaaaaaaattacagacactactgatgcatttacagccaaagaaattatatggagactacactacttcacatactcagaatcaaagccaaagtgacctacacaaccaacaccatagatacatcttcaggaaaacatcctcccctatgaaagtaaattcccaaaactggaataagaaaattttatatcagatgtgcaaattatcaacatgcgaacaaaagaaacacaaaaaagcaaggaactatgacaccttcaaaagagcacaataattcttcagcaatagacttgaatgaaaaagaaacttatgaaatccaggacaaagaattcaaaataataatattttaaaaaatagtgaattataagagaattcagattaaacaataaaaagaaatcagaaaagcaattcaggatataaatgagaaatttagcagagacagatatcattaaaaagaaccaaacagaaatcttggtactaaagaattcactgaaagaaatacaaaatacattcaaaaagcttcaacaacagacaacagacaagatcaaggagaacaatttcagaatttgaagacaggtcttttgacataacccaggcagaccaaaagagaaacaaaaggataaaaaaagaatgaacaaagcctatgtgacatattggacacaatatactgatcaaatatttgaattttacatgttccagaaggcaaagagaaaaatgaaagggaaagaagacctatttaacaaaataacagctgaaaatttcccaagtctagcaagagaattagacatccagatataggaggctcagggatccccaaacagatacaacccaaaaaggtcttctccagcacataataatcaaactatcaaaagtcaaggacaaacagagaattataaaaacctcaagaaaaacaaaaagcatcaagtcacttataagggaaccctcatcagactaacagatttgtcaggagaaattgtacaggccaggagagaatgggatgggatgacacattcattcgaagtgctgaaggaggaaaaaaacaaacaaacaaacaaacaaaaaaaactgccagtaaagatactatacccagcaaagttatccttcataaatgtagaataaataatgtatttcccaaacaagcaaaagctgagggaattaccactagaccatacctacaagaaatgcttcagggagtcctacacttggaagtgacaggataatttctaccatcatgaaaacatacaaaagtgtaaaacccactggtagagcaaacacacaaatgaggaagagaaagaattcatatgttaccactaaagaaaaccacaaaaccacaatgataaacagtaagaaagaaaggaaaaaggatacatgaaacaaccaaaaatcaattaacaaaatgacaggaataatccctcacatatcaataacaaccaagaatgtaaacagattaaactttccacttaaaagatacagcctggctgaatggatttaaaaacgtgatccaactatactgttacccacaagaaactcatctcatctgtgaagaaacatgtagactgaaagtaaaaagacagaaaaagatattccatgcaaatgaaaaccaagaatgaacacaagtacctatacacatgtcagataaaatggactttaaattaaaacagtaaaaagagataaagagggtcattacataacgataaaggaatcaatccaggaagatgtaacaattctaaacatatacaccaaacacagaaacaactagatgtataatattattagacctaaaggaagagacagattccaatacaataatggttggtgacctcaacaccccactctcagcattgggaaaaaaattaacaaataaacattggatttaaactacactttacacaaaaatggacctaatagacatttagagaacatttcatccaactgctatagaatatacattctttgtatcagcacatggaacagttcccagaatagaccacataaaaaagtctcaacaaatttaaataaaaatcataccaattatctcctcagaccacaatagaaaaaaaaaaacacaaatcaattacaagagtaactttggaaactatacaaatacatggaattaaaaaaaatactactgaatgaccattgggtcaaggaagaaattaaaaagaaaatcaaaaaatttcttgaaacaaatgaaaattgaaacacaacataccaaaaccaatgggatacaaccaaagcagtgcaaagaaggaaatttatagcaataaattcctacatcaaaaaactagaaagatttccaataaacaacccaaaaatgtatctcaaaaaactagaaaagaacaaaatcaagccccaaataaatagaagaaaaaaaataataaagattagggcataaaaaaaggatgagttcgtgtcctttgcagggacatggatgaagctggaaaccatcattatcagcaaactatcacaagaacagaaaacgaaacactgcatgttctcactcataagtgggagttgaacaaggcgaacacatggacaccgggaggggaacaccacacatgggggcctgtcggggggttggggggctaggggagggatagcattaggagaaatacttaatgtaggtgacgggttgatgggtgcagcaaaccaccatagcatgtgtatacctatgtaacaaaactgcacattctgcacatgtaccccagaacttaaagtataataataataataaaaatactatgtgtagtagggaataaaagttaatatttaaaaaataaagaaagaaagattagggcaaaactaaataaaatagactttaaaagacaatacaaaggatcaaccaaagaagttagtgttttgaaaagataaacaaaattgaactactaactagactaaccaagaaaaaagacaacccaaatataattagaaatgaaaaaaaaagcagtataactgataccatagaaatacaaaagatcatcagactattataaacaactatacgctagcaaactggaaaacctagaggaaatggatacattcctagaaacatacaacctaccaagattgaatcaaaaagtggaaaacctaaacagaccaacaatgaataatgagactgaatcagtaataaaaagtctcccaacaaaataaattccaggactaaatgacttcactgccaaattctaccaaacttacaaagaattaacacaattctcctcaaaggattccaaaatatcaaagggaggtgatttttcctaatccattctacaaggccagcattactctgatatcgaaaccagaaaaggatgcaacacaaaaagaaaactgcagggctatatcccagatgaacatagatggaaaaaatcctcaacaaaatatcagcaaactgaatctaataacacatcaaaaagataatataccacgttgggctcagtggctcatgcccgtaatcccagaattttgggaggtcaaggtgggaggatcacttgagcccaggagttcaagaccagcctgggcaacaaagtgagatgccatctctacaaaaaaaaaaggcatagtagtgcgcacctatagtcccagctacatgggaggctgaggcaagaggaacccttgagcccaggagctatgattatgccattgcactccaacctaggtgatagagtgatactctgtctcaaaaaaaaaaaaataataataataataataatgcaccatgcaccatgcaccatgatcaagtaggatttatcccatggatgcaatgatggttcaacatatgcaaatcaataaacacaatacatcatattaacagaacgaagaataaataccatatgaccatctcaatagatgcaaaaaaaattgataaaattcaacattctttcatgacaaaaactctcagcaaactaggcataaaaggaacataccttaacctaataaagcctatatatgacaaatccacagctaacatcatattgaatagggaaaagctgaaagcctttcttctaagaactggaacaacacagcatgcccactttcaccactcctagtcaacataatactagaagttccagccaaagcaatcaggcaagagaaagaaataaaggcatccaaattggaaaagaggaaggcaaattgcccccctttgcagatgacatgatcttatatctagaaaaatctaaagactccaccaaaaatctcctacgttggataaattcagtaaagttgcaggatacaaaatcaacatacaaaaatcaatagtgtttttacacaccaataatgaactatccaaaaaagaaataaagaaggcaatcccctttccaaagctacaaaaataaaataaaatacctaggaccaaatttatgcaaggagggaaaagacctcttcaaggaaaactacaaaacactgatgaaagaaactgaagaggacacaaatggaaagacatcctatgcttatagatcgaacgaattaacgttgttaaaatgatcacactacccaaagcaatctacagattcaatgcaatctctatcaaaataccaatgtcatttttcacagaaatagaaaaaacaatcccaaaattcatacagaaccaaaaacaagcctaaatagctaaagcaatcctgagcaaaaagaacaaagctggaaacatcacactatctgacttcaaaatatatcacaaagctatggtaaccaaaacagcatggtattggtataaaaacagacacatagaccaatggaacagaatagaaaacacagaaataaatccctgtatttacagccaacctactttttgacaaaagcatcaagaacctacactgaggaaagaaaccctcttcaataagtggtgctgggaaaactggatatccttatgcagaagaatagaactggacccctatgtctcaccacatataaaaatcaactcaagataaagactttattaagactgcaaactataaaattactaaaaacattgggaaacacttcggggcactgatctaggcaaatattttatggctaagacctcaaaagcacaaataaaaacaaaaacaggcaaaagggactattttaaactaaatgttttaaaacaatcaatagaatgagaggcaactggttgaatgggataaaatattttctaactattcatctgacaaggtataatatccagagtatacaaggaaggaactcaaacaagtcaagagttaaaaaaaaaaaaaagcaaataatctcattaaaaagtgggcaaaggatatgaatacactttctcataagaagacatacaaatgcccagtaggtatatgaaaaaaaacgcttaactttcctaatcatcagggaaatgcaaatcaaaaccacaataagatatcatcttaccccagccagaatggctattattaaaaagacaaaaaaaaaaaatgctggcaaggatgcagagaaaagggaactcttatacagtgttggtgggaatgtaaattagtacagtgactattaaaaaaaaacagtatgaagatgtctctacaaaaaaaaaaaaaaaccactaaaaccagacattccatatgatctaggtatccctctactggctatttatcagaaaagagaaaaaagaaagaaagacagagaaggtaaggatggaaggaagggaggaagggaggaaaggaggaaaggaggaaaggaagaaaggaagaagggaggaagggagggagggcatcatttcagcactttagggggctgaggcaggcaaattgcttgagcttaggagttcaagaccagcctgggcaacacggtgaaaccccgtctctaccaaaaataaaaaaaaattagccaggcatggtggtacacacctgtggtcctagctacttgggaggctgaggtgggaggatcacttgagcctgggtggtggaggttgcagtgagctgagatcacaacactgcactccagcctgggtgacagagtgagaacctgtctcaaaaaacaaacaaaaaaataaacaaaaaaaagtagaagaggaaaaagatatcagtatatcaaaaggatacctgcattcatgtgttaccacagcactatttaaaatagcagagacacagattcaacctaaatgcctaccaattaatgaatggataaagaaaatgtggtatatatacacaatgggatactatctggtcataaaaaagaatgaaatcatgtcagttgcagcaacacgaatggagtggggggcagtccttatattaagcgaaataagccagacacagaatgacaaatatcccaggcatgggatctatgaacataggattaaaaaaaattgatctcatgtatagtgaatagaatggtggttaccagaggctgggaagggtaatggggaggtgaggataaagaggggttagttaatgggtacaaacatacagttagatagaaggagtaagttctaacattcgatagcagagtagggtggctatagttaacgaaaatgtatggtatatttccaaacagcaagaagagagaacttaaaacattcccaacacattgatatggataggaacacatggatgtgttcccaacatatctcaacagaaataataagtacatgaggtgatgaatagcctgaatagcctgacttgatcatgacacattctatgtgtgtaataaaatatcacatgtaccctgtaaacatgtacaaatattatgtatcaataaataaacctgcagaagcctactatatattttttatgtttttctcacatatgtatacattcacaagcacatgcagagagacgataagtatcaattaatggtctgggcaaagaggaggctaatggaattaggaaggagtaaaagggctccaactttatctgtaattactgacttgttttatgtattaagtcccaaaagatcttgaagaaattacatcgaaatgttaacattttacaaagctgggtaatggctatgttattgcattataactccctgtaagcatttcattttgcttaattttttttaaaaaaggaaagaaagaaattgaattcagtctgagccattaagagagagaggaagaaatgggagggaatgttaatttactcatccacaaaacaaagagaaaaagatcaccttttatatgttgaacactgagaactctatttctgtgacatctattctcctgcaacttttaatcaggtaacccagaagacttgaaacttcataaaccaaatgccagctctaaaatgcagccttacttgaactgacaggtcaaaacaatgtaataattcatactgacaaaaatgaaaaattattttccattaggccattttgctgaaaggctaataacaatatatttccttataaacttgttccatttcaatttttaaaatggaattttgtatctattttagtttttattatcttctactaccttccattattgtcctttttttattacaaaacagcttatctctataaactatgtttttactgtgatgagctaagagacagcaataaacttatacaatttttaaaaagcagcacttaatattttagatactgagagcaattcatttataaccattttaaggggaaaaaaaaaaaaagccaaatgtggtcctaagactcctatgagtaaatgtattagtccattttcatactgctatgaagaaatacccaacactgggtaacttattaaaaaaaaaagaggtttagggccaggcacggtggctcacacctgtaatcccagcactttgggaggccgagacgggtggatcacctgaggtcaggagttcaagaccagcctggccaacatggtgaaatcccatcctactaaaaatataaaaattagccaggtgtagtggcacacacttgtagtcccagctacttgggaggctgagacaggagaatcgcttgaaaccgggaggcagaggttgcagtgaactgtgatcatgccactgcacttcagcctgggtgacagagcgagactatctcaaaaaaaaaaaaaaaaaaaaaaagaaagaaagaaaaagaggtttaatggactcacagttccacatgtctggggaggcatcacaatcatggcagaaggtgaaggaggagcaaaggcacatcgtacatggccgcaggcaagagagtgtgtacaggggaactgccctttataaaaccatcagatctcatgagacttatttactatcatgagaacagcatgggaaaaacccacccccgtgattcaattacctcccaccaggtccctcccacaacatgaggattatgggagctacgattcaggataagatttgggtgggaacacagtcaaaccatatcatgtatatttgtgatacatcatttgaaagagtaaataccatggtgtaactgatgactataatcctcacaatcatttgccaccttgtttctcctgccttttcttcctccactgccatagcattgaattcccccctgtaacttcagtgttgccctagttttccagctagttttgaatgagacagtggaatgatctatggttaagtctctccatcttgacctatcttacataagtgggatctacatctgaccatgacagctcattcctaagttcccatcagtcatctctacacaatccagcatgtcagaggtgagccctgcactatgacctgtgccattgagctgggatgcttcctgggtcttctcctccactgtctttaccaggttactgcagtaacctgatcaaccacaattaaggtaatactaaacagagttctaagtaggcaaagccctgagagctggggcctacacctgctccactccaaaaccttcctatgcttggtggtggaaactcatctaagtgcaaatgtttgatatcacctgctggacattctgactttgaaatcagccaactagttgaccaacacacacaccctactcttcttccttcaagattggaattcctgctactaaaggttgtctgaatcattgaaagttgctttatttctaatctatgctttcagaaactaatatgctccatggccctctaataaacatattctctgatgctgagaagaaagtatcaacccacttttgcttttctcctggcctgagcctgcctaacacaatcatgtatgaaatgggataagtttaacttaagggcagctcttaagtgatgttatgcaattaccaaatggcagtattaatattttcacacagcagggaaaggttgattttttttaaatgacagtcttattaaggcaaggtacagatcttaaaagacagaaatcccctggactctatgattttctcaggtggaaaaaaacagcaggccactgtcccaccttagtgtgtattcacagcaaagctgcaacaaaagttcaaagaaagacagctggagaatctaggggtatgaaaacgagattgggcaaacagttccctaatgggcaagaagtgggaaaaagccagacccactttgaaagataaaggagtagctccattaaccattgaagactaaaccaattaaaaaggatgtattagaaagaaaaataaacaaacatgaaaggtgtcttatgtggtttaccctaggtacccctgtacaatttcatcttatgaatagaaaattcaaaatgggctttcagattccaaaataatatctcttctcaaaccttatctgagtttataaacacaaaaggaggcacaagatgaatttaaattgcaatatgggaacaaatttaacttctaatagaaacatggttcaagatgaagtcagaagtctcaatgtttatctccacatgcatttattcctggcaatacgttggagttttccatagagtgtttatccaacgtggccttcctttgatgggtcttctggcataccacatacacagaccatatgtagtggttacctctttctccctgtaaagaacttccagaatttacctaatgttaaatgacgagttaatgggtgcagaacaccaacatggcacatgtatacatatgtaacaaacctgcacattgtgcacatgtaccctaaaacttaaagtgtaataataataaaatttaaaaaaaaaagaacttccagactaatcatggggaaaagggaaagaactaacatacgtcaggtatctatcaaaaggctgatactatacaaagcacttaacagttatttttgccatttaaacttgttaccacactgtatgttatttgaattctagagattttaaaaaataaagctgaaaaagacctatgtactgaagatcccccagctatggtgtataacagtctagatttgaaccaaaatccacccgggtctacgcccatgcattaccttttctcaattctatgttagacgaaattatcgtgtggcactggaaacatacttcatactgcaattaattgttcacattttagtttgaaagaaagcactgtcaagataatctgtaatcccttatttcagagactcataatttaataattgcaaacattgtatgaattcccttactctgaagccttctgtgtgtctcatttttgtattcttcagttgtgaaatattctagttataatttcaatctgttttctcacttagaaaataaagagaggaagtggaattgcctttttaaaccttaagagtcattgaatcattttatgcagaagagtaaactgatctaatcaatgtttttaaaaaataaaaataaataacccaccaactacaagaacacattttagaaaagcaactgaagaaacctgaatgtgaattgagtatcaagtgatattaaggagttatttatacttttgctaagtgtgatgatggcagtgtggttatttaagcaaattattttttagatatgcatattaacataaggggattttttaaaagatgacaatgctagggatcctaaaatacttcatcccccaaaaaaggagcaagtgaagcaactgtgtcaaaatgttattactgaatctaggtgttggctatattgagattgttatttttatttttgtgaatgtctgaaaactgccatagtacaaagttctatccaaaaagacgaatctttcagcctcaaaaaaaaaacccatttaatgtgaaattcagttgctttgataaaaaaaaaatccactttctaataacagaaataaaacctaaaacacagattttgaaaatacatattttgttgagagtacctattggtaaggatgtccaaaaaaaagtgtcttccaaaagacaacaaacagacaccaatcacttttttttttttttttttttttttttttgagacagagtctcactgtttcacctaggctggagtgcagtagtgcgatctcggctcactgcaacctgccacatttgcctcctgggttcaagcaattctcctgtctcagcctcctgagtagctgagattacaggtgcacgccaccacacccagctgatttttgtattttcagtagagacggggtttcaccatattggccaggctggtctcaaacttctgacaggtgatccaccagtctcaacctcccaaagtgctgggattataggtgtgagccacagcacccagccgcaatcactttttatcagaacactgaatgagaattggaggaacaatctcttaactaagatattgaaaatctacccaaattcacatcttcaatgaaagctacaggaaatcacttggagggatcaaaatatctttatgttcttgacttaaaaccaaaatggttgtgaacaggcaacctacagaatgggagaaaaattttgcaatctatccatctgacaaaggtctaatatccagaatctacaaggaacttaaacaaatttaagagaaaaaacaaccccatcaaaatgtgggtgaaggatatgaacggatacttctcaaaagaagacatttatgtgtccaacaaacatatgaaaaaaagctcattattcctggtcattagagaaatgcaaatcaaaaccacaatgagataccatctcacaccagttagaatgatgattattaaaaagtcaggaaacaacagatgctgaagaggatgtggagaaatgggaacacctttacactgttggtgggaatgtgaactagttcaacctttgtggaagacagtgtggtgattcctcaaggatgtagaaccagaaataccatctgacccagcaatcccattactgggtatatacccgaaggattataaatcatttctactatgaagacacatgcacacgcatgtttattgtagcactatatttacaatagcaaagacttggaaccaacccagatgcccatcaatgacagactggataaagaagatatggcacatatacaccatggaatactatgcagccataaaaaagaataagttcacatcttttgtagagacatggatgaagctgaaaaccatcattctcagcaaactaacacaggaacagaaaaccaagtaccacatattctcactcataagtgggagatgaacaatgagaacacatggacacagggaggggaacatcacacaccagggcctgtctgggagtgggggaaaaggggagggagagcattagaacaaatacctattgtatgcgggcttaaaacctagatgatgggccgggcatgctggctcacacctgtaatctcagcactttggcaggccaaggtgggcggatcactaagtcaggagttcaagaccagcctggccaacatagtgaaaccccatctctactaaaaatataaaaattagccaggcatggtggcacacgcctgtagtcccagctactcaggaggctgaggcaggagaatcgcttgaactcaggaggcagaggttgtggcgagccaagatcacgacattgcactccagcctgggcaacagagtgagactccatctcaagaaaaaaaaaaaaaaaaccaacctagatgatgggttgataggtacagcaaactaccatggcacatgtatacctatgtaacaaacctgcatgttctgcacatgtatcccagaacttaaagtaaaatattttagaataaaataatttaaattcaaataaatataaaaatgaaaattaaaaaataacaaaatggtcatgtaacaaatgagagacagaatgatacaccatgaaaaatactgataaagaagactcttgccttactggaatcacaggtgtgagacctgaatatcttttaggttttcagatacctattctggcctctaatataatcctaggtttaagagaagccaaactgctcactctggtactgaactattgactctttcatgaacaatgaaaatgaaacttttaatccaacttctatccacagtaacctgatcaagcacagggtaatgcttaacacagtgctagaaacagaaaatggctctggagagctgcaagtttgtttggtttcctaccccatccccatgcccccaatatccacaggatacgaacacattaactcaacctaatgatgaacaggttcctgtctgcaaatacatcccaggagtttcctttggataagaaaactctttttcagtgtctggaccagcagaattataaatcggttacaaacacggcatcttcttgctgctgctagtccagtttcgtcttagtattcatcacctagctttgtaagagctaggtgctctctcagcatgagaaaacaaaaatctgtctcagagtcaaggcaggggtaaagcagagaatacaaacttgccccacttcaaaaaacaaggcatatctttcaactaactaaacagcaatcccagcaggcgtgacaatgcaagctttcttccctattattgtttgaaacaatcacaagctatttgttcatattaattcgtttatatgtagtattaggcagccttgattagaaaaatgctctttgttacccaatgaatagagtaacaaacaaaaccaaaagtttttctaaaaaattgttgttttggccttagaaaaggattttcaggcctttcacacttgaatgtggatttatctttacaaggtccctgaattcactggaaaagaaagcaagttgatgtgccagacaataccaggctaaggtgactgagtgagctgcttattatgcttgcctaagaagatgctatatctaaattatttttaccttctttgaacttgggcaaaactgataataagagagaagacatcagtagaagcttcggggcaagggcaagtcagccttggactaaatttcactgtacaaattacatgtgaggaattgacatataattaggaggcccatcattggccaaaggatcctgggaaccaagtgacccaatggtctgcatctctccagaagaagctatctatctctatgacctaatgtcccagtgtatagctgactccttccccgtgggcttagttccccaaccatcagaggctgccactattcccaaaatacggtgagaataatgcaactaccctggttaaggttaattaataaacttgctcaataaaactattatcgaaagtcagaacttgaacccaggtctatttcaaaggctgggaccattaagctaacaaagacttcttttaagatcaatgttaaattcattaatacggtttgaaagaccctgtaaaatctccaactttataacctaacccatttatgctaattctagcacttgccgatttctgcagtataactattccatgtggctgatttcaagctgctggcatgaagtcaattggctcgcgaaattcctgaaaatttaacaatctgcttctgtgagttggtataggtggctctagggacatcactgtttacaatctcatgccccactgtagtgcaaccatccaaaacaaaattctaaatgctttgctccctctctctctctctctctcacacacacacataccttgggacacttgacattcacctatgctttttcttctcctttaccaaaataactcatattaatttgtcctcagcctagtggtcttccttcaagaagccttccctgatcctctaaatcttttcttgggtctccactttcctcccagagcacccatacttcctgtatttgtgcattcctgcatgggtgacaaagcgttgtaactttttgttttatctgtgtatctcccactatatctgtaaactctggcagggcaaaacttatttctcttatttattcttgtatcccccagccctgccacaaggcttgctgagcaataataacaatgcttgctaatatgcactgggcaatatgtgcccagaatatgtgccaggcactattctgagctttatagaaattatttcatttccgccttaaaataaccctatcaggttggcttcattaatgctatgctcattccgtgggtaaggaaatagaggcactaagagggtggataccttcccctcaggctcaggtaattagtaaattgaagcagggtgactggtgagcctatgtgcctccctcaagaaaccagtgtttcttggccatatttttttctcattagtgatccttaaggagaaaaattaattacatttaaattttttctaatgagaaaaaactaaatactaaggaataagattttgttggatagaggtataagctctggagggatttttttcatctcccaaaacccaatttttgtcctcttggggcaatataactatgttaagaatgtatgttctaggactttcattatccatttccattaatgtaccatatacttctccctaaaaatacacagtcttgttttagaattttaatggtatcttcccataagtactattttgcgtcttgctttctttttcctccatacgatatcttggagtaatatatagctgtgtagacatcctcattttaaaactactgaatagtggtcgggcgcagtggctcatggctgtaatcccagaactttgggaggccaagatgggcagatcacctgaggtcaggagtttgagaccagcctggacaacatggtgaaaccccgtctctactaaaaatacagaaattaaccaggcatggaggcacacacctataatcctagctacttgggaggctgaggcaggagaattgctggaacccagaaggtggaggttgcagtgagacaagatcgtgccactacactccagcctgggcaatagaatgagactctgtctcagaaaaaaaaaaaagaaataaataaaatgactgaatagtatttcaatcatgtccacattcctgaattcattaagtctttctactattggatattcacaaaattttgtacttcttggtttgcaaccaatgcttcaatgaatatctttatacattccttatacactccttgggctcatgtgtgagtggttttctaatgtagattccaagacaggagcagggcatgtgcagaagtgtataattttaatagatactgttgaattaccctccagagtgactgtaccaatttactttcccacagagaatttacgagagtacacatttcccccagtgattgtatgaaatagaacctctttctcctttgggcagtgttaaacattttaattaaatgagtcatttagaggtatttctattcctcaccagctgataggagcttgtgtaacagagaagatatatagataagaagatgctgttggaaatgctgaaagatgacagcagcaaaccgggatgtggaaatgccctgtctagaaaacccgcactagcctaactcacttcacgaaaggactaagaagagtcattacatgggaacagctgcagtggactttgaaatggtgacctcaggtaacaggcactaaatctctttgcccattctccaagtctctcagacaccaaaaaagtctattgaagataagggaaaccaaacacccaaagtaaatgaagtgttgaaaggacaatggtccacttaccagaaagaggaatgcgtatgacgatggtaacactaaacattctggaaaataatactaaaggccttagtactttattctttattcatatgatatgaataaagggctttattcatatgataaaatcccaaggttgataacaatgatgacatcccaaatggtgttgaggagaaaacactatactatatgagggaaaaatgccccttgttctcctttttccctctcctccttctctccttctctcacaaacacacaaacccctacttaaaatacatacaaaattgaatagcctgcaaaatcatactgaaaaaaacagtgtggaacaacgttctgtatcaagttcaaatttcaatcagtatggctctttcttgaaagtatgcttttttcttcaaagttgcccgaggccgggcacagtggctcaggcttgtaatcccagcactttgggaggccaaggcaggtggatcatttgaggtcaagagttcaagaccagcctgaccaacatggtgaaaccccatctctactaaaatacaaaaattagctgggcgtggtggcgggcgcctgtaatctcagctactcaggaagctgagacaggagaatcgcttgaacccaggaggtggagattgcagtgaaccaagatcatgccactacactccagcctgggcaacagagcaaggctctctctcaaaaaaataaataaataaaaataaagttggccaaaaaatgattgtcacaaataagaaaggaggtcacactatagaaagaagataaatgaagagtaaatgggaaactacacttgctgagcacctctgtatgcctcatgtatatgaaccatcattttatccatataaccatcatgtgaggaatgattacatgagaggaaactgaagctgagagaagctagcatgactagggctctttatcctgcaatcagaggagcagggatgtgaactgtggccttatgactccaaagtctgtttccacattgtaccctgctgcctggtgaatctgaaagagtccagccaatgcctgattaaatcaggctgtaaaatcatctgaacaaagaccatgtccctgccgtattactgctcttcactggacagaaaaaaataactcatacgattgctgctcagaagtttctggaattgcattttgtttcaaagttcctagaacagatcaaggcaaaagagtaagtataggaggaggacaacaagacagccctcagaaaacttgttataaaattagatccattctgatatatttcattaaaccccaccccaccccccggcccacaaaaaagccaagagaggaaaagcagcagggtttactactgacttactttgatttagagtttgatgcctataatgtcagacatcctaagcactgaaaaccaaggcctcctatgaacagaggccagttcactaaaatcacttgttcattgttccagctgcttcctgaacgaaatggcacctcactcacaaaagcaccattattcgaatacacaccaaatgatagcgagagagatatacatgatccctagagtcaaatacacttcctgaaacccagtttaaatatttgacaaacttacgattacctcagacctctgctagtttgaagcccttacctggggctgtgaaattacagggatggaagtagagatggcagccatgacagctctgtggttgtaggtggtgaacacgccccagaactacgggagacaaattttcttgtttgctgatcagatcgaagtcatgctaggagaagctgtgtacctggaaaacaacaggaaaacccacatttagcataaaaggactagcatatgggtgtgaagtaccattggccaaaggaggtaagaatccctagacatcaagtgtcaaatactagcttaatgcaaacagaaagccggtagggaaaagctaaggtctaaaagccacgacttctgtgctatctgtccaaatactcttaagttgaggaattttcataggtttgaatccaacatcccagctagatgttttgggaagacagtttcaagttgcagagctgaggagggtgagtcgggggaaaagccatcctgccattaaataataaaggaattgaataatccacagtggagagctgacggcttacatagagggcaaagagaatgcagtaaccacccccacttatctgaggagtggattctaagccccccagtggatacttgaaactggatagtgggtcaggtgcagtggctcacgcctataatctcagctctttgggaagccgagggggaaggattacctgaggtcaggagtttgagaccagcctggccaacatggcaaaaccccatctctactaaaaatacaaaaattagccaggcgtggtagaacatgcctgtaatcctagctactcaggaggctgaggcaggagaattgtttgaacctgggaggtagaggttgcagtgatccaagatggcaccactgcactccagcctgggcgacacagagagactccttctcaaaaaaaagaaaaagaaaaagaaaaagaaactgtgaatagtacccaaccctgtatataacagagacagctactgagtgactaatgtacaggtagcacacacagtgtggaatcgcaggacaaagggacaaatcacatggacagtatgagatttcacccacactattcagaacggtgtgcaatttacaacttgtgaattgtttgtttctgaaatttttcatttaatatttttggaccaagtttgactgcaggtaactgaaactgtggaaagtgaagcttcggataaaagtagactaccataataccgtcaagtgattagatagcaccccgtccaaccccacctatttgcagaagaaaaaattgaggcttagagaagaaaagggactagagtcacacatttaatggtagaaccaggactacagcagcaactccggttcccaggcctatatgaaacgtaacgaagttaatgtgttccctgcctatatctcctcaaggaacttagttaccgcttttaagactaaagaaaggcaagatacctgatgctgtaggtgtcagtcctgagaagtcaggtactcagataggtggatggggagcttcataaatcagacgtccacctgtgtgagaaagagaacatttctaaaatccttttgacatcctcaaagagaggatgctaaataagcacaaagtataaccaaatctcttattcacgtgttcattaagaaaactcagaaagatgctaacttccctgtagtaaatcacagccctagttctgtccaaaggctgatgtgactctttccacattgcaatttagtccagaagaaaaaaatttttcattttaagaaaataatttttaaaaattcgtttatttttaagaaacattttcattttctggtgatgttcatactccctaacaatatcttttcttttattcaaaagacgttattggctgggcacagcagctcaggcctgtaatctcaaaactttgggaggccagtgggggcagatcattagaggtcaggaatttgagaccagcctgaccaacatggtgaaaccccatctctacttaaaatataaaaattagctgggcgtggtggcacacacctactcaggaggctgaggcaggagaatcactagaacccaggaggcggaggttgcagtgagccgagatcgtgccactgcactccagcctgggcaacagagcaagactccgtctcaaaaaaaaaaagtaaggctaagccaaccttgcctttaaggagcttttgtctgtaaatatacttcctagtttcaccaacatgcaagatgatacctgaacactttttaaactattgggaaatgatacttttcataatagtaaaagtaatgaaccagatgtcacaagatccaagtcttgcacagcaggaactgtggagttggacatttaatccaagtcctttgtcccccacatcccttggtgctaccctatattagctcagggatactgggcaaatgaggagctcagaagtgctgcttttctaagaaataatctaggtttgacagcaacttctataagcttaaatttttaattgctacatttttgtgcagcatccttgatactacagtttcaatcactttaggttctggctgcttagaactgtagagccttcctattttcttctcccattacagcaattattttcattcacaaataagtagtaaagttctcaagttatcttgtcatgacattcaacaccgaattccacagctgccctgtgacagtactgatattctccttagtcccagttttaggaacaaatgagacttgtttatcacactgtgaaagtaaataaacaacccaggagaaaagcatatgtatacaggacctttcttttttcaagatgactgctagagtgccaaacctacccaagaaaattacaggaaccccaaggtgcactgttttacactgaacttattcctggcactattttttgctcactcctactttcatttttcctttctccttctcatgtatttattattcctggcattattttttgcccactcctactttcatttttcctttctccctcttatgtatttataattcacattatcttgctctatgtgacataaatgaatatatcaataatacaactaaaaagcaaaaaatcaagcacataagattccattcttaaggacgcatactatatgctcaggtccaatatcatttcaccaagctatgtcattaagcaatataaccttaaaatattttcaatattcagaatatagagagttgcctaaaaggtaaatagaggcacctagcttagagtaaggaaagcgaaatagaaatggatgagatccaccaaacaaatatgtcatatgacgttattactaacaacagcagagggaaagatgcgagactgggatttcatgaaaggccactggatgctgagctttggagcagtcatttccccaacagtttgaggcagatactattcagttattttacagaggagacatctgaggctttgaaaggtattgtgaggttatgcaacatacccacagtcacacagtcaggaaatgaaagagctgaggtctgaaccagggcctatgctaagattcatactctttccataggccaatattccatgtgatcaaagattaaaaagagatggaaagcacatggaatctttaagcaaaaatgtcagataaaaaatggagaaagtaggatgaaagtcagatgacctgcagagtaaccctgagacagagaaccttgtgctcttctcatctatataaaattttaaccatttaaccctcatttggatgtttcatttccttgagatgcctaataaacatgacagattgttagtttcacattttcaagaagaaaataagacagaaaattaactgccttctcctaaaacatgcgacacgtctaattttgttgaacctattcacacattacaagaacgctttataaaatagtgtatgcttactttgccaaatacaagggctaaatgacataacttcaaaggtataaatcagttttcccttgggagtgaagtcttaaaattatatcatgaaatctatttacttctcaacttatttacaaaactgcacaaatcatgggggaactaaacaagacaaaaaagacattaccctaagtaatcatgccatacagtatctagctgagtaagctggctcactttgacagatgaacccccgccttaccagagccccagactgtcaactagagagttgcacaataatttttaaagaaatacatccctggctgggtgtggtggttcacgtctgtaatcctagcattttgagacgccgatgtgggtggatcatgaggtcaggagttcaagaccagcctggccaagatggtgaaaccccgtgtctactaaaaatacaaaaaaaaaaaaaaaaaaatttagccaggcgtggcggcaggcgcctgtaatcccagctactcaggaggctgaggcagagagctgcttgaacctgggaggcagaagttgcagtgagccgagattgcaccactgcactccagcctgggcaacagagtgagactaagaaatacacccctctgaactcttccaagtacttggatacctgttctgcaactcttccaacctgccaccaacctaactctccatttcctttgcttgagcttcaaaactgtgttctagccacagaaaaccatgaagcaatgtgggtttgcccagctgacatcaggctctccaactgcccttggagcattactgctgcctcttctcttctttcctagttgtctccattttctattctcctaggcatctcttctcatctatatttctcttctcaaaaccgtaaaattacttctaatgcctctcacctgcaaaagatgagctttgtcatctatttatttattggatcattcatccattcctttacaatcactgggtctaaattacctcaatatcccccctatgattcaaatcacatatataaaatacaatttccaaataagaaagctataagcttatttctttgtgccagattaccaaagaaatgaccagttgattataacagaggaatatcctgaatcagccctggaaactataaatagatcttaaacgttcagaaatatatacttgaaagaatcaacatgggaggttgacaaaaggactaaaacacgatatcctcttcatgtgaaactgcaactgcacaaccagaaaataagcaaatgagaatccactaaacccataatgatacccctagtttagagcgatgggggctgagggaactaagcccaggaagacttggggtacatttaaaacacactaactcctttaaaagggctcctggcttcagaggccagccaagcaagtaacctctggctgcatttacttctggttgacaggtggccatgatgactaccacagaaaacacatgggaaaaagacactcccagctggctcctggcaagggcagccatgccaagtgacaatgaccttgctaattactgagtgccacaccaaatacctaaaacaaagtctttggtttgaggcaaacttccctttgattacttctggagctgatgctggctcttttcccaggcctcacaggaatatgaattcataattggtaaattaatctactacaaatgtaacctttttcctttgtctggacttgagtcaaatagtgactcatacaagtttcttgaaagaacacagggttactaatgcacgcggggcttaaaacctagatgacgagttgataggtgcatcaaaccaccatggcacatgtatacctatgtaagaaactgcatgttctgcacatgtatcccggaacttaaagtaaaattttaaaacagaaggaaagaaggaaggaaggaaggaaggagggagggagggcgggagggagggagggaaggaaggagggaaggaaggaaggaaggaaggaaggaaggaaggaaggaaggaaggaaggaaggaaggaaggaaagaaggaaagaaggaaagaaaacaaggcaatacccaatactgaatatgcattgacttccctaaggataagcaaaggagaaaaatctaaatccaccaggcaaatagaacacattgtggttcagaaaaggggaagattctagaatcagagcaaatatttacttaagaaatagatatactatataaaagagaaaactctattaacagaaaatttctagctcatgttcttaaaattccaggggacatagtagaatctttgcacatagagcaggtagccatagaaagaaatatgagaccagaaaagagtctgcgctaaccagaaaagaaaatctgaattatgaacttgaataaaagcaaccaatgaagcagaaagtagaatatttttaaaaagcaaaaaataaaattagtgatgcaaaagataaaacagacttctcagaggtagctgggggaagctacgtgggtaaagattttaaagccttcgtctccaaaacagaatagatgaatgaaaagcaataaaggaggaaagaagaaaccatcaatgctgaaacctggaaaggacaaatttattctaaaaactttagaaaactattacagatatacaacaatttagataaaatggggaaatttttcaaactatgtatcattcttcagagagccctatagtctgatataaacaaaatagaagaaattcctgaagcccaaacctggaggaacaagatgagatacaggcagttcagagctgaagcttgtcttctttcttattatctcttccgcctatcagagctaaatagcatctgaagccagtcttacatcatctaaggcctgagacggaaagatttttctctctggaatctgagcagatgaataggtttaacaatagtaacatcgagaagaatatattgcacttattcaaacaaaaacaggatgcttaaaaagtggtaattcaaaatctaaaaaagtttttcccacagaagtagagagcaaagtggtggttaccaaaggctggggtggttgtggggagagggagttgggaagatgttgatcaaaggatacatatttacagttagacaggagatctattgcagttaggaggaataaggtcagatccatcgtgtaggacagtgactatagataatgatgatacatggtattcttggaaaatgccaagggagtggatgttaactgttcttaccgcaaacaaatggtggctatgtgaggtaatgcatttgttaattagctagacttaaccattccacaatatatatatactcaaaacatcatattgtgcatgataaatacttataattttatatgtcaatttttaagaattcaaaaaaaattcagtagacagattggaatataactttaaggaatgtgcccaaaatgtagagttaaaaaaaaaaaagtaaagaagactagaacagtaaaaatgagaaggctacaaaatgagtccagcaggtctaatagccaaatagaattccagaataaaagagtaaaggaaatggggtggagtgaagtcaaatgactaactcaaaatatttcctaaaacgtaaggtcataactgtgtagactgtaagggcccactgagtgcctacctgcccatttcatttgatttcaatatgcccacattaaacacagcatctgtcatcatgagttgtgtttttttaactgtaaggatattaaaaaggtcctataaaatatcaaaaagcaggtagggaagctcataagcaaaagattaggaatcagaaagtctctggacttttcaacagcaaccctgaaagctagaagacaatgaagcaatgaggaaggcagttgacaacctagaattctattggcagatgttcttctgcaaaacagggaggaaactaagaaaaagacaggcatgtgatacaggaaacaggagtccaatacaagagggagaaaaaaaggaattcctggcataattgtgaagggaaatccttgggtgataagcaaaaagactcaagaagtagtatatcaagaggagatttggataaccaagagcatttaggactgaatgagtaaaaagcacatagaaaactaagcaaacatcaaaagaacaattagtttaaatagaacaaaaaatttgcagaagaggaaaaggattcatagaattctacatggctcaggtatgaacagcattaacaaggtcatcatcctattaacactgaataatggcctagtcaaaatcatgacctaactatactaagaaaaggaggttcaggatgggagtatgtgaatggtacactttgcacatggtacatctataaatattccaaactagtaagataaaaagaaataaaaaccttagaattccacatagcacatatttcaaaacatatcattcacaattttaaaaattttcaaaaagaagttaaaaaaaatcttacagattaaatgcaaatatcaaatgaggctgccaaaacaactgaaagtggtagctctggggaaggtaaaattgtaggaagcaagcaaggactcctctttcctggcaagcctcagagctatttgacactttaaattacatacatcctgtcatttgcagcaacacgggtgagcctggaggactgcatgttaagcgaagtaagtcaggcacagaaagataaatactgcaatgttctcgctcctatgtgggagctaaaaaagttgatcccacagaagtagagagtaggatagtgcttactagataccaggaagcctaggggacagggagggatagggagagtttggttaatggatgtacaaagttatacctagatagcaaaaataagttctagtgttctatagatctgaagagtgacttatagcaaacaacaatttattgtattttttcaaatagctagaagagaggactttgactgttacccgtataaagaaatgatgaaggtttgaggtgatggatatgttaattgccttaatttgatcattacacattgtatatacatgtatcaaaatatcacactgtatcccataaatatgtacaaatgtatatcaattaaaatgaatatatttaaagataatatagaggaacaaatcccaagcatcatttaatttcttctgtaaataactcagcataatacatatgctgtaagtaactttatgtttacatatttagctgttttgtccttaaaagaactcttttataaggaaactaccttaccatcatcacagttaaaaaattaatcagaggtacttgatatcatcaaatattcggtaagttcacaatcccctgattttcttataacttttaacagtttggttggttgagtcagaattcaaataaagcacatacatttctttttttaagaaaaggaggaagagaggcagtgctgcatagtagttacaagtacagtacgctagggaatccaactgcctaggttcaaatccttgtcctgccagtatgaccttgggcaggttatgtcatgtctccttgcctcagatttctcctctgtaaaatgggtataataatagtaaggctgccacatatgactataagaattgaattgattaatgtacctaagacacctggagtaatacttatcatactgtgaacaatatagtgaacatggtaaaagtgatagctaacattgtttgccaaataaagtatctacctatacatttttaaattataaacatttacaagtttgattttaaaattttttaaggaaataaaaaaaaatcactgcagaaactaaaaatttaaaactacaaaagacagaagtgccactgcagaaaaccaagttggtgccatggaagtctggcttgggaaaaagtacatgtgcttacaataatggaatttactagattaattagaaattatggacatacagaatctacaaataaacaaatttacaagaagaaaacaacctcatcaaaaagtaggcaaaggatatgaacagacacttctcaaaagaagacatttatgcagccaacaaacttatgaaaaaatgttcatcatcactgctcgttacagaaatgcaaatcaaaaccacaatgagataccatctcacatcatttagaatggcgagcattaaaaagtcaggaatcaacagatgctggagaggatgtggggaaaataggaatgcttttacagtgttggtaggagtgtaaattagttcaaccattgtggaacacagtgtggcaactcctcaaggatctagaactagaaataccatttgactcagccatcccattactgggtatacacctaaaagattataaatcattctactataaagacacatacacacatatgtttactgcagcattgttcacaatagcaaagacttggaaccaacccaaatgcacatcaaatgatagactgaataaagaaaatgtggtacatatacaccatggaatactatgcagccataaaaatggatgagtttatgtccttttcagggacatggatgaaactggaaaccatcattctcagcaaagtaacacaagaagagaaaaccaaacaccacatattctcactcataagtgggagttgaacaataagaacacatggacacagggaggggaacatcacacactggggcctgtcagggggtgatggactaggggagggatagcattaggagaaatacctaatgtaaatgacgagttgatggatgcagcaaaccaacatggcacatgtatacttatgtaacaaacctgcatgttgtgcacatgtaccccagaacttaaagtataataataaaaaataaaaataaaaaaatttaaaaagaaattatggatataaatcgcaggacataaagattcaacataatcggcatacttgacaaaaataagtggaacagaagttacttagcaataaaagtaaactttcctaactcctacaactcaaaatcaaaaacaacaaaccaacaaacaacttaaaaattgggcaaaagacttgagtagacacttctacaaaaatgtatatacacatacacacacacacacacacacacacacacacacacacggccaaacatgaagagatgctcaacatcactaatcatcagtaaaatgcaaatgcaaatcaaaatagtaagataacatctgacacccattaagatagccattatcaaaaaaagaaaagaagtattagcaaggatgtgaacaaactggaacccagcactgctggtgggaccaaaaatggtacaatcactatggaaaacagtatagaggttcctcaaaaaaattaaaataggattaccatatgatttagcaatcccacctctgggtatatatccaaaataactgttaatgatctttcaaagagatatttgtatacccatgtttgtagcagcactatctacaagagccaagaggtagaagcaacccaagttttcaacaacagatgaacagacataaactaaattggtatatacatacaatggcttatcatccagccttcaaaaggatattctggcatatgctatgacatggatgaaccctgaagacattatgctaagtgaaataagccagtcaaaaaaggacaaatactccacatatataaggtagctaatagtcaaattaatagagacaaagtacagtagtacttgccagggactgggggagagggatgaatgagaaattgctgtgtaatgggtacggggtttcagttttacaagacgaaaagagttctggagattggttgcacaacagtctgaatatacttaacactactgaactgtacatttaaatggttaagagggtaaattttatgttatgtgtattttaccataatttaaaaaagtgtgacaaattccaggaaaactatgaagtaaatgataagtgcaaaacaggtttaagttaataagctttaaaaattaaaagaaatcccattaaaaaaatcaaatggggaaaataaatcaaatcataatgggaaaaaaatgggctggacacagccattaacctcaccccaacaaataagatgaaggaataaatttcaagattttgtcagaaatatggaacgactcaaaaattctacagccaatcaagcctttgtttacctgcaataacaaaaacaagccacttttaatatttttatttttaatttttgtgggtacatagtaggtgtatatatttgtggggtatatgggatattctgatgcaggcatgcaatatgtaatagtcacatcatggtaaatgggtacgcatcacctcaagcacttatcctttctttgtgttacaaacaatccaataatccaactatactcttttaactattataaaatgtacaataaatttaccctgttatgctaccaaatactagatcttattcattctatttaactatatttctgtacccattaaccaacccaccttcctagcccctcgtaactatccttctattctctgtctccatatgttcaattaatttttttagttcctacaaataagaacatgcaaagtttatctgtgactagcttacttcacttaacacagtgacctccagttccatccatgttgttgcaaatgacaagatcttattccttttctggctgaataatactccattgtgtataagtaccacattttctttatccatttttctgttaatggacacttaggctgcttccaaatcttggctattgtgaacagtgctgcaataaacatgagagtgaagatacctcttcaatatgctgattttctttcttttgggtatatacttagcagtgagattgctggatcatatggtataattaagatatatttctccctgaaaaatttgttcaaacacataatacaactactcatatgacaaatcaaaataatgtgctcaggaaacctttggcaagagcagcttgtcaatccagataagcacagaatacctgtgatagtaacggtgacaaaaaaaaaagaatgcagttttaactaataggaaaaaaaaaaagctatacagttgaaatacgtgtaactaataagctaagatgaaaactccagaaaatcacaagaaaaaggagaacattcttcaccttttgagaaaggagccaatcaatactgtttcatttctaaagttgataaaatcagaatttccgttttaaagaatcaaaaagaaaaaggaaaggggaaaacaggatgacagagacatggccatgctaaactttttatctgggttacttatccctaccactgactctacccccttcactgacagtgaagcaaatggttcagctgggatgaaggaggctatgggttcatttgcttcacatgcagattcagaacaaagaaatcagaaatgcatttgagaaaccaaatgactaccttatgttttgttttaaaataccatcgccacctgtggctacaggctgctttcctctctctgtggctactttcctctcttcctcaaagtgtcagccctaagatcttgcttcagtgtactcacaggatacaatatatttcatgttcataaatccttttccacaaataagatcagtcttttcatttgcttctccagcttttcaattagatcttttattttcaaattggtctaaaagtctatcattttttctacagggcacagagctaacgcattccaaggaagaaatacaactagcccatcctgcgcacactgactgcagagagagaaacacaattaacacaattgcgcctttttacatgtattttatcaggtcatgatgggccaggtcaggtattctagaagctggagaaactggccaaaacttatataagtaaacactgtcttaatttcaaagactgtattcccagctgtatagttttcactttagaagtggtcctgatggagaggaatgctatcctgacacttaccaaaataaccaagaattgtaaaattcaaattatggagattactatcttagaataagtgtcactatgaaggcaaaggatatattggccaaactgtttagcctcaaggtcaagctagtttgtgttacaatgcttagaaaatgggagaaaatctctacttagaagtagtaaatcaggaaaggcctggaactacagatttctgagttggagaaaattgagctcaagggagtgtgatcactcatgaagacagagagcaagaagagaaggaatgagatctacattttaaggggaaatgaggaggattccacaaagaagactgaaaaaaatcctcttgaaaagtagaactctactctgggtaagagacagacttcattctgccctgtttctttccagagtcatctaaactcttgatcttctttgtgtgtgcatgccatgaccctcagccatttgcatagggacctagagcaatgcagatataaatttgaattaggatttccacttacaggagaagcaccctatagggtggatacatttctactgagggcgccactgtgccaagctggggtgttttcagtccgtagttttcagaacaaggacaattacaacctctataaccaagcttcgggcaggctagactcttccaaccacagatgagtcttgaaaaatatttcattctaagagtaagtgcatgtttctaacatgagaagtaattttcagccaagtatggtggctcatgcctgtaattccagcactttgagaggccaaggccggaggattgcttgagcccaggagtttgagaccagccagggcaatatagtgaaactctgtctccacaaaaattaaaaataaaacaaaaatttaaaaagttaactattctaaaaaaaaaaagtaattcccaaatggcctaaaatagaaggaatgtgaatatatgaagtgaagggaagaaaattagggaagaaaagagaccaatgggggtggaaacaaagtgtcgaaatagctagtcagaatatagaagtctgtggctgtggtaagtaaagtgattcagccctgaataacagtgttcaacagcagagagttctcttaacagagacatcttccattatttaaggtttcaagtagcttaaaattcaagcacctttgggagaatgaatcaaaatcaatactgagtgcttgaatgattgtgatttaaaactgcctcaacataagaaagttatccttgaaagatggttttctgatgtgtttgtatacaaagtaggaaaataggcgctcaaatgtatttctggtataggtgaaactgttgtaacctttctggaatgctaatattagggaaatgtgtgtatatgcatggtttccatcaagatcctaaaaagtgtgctgaatcagaaggcatgtaactccaccactaggaatttatactatgggaaaaatataaaggacaaagaatttgctacaaggatgcttaatgcaatatcatgtatgataggataattttaggaacaatgtaagcatccagtaatacagtacttggcaaccttgttattaaaactacatttacatgcaattcaactattatatatctattcaattattatgtttattctatataatatattgcatatataataggtattatattcaattgtataatacatatgtttatataatatatatgtttatataatatttcaactcccaataatttcatctccagtgccaccaataacactccctactccctggccccctactcacgaaattattctttaaaaacttcagtctccaaatttggggggagactgatttgagtaataaaactccagtcacccattcagctggctctacatgaattaaactctttcgctattgcaagtctcctgtcttgataaatcagttccacctggggagtaggtaaggagaacccattgggcagttacaccacagacagccctgtggaacctacatgtatatatatatatatatataaagttggccctccatacctgtggggttcgcataccatgaatactatatttctgatctgcatttggttggaaaaaaatatgcatataaatggatctgcattgttcgtgggtcaactgtacacgtaactggagtccccaaagcaaaaagggagagtgaaaaaacaaggctaaaaataaacactataaacccacagactcaacaagctcaatgaagcatgagcacaggaaacaaagaaaaatgcacaatcaaatttacaaaaccataacaataaaatctttaaagttactggattaaagaaaaaaaaagacacctagagaggaacaaggataagaatgacagcagatttctcatcagaaacaatccaagcaaaaagacaggtgatcaacatctttaaaataatgggaagtgggggaactatcaatctagaactttatacacattaaaaaatgttcagaggtgaaagtaaaataaaaacattttcaaacatacaaaaggtgaaagaattcatcataagcagacgttggaccataagaaatgttaaaaagaagttcatcagacagaaagaaaattataccacatgaaaatatggatcctcataaagaaatgaaggataccaaaaatattaatagtaataacatggataaatataaaaaccattttattatataagtatctgaaaaatataattgaaaacaactcatagaaagaaaaatatttgcaaatcataagggacttgtatccagaataaagaactcctgcaattcaataatgaagagacaagctaattttaaaatgattaaatatctgaatagatatttttctaagaaaacagacaaatggctaacaagaatatgaaaagacactggatatcctttagccattagggaaacaaaagccaaattcacacttcataactactaggatggctataatttaaaagacataataacaagtgttggttaagaatgtggagaaattggaacccttatacattgctggtgggaatataaaaggtgcagccactgtgaaaatctggtagttcctcaaaatattaaatagcattttcatatgatccagcaattccactcctaagtatatgcccaaaagaactgaaaatatatatccacacaaaaacttctccaagaatattcatagaagcattacagaatcatcaaaaagtagaaataatccaaatgtctatcaactgttgaaaggataaagttaaatatggtatttttaaacaatggaatattattgagcagcaacaaaaaaagaaagaaagatacatactacaacatgcagtattgtgcatttttttctaagtgaaaagccaatcaaaaaaggccacaaatctataagcctgtttacatgaaatgtccaagataggtaaatctatgagaaagaaagtagattcgtgtttttcaggagtttggaagaggataaatagggagtgattgaaaacaaatatgaggtttctcttggaatgataaacattttctgagcttgattggagtgatgattgcacattatctatctatctatctggagacaaggactggctctgttgcccaggctggccttaaactcctgtgctcaagtgatcctgtctctgcctcctgaatagctgggaatacaggcacatgccactgctgcagaactcttaatatatcaaaaactattgaattttaaatggctggcttttatggtattaaattatacctcaataaagttgttctaaaaagataatgaaaataacaatagagtttattacaaaagttttaaaaagcaggggagtaaagtaagtatactgtattgttgtgaggttcttgtactatacataaaggggtacgatgtcacttaaaagttgcctacaataaattaaagcctactgcacacactgaatcaaccactaaaaataaaataaagaattatggctaacaatccaacaagaagataaaatgaaatcataaagtataccaaatccaaaaaatagaacaaatgtgacaatagacaaaagcaagatgatagatttaaacataaccatatgaaaacacatatatatacactcattaaatgtaagtggtctaaacaactcaattaaaaggcatagattatgagactggataaaaaagcaagacacaactatatgctccctacatgaaccatactttaaacatgaagacacaaatagattaaaagtaaaaggataaaaaaacgaaatacccagctaacactaaacaaaacaaagctgaagtatcaatattaaaatctaacagagtagattagtagattttagagcaaaacatattagcagggattttaaaaaaaaaggttatttcataatgatagagtctctttatcaagatgacataacaatcctaaaagtgtatgcatctaattacagatttttgaaacatacgaagtaaaaacgagtaactggataaataaacaaatccacaaatatagccagagataaatatgcctcagtcattaattgacagaacagaaaaaatcagtaaggatataagagacatgaacaatacaagtagtcaacttgatctaatttgacattttgaaaagactcaacccaacaccagactacacattcctctcaagaacaaaagaaatctgtaccaatatagaccatattctgggccataaaacaagtctcaataaatgtaaaagaatttgagtcataaaaagtctgttctctgaccacacttaaattatcaataacagaatgatctctggaaaatcatcaaatgctggaaactaagtaatgtatctgtatataccttataaatcaaagaagtcaaaggaggtaattaaaaaatcttttgaattgaatattttgaactaaatgaagaggaaaacaaaacatatcaaaatttgtgggatgtcactaaaccagtgccaaagaggaaaaccatagcattaaacacctataatagaaaagaagaaaagtctcaaataaatgacctcatcttttaccatcaaaaactagaaaaggataatttaattaaaatcaaagtaagcaggaaaaaataaaatagtagataattatatagaaactataaaacaaatccaaaagatgtttctttaagaacatcaatacaattgctaacgctctaaccagattagtcgagaaaaaaggtgagaagatataaatgactaataataaaattgaaagaggggtcattactattgtccctgtcagagacattaaaagtataataaatgattaagacagtgtagtatagcattttctccacttttaaatatgaagtcacaattttaaaatcatggtggaactattagatatccataagcaaaaatataaactgaaaaaaccaactgattcatacctcataccatatacaaaaattaactgaaaagggtcataaacctaaatataaaacttagaaccataaaacttctagaggaaaacataagagaaaatcattgtgtactttgcgtaagcaaagtttccttagataagatacctgtgagccaaagtaacaaatgtaagaagacatatttgctcatttctgcttgtcaacatactttcccaaagcccctgactctgtgacaacgtgtagctctccagaaacgtgcattgaagacaaaacagaatagagaacagggcctcccaccctccagctcttgcctgagtcactgtattccttaaaagataaatggccctagtccttgccttttcctacacataagagaacacctgacagggttagtgattacacttctgtaatctataactagatagactcttgcacccaaactttgatgtgattttatatgcactgaacctgtatataaactgtgagctgaaacactattttggagcagtctgatagaatctttctggtttgttttgttgttgttgttgttgttgttgttgttgttgttgttgttgttttttgggacagtttcactcttgttgcccaggctggagtgcaatggcacgatcttggctcactgcaacctccgcctcccaggttcgagcaattctcctgcctcagcctcccaagtagctgggattacaggtatgtgccatttgtatttttagtagagatggggtttctccatgttggtcaggctggtctcaaactcctgacctcaggtgatccgcccacctcggcctcccaaagtgctgggattacaggcgtgagccaccactcctggccaacagaacctttctgaaagactcctcccaggctgtagtcctcagtcagtctatagctctcagtaagacttctggataaaactaacttaaattctttaaaagcttgtttttttttttctttagtcaaaatatcaaaagcaggatctataaagaacaaacagaaaaactgaacttcatttaaatttactttttaaaagacattgttaaataaattaaatggcaagccacaaactgagagaaaatactttcaaagtatatgtccataaggaacttgtatccaaagcatataagaaatttcaaaattcaaaaaggggcaaaagattgggacagtttaccaaagataatatacggatggcagataagcatagaagagcaattaggaaaaatgcaaattaaaaccacaatgaaacaccactacatgactattagaatggataaaattgaaaaaaccaaccataccaagtgtcagtgaggatttaaagaagctgcaactctcacacactgatgtgggaatgtaagatagaatcagtctggaaaataatctgacagtttctttaaaagttaattatccagttctgccatttaactcctaggtatttacccaagagaaaataaagtagttgtctatacaaagacttgagcacaaatgcttctagtagttttatctgtaaatagccaaaaactggaaacagctcaaatgtccattcataaatgaatggacaaattgttatgtatccataaaacagaagactacccagcaataaaaacaaatgaactactggtatgtataatactatctatcactctcaaaataagccgagtaaaataaaccagacaaaacacaacacttactgtatgattccattatataaaactgtagaaaatgcaaactaatttatagtgaccaaaagcaattaagtggttgcctgggagtataagagcagaatgacatgagggaaggatttcaaacaacaggagaaaagctgaggagtgttggatatgttcaccatcttcattgcagtgataatttcgagagtatatgcatacgtcaaaacaaatcaaattgtatactttaaatatatgtagtctatgttatcaatgaaaaaattaaaagaaagcataagtcttaaagaaaaacgctattttacaactttttaaaatgtaatatttaaagaacattctccttaaatggaaaactctggcatacaagaaaatatgaccactaaccacaaactaatttttttttaatatactttaagttctagggtacatgtgcaccacgtgcaggtttgttacataggtatacatgtgctatgttggtttgctgcacccatcaacttgtcatttacattaggtatttctcctaatgctatcccttccccagcccctcacccaccaacaggcccctggtgtgtgatgttcccctgcctgtgtccatgtgttctcataccacaaactaatttttaaaaattattatggaatagtttttaagttttttcctggcttttatacccttgatctcttgattataggctgtttattgtgtagaatgttcctcagtggctccaagggcagcccaacgcagagtgtcagagtctaagtgaggtgaagaggatgtccccatgggaaggtagcccagagtttgtgtcaaagcctgaaaggtgaggggtcaaccaggagagaaagaaagaggtaatccaggagagaaggagagaggttttcaatagaaatagaaataaaaacagttatcaatgtgtgtgttgcacagtgagaagcctgggaatagtgatatcccaataacaatgagcacacctaacacttacatcttcgtctcttaataccattctctacagaaaggtgccaggctccttggagatatgcctgttcctcagattagggaaatacatgatgccttggttaccttgagcagacagttaagacagcacttaaaagaattatgcagacatgtaaaaaggacaaggaaactagtttgaaaggtactcactggtctaattatttctaagtttgaaaatgaaaaaggaatccgtaagttcattttaatacaaataaaagtttgaccaaaaaattgatatttacaaagactcaaacacttccctagaaaatacttaccataaagtgcaaaataataactgtacagtaaataagtctggaagacatcactttaatcaagtgatcaaaataacatcaccaataatggagcaaatcaacagtgtgtgccacctgacaaaatgcaatgagaatatcacttctgtcatgttcctgccaaaagtttgaaatctgaatttaatcaacaggaaacatgtaacaaacccactgaggaacattctacacaatgaacagcctataatcaagagatcaagggtataaaagccaagaaaaaagttagaaactattccataataaagtagacttagaaaagacctaattataaatacagtgcaagatgatgagctggatccttcactatcaaggatattgttgtgacaatatgggaaaatttcaatgggatctgataattagatgatagtaagataatagggtgaatttactgatttcagtggttgctttgtgactatgttgaagaatgtgcttgtttgtgagaaaaacagagtatttgaagatgttagcgcatcagtgtaaacaattcactcttaattgacttagggagataaaagcttcttcacacttttttactgtacttgcaacttttctataagtttgagggaggcagagtagaggaggaggagaggaaggagcagggatagaaggagaagcagtcatcttacataaaataattttaagtggaagagagggttcatgtgtcactactaaccataagaatagacatccccaagatctggctaaaagtgactgttacaaagtacatgactaccccagacacatatgtgcctgattttagagaagacaggaaaagatgtctcaaacaaatcacaaactctaagaggcacgttgccaaaagtcaaataggtcttctgaaaaaggagaagtctagaccacagtcaacagcgcaggcagcatcgtaccaccaagtttagctgtgttttcaaaaaagctaaagaaatatcatagtattagaaagacacatttatgttaaacacaaaacaaagacaaaggcagatgctccagcaatgtggccctaagtacttctgtttccaggatacatgtcacatgagaaatgtgacgaggtaccatgttctttgaagatggtacattatgaaatttcttctgcctaccagtgagactaatctcttccagatgttgtttggcccacaatgtgctattcaaatatatgaaagttttgtttattttcaaagtttgagagccaaataagaaacccagtttccttcaccagcctctaattaaactggagataaaagcttaaaaaaaatcagtatataacctaagtctagacttatacatcctgcctgaagttttgaggtggggagggggaagaaaataagacctgtggaatacaatcctaatatctacttcagcatgggaaaaataatgagacgcttaatttcatttcctttcctgctcccagcatattaccattcttcctcattgaaaaccctcttggcaatacctctctaaaacagtaaatatagaggggaatctaaagaaaactagtattgtactagaggatgaattattcccagctgggtcgaggatatgtaaatactctggcttcctgagaagtcacatacgtgattttaccaacttgagggagcaccaagaaagagctggcctcattctttgatatacaattctatgaatagcatctcaaatgttaccactctgttgaagaaatcaggaagtgaagcaaagggaattaagtgacttttctctgttcacaatgatttagtaactatgaaaatcaccaaaaaaggggggtcccctctctaacttatgtgagtggttaactcctgttttcctgttatgaaagggtttaaaatataatagcggacacttttaaaaataatggctgaagtcttttatcaggaaagcagtagaaaatggaagggaaaaggagcctcttttttaataaactatgaggagatagtaaaaccacaaagtagccacaaagcccctatgtctgagacatgacctaaaaaccaaccggagacctaaaaacagctgtgaggccccacttgaaagacttctatctgctaatgggcctgaaagatgctgtcctacatgtccagaaaaacacagtgggatagtccaaatatgtagagaatggagaatatcacacagaaaacttctaactagtgtgaaaagggatttgatgaccactccaaaaaagagataaggcattatgacattagaaagggaattctgggctgggtgtggtggctcaagcctgtaactccaacactctccgaggccaaggcaggacaatcacttgagaccaggggttcgagaccagcctggccaacatagcaagatgccatctctacttaaaaaataataataaatataaaaatattttttaaaggaaaggaattctgatacaaaaggagtccgcttacaaaaaaataagttttactaaactgatattccctaaaaaatctgggagaagaagaaacaaccagactcagtggctgtgggtgcgacctgaccaagaatttcctggggcttgagaaggaagcgtgtgccaaagggctgaggttacagcgactgttgttttaagccaagtcatagcgataaaatgagcaggtggcaagtctctaaatcttttgtattcccagatttccccattttacagtaatacagtgctgggggcaagggataaaatgtgatgtgttcagccaattgcagagaagcggctccaagggtataattttagatttctaaaaggccacctctccaaagaactaccccagtttcttttggtggtagcgatggaggtaactgaagtgacatacaaggacccttccccttctggggtctgatggtctcgttacagagactgatctctgatctaagttacatgaactcctcctctcagctggaattcatagcaccacactgatttcttttggccccaagcccaaattgcagctgtttgtacttattcgtggtatggtgtattttgaaacaaaatgaaccagatttttcctactgcctatgtcagtgcctggtattgggaaacattaactctttcacagtgaggctaccaacaattgtattgtgtctatgaaaggaaggatgatataaagaagacactgaccccaagctgggaaagagtcaatcaagaagcccatttcaaagcaaagggcagatattccatcatttacttagttttggggccccatctacttccaaataagtttcagataggttacagaagattataaagaacaagagtcatggattaaagtaagcaagggaaataggtatttcaaaactgagtgcaaaattttactctgagctctctggtaaccaaagcaaaagggaaaatgaagagttgcgtattaactattgagagagagagatgttattttcttctactaattcctagtaagagttatcaaatggtataaaatatacaaaaatattaatatggctatttcttctcctatcaactctcaatgaaagctgaagataaaaataaatggttcttggatggtatagcacccatgaaacttaaacacaaaacaaaaccagacttttaacagagttttttatttagtagaaactagacatctgtattttttaagtctccttaattctgaagcgtatgtctgattacatgccattatcttaaatcagagttcttcacagatacttggactagaacaaacgtattatattctacatttattgctagtaagtgatctaatatgatataaggtgagcagagcaagctttactgcagaatatagtaacactgagtcctgtgtcttctccaaagctggtgcataagatgctgtgcgagagagaaccaagaatctgtattttaacaagcacccaaagtgggtctaggttgaaagctaggtgtgttaactactgcattacaccagtggttctcaaattgtaatatgtggcacacagaattcactggagggcttgttcaaacacagatgtatgagccccaccccactgcatgtctgattcagtaggtctggggtggatccaagaatttgcatttattaacaaatctccaagtgatgctggtgctgctcatggggccacactttaagaaccactcactaaactgtccatttaaaaaatcagtggcctcacatggcctttaatagaactggaaataataatttaaaataatacataattcaagactaaagtctctgataagtgtctgaagtgttcagtattgttgattagaaaaagttttaagtgcttttaatacctggcagaaaaggcaaatttggaattttattaaataaataaataaattggactttcatccaaactgaaggtcattccacctggtcaattataaggactgccagaaatattgtttcaggagagaacttttgaattattcaataaagactgtaactgaaacaccgtggaccagtgcaaaaaagaactgagggcaggtgttaccatttataaatcctggacattaaaaatacacacacatgtttaatgaaactcctaagagcatgttaagtttgagaacttcatcccggcaagcgtctacaacaataagggagctgcaattgtaccttcacattatatgacttgatctgtagcataaagctattagtgtaatccatctgaatctgaattttggagggtgtcgcccaaggcaacagatttagttttgacaaagtcaatagcaagttcttcttaaagaaaagaactggacaataggtctgaggattcttaaattcattttctgttcatgagcataagatcacaccatagctctaccggaaaggcaatatctaatgcatagatagatttcttaagttatcaaatcatagattcaaaagaaggcataaggatgtggacacaggtgggttttatatcatttggaaatggaacttgatctgtcaaaagataactcctatatactatgttattctctggatggctgtatcaatcctcttaggaaacattaaagtttaaaatcttcgtgatcagtcagctcaacccagagacattttattaagatcaaaagctgtagtgaaattaatatatcccgcacatggtcataaagtgacttctgaataaagatgatgtcagccccaactccccaatatgtccacacccaatttccagtcaaaatacaaatgaagacaaaaactcaaaatagctctgaaaccaagaataacaaccagccatttataagaacctgggagtaatatctattaagtacagtgcagatggaactgaattaaaagcaactggtgtccaacgaatgctttaattgctaaaaaagaacagctagaaataaattagaaggttcagacctcccccaccctacctcattttccagaacactggaatgagcaggaatgagtagcagcagcatccccacaccatgcagccctgctttctaaaacaaccagacagctatccacttgtcttagtcagttcaggctgctatgaaagctaccacagactgggtggcttaaacaacaaacatttctttcttacagatctgaaggctggaagtcgaagaccagggtgacaacaaagttgggctctgatgaggcctcttcggggttgtggtctgcgatcttctcaatttagcctcataagtggaaacagggctagagagctcttctggggtcacatttatgaaactcctaagagcatgttaggacagggtcttgctgtcacccaggctggagtggcgcgatctacctcactatagacttaaactcctaggctcaagtgattctgccacctaagcctcccaagaagctgaaactacacgcacacgccaccacaccaggctaattttttaaaatatttattaatagtagacacagggtcttgctgtgttgcccaggttggtctcaaactcctgagctcaagcaaatcttctgcctcagcctcccagagtgctgggattacaggtgtgagtcaacacaccgactgtagggtctcttttataaggcccctaatctcattcatgagggcggagcccttatgacctaatcacctcctaataccatcgccttggggactgagatttcaacatatgaatttcagggagacacattcttcagtccataacactgctattctccctttctcttacccctttcagaagctctgtacaaagaagttttttcataaatcagcaagcacaataaacaatctactggttggttcatggcctcctgaatatgggagaacagtagtccagttctaaaaagagctgggtacaagaattctaacatgaaaaatttccttgtcactagccaaatctcttagtattgacttgtgactagggaaacaacaggctccactttgatcgggtgacttcttaggggcatggggccagggttttctcctgtttcagcagtcagggtccagagcctccagaggtagtcaccaggatcacccttgtcaatggtgccagctgctcacttgcacaaaggcatcaggctaaaaggagagccatggctgcaatccagcaaggactgctctactcccccagccacgtgcctcagtgtgagctgtgctagcccaaaagaataagccttctgaaaccaggcaggaacctgtgcagctagtaaatggggcatggttagaactccaaagtctaggcccacactgtccaatatgatagttgctctcctacgtgcacagtgcagaaatacattttccattatcacaaaaatctgttggacaatgctggaatactgtccacaaaaattacgaagtggaaggaagctttgccacttttccattaaaatggaaatactcttattctctcctacaaaatacagtctccagagaggtcggtcattttggagtcagaattaaatctaactaaatgcctctaaaacaatgaaaaccttaagacagctggtacactaagctcataataaccccttttgttcactgcatgtttcctatgttttaatatgctaaaatcaaacacatggaaatgctgagctgttttaaataatactcctcaaaaaggaatagggttctctttagaagcattttcttcaatatcaggaataacaagaatctcactattactcctactattcaacacagttctagacagcctagttaattcaatgaaacaagacaacaataaataacatgtaaggagtgaaagagtcaaaactgcccttatttgcaatcaaaatgattatttaaattcaaagtccaaggaagtctatagataaacctgctcctaaatttccagtgaaatgctaaggaccaaaatagccaagacaaattaagagaatagaagtagaggacttgacctaccaatgagtaagacatattaaaagccatgtaatgaaggtaatgtgacaattgttccaggctagacattcagaggtacacaaagtttcaaaacagtcttacataaatgatacacatgacattacagtggggacataaagggactggaaaaaaaaatggttctaaggcaaaaggaaaaatatacctaatcagacaccccaacttcatatcatacatagaactaacatccagatggactaaaggcctgaacataatttgactggcctaggggaactccagcatcatgctggtctcttatttccttttagcttcatttctgaacccttctactgttattctgtgctaacaatctaatgtagggaaagctgcctctatttcctgaaataatacagaaacaagaagttaaaaagaccgtgcttgaagatctcttttatacctaaaactaaccactggcttccttcccctccaaagaaagtcatgtaatgttcctgattcagcagacagattaaaagctcaattagaattctatttttaaaaataatacatacagcttctgaaagaacatataagatgccaactaatcaataccctggataaaaacttccaaaatgactaataaataccctggataggaacttccatataaaaattcatataaatgtagccaacaaatgcagaacaagatttagcttttaacatatgctaaccttctttggaaattaaatattttacctggaaataacagtggttttttaaagttctatcttcagactttctccttggtttatagctctttttactttatataacacttacatgtttcagctgattaataacaactacgcaggaacattcaattccagaggcaattttaatgtagtcattgataaaatacaagctatcataataaaactgtttaatttacttaaaaaaggaatgcagttctaatcacatattcatctgttatacttttcttgtaaatttcccttcggaaaccaattttaaacttctaaaccacctcaatctgcacacttaacagtaaatcacggtaatatgtgtatgtattctagctctcttgaggcaaaacaagcatttaattttaacagacactactcatggggtgccaaagttaatcacacaaaaccagaagtatggctcaatgtgggaacatatttctgaatgaacttatcattaaagatagaaaaagtgtcccagaatgtaaactaataatgggaggtaatgaggatgaacacagtgcaatattcattgctgtttgagagctgaataggtaggtattctcttattcctaatcgaaattaagataaaccaagggacctaaaactccagagataggatttttcctgctaaggctaatggaacaaagcaattaacaactttcagtaaaagaggaatgcaagaactatgctctagaaagatgtgtccatcaaaagtcgaaagcgctgtaggtgtaacttctctttaaaatatgaagggagccaggcatggtggctcacacttgtaatcccggcagtctgtgggcctgaggcaggagaattgcttgaggccaggagtttgagaccagcctggtccacatggtgagaccccatctctacaaaaaaaataaataaataaaatatgaagtgttggttacaagaaacctaatttgtatacccagatgagaaattctgggaatccaggcagatcatcaggagcccatttgaaatggaaatcccctgatcctgtggaatcaactgtaaattaaacagttttattatgatagtttgtattttatcaacgactacattaaaattgcctcagaattgaatgttcctgcatagctgttattaatcagctgaaatgtgtaagttttatataaagtatttaaaccacagagattcagtcacaaacagagaaggcaggattatggctgtccctatccctggagtttagtaggcaagccagaacactccacggtaagacagagtcaacacatgcaccctcgcatctcaagtaaaagcccgcaagagtgagaccagcagggtggcacacaaatctacttagaacccattctctagggacaatgaatgtaatttgcttaatagagtgaaccacaaatcaaaagagaaagggctatgttgggtgctaaaagtgttacaaacacataggcatccctgaggatgccctaaagagttttcttatttggaaggaaaatctccttctctttggggagggtaagataagtacagtgaactattatttggggatcagggactaaaaagtggtggctgcaatcacagaaagggcagtcacccatgagccaatgcagtgtggccaggtcagaagcttcctcctccaccatcccaaggagccggaccatgaaaaccaaaccattctttgtgggagttaaggggagatggtgcagccacatatcctaggaattattcccccaaacctccagctgtatctcagatttatatggctcacagaaacaaaaatataatggtaaaaataattgggctcagaattcataactcagaaataactgaatttatttgcatatgtcttggaccactattccaactaacatgtaatattcatactcttagtagtgtcaaagtcacattaactatttcaatgaagttcatcccaacaactcagacttaagaaaaactaatcattccatgagggcataatcaaggctccatccttcacccagtacacagctgccatagttctttgtgctcataaacatttgtgaaatgcatgtcttgatcctccagtgatagtcaccgtcaccaattttggctaacaatgactttgcaagatatctctcccattcatcctagtcttcaattggccacatcttgttttgcactgcagtttacttcattcaattattctctcttctgtggcttcagttttgttctctcctcatttcccagtcctcagaatataaacatgctaggtttcctattcaagaaagaaaaagtactcccttgaccccaacttcttccttctctctcgttcccctaccccatcctcccttttcaaggcccaggatactgaagaaactgtgcttattgcttttacatttttatatgatgaaccatggcttcctccaccccaactcaaaaccttaagatcactgacctctaaaaaggttctttctctgtcctcatcttacttgaccctctgttggcattttgcatcattaatcactcgttttaattttgccctactcacaacaccatgctcccttgattcttatccaactttgtgatagccttttctcaagcttctttgcaggatcctcttcctctgatgactaggaaatgttggcttacccccaagctctgtacttggccctttcctattctacttctgcttactctccttaggccatcttatccataccaatcaattccacagacacttatagtctggtgatacttaattatgcatcccattccagaatgtagtccaacattccaacttaatagattcaaatccattcttggttgagcacggtggctcatgcctgtaatctcagcattttgggaggctaaagtgggaggatcacttgagcccatgaatttgagacaagcctgggcaacaaagtgagaccccatctctacaaaaaacaaacaaacatagctgggtgtgatggcgtgtgcctgtggttccaggtactcaaaaggctaaagcgcaagcattggttgagcccaagaggtcgaagctgcagttagccatgattacaacactgtactctagcctgggtgacaaagtctcaaaaaaaaaaaaaaaaaaaaaaaagttctctagctctaatctcatttcatttctctctgtctctctccaatttaacctcctgcaatgatctaacaaaattgtggaaatcctttcaattgttaagaattgggagggaggtgggccaggcgtgacggctcatgcctgtaatcccagcactgtaggaggcccaggtaggtggatcacttgagctcaggagaccagcctgggcaacatggtgaaaaaaattagctgggtgtggtggtgtgtgactgtgtagtcccagctactcgggaggctgaggtgagagaattacctgagcccaggaggtggaggttgcagtatactgtgatggcaccactgtactccagcctgagcaacgagtgagaccctgtctcaaaaaaaaaaaaaaaaaaaaaaaaaaaaaaagaagaattgggaaggaggaagcaaacttcagattcctttgtacattccccaagacctcccctgatccagcctctgcctcatccactagcaagtcttaacattatttaccaacaaaactacctggagttcctagaaaacatcatgttacttcatgccttccatattctgttttcacaattaaaatgccttcttccactgcctatccacaaggtgaactccctttatctttcaatcttccaatgtccagctgatgtctcaggagtctccttaatcactgccacacacacatcatcagcagtgtgttggtgtgccctgctatatgccatcacctctgtaccttgcacataagtcataacattcatcacactaaaccctattcagttatgagacaactgctggactttgagcttcctgaggataaagccagcactataattatttttttatcctaatgctcagtgtgcctggcaatatagacagtgctcaataaagggtaattgaacaataaaaggaggaattaatgaaggcatatagccactagaaatgaaaaatgaactgaagaattggtttgcccaaaagcacaagtattctaacacaactatttcctgtcaaatgattttcttcattcatgcatgcatgcaaaaggctgtacacaagacacaaagtgctggtaatataatcttcccagctttctcaagtcactgaaaatcctgatgatgcaagagccttcctagtcaatcccacacattccattcccaatggccattaggaagaaaaagaaacatacaaaatgttggggaaatgatccctaaaggttaagcattataattaactttctgtcttggcacatcctttaacttattccttcttccttaacacacgcacctgcttgttccatcatgaatttggagttcaccattgcctgtgcaaacatctatattaccaattccatgccatggtaattacatattcaaaagttacagactcaacacacaaaaaaaatcccaaataatttgggttgatccaaatcacacctccaaataggtacacaggcaagccaactcaaataaattcacaggggtataaggtataaatctttatagcacataaacaaatgtttatgcattagaattgagtatgaaaaataaagccttaagagatctagaagaaaatacagtagaatgtttatatagtcacagattgagaggaggctattttagcataaggccaaagaaaagactgataaaggtaactacctaaaatagtttggatatttgtctccaaccaaatctcacattgaaatgtaatccccagtgttatacctggggcctgatgggaggtgtttggatcatggggacagatccctcatgaatggttctggaacattctcttggtggtaagtgatctgagttctctcaagatattgtcatttaaaagtatgtgtcacctcaccccaactaactcactccttctctccctttctctctctctttcagtggtgcttgtttgctcctgttttcaccacatgaggtgcctcctcccccttcacctactgccatgactgtaaattttgtgaggcctccccagaagccgagcagatgccagcaccatgcttcctgtagagcccgcagaattgtgagccaattaaatttcttttctttataaattacccagtcttaggtatttctttacagcagtataaaaatggcctaatgcactacctaaacattcaaagcttcattatattaaacaaatgcatatttgaaaaaatgctttatatcacatcataaactgttaacattcttaaagtttaaaaacgaaaattatatgtattaaatatatagcttaaacaagtaaatttttagatgagcatcccaatagaaaaatggttgataaacatccacaagaaatttatgaaatacaaatgatcgatgagcataagaaaaaattgtgcctaacttaaagtgattaaataatctaattttaaaaataaaatgccattgcccccaacacattgataatctttctaaatttataatattcagtttaatgaagttgctgcactttcgagcactgtgatcaggggtttcagtatggaaaaatctcatcctgtccctgaaggatgattttggcaatatgtatcaaaagccagacaaacacaccctttgacctagcaatcctacttcaagatgtttatcattggaaaagaaacagcaatctgtgctaacatacctattgaagacaatcattacaaaactatatccgggaaattgaaagcaaccctaaggtttcgagaagtggtattaatttaagatgccgagcgcggtggctcacacctgtaatcccagcattttgggaggccaaggcaggcagatcacctgaggtcaggagttcaagaccagcatggccaacatggtgaaaccccatctctactaaaaatacaaaaattagctcggtgtggtcgtgggcacctgtaatcccagctactcggtaggctaagacaggagaatcacttgaacctgggaggtggaggttgcagtgagccaagattgtgccactgcactccaacctgggcaatagaacaagactccatctcaaaaaaaaaaaatcttattaataacaatatatttgaaggacaaaatatgtcctgctattttaaaagtcacactatagacgtcttttcccagaatactaagagcaaaatacagtgaaaactcttctagcacaaaaacatgtaaaactgctgtgtgtgtatgcatacataagcacacacctccacctctgtaaatgtttacccaagttggcaaaagtcatgaatctcccaagaagcaaaagtaatcaagaaatcaactcggaaaagaaaaaaataacaataataaactagggagtctgtcagccgattatatcccaataatcccaggtgaccttgagttttggcttttaaaagcagaaatcaagtgaaaaatggaagtcagatcaaagacctctgcaaaaagctgggacatcctacccttaacagctgaactaatagaaaaaatactgacccaagtcacacagggagagggtcagaaaatgtgactgtctcacacatggatctacatggatctaggtaggaaagagtcgcccctgagaatttatatccggacacttgcccttaataaactggggatgacctgaattcctactgctggtgtagccacccaaaaacctcaagctaataattcaacctgatgtggacatgggttgagagtgcctttaatgcatcaaacagaagaaaacacaaattctttctgaactgattcaccttaagctctcaaagaattcccagagaaaaagttcctagaaacatgagcttacattgggagaatggggagtggggtgggatcgcaaagcacatacagaaacaagtcaacatttacaagagtcatcaaaaagaacaaacagtcgaagcagacttacaaagtctacagatactgggattatccaatacagactataaaataaaaatgtttaataagtttaaaagtaaaagaggacatattaaaggataatatattaaaaatgacttacaacttttaagaagatgtaaacagggttcctaaaataaaaatagaaacagggttcctagaaatataaaaacacagtatttcaaattagatattcagtaggtgagtaatacagctgattaagtgcaactgaagagataattagtaaagtggaccatcactacaaacgaattacacagaggcacagatgggaaatctcaaagtgaggtttagagtcaggaatgagatttaaaaaaaaaaattcataccaaaacaaattttattgagcatttattaacacaaaaatgtttgatacattcctaaatattttttaaaaagccacaaagcaatatatacttgtgtcatttttattttttgaaaagtgtggggtttacagacataagtgtacatatttggaagaattggtaaaaatgattggtttatgtttgagtggaaatatttcagtccattttttgtttacatttttatattttccaggggttctgaattatatatgaatcacttttatagtaaaaaaagttatttaaaaattaatagaaaataatactgggcatatatatatgtatttgagtatatgaagggacatataccaatactgttaacagctgctatttctagtttttcagaatttgcatgatttggatgatttttacctataatttctaatcaataattgaataaattatatgtctaaatatggaggggaaaagacttggtacttacaaacactaatagagattttattatggatgctaagttactatgatttttatattttacaaattctcatttgtttttgttgtttatatagtttacactttacatattttcatttctcatttcataattaggaaaatatatatatatatatatatatatatatatatatatatatatatatatggatacatagataggtcagttggccatagaattgtatacaaacctttgtgcaagaaaatcccactttaaaattgaaaacaaatatgcaatatatctatatatttatatacaatgttttcagagacttacaatgtgacaggaaagcactgcctttaaatgttaaaattttaaaacacagaacaaaaatacattcagctctcataaaggtcttgcagaggaataacaggcagaaattataggagaatgttaacagtggctgttcctggtgtcctagttcccttcttgcattaatatctggggagggagagaacaagagcgccagtcagagtttcttgatgttaacatacatctggcctcaattttgattcttgggaaccagagcagtggaagcaagagaccaggaaaataaggtaggggctaaaaccacctatcttaaaacatgttaaaatgtacaatcattgaggtgaattagaggcaaaaagtcaacatttactaccgcctttcaagataagggaaaaggaccagtgcaaccaagaaaagggaaaagccaataatacttagctgttgccgcctttcttaatgacataaaaacccacatcagacaattttttttggtaccctacccttgaactggaaaccacagattttaatctctaatttatttaggaataaaaattcagatcacaggcaacacacttccatgtgactttaaatgtatattattagctaatgataggaaaacctcacattgcccagttgagttcacataaaatgtcatgacttcccttctccttccagaaacagatctctgaaagcatatccctaaagaagaataccaaatattagccagaaacttaatttattctatcccacattcctctgatctttgaaaaagtgattctgcagtgctttccaaattcacagcagacataatgtatgaacatcaaatcatcaaagacagttcaagagaatgcctcacttttagaaacactacaaactaaaacttaagagcttctacacctgcaaataataaacttcaaaggcaatccaaactatcctggcatttatcatttgtgagcataagtgtatgtagtgggtgtaagtctgtgcttggttttaataatcaattgactgattatagtttaactagtcttatttcagcctcgaattcgtgtagagtgtcttaaagctattttaagtatgttgttcataaaatttatagcatctcatcattggaagaaaacttctgaggtctagttctacatcttatccaatcctttagtcactgcagaatctattctctatgtctgctggaacacttccaataacgggaagctcactaccttccaaggccagccatgagatccttggacaggcagtttgctagaaattctctctcaaatgtagttcagattatcctaactgaaaaacccatccctgggacccagctactcttttgtaaccaaactgaatcccgttctttaaacacttcaaatcttacctggccgatgaagatagagatcagattgtctgtttctttctttcctctgtctcataattctattttgcagatcctttaaaacttctttccacttttcactgagaacacgacagctgatttattctatccttcaaggatgacacctaaaacacaatatagtacccttgctggctagttctgaccagtccagaatatgatgaagcccacttgttcttaatgtttggatatgaggtgtttagagagcacattataatgaaaacaaaatgtctacagtttgataaaacagtcatttcaaattggcccaactttgaaaaatgctgctaccgtgagatggaaaataataataactaaagtccccaaatccactgtttctcaaagaacatgtggcccaccagttgtctgttaaaaatgcagagtctcagctaggcacaatggctcatgcctgttattccaacactttgagaggccaaggcagaaagatcacttgagcccaggtgttcaagaccaggctggacaacatagcgagaccctgtctctacaaaaaaatttttaaattagccaggcatggtggtgcacatctgtggtcccaactactcaggtagctgaggtaagagaattgcttgagcctaggagttcaaggctgcaatgagcagttatcatgccactgcactccagcctggacaatagagcaaaaccctgtctcaaacaaacaaacaaacaaacaaaaaatgcagagtcctggatccttcccaaattatctgaattgtgaacactgtgagcaggctgaaaactctgcatttaaatacacatctctggcatttctgatgacagtaaacagtgaaaaccaatgccttatcctatgcttgccgaattgttattgttttaacaaacacaaacacacacatgcatgtacgcacgcgcgcacacacacacacacacacacacacatacacactcagtatcctggtagtccacaaaagcagaattgaatctgggttggtctcagttgatggtaaagctaggattagaacaagaccctggtaatcacatctttcagttccagtccaagcttgtcccctaaagaagaaaacaatatctgggatgtggtaggaggatgagacagagttttaaatggggctgatggggcaaaataaagagcctaaaataaagcaattacttcattcacacttgatcctttgaggttggtggtaaaaaactaagaaactgttcaattgagagaaatatgccagaagagaggagaggaaaaggcaaggaaagagaaaggagaggaagaaggaaggaaaatttcgtttaatagtaagcgggaattcctgtgactggacaggacagaccagctggattcagcctgtaactttgtgaaaggtctagaatttcactcttaaaattttaattttcaaattttcttctgttaatgttaagctttacgtgatttagaaaatgttctcccctaaataagcaaactcgtcatgaaaatcgctgatatctgcatttgctgcaacaagaacaacaaaaaatacattcaaggattttttttaattccaggataaggatcaaatttatttcctcatagaacaagaagacactctaacaatgaaggccaaaagtgcttgtaaaatcctttttgctgttggggtcgtagttttaaaaagtacacttcattccagttctaaatacacacgcaaactacagacaaaacatcctaccacaaaactaaatctgaaaatgtccaggaccaaccaatccacaataaagaggttaaacaccaaacccaaaatggtaaatgtaataaccatgaccctcaccatgtggtaagagatgaatctaattaatgttaccttaaaaagaacttaagtaactccttcctgtcctaattgcccattataagcctcagaagccagctgtgtggtagagacaaatcagtgacattcagcaaaccatgttctgaccaaagtaccactttaccctgtgtgaactctatgaaacatgcgttaatggattccaagggcatttaaagaggctataacctgtcaaacatttacaattacaatgggatcaataaaaatgggattgttagatggcatttttcagattgctctattctgattccaaaaagaaaaagaaaaaaagggtgatcagggagccgtgacacaaaacaatgacattttgttaaatcctgaggctggaagaaaccttaaaggttatctagtaaatttccccaaccttcattccctcttgcaaacaactcaatcatcaagcaagtcattatcaagggcaatttcatcacacccaacagtctgacctctcaagttagtttctgaattgactataccacttagcccctcatcattcagaattgcctgtgacacttcaaaatccccctttatagctgaaactatgcatctatgcagctgtttgtgctcatacacattatttcagccctccaaaatacccagcctcctgctccctccattctttcctgttcaccagccctatccaaggtcaattctcacaatgcccagcctaaataccatagtcagccctctgggctcccctcacaccagcctgatacctcccatgctcctttctgccaatctgccctttgacaccacaatcatgattaaactccaaactgcctgttctgctcccattcacaacctccagaggccttgtggggaaaacttaaggacaaggtaaagctgtcactattaatgaatgcattctaatctcaggtgagcccaaaaagagaagccatcagtgctgccatttctctcggcgcctcttccaagccttaaatcccctaaaggaactccccagtttgcacatccatcatggagaagttgatgaacatcaggcaagaagccccccaaactcccatccttcccatccttctctctctcttaccaaccaccacttgaatgatccgagccattctttcggatctcttctctacacttaacactagacccatcctctcaaccttggatcacattagaatgaccaggtgtctgccctggcctctctttcaaagactgagtcatggcctgaagtgagccccctgcacatggcatgtttcaaaagctcccccaggtgttcttaaaataagccaaggttgggtattactggtgaagacaatttttatccatgcccatgattttaaataccaaatctggagttcttttctgggctgtgttctcacacatccaaatgcattatagaaccaccaccaccaccctacatactccatagggtttgcaaattcaacatgtaccaaactcttcatccttcctgttctaggctaaactgtgtccccccgagaaattcatatgttgaggtcctaactcccagtacctcagaatgtgaccacatttggagccagggtctataaagaggtaattaagttagaatgaggtcattagagtgggccctaatccaatatgactagggtccttataagaggaagaaagttggacacaggcaggtacaaacgaaaaaccacatgaagacacggggaggagaccatcacatgcaaggcaaagagagaggcctcagaagaaaacagtcctcacaattctctatgacttccagcctccagaattgtgagaaaataaatttttgttgtttcagccacccagtccgtgggacttcatggcagccctggcaatctaatataaatacacttcccatgtccttgttactctctcctacttcgtctcattcaacggtattgtcatccattcactatcactcctccccctccctcacccaccatatctattcaatagccaagttgcatcaattcttcctcctaaatgtctttcgtatctaccttcttccctccaaacccactgttactgccttaactcaagccctcttaagatatctcagtactatacgatctcaacttataggtagaatcttaaaaagttgaaccaagaagtagagggtagaatgatggtcaccagaggctggaggcaagggatgaagaacagtggggtgggagatagggagttgttgatcaaagggcacaaagtttcagacagacaagaggaatagcttctttctgagatccactgcacagcagagtggctagagtcaataataatgcattgtatatttcaaaataagagtaaatttcaaacgtctcaccataaaaaattatataggtcagtgaaatggaggaaaaataaagatgttttcataaataactttttttaaaaagctattctagtcccttctacctgcaactatttctcctgggtgtttggagaataaccttcctaaaacagaaatctagtatggcaatgatctgtttcaaaccttcccatggttccccattgccccaaggccagcctcctcatgcacggcaaactgagtccttcaggtacttctggcttaggctataattcaccttgcttgttaagccccagcactttggatctactcagaaatcccctaacatataatgctaatccacacagctgtctttgcatatgcacttggcttttcctggaataccctcccttgtccaaattctatgcctggcaaatatctactcatctttccagtcacagcctttcaatgaagccttttatgggtcctattccccacccagattaatcaccacctcctctatgctgcttctgaacttacacatacatcattacactgtgaccatataccagcaaatgtcacaagcacaaatacccacagggaccaaccaggtatcataaatacatgaagtgccaatgaaaacagatctttagcttccatgatacagaaactacacttgcacgaggaacaatcataatgcccacctgtctatgctgacttttgaaacttgacctgaacaaataaactgtatgtggggccaaattcatttagcacatagacttccagtcttgcaaactctggccaaaggcatcaactgtcagagccttcatttctcttccttctactccctgaagtaaaaagactccacaaaatccgtgctcataggctgatctttgttcatgctactctcagtcaagtcaatgcttaaagcacaggaacccacacttaactgaccacaaagagaggatgcagtattgagcttaataaccttgaacttactgctactcagttcttatcaaaaatatccttttgcatgaagtaatattcataggaaacatcctgaaaagtatctaattcagcactccacaaagaatgtggaatgtctatgcttggacagagccagcagtgagctgcttgtctgaactgtcttgctttggctcttacagaatggcttttctgagataagcaattggcattatgccattaacctatattgagcaatacagttttttttaaccccattgtcacattcattgtaagattgtatttggagacacgactcaatacattaaagtacctaacgtttggagaaccatggataaaatcctctctcctcccagcacatgaagagttctcctcccagcacatgaagagttgtcccccctggttagtccttatcttcatgggctttctgggtaacacagctcattgagtcccctcttcatgtcaactatgaggaagaacagcaaaatgcgtggcccttttctaatacatgaatagcaccctaaggtgggcccttggtctcggtctctgcttaaattcacactcacttcctcttaccccatttccttcctatgcttattaaatttcactatatttagtaggaaaacagacatgcaactaacttataacattgcatttatcacatggtaccttcattcagttcccatccctcgagtctgagttttttgaaggtgggcctccatcactaatgagatatcaaatttaattggattacatgtgactacttccagtaatgggtgaaattgcaaatctattacctcctaaggaagctcactttatttccccaaggcacaaaagtggtccctgactgtaatatcaatggcatctagaagaaaattgagcttatgcgggtaaatatgcaaaatacacactaaaccagcacaggtataattaccatttagtttttaattctttgctattcatttttagagcacttgctccattttctagtagttaaccagttatttcacagaagtatactcatcaggaataccctaccatcagttgatgcagtgtatacagttaaaaacaaagcttggctgggcgcagtggctcacgcctataatctcagcactttgggaggccgaggcaggcggatcacgagatcaagagattgagaccatcctggccaacatggtgaaacctatctctactaaaaatacaaaaatcaactgggcatggtggtgcctgcctgtagtcccagctactagggaggctgaggcaggagaattgcttgaacccaggaggtggaggttgcagtgagccgagatggcgccactgcactccaacctggcgacagagcaagactctgtctaaaaaaaaacaaaacaaacaaacaaaaaaaaactttttcacagcatattaaaggacataaaactaagggaagcttgaaacataaagttctctgttagaagacaaaactgtggatgagtgaaagacatgaccacagtggagagaacatccaccaatgaggtctagtcaatgtcatccaggacagattattattaaagtttcccattgctctaatcatttcacatttcacttatactaatttccatctttaagtttttctcaaactctgctggtaggagtatgaagcattatcattgttttggaaatcaatttaatcatttctatctctagccataaaaatcatccctgccttttaaggcaacaaattatattaccaggaatctactctaaagaaattacctgaaatgcaaaaataggcttgcaaagatatttactgaagtgagttcactataacagtagctgaatggaattaacatcacttccatttactgcatactattaagagaaaggacaaagtactgattatgcccagtaggattccaactagataaaatttacagagaaaatattaaaagggaatatcccataaacttgacaatggctatctctaggtggggagtatgggtactttttccttcttcttctttatatttttctttgttttctaaaatgagcacaaacaggtgttacttttgaaagttaagtttttaaactaccttttaaaatctacttggaaaccaaatgatattactttcaaatcagtgatctcactcttaatcagtctacggaaattacataaaagttgttgagtacaatactttttaaaacagcaagtacaaaggaaataaaactgtgtaaaaatagggcaatggttgaatgaacagtttaacagcttaatggattattatcaggctattaaaaatatgattcagactatatcgccttatataacagtgtgttaaaaaacaatcagtagaaataaaaacacacatttgttacttctaggtagaagtagaccataaaatagaacataatagaaataggccataaaactaacatgactaaataacaaatacattcattagggaactgcaaatacaagtgggtttatttaaatattgccataatgtgatttcaaaaataatttttttaatgtttttaagaatacactaagggccaggtatggtggctcacacctctgatcccaacactttgggaagattgcttgagcccaggagttcgagaccagcctggtcaacatcgcaagacaccttctctattaaaaataataataatagagatatattttaaaagataataaacagtatttcatataaaaacaattggttttaaataagttgaacagttttaaatactttaagatgtgttcactggaacatttttactcactgagtcattctgccactaaaacgggatgaagaaggaaaaaggaagagagttaggcaggtaaatgatagtgtgtgttttctgctgaacggctactggacagagttacttttattccctacccaaattagtggaatgttgtattagcttaggctgccattaaaaagttccttgggaggccgaggcgggcagatcacaaggacaggagatcgagaccatcctggctaacatggtgaaaccccgtctctactaaaaaaaaaaacatacaaaaaattagccgggcttggtggcgggcacctgtagtcccagctactcaggaggctgaggcaggagaatggcgtgaacctgggaggtggagattgcagtgagccaagatcacgccacagcacatcagcctgggcgacagagtgagactccgtctcaaaaaaaagttccatacgttaggtggcttaaatgaaaaaaatttattttctcataattctagaggctagaaatgtaatacagggtgccagcatggttggtttctggtgagggctctccttttggcttgcagacagctgtcttttcactgtttgctcacacagcctttccttggtgaatgtgtatagaaacaaagatctctctcttcctcttcccataaggccaccaatcctatcagattaggaccccacacttataatctcatttaatcctaattatctcctaaaagccttatctccaaatacagctacactgggggttagggctccaacatgaatattagggagaaaatccagtccatagcaaatgttaaatatgttttataataaatctcttgtagaaagaatacatttagtcatgagacctcagctaattcctgctcctagagaaatagtattcaacaaggttcttaatccctgaatcagatgagaatttgtgatttcaaagccctctactttaagatgaccaaacacttgaagagaagctgggactttgtcccaaggtcatggtgactaaacccctgcttgagtgttgagattcccttgaacaatcagcgaagttcaactgatgcttccaactctgaaaataaatttctcctgggagctttagacttttgtctacaccacttctctcttagggctatccagaatgccttttatggaattctaggccaggcatctacatgctctgtgcctcttcctggctttgtctaccttgaacctaccctaaccccatgaccccagccccttcacacccaacctgtttctagtactagcattgagcacctgtgcctagtacctacttggacctacacattgccaaacattgcctgtgcctgtgtgacctgcccctgccttgtctcagatcaggagcctggagtcctggctggtttccatataataatcagcttaagaagatatttaacaacaaattaaaaaaatcaactgatgaatcagcaccaaaacacactaagtaaaatctccagagttacctggacttcctgagtaaatattttactatgaatgaggaattcagcagagttcagacaaacagaaaaagcatgcatctcatctttcttccctcgatttctaaacaaaaaataagaacgagtgtaataacatattcacgttacaataaatgaacttgaaagactgaatatattgaattacaaaaaaataatgttgaaatgtatttgaatcaaatgatttaatatactggtaagaaaagctgagttgatgggggaaagggaagatgctggtcaaagggtacaaacttccagttatgagtaagttctggggatctaacgtacagcatggtgacgatacttaatagtactcatttcacagtatatatgtatatcaccatcataagtagaacttaaatacagttttgcttgtcattatacatcaataaagctaggaggaaaaagaaaagataagctgaattgccaagtacctttaattctctttcacataagcccatttcttataaaatattccttaaacttggtgtagtcattaaaattgaattcatcttccatatgattccttagccctttaaaatctttttaaaataatatcaccctcatccaatgggtttttataaaatgtggaatatatataacttagatgctgcatatttctccaaagcaagcatccagcatataaacataagataatcatatttttccatgtttgctgaatctgaaaggataaaaaaaattaattccaagtgttgtcaaactgcaaactatgatataaagtcttaaaagatttaggccagttgccgtggctcacgcctgtaatcccaacactttgggaggcccaggtgggtggatcacctgaggtcaggagttcaagaccagcctgaccaacatggtgaaaccctgtctctactaaaaatacaaaaattagctgagtgtgggggcagacacctgtaatcccagctactcaagaggcttaggcaggagaatcgcttgaaccacccgggaggtggaggttgcagtgagcagagatcccgccaccgcactccagcctgggtgacagagcgagactccgtcacaaaaaaaaaaaaaaaaaaaaaaaaaagtctcaagagaattctaatctttacccattcttccatgttgtaatgagaagcattagtagtgttgcccaatgtgaaggaattagtgccacctgagcctgaccccacaaagacacagaaagatgcaaatacctggagttctcccaagtttggcctgagcttgttggactaggttagttaaatggtggggtgccaagtctttaaacagccagagcaaagttgaaaatagaaagcataaaggcacttaatactaataataggactgggagaatgattcttgcaaactgatttcaagtcctccattttaagacaaggctcccagggcctcaaaggttgggtattgtcaagggtatcatgcacagcaatggaagaactggcaattgaatcatggtctcccatctcacgtggtctccaacttactttatggacttctaatttaaaatctttcttttaaactcttcagttttaaaagagggtggggggaatgaacactaaaatcctaccaaggtaaaaaaaacaaaaatcctagtgcagtaataattcttaccattatattcaaatcaacaagaagcaatgaaatactcacccaaccatctgatcttcacttacaaaaaacttaacttcagtgttataatttcttacaaattatgcatagttactaaattggtaattatattatataaaagtattttttaatccaaccaaatctatttctcctgcatatcgaacacaactttgtacagctcctcatacagagcaagccttcaaaaaaccctgctattgccgggcgcggtggctcaagtctgtaatcccagcactttgggaggccaaggcgggcggattacgaggtcaggagatcgagaccatcctggctaacacggtaaaaccctgtctctactaaaaatgcaaaaaaaaattagccgggcatggtggcgggtgcctgtagtcccagctactcaggaggctgaggcaggagaatggcgtgcccggcaagcagagcttgcagtgagccaagatcgcgccactgcactccagcctgggtgacacagcaagactccgtctcaacaaaaaaaaaaaaaaaaaaaaaaaaccctgctatttagcaatatactatattgctctaatacaaaactacttcaacaaacaccaacacccatctcccccaaaaaatccttgacattcctatttgacttttgtcaagtaagaaaaaaaagccacaaacaggaaggcctactaagtatcacaaaaaatgccaactcatcaaagaagattgccttccacctgtctttcccttccggttttctattttgcttctgttactatttcttccatgactctgcaatcccacgcacacacccctgctcagtccttcacagagttaacacattctcatctgcagacctaaccaaatgtcagttccccagggaaatcctgaatcacccccaaagtcagatgaggttccccatttaatcgcttttgctcttttcccccacagaatttatcatgcagagtatttatacatttggatgtttttttttttggttcatatgctccatcccactagactctatgcttcatgccaccagtgataacgactgctttactcatcactctattcccagctactagcaaaataaccgatactgtatttaacaaatggatgttgaaaaatgaatgaacctgattttagacagcacagcaacagactagatcagtgtctttcaaactgcagttcatgactagataagtgttttcaaaatgtatgagttataaccagtactttttaaaatgaaaatgaacaaattatcataggaaaaaatagaaaagaaaatgtcagagtttactatgtgtagtaaactatatacaactaatgtctcattcaaatgtatggacaaacatttctaactatgggtcatgactaaaaagtttgaaagccactgaactaaatgtcccaataaaactcatcacaatttccagttaaaatgctcaagaaggtgcacacaaagacaaaaattggcaatagcactaaaaatatacgaggaaaaagcagccaaagtcaaggcattatttccactaactacatagtacaaaaaatgggtaagaagcatgttcttggaccatatgcacaatgcataccacaccttttgaacttcaacaagatagattctctaacaaatgtagaaaaaaatcctgagttgaactcaggaaatgcagaagatgcaactggccagataaatctgaagggcgtaatattagactgaaccgtacaaaactaccattttataggtcaagagcagtcaaataccagcaatctcatatgattcaacttaccaatgaagataatgaaaatggcagctaatacattcagtgtgctgggcatcatatatatacatatttttatatatatacacacacacatatttatatatatatttatatatacatatataatttttatatatttttatatatacataattatatatacatacatatttttatatatttatatatacataattatatatatttatatatatgggagtgtgtgtgtgtgtatatatatacacacacatatatatacacacacactttaagttctgggatacatgtgcaggtttgttacacaggtataaatgtgccatggtggtttgctgcacccataaactcgccatctacattaggtatttctcctaatgttatccctccccttgtcccccaccccccaacaggtcccagtgggtgatgttcccctccctgtgcccatatgttctcattgttcaactcccacttatgagtgagaacatgcagtgttaggttttctgttcttgtgttagtttgctgagaatgatggtttccagcttcatccaagtccccacaaaggacatgaactcaccttttttatggctgcatagtattccacagtgtatatgtgccacattttctttatccagtctatcattgatgggcatttgggttggtttcaagtctttgctattgtaaatagtgctgcaataaacatacgtgtgcatgtgtctttatagtagaatgatttataatcctttggatatatacccagtaatgggatggctgggtcaaatggtatttctggttctagatccttgaagaatcaccacactgtcttccacaatggttgaactaatttacactcccaccaacagtataaaagcattcctatttctccacatcctctccagcatctgttgattcctgactttttaatgattgccattctaactggtgtgagatggtagctcattgtggtttgatttgtatttctctaatgaccagtgatgatgagctttttttcataagtctgttggctgcataaatgtcttcttttgaaaagtgtctgttcatatccttcgcccacgttttgatggagttctttttttcttgtaaatttgttttaagctccttgtagattctggatattagccctttgtcagatgaatagattgcaaacattttctcccactctgtaggttgcctgttcactctgatgatagtttcttttgctgtgcagaagctctttagtttaattagatcccacttgtcaattttggctttggttgcaatcacttttggtgttttagtcatgaagtctttgcccatgcctgtgtcctgaatggtattgcttgggttttcttttagggtttttatggttttagttcttacatttaaatctttaatccaccttcagttaatttttgtataaggtgtaaggaaggggtccagtttcacttttctacatatggctagccagttttcccaacaccatttattaaataggaaatcctttccccattgcttgtttttgtcaggtttgtcaaaaatcagatggttgtatatgtgtggtattatttctgaggcctctgttatgttccattggtctttatatctgttttggtaccagtaatagccttgtagtatagtttgaagtcaggtagtgtgatgcctccagctttgttctttttgctcaggactgtcttggctatacgggctcttttttagttccatatgaaatttgaagtagttttttctaattctgtgaagaaagtcaatggtagcttgatgggaatagcattgaatctataaactactttgggcagtagggccattttcatgatattgattcttcctatccataacatggaatatttttccattcatttgtgtcgtctcttgtttccttgagcactggtttgtagttctccttgaagacatccttcacatcccttgtaagttgtattcctaagtattttattctctttgtagcaattgtgaatgggagttcatttatgatttggctctctgttcgtctattaatgatgtataggaatgcttgtgatttttgcacattgattttgtatcctgaggctttgctgaagttgcttatcagcttaaggagattttggctgagacgacagggttttctaaatatacaatcatgtcatttgcaaacagagacaatttgacttcctctcttcctgtatgaatatcctttatttttatctcttgcctgattgccctggccagaactttcaatactatgtcgaataggagtggtgaaagagggcatccttgttttgtgccagttttcaaagggaatgcttccagcttttacccattcagtatgatattggctgtgggtctgtcataaatagctcttattatcttgagatatgttccatcaatacctagtttattgagtgtttttagcatgaaagggtgttgaattttattgaaggccttttctgcatctattgagataatcatgtggtttttgtcattggttctgtttatgcgatggattacgtttattgatttgtatacaccgaacctgctttgcatcccagggatgaagccaacttgattgtggtggataagctttttaatgtgctgctggattcagtttgccagtattttattgaggattttcgcatcaatgttcatcagggatattggcctgaaattttctttttttgttgtgtctctgccaggttttagtatcaggatgatgctggcctcataaaatggactagggaggagtccctctttttctattatttggaatagtttcagaaggaatggtaccagctcctctttgtaactttggtggaatgcagttgtgaatctgtctggtcctgggctttttttggttggtaggctattaattactgcctcaatttcagaacgctccaccccaaatcaacaggccaggtgcggcgttcatgcctgcaatcccaacagtttgggaagtcaaggtgagagttcaagactagcctgggtaataaagcaagaccctgtctctacccaaaaaataaataaataaataaataaataaccaaacatggtggcatgtgctcacagtcccagctactcaggaagctgaagcaagaggatggtttgagcccaggagtttgaggccacagtgagctatgactgagcaactgaactccagcctgggtgacagaacaagacatggtctttaagaaacaaaacaagaaaaatattttggggaaacagcagaaaataaaaatacaattttttttaagtcctgtcctcatctaagaagtcagaagaaaagtgcaatggagaagaaaatatcaggcaagctgggtagacaggaaaggtcacacaattttaaatgtagtgatagaaagccttaactcaaagttgacctttgagttaagacatgaaaataatgagagcaggcatgtggatacctaggaaagaacatcctaggcagaaggacaaagaccaggaaaccacagtccactgtgtggataagctcaaaaatggagatcatttagagtaaggatagaactctgggaacatcaacactgaaatatgggcagagaagcacaagtcctcaaaaaaaaaaaaaaaaaaaaaaaaaagaagcaagcggagaaagggaatgactaaacataattaggtatgtttaatcagtcacacacacattaaatagtgtgactaatatgtagtcattagaaattaaaaatgaaagattttaatggcctgtgtacatacttatgatacaaaggagaatgctgttaaatattccgtaaaagcaaatatttttaaaactgcaagaaattatcccaaaatggaataagaattttttttttttttttgaggcagaatctcactctgtcacccaggctggagtgcagtggcacaaactctgctcactgcaaccttagcctcctgggttcaagagagcacatccagctaatttttgtatttttagtagagacagggttttatcatgttggccaggctggtcttgaactcctgacctcaagtgatctgcccaccttggcctcccaaagtgatgggatttccagcatgagccaccatgcctagcaagaaagtcaatcttaagtgatggaactacacatgaatccctgtacattccacatattttaaaatgagcatatactgttttttcctatcaaattgaaatgagtataatttaaaagaatcataatggcttagaaaaaagaaaactaagaataaacttgtcttttttctatcttgcatgcaaaaaggcatgccaataaaattatctaaggtgaaaataaattcttaattagaaaaagacttttttttttttttaccaagtaaaggacaaacttgtactgcatcctactttttagtaggcaactaaagcttaaaattatttgatcagacttttaaaacctctatgacaaacctttacgagtttctcaaagcgtggtctttaggctactgaaatttccaaagttcttctggaaggtttaccttttatatgacagcaatatgagactcactgccactagtcctacagtaaattaaaactatatctgcaacttcccccagacgtcaaatcaccatctaattattgtaaggatttttttccagataacaatagctggaatggggtgtttcagggattttttgttcaccccagtgggtattgttgaaatttgcaccatttccttcctatctccccaggaccacctatcaagagaagccatagtaaacgctcaacaaatgcttgataaccgataaaactactttaatctgctaaagaaaaataacctaaagaattgaaataagccttgtccttgttaaaatatatcaatcttttcactctaaaagtgctctccagcttatcacacacattttactggcatttacttctacatttagcaattatgcctgaatactgccaactgacttctcagctaaacttcaaactcaaattgccagccaccagctgaaaatctctgcctgcatggttttagacatgtctaaaactaacaagcctcactgcaacaatcatcatgctctcgtgtcctgtctggtaatggcatcaacatgcccttttttgtccacagtagtctccagtacccttctacctccacaagcttcgagattggtcccaccacttcctgccacaaaccgtcaatttcaggcactcctccccaagcctgtcactcactgggtcttcctcattactcttctgcatggaatgagctccacagaccattgaggctggcatcctgctgcaagtcatttccctcctctaaggctgacttaccctctccatcctcagatatgcagacagctctttgtttgaaacttggtttaccgtattcatcactacctacctgatcttaatcatttgagtccatatcgctccatgttcatgagctactcaagagcggggaccgtactttcttaatttttttttaattttagtgtcctcaggccaggcacggtggcttgggcctgtaaacccagcactttgagaggccgaggcgggtggttcacttgaggccaggagttcaagaccagcctggccaacacagtgaaaccccatctctaccaaaaaatacaaaaaaaattagccaggcatggtggtgcacgcctgtggtcccagctacttggaaggctgaggcaagagaattgcttgaacccaggaggcagtgagccaagatcgtgccattgcactccagcctgggcaataaagtgaggctctgcctcaaaaaaaaaaaaaaaaaaaaaaaaatttagtgtcctcagccaaacgtaaggacacagaagttctccaagatatcagctgcatgaaactaaactgacagcgtctcaaagtgaccagagaacagattgtgctaaatctggaaaagtcagtcatcttgccctagcctttgaacctttacttttctgtgcctagtcagaaagtaaagcaagcagttctctgtggaactacaataaatagtgggtacagaatgaatgcctcacttagttgacaataatccttctccccacaatcgtagtccaagaaggcaaagcatccccttaacaaaaggcaattctgtttcagttgtgttattctcttagtaagaacacaccatccttatcatctgctgattacagacttccaaggcgggggtcctcactgaatactcctacaatgaaacctgcctataatgagtaactctacctatcttctctgctccagaagtggttgaaaggcctttcattcaggccttgttttctacctaacaaaaggttcacagatgccaaacacgtgctccaaaatgcccctcctcccgtcgtctgagacccagatgaagcagggtccttgtggcaataatattctctgcaatgctttttgtcgtcttggttgtcacacagctggaaatagttttcttattcccgtttacaatagccagacattcattatcactctgacaagaactcttgagtgatgtcatgctgcacatgctgcaccagttcaagaagggcccatgcaggctcttccagcttcaaacttctcactcttgatggcagcctcaagtatagcctctctaaagcaaaagaaaatggaggcaggcacagacagatacacacacaaacatacatatgagtatgtataaacatatccacacttatcccacacacacataaatatacataaatattaatttttgtaggtttgtataagtaaaaggacaactatggaaggctatggaacaaactgatatcagatgggtaaggttaaagtggcagagagagatttttacatttactttagacacatctatagtgtttgaatcattgcaaaaaaaaattttgtaaatgaatgcagctaccctctcctggttgggatgcattttattgtgtttgtatccctgagtgacttcaagatcataagtgaaatacattagtgaagcaaagcaccatgacagggtgacttcaaaataagtattagccagatgcggtggctcacagctgtcatcccaacactttgggaggccaaggtgagaggatcccttgagcccaggagtttgagaacagcctgggtaatgtagtgagagcccatttctttaaaaaaaaaaaaagaaaaaaaaaaagaaaagaaaaagaaagaagaagaaagaaagaaaaagaaaaaaaatagccaggcatagcggcacacacctgcggtcccagctacttggaaggctgtagtgggagaatagcttgagcccaggaggtcaaagctgccgtgagccaggattatgccactgcactccaagaccctatctcaaataaataaaaaataagtctgactttctacaggcactaggtttgaattattctagaaagcaaactatatactgagcaaagaatctcaaacacaagttgggttaaaagtaagaatagggaaaatgagatggaagcaaggcagggctacagataaaacacagctatgtctatctctagactttaaaacagataaatcctagcaaaatatttcaagcatataaaatgaaaaggagattaccgggctctgtggtctccttccttaaaagggaaaggccaactcacctcaaagtattgagactaccttggagaaaatgttcctaaaatggaagaataacaagatacatatgcctgagtttgaaggcattctaaaagaacttctcttactaatgtcatatgatagagggcaagctccatgagagaaggggtctgtccacatcttgtttcctgcagtgctatcttcccagtacagggtgggtacaaatgcctactgaatatggaagaaagagtaatataaaggattaaggaacacatagtaaatgaaaactagaattaccaaccagatatcagttcttattcttattttccagatgtaaaaagagaggcactttgacctacccaggagtagcgaaactggagatagaaagcctcttgatcccttttttacctcttctaggcttggtttatctcccaggatccttccagatcctaaccttccaggagcattccctgacctccaccacctcaccgctgagggtcaagtgcccccgcttggtgctcccgcaaagtcttctctctcataacacttgttacactgaattgtaattatctgttaatcgtgtgtaagctcctcctggagggtgggaatcctgccttattcacactcacccctagtaaaactagcacaaagcctggtatatagcaggcagtcagttaagtgctcctgagatggggggaaaaaaagtttcctctgcccctgaaccatttctccctccaaagacccaggaatatccttcaattagagcagaatttcagaatcagggcagttaagggttggtcaaagagaaccacctaggcataggggaagaaaatttagtagaacagatcgatataaagtctaatctagagcattgtttagacacataagttaatgaatatagggaaacttgctataacaggaatggttcacagtagcaatctcagcatagcaaatcctaaactctaagagacatagcacacataatggccataatgaacaaaatttccttcaaccaacagctggaaatcccacccatggccaggtattattagtcaaaattttttcttttagagaaaaatgctggttttgaaaacattttcctttattttcataatacaacaaacacagcttgccctgcctcatgcaggcttattgcacgtttgttttagcactggactaaagttaagggtctgccctgtcattatatcacttttttaaaacagtatcacaaaaataaaataaattataacctaaatccatgaatgtagtaaaatagttctctttcatttctggaaaaaaataattacaattttacatggacttcagggttaaagtttctatagcactgattagatgacagggacatgcaagtattaagacaatattctttggcccagccccacaagttgataatacaacaacaacactactttgaaatcatactaacctgctaaaaaatgccaaagagtttaaataaaatcatcaccaccaccatgccacccctcctcctctcctaccaaaaatgtatcctaaaataaagtatactaaccttgggcttctccaacttaattaacttaatttattaaacatgccaaacataagttcccttgcagaagataaaacaaactgctgggaagatcattcattaaattgaattcacaaggtaattgaaagaaattcagccaccttctttttctttttctttttcttaagttttttgagatggagtctcactctgtctgcccaggctggagtgcaatggcacaatcttggctcactgcaacctctccctcctgggttcaagtgattcttctgcctcagcctcctgagtagctgggattacaggcgcccagcatcacacctggctaattttttgtatttttagtagagacagggtttcaccatgttagccaggctggtctcaaactcttgacctcaggtgatccacccgcctcagcctcccaaagtgctgggattacaggcatgagccgccgtgcccagcctcttctttttcctgtctgtctcctgggtaccctagcatctccagattcaacagcaattcaaagacatccaagtcagttccacctctgacatgcaactgaaaaccagtgtatatcctcctgtgacacagaggtactggggagcaagtgtgaacctataaagctcctgaatacctctcccaaatggatcccacagagtgaagataatgagttaaatgctttagctctagggatttaaaatatatagaaagcaagttacttctactggaagttaaacttaaagaattctcatggttatgtcatctctcactgcagtaccgagtgtgctacttggcttccctctctccttccatctactgccttgccctatcatttacagaggcattaatgccggtttcaaactaataataattctttttcttctgtgctgcaaatacccaatcactgtggttaaataccatgtataacataaacagggtcaagaatgccagctgccagaagagtcatgtttaaattagcattaaccagcaagcccttccctaaacaaaaaagagaggggaaaaaaaatgttttcttggacagctctgtgcctgcagaatgacttcaaccccacatgttcaaaaggctccacaaggtccagctataacacaatagcatcattaatttttactaaattaaatttctcaaaagtataaagcactatcaatttgcggagagtagggaggaagaaactacttattagtttattctacaacctttatataatttgagtaaacaggcaatagtgtcttaaaacgtagcagccataagttacacggattgtaatggaataaaagcccagtcctccatccatcatcgcacccctcactctgccccaatatgtgttactcagtgtctttccacatcttgaggttatgtaatacttcctccttgcctccctatccccatgtagcataactccttaaaataacatcagaggtcccccacaatttgtcccttcgtaactttccagccttcatcaccccacactctcactttgtcttcattcccccaccattcatcttttaaaagatatgttattcttcaagccacatttataaattcgtcccctgaatcaaaacgtaattctccattccctggcatgccaaagttcttggactctacagctaccacccagttacacaacactgcatatacatattcggtatgaaccgtgaggctcactgcatctttcccccctgtgttgcagttctttctggagcttccttttcaccatccttgcatctaccacatggaaggaattcaataattgtttgctgaaatagaattacctccttttctctcaactttctaagacatccataatagttttccctaagatttttttttttaagagacagagtctctctgtcacccaggctgtagtgcaatggcacaatcacagctcactgcagccttgaatcctgggctgaagccatcctccctcctccgcctcccaagtagctgagactacacgcacatgccaccatacccagctaatgtttctattttttttatagagacagagtctcactatgttgcccaggttggtctcaaactcctggcttcaagcgatcgtcctgcctcagcctcccaaagtgttgagattacaggcataagccaccacacctggcccgggatatttaaataagagggtaacatgatatgtaaaaataagaaaccaaacagtagtatgatgctgacttaaggccagagaagactattggactttaaaccaagagcttatgtttaagtttttattacatcacagttcagcttttacaataaataatgttcctcaagggtgtaggcatattgataccaaaacatcaaagaaaaggaagacaggccacacatcaaacacagacattaaaatcttgacctcaaactaaattctgaaagttctgttatctgctgaatacttggagcttcccagtgaaaatgatacagtgtattctgcccagattgcaactttccatactaagcatttgaaatgattcttggccctaaatatcacttacttcagactgaatgtcactgtgtatcaaaaacactgagcaagtgagatttttattctttgaacgttccagtaggtcactaatggaatagattcagtaaaaccttgcagcctacggtataatttgaaacaacaaaaaaatcaaatcactttttggaaaatattaggtttgaacaaaaatagaagtttcgaaagggctgccacttacattcttacctctgttagttctttcccatcactcacagggagactgaaatccatgctgagtgcccacagacctgggcaggagctgttcccttgagagacaatgatgcaaatgagtcaagtgatgcctagtagaagtcagactgcaaggatcaccttgacctcaccctagtgcattagctaagcaaactcacaagctttaaataataaaggtaacaagagattgatctgaggtgggggaagtattattgagtcccttgaggaaaggaaaaaaaaaaaaaaaagaggaaatgagctcccagctcaagaatttttctcctccaagcatcctctgttgcttgttttcttccatcttcctggccctctggacctctcacttccccctcctaccttttcctactgctctaacacaataagataacctcccaccggtttctcgctatttgggaagctggaaggaacagcaacgatcaccaaccccttccattttccggatggggagacggagaccaggatctgagctgacccgactggctgaggtcgcgccgctaggggacgtggtgtaccttgcgggctcggatgatgacaacccagccttccctcctcgctcctcgcccgtgccttcctgcctcaagctacctccttctcttgccacttggtgtttttatcctcaaatcagacaagtatcaagaaaaaaatgcaaccttaatatacttacaatgctgattattattcataattttgcatttggggcaattatactcgctcctactgggatatggaaatcaagggcagaaagaactaggtgacattctacctccctgtgtattttaatgatgtttagtttggttcaaataaccatacctctaaaatacaccctttttccttgggacccactcttctatccggcaagggaataacttcttaaaaaacttcgcattttccaagtgtacagtctccccttaaccagaactgcagactctgaatcacagacctctggcttaccaattatgcttagctgagcaaacacacttatgcaaatacgtgaaaaacaaactgttagagcctgaaggaatagaggatttcgctgtgatcatcaatatgtgatcatcacattttcaatatttatgtttaccaatatctatctaaccccataggaaacgacgcgtccatagtgaaacaagccagcacccacatttatgaaaaaatccacggatttcaacaaaaatgaagagaggagagcagaagcggagagccacaacctcaggccccagacagcaggcagcagcaagtcctgaatgccttcactcttaacattgcaaagaccaaatggcagcaaagaaaaacaagaataaactttaaatccattcaccacaaaggagtcctacgcaagtcaaaggagccgtcgatttcaaaaccatcaactttcaaagccaggtccctcccttgccttacaacctcctgttacttgttaagcacgtttgttaggcggctggacagaaacttagttaaaagtcctcagcccggtggtgggggacaaccgagtcgtcagtgggaagcgagaggtgcggagccccaggggcgcagggacccctcggaggtgcaagtccagcgggacgaggttttgggagaatttcgagggcccctcgcaagccctcccgcgcacccaccccgacccaggtaaccggaggccacctacgtgtcactgggcgggccccggggcgcactgacctggcgcgggacaggagggccggcggcccgggcggctgcggcaacttccctccaggggctcggtccgccgctgggtgcgggaggccaggggagcctcgcctcctgcaggccggctcgcaagaacgcacggccacccacccgcgccgcggcccacagcgcgcacccacactctcactggcactcgcacgcgcgcccccaaccacaaagcccgtccgcggcgggacagtgtgagcccagcgcgccgtgtggcgggccgagcagtcgccgcggcctctggcttcgcgcccagggggcgccgtccccacacgccgcgccggcccccttacctgcgctcgctgccgccgcgcgtccctctcctgccgcccccgggctggcttcaggccgcgcgcccagtcccggcggcccccgccccaccgccagccgagcccggccctccgcccgcccctcggcagtcgcccagagcggggccgccccctgcgcccaccccgccggggtcccgtgctcggccgggcggcggggagggctccgcggctccgggccctggccgccccagatccggcccgcgctccgcagcggggctggagacggagtcgccactcagggagcgtcagccgccagtcggcccctactgcccggctttggcgcgctggcaggaggagggggcgcagagggagggccagaggagcagcgccgacgccagcctcctctcttcctccgccttccttcttttctgcttgttccacgtagcacaagtcagcaacacccgaacccccagagtccgccctccccgctcccaagctggaccccttacctggtgtggcgcccccagcgcccctgacctctgcgccccctcctccattcattggctcgacagcccacggtggtggcagggccggggctggggggtggccttagcctcccattcattatctcagcagcctcccccgccccgcccccgagtcgacacacccgcagcgggagacccgtggccgccagctcgggtcccacccccgcccctcctgcgcttaccccagcgccggacagctggcaggactccggtggacgccccggcacggggcattttcacgttgtcgctctcctcttcccactcgaaaagctctggaaaacatcgcggggcccgcaaaaccccggaaatgtggcctctctttcgtggctcactttctaaactttccagaaggcgcaaagtttctcccagcgccgccctgcactggaggctgcgaagaacgcagaagcggctttgctgctaggaaggtgcatacgtttctagttctgatttttcacttcactggatctgtaaacgaaagcaagtgtgtctgctcccctagttctccatatccacgattataaatttctcttccgctttcccagtgtagctttgcaagtgtaaactatcaattttagtgagagtaattaagggcggggactgcacacctggaggtgtgggtgggagcggcgcgggactaaggcctagggaacattctcaggagagtggcagccacagggattcgcccaggtcttataacacacccactcgatggggtctccctagccacgccacctcacaacacccatctcccacttctggcttcccaggatttccggagtgatcacaattatcggcctctcgctccacagctaaggccaccgcatatcaaaaatagcagcgtgtgagtaaaagtttcatgagccctcgccttgaaatggcacagaggacacagcacaccagcagtaaggcatggggactcggcaggactgatctgattgagagaaacgcaggacagcgaggcggggctatgttggtggtggccaccaggtaaccgtgggctttgcagaagagaaaggtcactgcaaaccgtagctggacggaaacttttcaagcctcaagtgagttatgctgtgacgggaccatgaccatctcccaccggtgactgcttagaaccttgaccaagctcgtgtggttttcacaggatgctcagggctgagtcctggctgtaaataatttactatctaaagctgtttccttttaaaaacaatggttctaatcttttttttaaaaaaaatcattcaaatcttttttaaaaatccactttaaataactttgctttctatacctttcctacgaatatatgatttattttataacctactatgtgaaaaaattgaaattttagtacatgcacagtgctaatatgttcatgcacaatgctacttatgtttgtgtacggcatgcagaaatgtgtatagatatgtatacccatgaatacaaaccactcccttatctcacaaataatcataggggttgataccaaactataagaaatattatattgggatgaataggcaaatgttcactataaaatctcagtatcataaaaagtatatattggtaagaaaaaaatatactcgaaagaggtttccatatatttttaaccatagctctactcaagtcaaaaaatcacttattagctaattttcccgtctctttcttcctatacactgtacttactatcagatttcttaacaccaatacttctatatctaatataaagacattttaaaattaattatttccatgtttagcctttccccataaatcaaaggtaaagtaaaaggagtttcttacctaccactcaacttgaatatttttaatatgttgattttgtctcttaccttcttaaggaatacagttgcttctgttttgactatcttaactactctgtggccccttctaacatcaaattgggaggcctgtccgtacaagacatgtgtattcaacagtaagttatttgctataaaacacttcatttcctctttatttggtctgctgtggcctgaaatgaaatatagaacaaactgaaaggtctgcctggacagacctgtcttcctgacaagcgtggacctgtctaaatgagacagcttctgcagccagctttagatcgataactctaaaattaaatgtaggtatgtacatccagtagaaaaggacagagaaaatgaaatacaatacagaattcagttcagcatctagattaatccataaaacctagctcattatgttccaaatgagctacttttctcatctgtaaaatggaataatggtaccagtgcagtcttttatatggttccaagttgtcttttatcaaagtaaaataatatatttgggtgggcttctgaagacactaacattgatgatgaggtttcaacaggaacaaagaataccttgataaattttcttgaatgttttctcctgtctgtagtcctcttgtcattcagacattccctttcttggagagtcatcctgatgctttctgtcctaacctttctctcctcccctctgccaagcagtatttctttagatttgtttcttcaaatgacttcagcagaggtaaagacccaaagacagctggcgctgtcaaacatgacaaaaaatattcttagccacagtggctcatgcttgtaatcccagcattttgggaggctgaggcgagaggagcgcttgagcccaggagttcgaagctgcagtgagctgccattgtgccactgcactccagcctgggcaacagccaggccctgtctcttaaaaagttttaaaatttttaaatatatatgtatgttcagcaaaatgaagccaggcatggtggctcacacctgtaatcccagcaccttgggaggccaaggtgggcagatcgcttgaggccaagagtttgagaccagcctggccaacatgtctgtctctactaaaaccctgtctctactaaaaatataaaaattagccggcatggtggtgcatgcctgtagtcccagctgttgggaggctgaggcataagaatctcttgaacttgggagagagaggttgcagtgagccaagattgcaccactgcactccagcctgggcaacagaacaagactgtgtctcagaaaaagttcagcaaaatgaaacattgtgatggatatttcaagttcaggttttacattaatatctggaaggacaccatagactttgtcagactattgatataagctagtgatccaaggactataatttgagaagcatttcgggtggaaaaattggctgtcactgcctttggcactattatttgttcaaaaggttccccagtcatggcacactcatggaagagttctctcttcctccctctgttcgcttccctctggcaaaaagcttttgaaattttctgttcgagagtaatcaaaactatcagcaaaacgatctgttggaaactttccctccagtctattaaggtagagactgattcaaagacagtattttggtgaaacaataccctgagagaactcagccttttccggaaagttttgcagatgatgcctccaggcatagttttcttcctccttgaaatggggtatttgtgcctctccagtgtttttccccttggctaggggggaaaaaaaagcattctccttaggaaacctttctattttaaaagtccagcggcaaaggtgggtggggcagcccaatttagtaaaaagtaataataataacactcttcagagtgcaggtggcataaggagattccaagaatggagagaatttgggtttgcatgcagcagcctcctgcaaggactaggctgcaatgaaagccccaaacagagtaactctgtgttcacctttttcttatcacatacatctgcatgaatactctgggtaacatcagaagtaggtcaaggctagcagatcctttctctgtagtctccctcatccaaaataaaaaaggcttagatctaaaacagagtgaagaaagacaaggaaaaggaaaaaaatatatgtgtgttatatatacaactataaagctaaaaatggatctggatacaaagaaatcatagaaagggtcaacaaaacaaaaacctagttctatagaacaatagcaagatagataaatttctggtaaaattgacaatgaaaaaagagaaaagaaggctatgaatatggagattataattacagtttcagtagaattttttaaatcctaagaatactatgaacattaaaaaacttggctgaaatactttcttcaataaattaatttttaattcaataaaagatgaaaattaaaataatacatgattttacattttcctttgttgacaaagatttcttttaaataatgatacttgaaaaataggtgtaaactcatgcaaactctctgtaatgtaatttagcaaaacagtacagttacattttgtatgattttaattgaagtacatttatttaagacggagtttcactcttgttgtccaggctgcaatggcacaatcttggctcaccacaacctccacctcctgggttcaagtgattctcctgcctcagcctcccgagtagctggcattacaggcgtgcgctaccatgcccagctaattttgtatttttagtagaaacggggtttctccatgttggtcaggctggtctcgaactcccgatctcaggtgatctgcccacctcggcctcccaaaatgctgggattacaggcatgagccacggcacctggccaaagtacatttaaatgtatgataaacacatcaagaaaattttactttatgtgcaaaatttttaaataatacaaagctcagtatttttaaaacttgaaaaacagcaaaattacagagctgaaatactttttaataaattgtaaaattgcattaattcaaaaataatacaaatgtatttaaaaccattaaataatttaaattcttatttctaaataaatatgcaaaaaagttcaaagttttggttggtaagacttaccaaatcttcatggacaaataacctctattcaaatggttgcaaagcatagaaaaagaaaaaaagcaccccagtccattataagctaataaaattttgataccaaaacctgacaaagccatagaaaagaaaatactagaccaatctaataaggaataaaaaatgataaattctacatatagtattattaaaccaatttcaatgtgttttcacaatatgcataataaacatattgggttgataccataaatgtaaagatggcttaatattagaaaatgtggcgggatgcagtggctcacgcctgtaatcccagcactttgggaggctgaggtgggcagatcacgaggtcaggagttcaagaccagcctgaccaacatagtgaaaccccatctctactaaaaatacaaaaattagccaggcgtggtggcgcacgcctgtagtcccagctactcaggaggctgaggcaaaagaatcacttgaacctgggaggtggaggttgcagtgagccaagatcgcacccctgcactccagcctgtgtgagactccaggggaaaaaaaaaaaaaaaatatatatatatatatatatatacacacacatatatatatatacacctatatacgtatatatatgtacatatatacgtatataggtgtatatatatatacgtacatgtttcatgttcaggaaattcctccctattactactttgctaagataaaaaaatgagttgtgaattactttacattttcatatatatatatgtatatacatgtacacatatacgtaagtgtacatatatgtatatatgtatatgtgtaatatatacgtatatatgtatgtacatatatacgtatgtatatatatgaaaatgtaaagtaattcacaactcatttttttatcttagcaaagtaggaatagggaggaatttcctgaacatgatagagttgctaccaataacccaactccagaagcattatttttaatgttaattcattcaatatttttctttcaaaattgacaacaaaacaaagatagcttttgccatctccattcaacattgtactgaagccacttgtcaatataataagacaagaaaaacaaattagaaggtatgaaagttagaaaacaagaaaaatatgatttataggttatatagttgtctgcttaagaaatccaagcaaatccaataaagtatctaataaagagagcttagcaacattgttgaatatgagatcaatatgcaaaaaagccacacccccttagaaaaaataatttttgaaaggcctctcacacatattgatacagaatggctgagctcctggctaaaccccaccctcaagcctagaacccctaacctaagtgaaaacagccgatcctgaagggctgggcttctggctaaacctcaccctcaagcctggaaccttggccctaagtgaaaacagctgaccccatttttcgtcccaaataattgccttttggcccaccctgccccctatcctgtgcccataaaaaccagaccagctggcagaaaaaaaaaaggaaaagagaagcacaagcagctgactggcggggatacaagcagccaagcagcaagcagagaggcaactaagcatcagaggctatggataaatgtggctaacttcagagggtgcagtttcagaagggtgcccagcaagagacagctgggcttcagggaaagatcacctttttcccacaccatcccctttccagctcccctttcaccaagagccacttccactgctcaataaagtcttctgcattcatcttttaaacagttcatttgacctgattctccctggacaccaaacaagaactcagggtcaaaaagggcaggtgcaggaggctgtcaccctgacccttcactgagctgttaacacttagccatccatggactgcaggctgagtgaaatgagccactccattcctgtccatgaagggggtcaaggtcaagggaacaaataccatctcaatattagcaacaaatttttttaatttttttatttttttttgagatggagtctagctatgttgcccagactggagtgcagtggcactatctcggctcactgcaacttctgccttccaggttcaagtcattctcctgcctcagcctcctgagtagctgggattacaggcatgcaccaccacgcccagctaattttgtatgtttagtagagacggggttttaccattttggccaggctggttttgaactcctgggctccagtgatctgcccaccttggcctcacagagtgctgggattacaggcatgagccactgtgcctggcccatattagcaacaagtctttattataactttaatggaaactaacaggaaagtacagtgcctatatggaaaattataaaactttattaaaatacataaaaaggcctgaatatgcaccgtgtttgtggatgcaaaacctccaatatatgtaatgcaatctactcaaaattgcaatagggtttttcacagcccctgacaacttgattctaaaattcaagggtaagcctaataagccaagaataatcaagagaattctggagaagcttaaggagggaaaattttccatccagctatcaagataatctaaggcttctttctcaaattaaaaaaaataataataatgtggtattggtgcagtggctgataacgtagcgaaagagaattcagaaacaactacatgtaaatgtccaagtccatgtaaattcatacatcaaagatgatttgcttaaaacaacaaagctgaaggccaccctacccaacttccaactatacaacagggctacggtaaccaaaacagcatgatactggtacaaaaacagacacatagaccaatggaacagaataaagaactgagaaataagactgcacacctacaactatctgatctttgactaacctgacaaaaacaagcaatggggaaaggattcccttttcaataaatggtgctgggataaccggctagccatatgcagaagattgaaactggaccctttccttacactatataccaaaattaactcaatatggattaaagacttaaatgtaaaaccccaaactataaaaaccccttgaagactgcctagacaatatcactcaggacataggcacaggtaaagatttcatgatgaagacaccaaatgcaaaaattggcaaatgggatctaatcaaactaaagcgcttctgcagagcaaaagaaactatcaacacagtaaacaacctaccgaatgagagaacatttttgcaaactttgcatctgacaaaggtgtaatatccagcctctataaggaacttaaacaaatttacaagaaaaaaacaagcaaccccattgaaaagtgggcaaagaacacagacatttttcaaaagaagacatacatgcagccaacaatcatatgaaaaaaaagctcaacatctctgatcattggaaaaatgcaaatcaaaaccacaatgaggtaccataccatcttacaccggtcagaatggttattattaaaaattcaaagaataacagatgctggtgaggttgtggaggaaaaaaaaaaacagtgtatacactgttggtgggagtgtaaattagttcaaccattctggaagacagggtggcaagtcctcaaagacccaaagacagaaatgccattcaacccagcaatcccattactgggaatatacccaaaggaatacagaaatcattccattataaggacacatgcacacatatgttcattgaagcactattcacaatagcaaagacatgcagtcaacctaaatgcccatcagtgacagatgggctaaagaaaatgtggataaagaaaatgtggtacatatacgccatggaatactatgcagccataacaaggaatgagatcttgtcctttgcagggacatggatggagctagaggccattatccttagcaaattaatgcaggaatagaaaaccaaacaccgcatattctcacttataagtgagagctaaatgatgacaacacatggacacatagaggggaacaaaacacactggggcctattggagtgtggagggtgggaggagggagaggatcaggaaaaataactaataggtactgggcttaatacctgggtgatgaaatagtctgtacaacaaacccccatgacacaactttacctatgtaacaaacctgcacatgtacccctgaacttaaaataaaagctaaaaaaaaaacatgtgttgttgcttaataaatgatgctgagataattggcactttatatacaggaaaaaaatcagttctctacatcacgctattttttaaaaggttgttaaccttttaaacataggttttgacatagggatccgatatttcttcctctttaagaacctttaaaaaatagtgtgacatagggatctgatattttttcctctataagaaccttttaaaaagtag

SEQ ID NO: 279 - DNA, 37781 bp, Homo sapiens
gagtggggtgggggcgagcggacctcggcggagcctccggcctgaggcaggatcagggccccttcctgggggagtttcctgcctggtccgcccttccccgctctccccgccccctctccgggccgctccttgtatggtctgggcgccgctctctccccgccccctctcttctccctccctcctccttccgtgtgtccctccccgcccggctggaggctgctccggaccgggacgcagagtctgcggacccggcgccgaggcggccacccgagacgcggcgcgcacgctccggcctgcggtgaggcgcggggagcggcagggcggccccacggggagggggcgcggggcgccgggagggggcgagtgggggtcaccaaggggagctgggaccgcctggggctcctgagcccggctccgcgctgcgtaacccggcgacccaccccagcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgcccccggaaggtatgcggcggggcttggggaatgtaccccggcaggagccggggtggggggcagtcgtttcgggaatttggggatgtctggaaaggttgttgccgagggggctgggcgcagccaccctgtcccgagcagatgttcttacctcatcgtggagctcgtggctgggagccagggctcctgggaccgttccaagtcccccgcctgggagtgggagtcgggaatgtggggcacgaatcttcccctccgggtccgttttccgaagtgtaacgggagctgcaccactcctcggcagtgcgcccggcctttcctgacctggtactcccagggcgccctgcgcccctcctttgcttccccacacgctctgggacccctgagagagttcttgggttaggggttagagcggttaactgaggggagcttgggtgaggggtagagggaccccggccgacgtctttctccttcctaccccagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacaggtacggaggcctgggaggggcggctgcactggacacccccaaggagaggagaagagggccctttcttcttacctcccctgcacctctgccttgggggtggggggatagaggcatggaataggtgctctgacctctgaccctctagcccagggagaaggtgagcagtattgatttggagatcgactctctgtcctcactgctggatgacatgaccaagaatgatcctttcaaagcccgggtaagggaccggagagtaggaaaagcagggctcagggccagagagactgggcatagaactaaggaggatggtgtcctcctgactgcatctctcttccctctcccaccccttgcaggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgagggatggtgataggacaaggcttggtaccagggcactggggcggggctgggtcaggagccagagcataagcataaggtgattggagagtcagggtggacacgggggttgcggggtggcgggataggaattttcatcctctggggttagcctggtggaacaatggtaggaaaatgctcctctggaggagaggcctggctgggtgtggggctgggtggggcctggctgggacggcgcagagagcatgggctctgaattaggaggatctggtggacctttccttgtgcctttaccccagaaagttaaagggagggatgagatcaccagttccaccttggtttttcccattcttgggtcttgagttaatctccctgctcctctgagcactctttctgcctgagggcttggaggtaagagacagccccagtaaacactggttgagccagcatccaccacgtgccaggcactgtgctctgtgcccaggagggtaggacatgggagggaagagatctctgcaagaagctcagccttcaggtgtcagatggacctggaatggaattcttggctcagcttctcccaagtccttagactgggcaagttaggtgaaccctgagcctcagtttctcaatctttaacattctctactccatacagtggttgtgaagattgggtgagctaatacctagagagtgttgggttctgtatctagtacaggaatgctcaaaatagaaaagctgtaattacaaaatggttcttgccttctagttcaggaaataagatcgtccaatttctggtgacgaagatgaccctgatggtcatctagtccaagcatccagagtccactgatagtgttgatgtctacctacactcggacacagcataggaagaaatgccaagggccagtgagctttgcagaatcctgtgagtcacaggcactcagaccagggagtcaactcggggagtcaaattaggaaaggcttcgaaggatgggcaggacgtaagaatccagagaggagagggatgtttggagaacagaaagtggaaggttcctgtaggaaaatgatagagctatacttggagaggcaagcggggctggagggtgtaggaggtgaagtggctcacccaaggagctcttgagcactggagaggcattcatgatttttgagtaggtgtggggtgggtcaggagggctggtgaaagcagtgtttttggaagctttctggaaagtttcaccagcagagatgtgtattcgagggaggtcagtgatgggtgtgaattcactcttgggcaatagtaatgttagctgcaatgaaaattaaaccgtgcatgtgagagctgtgtgctagagctgttgggaaggcacagcctccaggacttagcaagggatgagcaattggaagacaagggtgaggggaagagggaaaaaaaagtctccagcacgatttggagatggggtgtgggcggatggcaggattgctgacaaaatagagaagtccagaaggggaaatggtttggacgggaagaggaggggtccagctgtcaacgttttgagcaacaggtcccaggaggactttcagctggggccgtcattcagctagaaatccagggctaggtttcaggagagggccagagatgtctagcatggtagtggggcacagtgacactgtgacgctggagggtcagggtcggagcggaggagcttcccagggagtgcagacagcggggaccaggaggtgcgggaagaagagtcaggaggagagtcagggtgcacttggagaagagagctgagctcctcagtggggtatttgagggagtgaggactcaaggctagagattagactgttgggaaatcatcagcggtcttgggatggcctgtttgtgccctgtggtgggaacacaatgtgaggagttgaggagagagtgggtggtgagaagtggggctgctggtgtagcctggtcttaaaggactaagggaaggactgtgtgtcagtggtgtgtgtgtgtgtatatatacacatatgtgaatatatgagtggcgtgtgtgtgtgtgttagtgtgtgggtgtgggtatggtgtatgtgagtgtatgtgcatgtgtgagcatgaatgtatgagtggcgtgtgatgtgtgtagtgtgattgtgtgaaagtatgtgtatatgagtacatgtgtgcatgtgtgagtgaaggtgtgtgcatgtgtgagtgtggctgtgatgtgtatggtgtgtgattgcacaagtgaaggtgcacatacatactttcttacaaatacacacaagtggcgtatgtgtatatatgtgagtggtgtgtgtgagcgtgtggtgtggtatatcttttttttttttttttttttttttttggagacggagtgcaggctgtcgcccatgcttactacaacctccgcccccctggctcaaacgattctcctgtctcagcctcccaagtagctgggattacaggcacgttccaccacacctggctaatttttgtattttttagtagagatggggtttcaccatgttggctaggctggtctcgaactcctgacctcaagtgatctgcctgcctcagcctcccaaagtgttgggattacaggtgtgagccaccgcgcctggcctggtgtggtattatctgaatgtgagtggtgtgtgtgtgtgtggtatggtatatgtgtgagtgtgtgtgtgtggtgtggtatatgtgtgagtgtatgtgagtggtgtatgtgtgtggtctggtatgtgtgtgtgcatgtgagtggtatgtgggtatgtgtgagggtgtgtgtgtttgagtctgtggtgtagcatatgtggtttttgcaagttaggggagaagggctcaggtacgtgtgtaacccggggaagcaggtgatggagggtgagtgttgtgggagagcaggggcaggctgcttcggtccctggaggagatcttggtgatgtctcctcccccagaggcataccagacagcaaggacagagtggttgcagcgtggataggaaggacgatgagggagcttaagctggctggcttccatgtcctcaaccatgtgggaggtgaggtcacggtgcgagcaaagggacgaagcaggtgggggctcaggagatggagaggtctggaacggctgctgtggggaaggctgggctggaggtcgcgcgggtgctgcagtgttgtgagctcacgctgcagtgttcagtgatctctccactgctttctgcagcttggaagcagaaacaggaagagggtggtggtgtgacttggggttggagactgggccggatagctgcgggtggctgcaggtgcccggagggacagtgaaccctgtaggagttagatggtcatgggaccaggctggggcatggtggacaaagtccaggggtgggttgcgggtgggggcaactaaggcttttctgggttcatgtagtaggtgtggatggggaagaggagaggcagataatggctggcaagagacttggaggtaaatctgaggtcaaggatgtcccatgatggatgatgactgagatggacggaagtttggtttgaagcggtggcattggtgcaggctggcagagggggcagttctggatagagtgtcctgatgaatggggatacccatgggaggtgatgcagatgaggattctgtgcttctgaaggaggagccaggcatttagaatggcactggagagcaaggactgactgagccccttcactgtgtccccaagaggccaggaagggaagattggaggagacaaagttgaagtgagtgttccagggaacgagtcagttaagagatggtaggatcttaagggaagatggctaagatcttaagggaaaatggctaagatctggagagttggacttatatggacgcatgcttcactgggcagaaaggacgcaactctgggtacagatgggggtcggggtgaggggcagtgaagccagggctgaggggagaggggctatgggaggaggtagcaggggggctttggaggttccaggtgttatgggaatgaaggcatctgcaggtagcacactcagtgatggggccacagtcctgggtaggcttttccagacatagaaaagacccacccagtgcacttgctcctgtgggcgtgtctcccggcagtgctgatgcaggtcagacagcccttcccggagttctcagggttacctctcagggttactggcagcgctgtccttaacatccaccccccactccagtccccgggatcccctaaatgggaaggttgggctggcctagggggtggcctttggaccttctctgaggctgctggggagggacctgagtgaggtagttcagaggcccctcactcgagggacagggtctctgtgtgggggtggggctgggttcttgcagacagctcagtgggtttaacctgcaattcctgcctgtgttgtatcctcacgctgacaggggctgctcagcagcaggcaggccgggtaggtgtgtgtgcgcgtgtgtgcacgccattgcgtgcccctgtcccatgggggcgatgtccgagcatgctctgtggagttgatgcgtggccctggagtgtccggtgcttcagtgacccgagctgctgtgtgcgtggcctccgtccgcccagtcattctggcctgtctgtgactgctcagggggtttgggcagagtgggtggaaatgtcttgctgtacgagatccaggcttaggtcccttcccctgttatttgtgtggtgctggggatggcgggggtagggggacgagggagaagctttaagggtcaagcctgagcatctgggacacgagctgggagctaagcctcatcggaagaagccgggtaggctggcctgggaaggttcttggaggcagcagccctctagagtgtgaggaaaatgttgggattgcaggtgcgctcccctggggccccagggcccctgactctgaaggaggtggaggagctggagcagctgacccagcagctaatgcaggacatggagcatcctcagaggcagaatgtggctgtcaacggtgagcccaccccaccgggacacccccaccctgcccccacatcacggtgggggccagggctgtggctccactccctatctgagctggctgatccctcgcagctctacatacttccttctatttactgctgtcttctctggccttcccagaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgtgagtcgggctgtgctgggctgtgctgggctgtgctgggcagtcgggccctggaagcttgctgtggggtgccggttccctgccaacctcctcctgctgcctcctcaggacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagtgaggacctgccacctgccttctgggttcccggcgtgcttggtctggtagcccggctgcttgctaccctagcctcaggacagccccaaacccctggtggtgttttctggtcccatgtcctgtctgtaaacagcagggaccaagtcatcgggatgtagctgtccaggggccttaggcctgggcatcgagtcctgctgctgtctggtccctccctcgcccttgatcactgaagcttattgtgggtgtatgtcagcatttcgtgaagtgtgctggagtgacttcatctcacacacaggctgggttctaaaagttcttttggagatcagctgtttggatttctggtttctccccagaaatagtgtttagaaggtggctactttttcaggctgacccgcagaacctcagtgcagctgtgggaacagtgcagaatctgacccccacctctgacagagtgtttgggtaaacactttcaggattccatctggggtggccacaacttcacatccctccacagtgccagacagtcagggcagaggcaacgtgcatgggggtgggaggattgggggaaggtgagggtcagggacccaggatgggatgggaggggtacctcagggctggctttctgcaggagctgcagtgtgaatgggacagtaagggtcgagtgggagagaacaccgtggcaggtgtgtgggaggctcccttgctttgggagagtgactggtgaggcaggaaattccctttgatgagggccagtcatggtgtctcactcttaggcccttctggtgagcttccttcacctggagatgcagggcagagaagtctgcttccttgctgcccaacctggcttatgcgtgcgcacaccggggatgaaagccctggctaactcggctggccctttctgccccttccaggcagtacgccccgaggtgctccgtctgctctgagcccatcatgcctgagcctggccgagatgagactgtgcgagtggtcgccctggacaagaacttccacatgaagtgttacaagtgtgaggtcagccatccctctggactccttgggcaggttctgaccaggaggtggcgggagatgctgcttactaactgggaggtggaaagcaccagcattcaggaaacagggctgtgattttgagggtggctcatggtggcaccccatctgtcctgccagaatgcttcctgccactgcaggaaatggggctgtggggcttctgaggtcactttgagtcatggataagccaagaaatgggacaagccaataggagagaagaagggcatggtgttttaccgtggtaggggatggggaaacaggagctgagagaagaggtcttcgaatggaggtgagccaacctctattttattagggtggtggtgggcaggggagcaagcaccttgggagcagctctacccactgcttgccctcttgcaggaaggtcctagtgggtgactggaagtaggatagggatggggagttgggtgtggctggaaaaagcgatgacaccagctctgagccatgaagcatctttctaattccaagatggagctggatggggtggggtagggtggagcagagcaggggccttccggtccagtgcccctcacccttccttcttcccaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccagaattctcagtagtcagctcttttgtagtgcctgcagccctcatgggtgggatggaggcagaaaatcagttcctgtttatttacaaaaatatatatatgtgtatgtatgtatatatattaacccctcagctccctcccatgatcatccttttacttctacccccacctcccttttaaaacaaagaggttttctggggtgcagagcagggttctcctgaaagtgggcagaagcagcaccgatagcctagtctggcaggttgtgggaaggggcgcagggagtgaccatgagcgaccttggccccgtccttgctccttgcaccctgattgggcatggggtgagaggagggatcagtccttgaatccctgaatactgcaaagaatgcgcttctggtgcccgggcagtgtgattcccatctgcgtcaggtccctgtgggcaaggaagggtgggggcatgagtccggaggctccacccccgcagccctcccctgcccagacagctccagctccttactcagcggtcagctccagcacacactccatggtgtccagcccagccgagtggaagtgcaggatgtagcgtttcatgcgtatggactcgagccactcagagacggttcgatatgggatcccatctgagccactcaggctgggcaggcgaagagtcatcctgtgggacatgggcatgtcagtcacagcgggtacatgggctgatctggttggccttggcctctgagcatcagcagccagcactgaagttcggtgtctgggcacagagatcatctagactgtggattgaccccaccattatctctgagcccacttcctggcctgtttcctggtgtgctcacaacagtggactggctgacagtcctgctatgtcgacaggcctataggaagggactgtcctgggaagccccaacagaaggggatcaccagccggtctcctgctggagtggccggttctgggcacctgactgagggctggttaagacatggaagtctcctgtctgagaggaagctgaaagtaggagaacagaggcctggcacctgggcgtggtcctgcctttttccatagtggctgcttgagttccgggagcagtccttcctcaccaccttcagcttcggctgttattcttgcactctgacacccacaatacaatgagtgttcctgtactaaagctcgccagagccaaaaaccattagcaaagtaaatctgctgggggaaaaaatatccagcattccagaaagattagcacacgcagtctccagtgtatgagggagttgcgctccaaaagatagtttcaaaagttggaacttagagcatgttttctcccagaaacaaggttatatatggtggttggatacagaggccagttggccaggctggctacccaataaagcacttgaagaacagccttgcctgcttccccaacctgagcgctcccccacccccccatcagttcattctctacactcaggccatatttttggtaaaatgcagctctgaccatgtccccccatcctgtggacagcttttaagaattggttctccaggccaggcgaggtggcccacgcctgtaatcccagcactttgggaggccgaggtgggcggatcatgaggtcaggagttcgagaccagcttggccaacatggtgaaaccccgtttctactaaaaatacaaaaattagccgggcatggtggtatgtgcctgtaatcccagctactcaggaggccgagacaggagaatcacttgaaccctggaggtggaggctgcagtgagctgagattgcgctgcgttactccagcctgggcgacagagcaagactccgtctcggggtggaaaaaaaaacaacaactctgcactcatggtaaaatccaaacttctcaacagggctggtcctctttgtgttgactggttgtctctccagcctcatggctgctattcctaaacacaatgccgcagccatcctgcactatctgcaacctaccagccctcagctccccacagactagccatgtgatccagaagccttcccaaaccctgcaaggctgctgctacctaccccaccccagcctggctgcccaagctccctggagcttgggtaataagtgcagctgtatctccaatgtccagcaaacagcttgcaccagtaggtcctccaaaacttcatgaatggatgaccctttccttcacatgcagaaatatttctatggggaaggggatgcatcccaagaatgggccacagtacaacacagtgggattggcaaggatggctccgggagtgtcttaggtgaggctgcctgagaagagaaaagatgggccccccacccccaagcccaggtgaagtgagggaactggggcccagccataactgattttctgcaaatatgcataatctaaagctgacctcttggactctccccaagggcacgtcttgcctcatacactggacttggtccagagctccccaggcccagcgctcaaagaagattggctgaatgcccatttccactctcctagcgctgcctctgggttccctagtccttcccctgcatggttacctggggtcaaagttggcaatggtccgcagggagtgggggttggcaagcagttgctccagatgtgcctgaagcttctggaagtgtggccggcgggcacggtcatatgcccagcagttcttcatgagctcatacagaggggcagggcagtccacaggagggggcaaccggtacccatcctcaatgctcttcataacctgcacggcgggacaggaggatgctctagagtagcaagctaacctggaggcccatgagaaaccgacggtcacacaagataattgcagtggagatcctaggatgggaggaggtgggaggaccagggtgggacgatcacagtgggaggatcagggtgggaggagtaaagagagcagggcatgaggtgaagaaccagaggagccaggagtacagaaaaactgaaggtcatgaataaataaagatatttgcaggaaaaggccatgggaggaccttgggaggaaataagaggtgtgaattggagacaagatgaggaagaatattctgggctcacctcctgattgctcatctccccataaggcttgtccccaaagctcagcacctcccacatcacaatcccaaagctccacacatcgctggctgtggtgaagatccgatgggcaatggcttcaggggctgtccaacggatagggatctttcctccctaagaaggcacatgggtcagggacggaaagttatggtgtccacctgagcacgagtctttctgcttcttttattgtatttttattttattttttttgagacaaagtctcgctctgttgctaggctgcagtgcagtggcgcaatctcggctcactgcaacctccacctcccaggttcaagcgattctcctgcctcagcctcctgagtagctgggactacaggcgcctgccaccatgcccagctaattttttgtatttttagtagagacggggtttcaccatgttcgccaggctggtctcgatctcctgaccttgtgatccacctgcctcggcctcccaaagtgctgggattacaggtgtgagccaccgtgcctggccaagtctttgtgcctatatacatgtgactgtatgaatggcatgttacggggcaatgtgaatgtgcactgggtttgtaccggcctctaacctgggtttcgtatgtgccatcaaagtcatccaggaggcgagtcaggccaaagtcagacaccttgcagcacaggttttgattcaccaagatgtttctggcagccaggtcccggtggacataattgtgattactgaggtagttcatgccagatgctatgccctgcagcatggccactagctgcccagggaccagctggtcctcccgctcctgcagcagggtgagtgggtgagtcaggggatgggccaggtctcctcccagtgcccagggtaccatggtgcatccccctccccagctagtcctctgccctcctcaccctcaggaaggcatccagggctccattctccataaattctgtgatgatcatgatcggctttcctgagacacagacacacatatcacactcagaaccgggcttcctgcccttggccacacatcctccctccacttccagtggtttcacccctctttcctgcatttcccgcccccagctgagggagaccactcatcgtacgctttgtgacgacgccttccagatgcagaatatgcgggtggctaaactggcccatgatagttgcctctcgaaggaagttccaccactggccacctggggatgtgtcttttaaggtcttaatggccacagtcttgcagtcctggctggggagcctcagggtccctcgatacacttccccaaactctcctgggtagaaagaaaacaggctgtggcccgatgcactgcagggctcctccaggggacaggcagcaacccctccagtcctccggcccttttcttttctggagaatcagaagcgtggagtgcccttcctgggacagggcgtgggctgtccttcctggggaaggtcagagtctggagctggagtgcaatgccgtgacctattcaccactgtctcccagtgtttgcacagttcttggctcacaataggcgctcggcaactgcagggtgaatgaaccctgtggagcgggactgggccgtgctcatgaagagcaagctagtgcggcactagtacccaagtggcagggacgctggctatggccgcctctcttctgtgagctcctctggtcccagcttgcctggctcagctgcacaattggcaaggacaccaccaagctttgttctccactgagatccatttcctctggtgacccaagggaacagggcagcccaaggacactgggcctctgatggggtggaatgccaggctagggagggaatgagtcctacatttgggcatcatcacagaacatctggaccctcagcacagcagcacctctgtggatgaaaacagtgtatttaatgccctttatcagaaactccaaaaccacagaagcaagtgtgtaggagacaggggttgctccagggcacctgatgaggggtttttaacaagaacgcaatggttcaaagaggatacagagcagagcagagtgagtacctctggaaactcttggaccagagaagccagctgggctgcccagggaagcgctggaaggaaggggcctgctggtggctctgtgctgccccacatggcggggggcctgctgcggtgcacagcaggactcaccttctcctatgacagtgtccaccatcagccacgctggatcaagctcccgggtaaagtccagggctccctgtgcagggtcctcgtatgcctggaggtccacataaggcttcagccacagcttgtcctctatgggcagaacatgaggttggggagtaccaacatcagggctcaggagtatgggggtcaggagaagggccagcagcggaccacacacttctccacacctccctgtttcccaaggtgactcctgtttgggctgaggtgggagaaagtctccatttagcaactaggcctttcttctccctgtctatgctccaagctccgctgtcctcactccacaaggtccggggcggtggccaggatccacacccgcagagcatatttgctgcctgagttgcccaatcttctcagcggccagtccccacactgctctggtcagtcacacctcgttcacattcccagacagagccgcgcatggctcccaccccagctgcccggatggacccctcactctcccctttgtgggtcacctaatgaggtgacaagcaagaagctcataagcctcggaggacgtcaatcctcctcccgcctggcctcggcccacagccctggcctccaggatggggagggctgtccagagcccagggtgacaagacagcggcaccagcagtgaacggacactaacagataattgcatcagagccactggggggctaccagtacatagttaattaaccaaagttaattaggtagcaaaacacaagagccctggggacaacaaaccccacatgtgcccccagagttggcctagcaaatgtgtcccttgatcccttcccagtggcatctcccaacacacacacacacgcacacacaggtgtgcacacgcatgtggggacacacgcaggtgcacccgactcacctcgatccacatcggtggcgcggtcacgctgcctctgctgcctctgccgctgggctctcctgtgggggttggggaccagctccttcagggccccaggaccacctcaggggtccgagggactctggctgaatcttccccagaaacgggctgggagtgcaggatgggttttgatactaggggatgggagggtcgttggggctgcagtcaggggcttctgacccagggctggtggttggggagggggcaggagctggcacctggaccggaaaacgagaatcccaagcagcaaggctgcaccaagcagcagcccaaagatgacggctacaatctctcctccagtcaggcccctggacactgtaggcacaaagggatgaggaagtgttgggactcacagtccgtaggaatgaggggggttaaagggcagggccctgggtacacctagggtcagacctttcagtgtgcatcaggtcggtgtctgtcccctacccccggaagaagggagtgtgtgtgcatgtgtgtagaggaagaggaaaagtcactacgtggaacaggagctgagttgcctcagtgaggcaacaggtgtatgtgtgttggggcagagcacaagataccccacctggtgggctggtccgaaactcatgatcaggggagaaagggccaggacccagtggggtcagcattcggactctgacgatgtatgtggtgtcaggctgcagctctgtcagcaagaccctgggttctagaaccatctggtaccgttcttcatcctgtgggttggagttgcattaagtgggcagtgctgagccagacccgggtggatgtgatggacagcatcagagcacatggggaggggctggagagcagaatggttaggacagggttcttcatagacttttgtcctgagaaagccacacagtggacttcgggtggattcctcccaacccacaccccaggctaggaatgttggggtgtgcccgggcatggacactgaagaccatctctcagtagcatcctgacctggttcagcacgtgcagctcataggtcaggttcgccccagggcttcggggccgggaccccgcccaggtcagctctagttgcctcggttctttcttcaccagtctcagagacaggcctgacagtgactctgggggtccagagggataaggttggatatgtaaggaaaaaggaaataaccttagtaacttttctatggcttcctgcccatcagtttgttctgtggtcttaagcccttctgtctccaccaggtccctgtcccagcccctctcagcctctcacctgcatgccccatgctgatgctgactgaggtgctggcatggccagagctgcccagccctgacactccattttgggcttccacattaaaggtgtagttggcataaggttcaaggccattgacatgcactgcaggtgtggtgagcccccgggcccccggcgagaagtgcacgcccaccccacagggctggcagggccccccgtcctgtgctgtgccctgacactgggaacacctcacactgtatctgacatcctggcgtccccccgtatctgctgggggttcccaacgcagggagagctgagtccctgaggcagagaagctcaggtttcggggggccgaggggggacctgtgggagaagaggagccatcagtagaagccgacctcgctgtcacccgagctgctgatccccggcctccaccaccacccaattctcgatgtcctctgaagtcctcttggggagatttgatttctactgggtttgactacatctctgcattcttctagggagagcagggtgccagggcaggggctaaaagtgcctgacaccctggaccatctccaatatctgacaagctctggaaaaatccaaccctgacaaagtctcagcaaagatccagcccctccctccagatggccacgccccaccccctggactcacctgtgcatgccacctgggggccctccccgggagctctgtaatggccgctctcacaggtacagatggtggccccctcagactcagcagtgctctgctgggggcacgtgagacaatggggtgtgtccatgtccatccggtaggagccgctagggcaggctggagagagaacgcagcagagcagtggttctgtaaatgtttttacaggcagaaccaccaccaccccttcctgccccaatcccttctactggaaacatctctgcatgtgtgtgtccgctgctctgggacactcaggttaaaaacccactgaggcggagcactggcctccttctctgccggggtactcctgcaatcctcccgagtggttcctcaggttctcaccgcctccgttcttaccaacacatgcttcgccactgccaccttcctcatagccaggctcacagtggcaccgtcctacaggcaccagccactcgccatcagggctgcagtgcatgcggggtgcacctgagggcctggggctggcccgcgcgtggggcaagcaggtccccgccacttccaccaacccagcggggccaggcagagtgtctgggaattgggccaagccattcagggtctcaggacagcgctggtagaagacccggacagacaccagggccacacaggcacccgggttgtggaaagcgaggtagaggccacggcgggtcaggcggcccagagagcagcgctccacattcagcttcacggagccagacacaaggtctcgaatggtgaagctctggtctgcagccaccgtggttacctgggtagaaggtggggaagaaaggggagcaatggcaaagtcctgcttctttcccacataacagaaacaatcgtttgcttaatactttccacaaccatgaacactgagccttgtatgtgtgaggtgccaggctaagcattttatgtgcattatgctatttagctcatgcaatcctcttatgaggtaggatggcttattgtctctatttaatagatgaggaaaccaaggctaatagaagataaagaccttgtataagatcacacagctaccacatcatggggctaggactggaatccaggcattgggactctacagtccatacaatttctgctattcagaggcattcccaaactcagtgccaataacatgatgagttatagagcatatcgttatcaatttattactagtaacaaattttacaacattttctctttggaaagaaacaagagcatatcctatcataaaatgctccttactcttctgcatcccaggatgtttttttgagtaggaaagaaagggatgtgctggagagtactagcctgcagggaattgtcttgctacatgactccagtgatactatgggagtgggttgcttatgaacatcgtgggtatcaataggaaaagtctaaataactctgtgctacacttccctcctccccatggtatcctgtgatctcagtggatgcttataaaagcctataaaatagatatagctggccctattgttgtcactattttatgactaggcaacaaaagctggagaggttaaatgacacccccaaagtcacggcacagcagaaaagatactcaaatccagcccttctgatttccaatgccacactgttctttttttctttagagacaggatcttgctctgttgcccaggctggtgtacagtggcacaatcatagatcactgcagcctcaaactcctgggctcaagtgatcctcctgcctcagcctcctgagtcgctgggactacaggtatgggccaccatgcccaggtgatttttaattttttgcagagatgaagttttgctatgttgcccaggctggtctcaagctcctggcctcaagtgatcttcccacatcggtttcccaaagcactggaattacaggcacaagccaccatgcccagccttcaagcgccaaattcttttcaagattctacctctgcaccctcttcctgtctctgcaaccttctctggcacccaataaggagccaccagggatctgcaccaggacccagatggcatggagggaagcagcaccttctggaacaagggccgtcggagctgaatgcccacatcctggtcactctccatgtacagaaggttgaaggtctccttgcagcccagaggcccggctcccccagggaaactcttgcagtcccgcacggtgaactgcagctccacgtggacgcgggaagcctcctccccgcggtagatccaattggagcgaagccagtggtcagtgtctctgcgtccttgcattgggcagtcctggtacatgtacaggggtgtcccattcagtatctgttgctgttcactccactgcaaggaggaaatcagagtcagggaccagatcatcccctgctccccaaacccttggtttttagagctgatggagaagcagctgtgtcagagcccctcaggtttatgctacttgttctgcctctccccacccctcagctccaggacagtagactgagtgtttagggttggggatttgtttggatataagatgggcaagacaatagtcccttaacatccctagttgatcctggtcccttcagttagtctagtccacttatttcatcagcagaacagccaggtacccccaaggcaaagctcatttacaaaacccttctgtttcttcaagaggatattggtgaattttttgtttttcagagacagggtctcgttctgtctgcagcgcagtggtataatcaaagctcactatagcctcaaactcctgggctcagtctcccaagtagctgggactacaggtgcctgccaacacactgggctattttttctttcttttttttttttttggtagagatgagttcttgctatgctgtccaggctgatctcaaacacctggactcagatgatcctcttgcttggcctcccaaagcctgtgagccaccacacccagcccaagatttatttttaattattaaaaccctttagatttggagggtaagaacaagcacagaactgtacagaggattctcatcctctccaatatttcaattatagccatcatcgaaatcaacaattgacagatttggctggacttcttgatactatctagtctactccccttaactttttgtttgtttgtttgaggcaaaggtctcactctgtcacccaggctggagctggagtgcagtggcacaatcttggctcactataacctccgccacctaggttcaagcgattctcccacttcagcctcctgagtagttgggattacaggcatgcaccaccatgcctggctaattttttgtatttttagtagagacaaggttttgccacgttggccaggctgttagcttcttttatctgaaaagaacttttaaacttagtaatattaatggctagcactaacatagtgcttactgtggcccagtcaccggtttaagcactttccacgaggaaactgaggcacagggaggtcgagtgacttgccaaggtactcagctatgagaggcagagctgggaaatgagccagacactccaggttccagaattcatgcctttaatcattatacctctgtgtgcttattgtgaaaagtcaaaaagtaaagacttacacagaataaagtttaattccctcaccctcatccttccactctcattctcagaggcagccactctcagcaattgttagcaaaactttccagaccatttttcaatgcctccagagaactgcttgaatgtttctgagttttgctttcaacacgggatcatacaagtgttattttgtaagctactttctgttttcacaaataataagtatttgagggccgggagtggtggctcacgcctgtaatcctagcactttgggaggcccaggaaggcagattccctgaggtcaggagttcgagaccagcttggccaacaaggcaaaacctcccatctctactaaaaatacaaaaaaattagctgggtgtggtggcacatgcctgtaatcccggctacttgggaggctgaggcaggagaatggcttgaacccaggaggcggaggttgcagtgagccaagatctcgccactgcactccagcatgggcgacaaagcaagattccctctcaaaaaagtctttgaaagatagccacaaaagtgtatatagagctttcttactttttttttttaaagcaatccataagtaatactccattgtagagaaggccataatttatttagtcccattcacctattgttggacatttagacagcttctagtttttttttctttttaaagaaatcatgtacagattgatgtaagatttccatggaactgccatatcaaagggtagacatactacaggttttataagatactgtcaaattgtcttccaaaaaaggtttatcaatttacacttccaccagcaacacaagagggctcattttctcaaaacttcatcaacacagaatactaataacctttttgccttttgccaatcctagggtcaaaacacagcttcttagcattttaatttgcatttcttagaggaggaagttgtatatttctcttttgttcattgactatttgtatgtttatgcaattatctgtctataacctttgcatgacattctattatcttttgattactcagttggatgagtttcttttttaaacttattatagacacgaatcatttccttcaaatgtatgtttcaaatattttctccctgtctgccataccacttagctttgctaatgatgttttgatgtggacttacattgtaaatttcttacataataacatctacagtatttcccttcatgatttctgggttgtatatttgacttgggaagttttcctatctcaagattataatgatctatattttctcctaaaatttgtgtaggttggcttttaggttgagattttagttttcttagaatgaattttgtgtataatggagagatatatcttttttttttttttatgagacagagtcttgctctattgcccaggctagagtgcagtggtgcgatcttggctcactgcaagctctgcctccagggttcacgccattctcctgcttcagcctcccaagtagctgggactacaggcgctcgccaccatgcctggctaatttttttgtatttttagcagagatggggtttcactgtgttagccaggatggtctcgatctcctgacctcaggatccgcccgcctcggcctcccaaagtactgggattacaggtgtgagccaccgcgcgtggctatggagagatatatctttatatatttatttaaaaattatgaatatctaaccgtcagtttattaactaggtattactttccatattgatttgcaattccgatgctatcacatactacaacctcatatgtgtaggctcgtttttggactttctatcctgtcccattaacctgagtgatcttgtgcaagacatatgttttagttatagctgatggttctgatatctgcttgtcagacaagtctcccatttcattcttcaaaaactcttctcaaccattcttatttcctctgtcagatgaattttcaaaagctctcaaattctataaagtattctattgatatttttgttgcaaccccataatttaatgcagaatagactgaggcccttagaaagttcactttcctgaggtttctactccattataatgcaggggccctcatccctaccctcagctctgggaaaaggcaaaaaaaaaaatcattaatcaaaaatttggggtgaggtggggcagaaatagaagctgctatgaggcacatatttctgcattatgttagggagttcaaagattgggcaaggggtgtctaaaaggcaaggaagctggaatgaaaaaggcaccaggaggcttctcctaaggaaggctgtgctggggaagcccaagtggaaggcactggcgggggtcaggtgggcagggtggtgagtggttaacgtgcagctcattagccagattgccgtggctgaagctggagccaggagaagcagatgttcccagctgtgccttgcctctcccagttccagcagtgacagatgggcgagagccagctgtccaggatcagcagtaaggatccttttgcttatcactcaggcgctgctggctgccacatgggtgcattctggacctgaatgcctgcgtgtgcatgtgtgcgtgtgtgtgtgtgtgtgtgtgtgtgttttgaaaagatggggagaaggagggggacaaggtagatagtgggagtgtatgactgctggctgtctccttgccctcctagcatgcaggactgttttgcctgtgctgagaaagtggccttgctgccattccagtcaaattagggaagagttatttgggtggaggtgtcaagggcccaaggaaggcccatgggagccagaagtctgacctgcagctatcactgtgggtgattagctgatttatgagataagtcaactattagggctggatcttccaaacggcccctcctggaggatccactatggtttagtctattagctctaattacaggctactctgtaggagaacagagaacggagccaggactgtaggacccagagggaaagaaagcaagtaaccctgaccccagaaacaggggctggattgaagtctcaagtactggggtaaggaaggaaaccctgagagaaggggttccagagccagagttgtagatgctccagtaacttaggcagccccctaagtggttctgtgaccagctgtgctgctggcagaaagggtgctgtgaattgtaaaatatatatttggtctttgtccacatttcctggcaaacaacccctaaagccctcaaaatccctgaagtgacaaatgtctttttatatgctagtgagctgactgccggggatgggaactagactggggtgggggaggcctgggtggcagaaggcaaccttgtgattggagttgggactttcggccccacccccaacttccagggaaggtagagaggttgaaggttgagctgataaccagtgggcaatgatctaattaatcacgcctatgtaatgaagtctccataaaagcccagaaggatggggttgggagggcttctggatggccatacatgattaggtccctgcagggtggctcgcctccttcacatataccttgccccatgcagctattccatctggtgttcatggtaccatttgtaataaccgttatagtaagccagtaaatccaagtcaatgtttccctgagttctgtgagccatcctagcaaactaattgaacccgaggaggagggtcaggtaaacctgattacagccgatggaacagaagtataggtgacaacatgttacttgtgattgttgtctagaggagggcagtcttgtggggctgagccctcaacctgaggctatctccaggtagatagtgtaagaactgaataagattagaggacactcagctactgtccactgaagaatctgccagagagaactgactgcaggcgggaggaatccctacacgcattttggtgaccacaggtcaccgaagtgatttgtgttgagagtgcagtaggaaaaaactgagtttggttttttgtacatcataagagctgctctctgcatttgagtctgaatatgctctctcagacccacctcacaacctgttcactgagtcttaggaacatccaaggaaggaagggaactggaacaagctctgacactttcaaacagctggaatgcatggtgtgcacgcagtcagcctgaggaggtgtggaggatgagctaagggctcagaaacctttaggggagcagcttttaacttcggaggagtcaaagaccctttgaagaatttgatgaaagctttggctggtctctccagaaaaaaaaatgcccgcttacatatacagaatttagagtacactttcatggggtttccccaccccctgaaacctatcaatgcaacttcattgggatgaatggatctcagattgaggatgcttttctgccttttctatccctccccaagcaaagcactggtctcagccttcaaccatccccagcatggtgcattctctccccgggtatgtgagctcctctccccctcacaagtatcagcttgtattcacaatattcccaagtattcactggaggagccaggccattcaagcgttcatcttgaggtgaagtctgacccccccaccccttgtcccattgaggaggctctgactcagcctcctctccccctccctgaggagacacttccagtttttcctgctcttttctctgttcctccacccacctctccaccccatttcccactggccttcaggagttttccaagatccttccctcttccgacacttaccccatcttttgggggatccagcagccagcccagctctccctgtgccttgcttgtgtccatcagagtaactgaaagtggggagaaaagaagtctgtcacctctgggggaggaggtgcccctgcagcccacattaatcattctggggcctcagccccaggctgcaacatcctgttcctaaaagctgtgacttcctgaggcttaggggagaaaaagggctcaggactgaggagtgaagagctccagggatttcactcttctttgtgtgtgtgaaggaaggcaggtagagtgggacaagggttggggcgctgggtctttgaccaaagtcaatgcaagaagagcagccccacgagacgctcagttacccaggctgctgcgtcctgggacacccatcagctgcaggattggaacgcgtggagggcaggaggagctcacctctgctagccaggagtgggcagggtggaccggggacctcagaaggggtttcctgggtagggaggctcacctccactgtccgaagcctgctttggcctgacctggccagtgatcagagccgtgaagtggggataagaggcacagctacctgcctgggaagtgggggggagtaaggccggagagggtgttccaactttcacatggaatattcgactcggacaactgggaacccctgtggcgtcagtcctaacccttctcccggaggcagctccctctgtccctggcctaggttggcaggaggcgacttcccaccttcaacttccaagggctcagatctctggggtgggcacctgaagctgggactgtctgggaatgcaggcaggggtgcgggtgcaggtgctacttcctggcaagggtccggaattccctccccactcccaggagcagattgctggcctgcgggagtgggggtgactgacccgggagagcagccgcttggggttaaagaccaaagatgggcctggccagtcgatagcctggcggtcgggcacagcgagagagctggcgagggtctcggggaacatggcccctaggaatgccggcttctgcaggggggtgctggccgggccccgggaaggggcggggcgcgggggttgggggcgcgggggcgggggtcggtaccttccttggcgcgcgcccccgggggcagcggggcgcagagcagcagcaccagccctagccccaggggccagcgccgctccatagctccgggccgggacctgggacagtggcccggatggcagcgccaggttgcaagggactaggagagccgggcgggccgggcgggggcggggggcggggccagcgccgggggcggagtcccggcctcacctggttcacctccttaaagggacagtagggcaggaaagaaacttgctagactggtaatcaaattcaagaaccggaggcgtcttgacccgaatgagactgcgggcgccgcctagtaggtgggattaagaattgacgaaccttttcccaattctaatcctaaactcaacccaatcttgatccagcttttaacctaattctacctctgacttgaattacactcctatattcctctttctgtctttgtgcaggccccagagctgggtaatagggccggggaaggcaaggggtaagagtcatatcttcaccctctagcaggggaggcttagatgaccacaatgcaaggtggggtacaacctgcagtgaagcatctggagattagaagaggaagcaagcccagtcatcggggcacattagttgagtcttcagggagagctggtgtgacctgggttttcagtggcagagattgggaaaggcaccagcaagggcctgaaggcagggagcctcaaggtgcgcccagggagtggtgaatggaccagtttgactgctggggcgcaggatttgtcttgggaatcagggcagaaaggcaggtgtgggccagggctgggtaaacaagaaaaggagtttgaaccttgacatgcacttacacagcagacatgaatatctggttaaggttccagccacaggtggcagggaaggatattttaacccatcttagtggtgtcaaaccacgtgccctctcactttcttgcggacttccttatattctttttcttttttgagatggagtctcgctctgtggcccaggctgcagtgcagtggtgcaatcttggctcactgcaacctccgcctccctggttcaaacgatcctcctgcctcagcctcccgagtaactgggatcacaagcgtcaagcgtgcaccaccacacccagctaatttttctatttttagtagagacggggtttcaccatgttggccagcctggtgtcgaactcctgaccttaggtgatccctcctgatctcaagtgatctccctgcctctgcctcccaaagtcctggaattacaggcctgagttactgcgctctgccgagactttcttatattctatttagtaaatgtttgttcagtttctgctatgcatgcaggaagctctagaagcacctaagaacagaaggacaatgtcttgccctatataagctattaatttggggatgctgggggttgagacataaataattgcacaaatgattgaaatggcgggcaggagtggaccccaggcaaggtacacacagggatcacagtagctcaaaggggagtgatgcatttactaaagaggctgggggtccactcctggcccctccttctttcgctccatcccatctgggtaaattgttcataatttttctatcatttacattgttgcacatttcggtactgtgaatgaagggaggtggtggattataggtgctttttctcattttcaaaatgtaatgcttctcaggttttttgttttttttttttgctttcttatgcagatacgtatatgacaaacacggcccatcagttcttggctcagactatccttatttgcataaataaatgtaattcatgtacattggttaggaaattcatgttgaacatacagaaacaaaatgggaagtagaaccctctgccctccaacactctaatttctgttccccaagttaaccaccatcaactgtttcttgtaagtcctcccaggattgcttcctcgctgtgtacacaccatcgtgtatttttccctccctctctccctctactcccacacttacatgcttttaaaatgtgtatacagaggggccatctgacacacattgctctgcaccagaggcctcttttctaatgttaaagactccaggaaggaggaggaggctcacgctggctggcgggggtcagagctttgtgatttcagcagggaggaatgggcgaagggtacaaagccaacagaaggggggaaatggagcaagcgttggacaattgctgctaggacataagccagactgtggtgaggtaatgcatgtgcttgctgctgcagtttgttaaagttacaagacccttgggactccagagggtggggggtggggggtgggtgtgtggagtgggggagactgctccatgcagtgagacatggagtctagaaccctggaaaaaaaagtcttgctttttgttttaggataggctctttatcctggtctgaaagtctctgcatatggggaatgaatgtccactttctgtctcctttcaggattatcttgatttgacattttctggttagtttgtcatgagaggaggcacatcttcaagtttagtctctgttcttaactagcagtacaacttttgtcaaattatttatgttctctggaccatggtttcagtttccctagacctagatgatttctgaggctatattcagggatggtctcagaaaataaaaagctagcaggattttgagtcaggagactttggccagttcccttagccataatgtgcctcagtttccttagctataaaatgagattaatcacgtccaccccacagagtcagtgtaatgatcaaaagaggagaaagtgctttatgaactgtaaggtactgagcaaatgttaattggctaggagaatggtggaggctaggaattgctggagttctcctgcaggcctcccagcttgctcccagagcagaacaacctcaattactaagacatcattatttttccattccaaaatcaactttactgagggacaacttgcataaaataagttgcagccattccaagtgtacggttcaatgggctctcacaaatgtatatgcaccaccacctcagtcaagatgcagagcagtttcagcatctaaaaacattcactggtgctcctgtgaatcaatcccacctccagccttagggtttctgtccatttgggtgagttttatcctttccagaattttatgccgtctctggactctgggtctttctctttagtatgatgctcccaagatccatccttctaagactcatccttctaagatccatctttcttgttgcctccatcaacagtttctctttttcgatgctgggcagtattccctatagagatgccctaagacatcatttaaaattacaaaatcaaaccccaaaactcctccttttttttggtcccctaggaaccacaggcctcgtagcagacagggcctcccagagggacacctctttccccttctggcgtctggccctgttctcattctgcagtcagaaaggaaagcctgcagagtccctgcagcccaggctgtggcttgttcttacaaacttgacgttaacactaccctgttcatattattccccttctactccctacccagctcctttctgactgaggataaggtgaaattacacccagcctaggtcatggtcttgtatatccataggctctggtcaaaatgcaaccaacatcaccagcagggtaacccaggatgttgctagcaactactatgagagaattagtacaaactaattttttggactagtattgtcagaggcatgtgaaccagagcaactccatcttgagtaggggctgggtgaaatgaggctgagatctactgggctgcattcccagacagttaaggcattctaagtcacaggatgagataagaggtaggcacaagttacaggtcataaaaaccttgctgataaaacagtttgcggtaaagaagctggccaaaacccaccaaaaccaagatggccactagagggtcctggggtcgtcttcactgctacactccccccagcaccgatgacaatttacaaatgccatggcaacgtgaggaagttaccctatatggtctaaaaaggagagacgtgaataatctaccccttgtttggcatataatcaataaataaccataaaaatgggcaaccagcaaccctgagggctgctctgtttatggagcagccattctttattcctttattttcctaatcaactggcttttactttactctatggactcaccctgaattctttcttgcatgagatccaagaaccctctcttgggatcttgatccagacccctttcctgtaacagtatcaagtcccctagcaagggccctcatggatgggacccaaacgactttggttggctgttgtgggccagcccaaacttgcaggcagcaaaatccaggagaccgtgtgggctgtgggagggaggaaatggcacttaccagtacagccttctggtggattctgcacgtctttaatcataagcctagttaggtccttccctttccttcttgtctgtgttcttacctatctgttctctgatccccatttaccaccaggcaacaggggcggggataataatagttaccacttattacagcacctacgcaggctgccgcacttcacatacatcgtttcattgacttctcacaccaaccctcggaggaaggtatcattagtctcattttataggtggaaaaatctgagacaccgggaattaaagtagttcaaagtcactcaactgcagaaccaggatttaaacctagttctgtctgactcccagtcctgtggcctaacctctattcagggtttcaagaagcagagatgttagcaaacacctcacttttgttttactaccccgccccccacctgagagtaatatcctgacttaaaacaccacggagtggatttgcctgtttttaaactttatgaaacggaatcatctgatatgcattctttggtgtccgagttctttcatttaccgttacgtttggaagatgtattccttggttgtgtgtggattcagtctcattgctgtatggtatcccactgtataaagaacaccttatttttaaaaacttcttgacctgtggttaaacaggtttaggttctacctttgaattgctacattgagcgactttcatggtttatccggcttatctgtgtctctgagaggtttaatctttccaaacaaaacgtacttcctttttttttttttttttttttttttttttttttttttcaggtggagtctcgctctgtcgcccaggctggagtgcactggcgcaatctcggctcactgcaagctccgcctcccgggttacgtcattctcctgcctcagcctcccgaatagctgggactacaggcgcccaccaccacgcccggctaattttttgtatttttagtagagacggggtttcaccgtgttagccaggatggtctccatctcctgacctcgtgatctgcccgcctcggcctcccaaagtgctgggattacaggcatgagccactgcgcccggccgtacttccttttttaaactagacttttgctaacccaaatgattctttttttttcttttttgagatggagtctcactctgttgcccaggctgaagtgcagtggaatgatctcggctcactgcaacctctgcctcccaggttcaagcgattctcctgcttcagcctcctgagtagctgggattacaggtacctgccaccatgcccggctaatttttgtatttttagtagagacggggtttcaccatgttggccaggctggtctcaaactcctgatctcaagtaatctgcccgtcttggcctcccaaagtgctgaaattacaggagtgagccatgacacccagcctcctaacaactttttaattgattaaaagtatgcagaggcggtctgtaagcagtgccacaggtcccaattatacaccctcccccttaaaccctgcatgtcctcccttcttccagtcagtttgctaagaggaagacacccgatactgtttaggaatctgtcttcttgctagaaatagaactgttttgagatagaggcggttggaagttttctctgaagtgtcaaaagcaaagttatattttagaagattttaatattgtcacttcatagccaagtgatcttgggcaaatcacctagctgttttgagactccgcttcctcatctgcaaaatgggggaaatgatgataatgttgttggtcatagtatatgagaaaagtacaaatatgagaaagtgtacaagcaaaagcttctggtggcaccatgcaatttaaggatacatgttttttatttttgtgtcctcctgtacaggtttatttgcaagatgggtttgagggaattaaggataaagtctgctgaaagtagcaccagcctctggattaaaagggatgtttggatgaagcttcaatctcaagaagaggcaagagaaaactaaagaaaaaggtaagagagccgggtgtggtggcgggcgcctataatcccagctactcaggaggctgaggcaggagaattgcttgaacccaggaggcggaggttgcagtgagctgagattgtgccactgcactccagcctgggcaacgagcaaaactccatctcaaaaaaaaaaaaaaaagatgctaagagagatcactttcgacccatttacattatgatgcaatatgaaaataaaataaataccactctaacattttcaggacatatggcaattctccctgtgctgattttttttaaatgtatctctgcagtattaacatcctctaaatcattctctttgttttagagacaagaaggtagttgacaagctgtgaacctgcattgcattctagtgatgggacacgtggaaggggaagctgaagttgaagggtggatggtagcagccacagggagtgagatgggctcgtttctggagctgttgggagagaaaaagggagtcaaacgggaattcacacagggttgtgcattatatccaagtgtgtattcagatacaagcctttatctcaataccttccttacccccattccgcacatatctcataccaaagtacaaataaaaccattcccaattgttctaatatttcatttgatttcttgagtcatgaaatgaaaatgtggaggggttagtcatgtgaagtggctgtgactcaaatatcttacgatgatatttgtgcgcgtctcatgagaaatcattgtgtttccacctgaacttgtttgcttgactgcctgagaagatagtgttgctaacctgagaagttaatacgctgccttaatgcttgggctggtagaagtgagggagggaaaggaagagaacaaatgtgtctcagtgaactggggcatgacagaaatttaataagaacaggttgagacaagtgttaaatactggaatcccccgggagcacagcgatagcttggtccttgtcaaaaagtgtactggttggagctcaggagggaaagagaaagtgataaatcagccatgtcttgaagtccattttaatttagctagcctgcgagaagagagggctgaaataaactatcagctctgtcttctgcattaagcaagcataatttatttgaaaaacattcagttttatttctagctaggctaggagttcttgtaacttctacagagggttgggaagaagatcggcataacccatgcttactatttgaagttactggttctgttgtcaggaggtaatattatattgttgtcttgtaaaagaagtatttgataagtatgggacctcttaattgggcacagattggatttcttttacattttgctttgaagaagttatttataaagggatcgtaatagggtaatttatatctttttctaacaagttctagtttgaaagtattataaatctacttacccagacacagacacatttgaacatatagataacaaccacctctgttaagaaattaatgtacacatttccaaatctatccctgagtttaggcgatccaggccatgggtcataaactatgagagccacctagtgggaaaatttggtaattgcacctatatcttcaaattctgggtgtgagagccacagataatttctgtttataaaatcttagaataccatgggaatatttatcaacatgatatgaaagtgacagcgatttttatatattcctactattataaagatggtaggcccttaggctaggaagtagctttcttaacttgacctagtcatcacagtaatgatagacttttgaccaggtgaggaagggagggtggggtgtgccaccatgttgcctcacttttgggctttctgctttggatacatatgaaaaaaccagaaaccaagtcacctaggaggcgctggctgggaaaaaaatggtgcccactgtttgtagtgtgtctgttaggttgtaagctagagagagatgcttacactctaacttttttttttctgaagagatgagctctcactatgttggcagactggtcttgaactcctggctttaagcaatccttttttttttttttttttgagacggagtttcactcttgttgcccaggctgaagtgcaatggcaccgtctcggctcaccgaaacctccgcctcccaggttcaagcaattctcctgcctcagcctcccaagtagctgggattacaggcatgtgccaccatgcctggctacctttttgtatttttagtagagacagggtttctctatgttggtcaggctggtctggtcaggctggtctatgaactgccgacctcaggtgatccgcccgcctcggcctcccaaagtgctgggattacaggtgtgagccaccgcacctggctctgattaagtcttcttacactgaagctgctgtgttgtctgaacagagcctcaattaagaagtgactgaagcttttcccctccctccctctcttcctttcttccttcctttcttctttgtttcaacagttctggggaagtactaaatattagaccaaaattaaaacctgatacccaccgtactgagtgtttgcttagaaagttcttgtttgtttttgagaagcactaggagttaatggaatgggtatttagtggcctttggattctgtagactcctagctctctgcctcctatgtgtaaggccttggacatttctcttaacctctctgagactgagcttcttcacatgcaaatggactcatttaccttccaggagcacctctgtgggagggggatgcaccatgtgaaagaggtaagccctaaggtggaggcagaagcaagtggccaagggaatacaggaggctaattttgacaggaactgtatgggaaaaggtggcctttgtgttgagcctagtagaatgacttcaataggcagtttttattcattcattcaacaaaaatttattgagatcttattatgagtcaggcactgttctaagtgctggggatataccagcaaacaacaaaatagaaaaaaaaaaaaaaaacccaaaccccaccctccctgagtgtacattctagggggaggagccagacagtacataaaaaaataacaaaatgcattcttcagatggtgagacacactgggagaaaaattaaaacagggttaggggaataggaatcacataaggagggctctattatacagatatggtaacttttgagcaaagaattgaaggaggaaaagaatgcgctacaaaagtcatcagagggaagagcaatccagaccaaggaaacagccctaaagtccagggcaggcatgcatggggttcatggaaggacagggaggccagagctttaggagggagatggtcataggggttggatggggagcagcacacctaaggcctcccaggctatttcacagatttttgctttgactttgagtgagatggaagccattagagggagtccagtgaaaggagatgcatattctctgacttacctttgaagagatcaacctgcccagcgtgcagaacacagatggggcaaggcaggggagggctgagggcagaagcatgggtaggttaggaggctgttgtcttggtctaaataagagatgagagggcttgaagcggggtttccaggactgtgcaggggctggggagagtcagctgtgtgacaaatgtttcaggcccacacaagcatcagcagctcgatgcctgtacgaaat

SEQ ID NO: 280 - DNA, 58609 bp, Homo sapiens
agtagggcttcattaatatttgttaaatggtgagtgatgtgccaccataagaaattagcctgggccaggtgtgatgtctcacgcctgtaatcctaacactttaggaggctgaggtgggtggatcacctgaggtcaggagttcgagaccagcctggctaatatggtgaaaccctgtctctactaaaaatacaaaaaattagctgggtgtggtagcgggcacccatagtctcagctactcgggaggctgaggcaggagactcgcttgaacccgggagatggaggttgccatgagctgagatcgcaccattgcactccagcctgggcaacaagagtgaaacttcatctcaaaaaaaaaaaaaaaattagcctgagttctctcagaatatcatagcataagtcctgttcccactttctaaaaacgtttgtacttgattctcacaatctaggaggaaaacatggcagtgtttgtatccccatttcatccatgaggaaactaaaatccagggaagttcaggtcttcttgcccagggtcgaccaatggtatggtgggtctaggacaggtggccctttcttttgcatacagcctccccctgatgccccataactcccacctcatcccaccgggtgccctgctgcctggtgcagcatttagcattactggcaagtcacaatcatcacagatgagcgaagttcatagagctttcattcagcgaagccaggcaggatgggatgaaagaggggagccaagaagcctggagagaagacaccatgtgaatgctctggcctgattctcctttccctgcaaccagtgactctccactatgcaacagtgtcaggctcagagactcaagcccagtctgcctgttagtgttctataataagcagggaatgggtcaggcatggtggctcacacctgtaatcctatcactttgggaggctgaggtgggtggatctcctgaggtccggagttcgagaccaggctggcgaacatggcaaaaccctgtctcttctaaaaattcaaaaatcagccaggcgtggtggcgtgcacctgtaatcccagctactcaggaggctgaggcaagagaattgcttgaacctagggggcggaggttgcagtgagccaagatcgcaccacttcactccagcctaggtgaaacagcaaaactccaactcaaaaaaaaaaaaaaaagcagggaatggagagcaagcaattatcccccacagatgggagacggctgtgcccccgccttagactgaatcactctgaaaccccaaaataaccctttccagagtcccaggcccccagacatagacgttctctgttggacaatgcagtcccacagacggatctaggctgttcttaaagtggttttccaagtaaaggcacttgtctccccgtgaggcgagggccatcaaagctccttttccctcaacgcctaccaagccacaacctattttaacaacacacacataaattagctcagttcatcaacaagatcacctctgaatagtagatgtagaaggttgaaggatagcaacaaagatgctagttatactttcacgtggaattcctgaccctatattctggtaccatattgcctaaggcaagagacaaggcaagacgggttcctccagcaaggggcacatcaggtccctgagcactggaagaaagtagtgatggtgttgatacttgcatcaggtcagaggcagagaagagaactggcctgcagtgatggccaagggtgaaggtaggggtactggctcccctcttctcccctaactcttgtcaaggccacccactcctctgtcctgcctagaatgtgaagggaggcacccagctcagctgcagggtcctgacttcccggtgatctgcactagcctgcagtcccctgaaagcccagacctggatgtgtgtgcctggccaccaaagtggccccggggtgccctctgtgaccacaggtgtataaacatgcctcttaaaagacaccatgaccaaccatgaggccaagtgtggggctagcattcgctgatgtctgtgttttgcacatactaattcacttcatcctcatggaaatctctgaggtaaagaagtatttgctttaatttacagatgaagaaactgaaactcaggttaaaaatagaccaaggacacacaggtagttgaggggcagagcagggatttgaacactgttatgaaaattatctaaaacttggaagtaaggcaaaaagattgctttgaatatttaattcaaagttagaccagaatagtggttctcaaccaggggcaattttactccttaggggaccttttcacaatgtctggagacatttttgattgtcactattgaatgggagagcagatactactgccatctagtgggtggagaccaagaatgctgctaaaccaccttacaatgcatgggacaaccaccacgacagagttagccatgtgttgcttaacaacagggatacattctgggaaatgcatcattaggtgattttgtgatcttgcgaacatcatagagtgtacttacacaaagctagatggtctagcctactatacgcctaggctatacagtctagcctactgctcctaggctataaacctgtacagcatgttaccatactgaatactatagtcaattgtactacagtagttaagtatttatgtatctaacatatctaagcacagagaaagtacagtaaaaaaatataatcttaggggaccattatcacatatgtggtccatcactgactgaaacagcattatgcagcacatgactataatcagtagaaacatcagtaaatagtcaccattgagaaactctgttccagcacagtgtgactatgctcgacttattatttgccattaattaggtctcaaggatgtcaatttttagaagacaataaacaaaaaaattaaaataaaaaaataaacagcaagcacagtagctgatgcttttaatcccaaaactttgggaggccaaggcagcctggccaacatgatgaaacctcgtctctactaaaaatacaaatattagccaggcttggtggcacatgcctgtaatctcagctactcaggaggctaaggcagaagaattgcttgaacctgggaggcggaggttgcagtgagccgagatcacgccattgcactccagcctgggtgacaaaactccgtctcaaaataaataaataaacaaaagagaaaagaatgtcagcttgtagaaaactggtaagatgcaaatgactcttgtctaagaaagtaaccccaaagactatagttttatagacctgaaggacactacccagttgtgtatctcacttagcaatcttacgccagaatgctctttttatcactgactattatagatcagtttcttccagcttcctttaaaccagtttgccttcctgctggctccctcttgtattttgctagggctgccataacaaaataccacagactggctggcttaaaccacagaaatctattttctcagagttctggataatggaagttcaagatcaaggtgctggcagggttggtttcctctgaggcctctccctgtggcttgcagggggccgccctcttgctgcctcttcctgtggtcttttctctgtgcacatgtgttcctggtgtttctttctcattttataaagacaccactcctttcacattaggacctacacttgagacctcatttaaccttaattactttttttttttttgagacggagtcttgctctgtcgccagactggagtgcagtggcgcgatctcagctcactgcaacctccgcctcctgggttcaagtgattctactgcctcagcctcctgagtagctgggattacaggcatccgccaccatgcccagctaattttttttttctttgtatttttagttgagacggggtttcaccatgttggccaggctggtctcgaactcctgacctcaagtgatccacctgcctcggcctcccaaagtgctgggattacaggcatgagccaccatgcctggccaaccttaattacttctttaaaggctttatctccaaatatagtcatattctgagtgtcctggcagttaaaatttcaacctatggactttgggagaacacacttcagtacctaaaactccactaattatttaatctttgatgcatgctcactacaaatttgcatgagaattgtttttaactttttgaaaattatgctttgcaaatacatttgtctaagcccacaaagtctacttgtttctactatactatacttcttgcatgctggacagatagagccaattcactgagacagcagtattgcagtaaagaaacagtttaattaaggcaagggctggccacatgaaagacaagagttcattattcaaatcagtttctctgagaactcagaggctagggtttttatggataagttggcaggcagggagttagggaatgggtgctgctgattggggataaaagcatggcaaacaatcctcatgtgctgagtccaccatagggtgggggccacaggactggctgagtcatgagtcgtgagtccaagtgaagtcagttggtgcccagaatgcacagttctgaaaatcatctcaaaagacgaatcttgggttctacaatagtgatgttatttacaagagcaaacggggaagtcacaaatcttgtgacctccagcatagattatagaaaggcaagctattcctacatcttagcagaattcagacccctcccataatcctaatcttgtggcctttcattagttttacaaaggcagtttcagtccccgaaaaaggaggggctcagttttagggagggactattatcattcttgcttcaaagtgaaactatacactaaattcctcccacagttagcttggcgtggcctttgttatatgcccaggaataagtgaggacagccagcctatgagactagaagcaagatggagtcagccaagctaaatttctctcactgtcataacctttacaaaggtggtttcattaggcatattaatgcaaattccttagttaaaacaagaatgactctctaaaggctatatttcagatacatcacatgcttctttcctcttgtcccctcaacagtaagcaagaagagtatttttgtacaagagagaggcctctgcctgaagctcccttaatctgtcagatcacagatcaaaagctatcacacactgcccaagggaccctaaagggagccactctcagaaaataaatccaaacctccttttttctggccactgaaacgttcaataattagttcattatctacatcattcacatgtttaatatttattgactttggaattattgattactttgctgagtatcttatgaatttaatctatattaatattaaggtgatgtatcaaattgcattccagagtgtggatttgactctagtgccataatcagtctcctgggacaaacagctgtttctcttccctcattatagaaaaaaattgcccttggcaaatgtcaaagaacatccttttatcaatctctcttaccaatcaatccaagcaaatgcagtgggatttcttttccccagagttgaagtcacctcctgacaggaagttaagtctttaggcactgaatcatagcactgagctgaagcccaggactaagcaagaatgagtgagaatttggagacttaaggtttggtcatctgtagaggattgggttttgtcttgttttgtttttgttttggtgtcctgcaaggtttctcactgcccttcatcaggtaatatgccctgtccctgaactggccaattgtgttaccccattcccttagcaacagtgattgctactgaagaaacaggaggccaacaaagaatatcactcattcaccagtagagtgtctatgtcagagatattagataaacaggaaaactaacaattacattgcaggctgtggaaacagagagaggtacctaaggcacacctgtgggaatatgaaagtttggtttcataaaaggattctggaggaagtcacctctgacatttgagttgagtcctacaggatatgaagaaagtagccccatgttccggttactatggctgtgtaataaattacctaaaacatactggattaaagctatgaaaacatcttttctgcccagagattctgtgggcctgaaattcacatggaacacataaggcataccttgtttctgctccatgatgtctaaggattcagctggaagactgggaggctgggggctggaatttatctgaagaatgactcatttacatgtctactggttgaccctggctgttggctgagggggcctcagctctctctacattgtttctctactttggctagtttggatttcctcaaaacatgatggctggtcctcagtgtcagcatcccaaaaagagaatgccggacacagtggctcacacctgtaacctcagcaatttgggaggctgaggtgggaggttgcttgagttcaggagttcaagaccagcctgggcaacatagtgagactctgtctctaccaaaaatttttaaaattttaaaaatcagccaggtgtggttatgcacacctatagtcccagttacttaggaggctgaggcaggaggatcacttgattccaggaggtcaaggctgctgtgagctatgaccacaccactgcatttcagcctgggtaacagaatgagactctgtttcaaacaaacaaaaacccaaaaaaaaaaaaaagagagagagagggagttagaaggaagatgcatcatttttatgacctggacttggaagtcaccaagcagcacttctgcagtaccctgttggttggaatagttgtagcccaaacccgaattcgaagggaggagaatagataacatccctgggtgacaggaatgtcaaagtcccaaacagcatatgacatgtgacaaatattggtgtggccttctttggaagatccaatcttccataccaggcaaagggatggaagactaaggaacaacatgagggatagccagagagggaaaaagcatcacttgttctaggaactacaaatagcttgaagaagcaaagatgtctagatgcctcccaatatgcagagtggggtgtacagaagagagtggtaagggcgctgggagagctaaggtgggcaagagagcttcctctgtcatgctaagaaagttggaatttatcttgatggtggtgaaagcagagggctatggttagattcacatttgagatttagatttttagatttaaaatgatcaccctggtgacactggcttaactcacaattttgcccaaggcctatgctaccacagtgcttctgaaactttaaagcacattagaatcacctggaggtcttgttaaaccatggattgctgggccttgaaaccccagagattctgattcagtagatcgagaatagggcctgagaatttgtatttctaacaagtttccaggtgatgctgaggctgctggcccagcgaccacatttgataatcatagccctctgataaatcctatcaaaatatcctaatggcagagcaagggaattctggtgatatcctcccctacccataacctgacagctattaggatctgcctacttgaggctaaaagcaaccaagagaggaacagctacagtgtaccacagagtccctcaacatctttgcccacgccacggtgccccagcttcttaccaagtgtgcctgattcctcttgactacctccaaggaagtggagaaagacaagttcttgcgaagccttcgtcttctctgatatgctattctatgtctatttctttggccaaaaagatggggcaatgatatcaactttgcagggagctggagcatttgctagtgacctttctatgccagaacttgctaagcatgctagctaataatgatgtagcacagggtgcggtggctcacgcctgtaatctcagcactttgggcggccgaggcgggcggatcacctgaggtcaggagttcgagaccagcctggccaacatgatgaaaccccatctctactaaaaatacaaaaattagccaggcgtggtggtgggcacctgcaatcccagctactctggaggctgagacagaatctcttgaacccaggaggtggagattgcagtgagcagagatggcaccactgcattccagcctgggcaacaaagcaagactctgtctcaaataataataataataataactaatgatgcagctttctctctctgagtatataatgcagttctgatgatgtgaggaagggcctcactgttggtgtggcagagtctgagaccatggctggcaatgaaaacactaccctttgatgcctatgggctctccctttatggtttcaaggagggcttctcaatcttggcagaattttggactggatagttctttgttgcacaggtggggggctgtcctgcacatcacaggatgtttcatccctggcctctacctactagatgccagtagaacatacccaccccacagctgcctgttgtgacaatcaaaagcatctccagatactttgcagggggaaaatgatttctccaggcctggcatatacataacagtatttaagcagctgcctagaattaattaaacacagaaggatgtctctcatccagaatgccctggaccacctctttgataggcaatcagatcccacctcctccaccctatttttgaaggccctgtgccaacaccacttcttccatgaatacttccttgattcccccatccctagctctatataaatctcccactcaacactcacacctgttagtttacattcctcttgacacttgtcatttagcatcctaagtatgtaaacatgtctctcttcacgattcacaaagtggctttggaagaactttagtaccttcccatcttctctgccatggaaagtgtacacaactgacattttctttttttttaagacagtatcttgctatgatggccgggctggaatgctgtggctattcacaggcacaatcatagctcactgcagccttgagctcccaggctcaagtgatcctcccgcctcagcctcctgagtagctgagatcacaggcatgcactaccacactcggctcacatttgacatcctctaaagcatatataaaatgtgaagaaaactttcacaatttgcatccctttgtaatatgtaacagaaataaaattctcttttaaaatctatcaacaataggcaaggcacggtggctcacgcctgtcgtctcagcactttgtgaggcccaggcgggcagatcgtttgagcctagaagttcaagaccaccctgggcaacatagcgaaaccccctttctacaaaaaatacaaaaactagctgggtgtggtggtgcacacctgtagtcccagctacttggaaggctgaaatgggaagactgcttgagcccgggagggagaagttgcagtaagccaggaccacaccactgcactccagcctgggcaacagagtgagactctgtctcaaacaaacaaataaatgaggcgggtggatcacgaggtcagtagatcgagaccatcctggctaacacggtgaaacccgtctctactaaaaaaaaaaaaaaatacaaaaaattagccaggcatggtggcgggcgcctgtagtcccagttactcgggaggctgaggcaggagaatggcgtgaaaccgggaggcagagcttgcagtgagccgagatcgcaccactgccctccagcctgggcgacagagcgagactccgtctcaatcaatcaatcaatcaataaaatctattaacaatatttattgtgcacttaacaggaacatgccctgtccaaaaaaaactttacagggcttaactcattttatccttaccacaatcctatgaagtaggaacttttataaaacgcattttataaacaaggcacagagaggttaattaacttgccctctggtcacacagctaggaagtgggcagagtacagatttacacaaggcatccgtctcctggccccacatacccaactgctgtaaacccataccggcggccaagcagcctcaatttgtgcatgcacccacttcccagcaagacagcagctcccaagttcctcctgtttagaattttagaagcggcgggccaccaggctgcagtctcccttgggtcaggggtcctggttgcactccgtgctttgcacaaagcaggctctccatttttgttaaatgcacgaatagtgctaagctgggaagttcttcctgaggtctaacctctagctgctcccccacagaagagtgcctgcggccagtggccaccaggggtcgccgcagcacccagcgctggagggcggagcgggcggcagacccggagcagcatgtggactctcgggcgccgcgcagtagccggcctcctggcgtcacccagcccagcccaggcccagaccctcacccgggtcccgcggccggcagagttggccccactctgcggccgccgtggcctgcgcaccgacatcgatgcgacctgcacgccccgccgcgcagtaagtatccgcgccgggaacagccgcgggccgcacgccgcgggccgcacgccgcacgcctgcgcagggaggcgccgcgcacgccggggtcgctccgggtacgcgcgctggactagctcaccccgctccttctcagggcggcccggcggaagcggccttgcaactcccttctctggttctcccggttgcatttacactggcttctgctttccgaaggaaaaggggacattttgtcctgcggtgcgactgcgggtcaaggcacgggcgaaggcagggcaggctggtggaggggaccggttccgaggggtgtgcggctgtctccatgcttgtcacttctctgcgataacttgtttcagtaatattaatagatggtatctgctagtatatacatacacataatgtgtgtgtctgtgtgtatctgtatatagcgtgtgtgttgtgtgtgtgtgtttgcgcgcacgggcgcgcgcacacctaatattttcaaggctggatttttttgaacgaaatgctttcctggaacgaggtgaaactttcagagctgcagaatagctagagcagcaggggccctggcttttggaaactgacccgacctttattccagattctgccccactccgcagagctgtgtgaccttgggggattcccctaacctctctgagacgtggctttgttttctgtagggagaagataaaggtgacgcccattttgcggacctggtgtgaggattaaatgggaataacatagataaagtcttcagaacttcaaattagttcccctttcttcctttggggggtacaaagaaatatctgacccagttacgccacggcttgaaaggaggaaacccaaagaatggctgtggggatgaggaagattcctcaaggggaggacatggtatttaatgagggtcttgaagatgccaaggaagtggtagagggtgtttcacgaggagggaaccgtctgggcaaaggccaggaaggcggaaggggatcccttcagagtggctggtacgccgcatgtattaggggagatgaaagaggcaggccacgtccaagccatatttgtgttgctctccggagtttgtactttaggcttgaacttcccacacgtgttatttggcccacattgtgtttgaagaaactttgggattggttgccagtgcttaaaagttaggacttagaaaatggatttcctggcaggacgcggtggctcatgcccataatctcagcactttgggaggcctaggaaggtggatcacctgaggtccggagttcaagactaacctggccaacatggtgaaacccagtatctactaaaaaatacaaaaaaaaaaaaaaaagaagaagaagaagaagaaaataaagaaaagttagccgggcgtggtgtcgcgcgcctgtaatcccagctactccagaggctgcggcaggagaatcgcttgagcccgggaggcagaggttgcattaagccaagatcgcccaatgcactccggcctgggcgacagagcaagactccgtctcaaaaaataataataataaataaaaataaaaaataaaatggatttcccagcatctctggaaaaataggcaagtgtggccatgatggtccttagatctcctctaggaaagcagacatttattacttggcttctgtgcactatctgagctgccacgtattgggcttccacccctgcctgtgtggacagcatgggttgtcagcagagttgtgttttgttttgtttttttgagacagagtttccctcttgttgcccaggctggagtgcagtggctcagtctcagctcactgcaacctctgcctcctgggttcaagtgattctcctgcctcagcctcccgagtagctgggattatcggctaattttgtatttttagtagagacagatttctccatgttggtcaggctggtctcgaactcccaacctcaggtgatccgcccacctcgccctcccaaagtgctggaattacaggcgtgagccaccgcgtctggccatcagcagagtttttaatttaggagaatgacaagaggtggtacagttttttagatggtacctggtggctgttaagggctattgactgacaaacacacccaacttggcgctgccgcccaggaggtggacactgggtttctggatagatggttagcaacctctgtcaccagctgggcctctttttttctatactgaattaatcacatttgtttaacctgtctgttccatagttcccttgcacatcttgggtatttgaggagttgggtgggtggcagtggcaactggggccaccatcctgtttaattattttaaagccctgactgtcctggattgaccctaagctccccctggtctccaaaattcatcagaaactgagttcacttgaaggcctcttccccacccttttctccaccccttgcatctacttctaaagcagctgttcaacagaaacagaatgggagccacacacataattctacattttctagttaaaaagaaaaaaaaatcattttcaacaatatatttattcaacctagtacatacaaaatattatcattccaacatgtaatcagtattttaaaaatcagtaatgagaccaggcacggtggctcacgactgtaatcccaggactttgggaggccgaggcgagtggatcatctgagatcaggagttcaagaccagcctggccaacatggtgaaaccccatctctactaaaaactagctcagcatggtggtgggtgcctgtagtcccagctactcgggaggctgaggcatgagaatcacttgagcccaggaggcagaggttgcagtgagccaagattttgggggattctgtgacatacaaaaaaaatcagtaataagatatcttgcatactcttttcgtactcatatacttccagcatatctcaattcacaatttctaagtaaatgctctatctgtatttacttttataaaattcacaattaaaaatgaaggttcacatagtcaagttgttccaaacacacttaaatgtctcctaggctgggtgtggttgctcacacctgtaatcccagcactttgggaggctgagatgggcggatcacctgaggtcaggagtttgagaccagcctggccaacatggtgaaaccccgtctctactaaaaatacaaaaattagctggatgtggtggcactcacctgtaatcccagctactcaggaggctgaggcaggataattgcttgaacccgggaggtggtggaggttgcagtgagccgagatcgcaccactgccttccaacctgggcgacagagcgagactccgtctcaaaaaaaaaaaaaaggctcctaataactttattactttattatcacctcaaataattaaaattaaatgaagttgaaaatccaggtcctcagtcccattagccacatttctagtgctcagtagccacgggggctggtgaccaccacatgggacagcatatttagtacctgatcattggttctcagatctggctactcagcagaaccaagaatccacagaaacggcttttaaaagcacagccccacagcccccagccccagccttacctacctggaggctgggaaggactctgattccacgaggcagcctatgttttttgatggagggatgtgacaggggctgcatctttaacgtttcctcttaaatactggagacagcttcgaggaggagataactggatgtgtcttagtccatttgatggagggatgtgacggggctgcgtctttaacgtttcctcttaaataccggagacagcttcgagaaggagataactggatgtttcttagtccattttctgttgcttgtgacagaatacctgaaactgggcaatttatatggtaaaaaattttcttcttactgctctggaggctgagaagtccaaagtcaagtcccttcttgctggtggggactttgcagagtattgaggcggcaccgggcgtcatatggtaaggggctgagtgtgctacctcaggtgtctttttcttttcttataaagcctaactagtttcactcccatgataacccattaatctatgaatggattaatccattattgagggaagaaccttcatgacccagtcaccgcttaaaggccccacctctcaatactgccacatcgggaattaagtttcaacatgagtttcggaggtgacaaacattcaaaccatagcatgctgtctcttaaatgactcaataagctcctgtggcatccacttctgcatgccttgggcagcttttagacatctgtccattttcctagagggacaagaccaccacctgtgatcctatgaccttttggctttaggcctaacaagcaggttataccctcactcactttcaaatcatttttattgtcttgcagacaatttacacaagtttacacatagaaaaggatatgtaaatatttatacgctgccgggcgcggtggctcacgcctgtaatcccagcactttgggaggccgaggcaggtggatcacgagttcaggagatggagaccatcctggctaatacgatgaaaccccatctctactaaaaatacaaaaaattagccgggcgtggtgacgggtgcctgtagtccccactactcgggacgctgaggcaggagaatggcgtgaacccgggaggcagagcttgcagtgatccgagatcgtgccactgcactccagcctgggtgacagagcgagactgcatctcaaagaaaaaaataaataaataaataaatatttatactgcttataaactaataataaatgctatggtctgcatgtttgtgtcaccccaccattcatatgttaaaacctaatcaccaaagtgatattaggaggtggggcccttgggaggtgatgaggtatgagggtggagcccatatgattgggattagtgcccttctaaaatagcccaacggagcccagtgacaaggcatcatctatgaaccaggaaactggccctcaccagacaccaaagctgttggtgcattgatcttggatttcccaccctccaggactctaagaaacacatttctattgtttataagccacccagtggctggtattttgttataacatcccagactaagacaaataacaaatacttgtatccctgacaccaggttaagagatagaatttgtttgttcctctggaggcccttgtcttcaccccatcactgccctgtcctccctggaggaatctgccagcccgaattctgttcatcgtaccctccttttcttagagtttgacctcctctgtatctcccccaatccatgtattgcttatatacaaggtattctgctgtatctgttctgctatggcttgccccttttgttcaacactgtttttgtgcgtcatctgcattgatgcatgcagttgtcctttatttgttctcactgctggatagtatctggttgggtaaatatatcacactgtaaatcacactatccaggttcctttaggtgacatttggttgattgcagtgttctgttgttacgatggtgctgctgtgactgttcttgtgcatggacagaagttcctttcaggtgaatttctcagaatggaattgctgggcaaaggggcagccaataatcaactcatttgatgccaaaagtggtggtgccagttcatcctcccctgcgaggtatgggtcctgattcactcttcaagtgctgtggtttgacagggccgggggtgacaaggggacacctgggaaggaaagctgggctccctgctggccatccaggccagtccttaccagggggtaggcaatgattgggtcaagtggttcctgaccactgggcctgagacttcaggcccagaaactatctaatatttcctcaaatgcatcccatgagcaggcactgtgtgagtgagcacacacatctgaagcctcaagctaggcaagcctaccatgacttgtggtccaagggctcacgggtgacctggagttagagggagacatggctgccaggtggctttagaaagaacactcatcatggccaggtgcggtggcttacgcctgtaatcccagcactttgggaggccaaggtgggtggatcatgaggtcaggagtgagaccagcctgaccaacatgctgaaacctgtctctcctaaaaacacaaaaattagctgggcatggaggtgcacgcctgtaatcccagctactcaggaggctgaggcaggagaatcacttgaacccgggaggcggaggttgcaataagcctagattgtgccactgcattccagcctgggcaacagagcaagactccgtctcagaaaaaaaaaaaaaaaggaagaacactcatcctatgaccttgacctccaagctttgcctccctcaagcagaacagaatggagcctcccttaggcagaggcggaagtttgcctctcacctagttctccattcttttgttcagagcctgaataccctcaggctctgtacttggggtatttctgttctcttgttttatgctcacggttgtgaggtttgttgtgagtaccacgatcccttccttcagaggagtaaactgaggttccaaaaggtttagcagttgcccgaggaatattaaattggcaaaagcaggtagaatataaagcaaggagtatttggcaacggttcttttttatgattaaaaacagccgaagaaagacttctacttgtgcctttgaaggagtaactgcatttgaccttcccaccagtaacaaccatcaaatctctattaaattaaacacacacacacacaaacaaaaacagctattgtgaaggtatcagcgactaagacaactaaggtttgaggggccaggatcctggagagatggaaacttccctgaggtgagccccacattctcagacacttttccttggatgttttgagcactgctttaattcctgggaaaacaattccttccactgtgcacagactctggggccagacagcttgggttcaatcccagctctgccacttaatgtctgtgtatctgtgtaggcaagttaccctttggtgcgtcagtttcctcatctgtaaaacacaactatagttgatcctcattcgttaagagtctgtacttgttaatttgctcacttgctaaaatttgttaccccaaaatcagtacccctagccttttggggtcgtttcaaagatgtgtgcagagcggcaaaaaaatgtgagctcctccaggctcatgttcccagccaaggtccaacaaagtgctgccctgccttcttatttcagctgtcatagtgtaaactgtgtccttttcacagtctgattagtgccatgtttttcagatttttatgcttttttcttggttatttctctgttaaaattgtctccaagtgtagtgcaaagtttagcacgaggaggctgtgatgttccttacagagaaaatgcatgtgttagagaagctttgtcaggcatgagttaaggtgctgttgtcctgagatcaattaatttgttgttgttgttgtttgagacagggtctccctctgttgcccaggctgctggagtgcaatggtgtaatcatagctcactgcagcctctacctctctggctcaagcaatcctcccacctcggcctcctgagtagctgggactacaggtacaccccaccacacccagataatgtttttgatatttttttaggtggaattttgctcatcacccaggctggagtgcaatggtgcgatcctggctcactgcaacctccacctcccggattcaagcaattcttctgcctcagcctcctgagtagcacagattacaggcacatgtcatcacgccttgctaatttttgtgtttttagtagaggcggggtttcaccatgttggccaggctagtcttgaactcctgacctcaggtgatccacccgcctccgcctcccaaactgcagagattataggcacgaaccacaatgcccggcctcatgttttttatttttcaagttgaaatgaggtctctctatgttgcccaggttggtctcaaactcttgagctcaagtaatcctcccaccttggcctcccaaagtgcggggattacaggtgtgagctaccatgcccagccaagatcagtgttaatgaatcaactatatatattacataaggtgtctttaaacagaaataaggttatatattgatcgattggtaacaatgttgtgaccagcagcttacagggtacctagccttgtatttctcctataaataatttgctcgttgagtgtttgtggcaactttgtagcacataactaccaagaataaggactgtaataagagtacgtccctcacaggattgtaatgaagactgagtccatttacataaaggctgagagcagtgtcaagcagatggagaacactgtagaatgtgcgatagctctaacagtggttatcatggctgccctctcacttcttcagagacatgtgtttctaaggtctgcactctgccccaccctccccatccactgtcccccagcccgtttcctcctccacttacttcccagccctgtgccttctgccttctcttttctgagtttgctaagggcactgctggctcaagagcagtaactaacagtctctcgcctcttctctccatggcaaccagtgacctttggagaatgtaaaccttatcaccaatctcttaaagcccttcggtgccttcccaggatgacgtccagctgaggtccttggcaagacccagggcgccccctcctcgctccatcacctcccctgtcacctcccctgcatctccctactccagctgcaccactcttgtgccccagtggctcttgtctgattatttccttcatctccccagctggtcagcagagctggtggtaatcaactcagaccctgtcacctggatgtccagcagttagggactaaaaaaaatcaacaggtcacattctgtcctgcagatcatgataataagatctgtcagacagcagtcagcagtcagagccaaatcttctggacttcagcaggattctgcctcttgctatttcctgttgcctctcttagtgaccttttaagagcattgtggatgcctcccagcctcctgctaaccaccctgtaacctgaacagcctgcagcagccctgcccagtagaacttcctgatgtgatggaaatgctgtgtctgcaccactagccacatgtggccacaggattctcgaaactggtggtgcagttgaggagctgactttatattttatctcattaaatttaaatgtaaatagctacgtgtggcttgttggctagcctattggaaaacacgggcttagagagacacagggagaatcactgtaatgcactaaaagaaggtaaaaaaaaaaaaatcctaagaaatattcctaaaatactttaatatagggctgggtgcggtggctcacatccagcattttgggaagctgaggagggcagatcacttgaggccaggagttcaagaccagcctggccaacatggtgaaaccccgtctctactaaaaatacaaaaaatcgggtgcggtggcgggtgcctgtaatcccagctacgcgggaggctgaggcacgagaatcactcgaacccgggaggcgggggttgcagtgagccgagatcgtgccactgcactccagcctgggcgacagagcgagacttcatctcaaaaacaaaaaacaaaaaccaaaaaaaaaaacttcagcatgattatttaaccaaaatgcaggttagttgttcaccggatgcagagtccaattaacaagagcaaggcctggtaccaaaaaaagtgaatttactccgaaactagcttgggtgaggggtacaaagcatcctgcctttctttaaaagtgctgcttccccttggaagtagaaagtggacacttttataaggtaaggggggaagtgtgcaagggcaagtgggggggtccctctgctagttccgtgcatactctacaggacagttgacttggcaccttcctggttagtaataagctgtagcagtggccaagtgggcatgctttcagtatgccctcccagtgaatgaaagtcctgaggcaacccccaagggtggaagtgccaggccaccacccactggaggtgaaagttccgtgatgggtttgctttggtctgcgaatctactgtcatgtggagagatctgtgctctggaagagcatacagttagaaaagcttgccctgaagggaatgtatggtgaaggggaggtgaaaggttatatttgcatttctgaagggctaagtaggaaaccgggaaccaggggagaggagaagagaagagaggataattttttttaagaaaagcaacatattccctttttcttagaaaaaatggagcactcggttacaggcactcgaatgtagaagtagcaatatataaattatgcattaatgggttataattcactgaaaaatagtaacgtacttcttaactttggctttcagagttcgaaccaacgtggcctcaaccagatttggaatgtcaaaaagcagagtgtctatttgatgaatttgaggaaatctggaactttgggccacccagggtaagataaaacaccttccacgtcataggtatcttcctctctccttccctgcctctcccattagaacctggttttcttcctgagcagcaacaatcttaggcatctttccatgtgactgagtatccaccacattatttttaatgaaatagtattagattgcatggatgtgacataatccatttaacccatcccctactgttggacattcaggttgtttccagagtttcaatattattttatttaataccctaatagttagagcaggccatgctgctatcacaaatagacccaaatatttaatagctcaaaccaataacgtttgtgtcctcctctctgggcagtacagggttggcatacctcctgaagtgaattaggaactacactcattccagcttccagtttggtctttatctgtcagtgccttactgtcctctgcattgttgagtctcagtcaccttgtccaagttccattggccagaaagggctagaagcacagaagggctggaagtggcatttgttcctcactcacattctggtgggaagaacttagtggtgtggccttagctgactgtaagggaggctgggaaatatagtctagcgagtgccctggaaaaagccggcacggcattccccatggaaagctgtcaggcacggctacagtctaccccctgccaaccagtatctgcatggaccctccttccacactcagatgcatttacccccagccccaagagagccaaccgatgcccatgtggtcaccacagccacctccgagtccaagatttccaggtgacatgcagtctcctctctcccagctttaggaatggcttcttctgatctacacacagacacagacacacacacacagacacacacacacacacacacacacacacacgatggagaggggcaggataactgcaactgtaactccattcagaaaagaggcacagcactagctgcccgcagcactggagccctgctgggcagcactggatcaacctctgccctggcagaggagcatgttcctccacaaatccctgcttcagcctctcgagaggctcctccttgtctgttattttccttggccacaaggcaggcaggcagtgggaagtgtgccctcctccggggcaaggagccttcacagcccacttcctgctaataacagtttggggttccacagggtgttttaagactccagtcagctattttaggccagactcatttctctctctctctctctttttttttcttttatgaaatcacaccctgagacccaggctggagtgcagtggtgcgatctcggctcactgcagcctccgcctcccgggttcaagcaatcctcctgcctcagcctcctgagtagctgggactataggcgtgcagtgccacacctagctaatttttgtatttttagtaaagacggggtttcaccatgttggccaggctggtcttgaactcctgacctcagatgatccgcccgcctcggcctcccaaagtgctgggattactggcatgagccactgcgcccagcccagactcatttttctttgagagtaggcttttcccaaaagtaggcttctgagctattcactttcaggcagtcccatgtgccaggaaccacatccaaatttcctccgtggatgggagtctcaggctgccttatctccttgcatgtccccatgcccagctgtctcagcctaagggcaggtaccttgaagtcaagttaaacaataagattggagaccagcaatgccctcagcctggtttttgcagcaggactgagtcccttgttttggctcaatgggaagtctttgctgttcaaagccttagcttctctggctgagtgcggtggctcacgcctgtcatcctagctctttgggaggccgaggtgagcagatcactgaggccaggagttcaagaccagcctggccaacatggtgaaaccctgtctctactaaaaatacaaaaagttagccaggcgtggtggcaggcacctgtaatcccagctactcgggagcctgaggcaggagaatcgcttaaacccaggagatggaggctgcagtgagctgagatcatgccattgcactccagcctgggtaacgagcgaaattccatctctaaaaaaaagaaaaaaaaaaggccttagattctccctttgactttccacgtttgtgcagccttttatctccaatgctccatttcattccatctcctggcttattcttttcttgtcacatctactaaaagcaacaagaagccaccggtattcaggaacattctacctgtccccagagctatatgctcagtaggcatacagttggccctccaggttatctgagactcagatttccagagggctttgcatggctcacaaggtctgaagaacctctgagcctcccgcctgcggtgtctgttcattgactttgccacagtctcaaagaggcactgcatgctgcatgtttgaggtttttgctttggtggcatccatttccagcctcggcttccggcattcctcccccagcagactctctgctgctttccccttactccttctggcagttctgggaggttgcatagggcccttgcaggatgccccaagtccagctgcctctggcctctgggaagcacacccttgacctgccatgtgtaggaagacagcccgcttctgccagggcccaactctgccggcaggtagcaccttccaacctcttcactttggactttataactgtcaggtataaagtcggttgtgtccttacgtttctcaaattcttcaagacacgtcaaccagcctctcctacgcattctctccagctcagtctcaaaacacaccctttctctccagctcactctcaaaacacaccctatcaggccaaccactctttttaaaggacagctcctcaccaatccagtcaggtagccttccccacattgtatcctggaagtgggtgatggactgggtggggaagagggtcatatggcaaatctgtatgtcttacagtaattgtctagcagcccctggtgtcttactttaggccccctggaaactttcagatagtggagttgtctgatacatatcttataacctacagatattaatatatcctcacaggggcacaaaagctcttacaaggatgtttattataataatatttttattgttataatttacatgccataaaactaaccattttaaaatgtataatgcaagggtttttagtatattcacaagattgtgcagctgtcactactaattccagaacattttcattattccagaaggaaaccctattcatattagcaatcactcccccattccgcctttccctaaaacccagcaatcactaatctactttctgtctctgtggatttaaagtaattttaaatttgaaaaatagtatctataaggaaatgtatctagtcacaagcatacagcttgatgaatttgtaaaaattgaacagtcctatgaacataccctgtaagctcaagacatagaatgttaccagcccctgcaagcaagctgcctgctcacttctagtcattaacccctccctcttttccttctagtcattaacccttcagagtaactattctgattaccaatagcatagattagttctgcctgttgttttactttatataaactgtctcattaagtataaacatgtttgtgtatacttgtgtatttctttctatcacaatgatgtttgtgagattcatccatgctgttcctatagacaattctattttgcagcgtagtattccattgcatgactataccacaatttatctgtgatattacaaaggaatacttgggcagtttccagtttggggctataggatagttgtgatacaaatattttagtatagtacatgtcttttggtgaacctgggtacacatttctgttgtgtataccccttaagagtggagctgatgatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcttgcagtgagccgagatcgcgccactgcactccagcctgggcgacagagcgagactccgtctcaaaaaaaaaaaaaaaaaaagagtggagctgatgggtcatagcatgtaaatgcattcaactttagtagatactgtccaacagttttccaaagtgattgtccaacttacttgcctatcagcagtatctgaaaagtctagttgcttcttttcttggccaactctttttttttttttgagatggagttttgctcttgttgcccaggctggagcgcaatggcacgtcctctgctcactgcaacctccgcctcctgggttcaagcaattctcctgcctcagcctcccgagtagctgggattacaggcatgcgccactatgcccggctaattttgtatttttagtagagacagggtttctccatgttggtcaagctggtctcgaactcctaacctcaggtgatccgcccgcctcggcctcccgaagtgctgggattacaggcatgagccaccgcgccaggccggccaactcttttttattttattttattttactttaaagacagggtttcactttgtcacccaggatggaatgcaatggcacgatcacagctcactgcagccttgacctccctggctcgggtgatccctcccacctcaggctcctgaggagctagaactacaggcatgggccatgcccagctaattttttaatttttggtagagacggggtctctgttgtctcagattcctgggttcaagtgatccttctcccttggcctcccaaagttctggtattacaggcatgagccactgcacccagcccatggccagctcttgatacgatctgtctctttcttttctttttttttttttaatttgagaagtgttaaataatctttctttgatattatacataaaccacaccaaaatgtctttcagtaagtaaaatgaaccattttagatacagaaaattctaattagattggcatagttaaggccaaaaatataaagttgacattgctaccttatcttcagcccttgcctttaagaggcaaatgaacacaaaatacaggtgaatcttgcttggttctgagacagtgaaggactttcccccagtatttaaatatatttacataaccagttacataaatctaaatattaaaaaaatctccaatagattttagatggcattcaccatctttgtgaaaagttgaacattactaatgaaatctgatcatatctttagaaggataaacagtgatagcatttactgaatcagaataactgttttttggggttttctttgagacggagttttgctcttgttgcccaggctggagtgcagtggtgccacctcagctcactgcaacctccgccccctggattcaagagattatcctgcctcagcctcccgagtagctgggattacaggctcgccccaccatgcccagctaatttttgtatttttagtagaggcgaggtttcaccatgtcagccaggctggtcttgaactcctgacctcaggtgatccacccgcctcagcctcccaaaatgctaggattacaggcgtgagccaccaggcccagcctattttttttttttttctttttttgagacggagtctcactctgtcacccaggctggagtgcagtggcacaatgtcagctcattgcaacctccacctccggggtttcagtgattctcctgtctcagcctcccaagtagctgggaactacaggcgtgcaccacaagcccagctaatttttgtatttttagtagagacagggttttgccatattggcctggctagtttcaaactcctgacctcaggtgagccacctacctcggcctccgaaagtcctgggattacagacgtgagccactgcactgcctggcccagaaaggactattaattgtagttgcctctgggaatgggggctgcctgcttctttctgtaaccccttctgtgctgtttaaatttttttttttttttttttttttgagacagagtctcgctctgtcgcccaggctggagtgcagtggcgcaatctcggctcactgcaagctccgcctcccaggttcacgccattctcctgcctcagcctcctgagtagctgggactacaggcacccgtcaccacgcccggctaattttttgtattttcagtagagacggggtttcaccatgttagccaggatggtctcgatctcctgaccgtgttatctgcctgcctcggcctcccagagtgctgggattacaggcatgagctaccacgcccggcctttaaatttttactttgggccgggcacggtgccttacgcctgtaatcctaacatttcgagaagctgaggcacgtggtggatcacttgatgtcacgagttcagaccagccactgcactccagcctgggtgacagagtgagactctgtctcaaaaaaaaaaaaaaaagaaagaaaaacttttactttttacatgttattttcatcaatttaatgaatttaaataacaaatgtataaatttgatattaataaaatggaagcatttggtaatcatgttttgggttttgtgcttcctctgcagctctctagatgagaccacctatgaaagactagcagaggaaacgctggactctttagcagagttttttgaagaccttgcagacaagccatacacgtttgaggactatgatgtctcctttggggtacctcttgacttcttttatttttctgtttccccctctaagaattttagttcactaaaatgaagaatttccctccagcagagctaagcatcaagtagcatgtagttgtaggtaggattaaaagactagggttccgggaggtgaaggttgcagtgagccaaaatcacgccactgcactccagcctgggtgacagagcgagactctgtcatagatggatggatggatggatggatggatggatggatggatagatagatagatagatagatagatagctggatagatagataagatagataagacaagactaggcttcaagctgcagtccagctctaccaggcttgttgtgactctgggcaagtcactcagcctctctgagcctcattttccagcttcagtggatacccatgaaggcaaatcagagaggggcctgagtgtgtatttgtccagcaggcagatggagggaacaacaaactagacccgtagttcttcagtagggataagataactgcccaaaagttatttagattacaaagacttgagccctgctcctgtgagacagtgatggggtaggtcgggtgcattcctgggaagcatatttttgaaaagctcacctgggattctaatgtgtatccctaggtcttattcctagagattttgattacttggtctggggtgtggcatgacctgggcagggcactgggatttttaagctccacagatgattccaatatgcagctagtatgagaacttgtttttttttgaaggagtctcactctgtcacccaggctggagtgcagtggcgcaatctcggctcactgctccgcttcctgggttcaagcagttctcctgcctcagcctcccgagtagctgggattataggcatctgccaccatgcccagctaatttttgcattttagtaaagacggggtttcaccatgttggttaggctggtctcgatctcctgacctcaaatggtccacccccatcagccttccaaagttttgggataacaggcgtgagccaccaggtccggcctggtgtgagaacttctgagttggatgaaacattagccccagatcctagaagccagggaagtgctggtctttatcgactggccaccaggtggcagatttgggcaagggtctgcctttgggtttagaattattgcttaggccttaaagtagttcttttttgccagtgggagaaaatccctcaaagatggttttctgggttggttggtttgtttgtctgtttgtttgttttttgagacagagtctccctctgttattcagcctggagtgcagtggcatgatctcactgcaacctctgcctctcgggttcaagcagttctcctgcctcaacctcccaagtagctggaattataggcacacgcccccacacccagctaatttttgtatttttagtagagacagtgtttcaccacgttggccaggctggttttgaactcctgaactcaagtaatcctcccacctcagcctcccaaagtgctaggattacaggtgtgagccaccgcgcctggctcctcaaagatgttaatcctcttgatggcaattgactaataccagaaaatgtcacgaagcgtgcattttggattcaatcatggaattgttgaggacaatcagccatcagactaaagcgatagaaatagtattggaaattgcagcgggagcactgaatggagaaggcactccacataatggaggaggcaaccaagtcttagagaaggtatcaagcctgactataaggacagtgagggaattgaaaaaacaaaaaaggagcaatggagcagggaaggattgaatgcctttcaagtagattcagtaattgctgttagcagcaaaaaatgcagtagtgcctgggcagggctttaaagtgcttgcacaggcagccctagagggccgggctgcttgggaactcttacaaactgacctaccaacttgagcatccacagcctgatcagaggtgggggagttaagggccttctctcccctagcctctactagagcctgtaactgcagggaaaccaagttgcaggctaaactctgcccacacatgcagacattgattagcaagctacaaaaacagtcatgaaacctgtttttataggattagtgaagccccagtttgaccagagtactttgcatgaatgttttgttagaagcaaatgtgccaatattctagcagctgcgtttggtttacttcttcttcttctttttttttttttttgagttgaagcctagctctgtcacccaggctggagtgcagttgtgtgatctcagctcactgcaacctctgcctcccaggttcaagcgattctcccgcctcaacctcctgagtagctgggattacagacatgtaccacaatacagggctaagttttgtatttttagtagaaatggggtttcaccatgttggccaggctggtctcaaactcctgatctcaagtgatccacccgcctcagcctcctaaagtgctgggttaacaggcatgagccacggcacctggcaaaagtcatcttttggtttacttctattgaactgaaaaagtcacaaatatatttatatttaattaaatatatttatataaaaatatggtatttagtattattatttttagagacagggcctcgctctgtcacccaggctggagtgcagtggcacaatcatagctcactgcagcctcaagcttctgggctcaagtgatcgttccacctcagcctccctagtagctgggactacaggcacatgccaccatactcggctaattattttattttatttatgggtctcgctatgtttcccaggctggtctcaaactcctggcctcaagcgattctctcacctcggcctcccaaagcaccgggattacaggtgtgtgccagcacacccagccacaaatctataaatttagaaaggaggactatttctaaagagggtcccactacctgtaggcaggaagcagagcctctggccataactgaaaaacaagcacttccaagaaggggcaaagggaacatgaatttatgctgagaggcgtagctaagcatacatattcaacagattatgggaggatctatgaatattcacaaagggaggatctatgaatatgcacacatgtggagtaagctaacgtgtgcagcatgtctcccatgttcaccttaggcagaaacttaacactaacatgtattacagggcaacaaaatgagactgcatatctacataacctagctatttggtaggctgaagcaggagcatcacttaagactgggagttcgaggcagctgtgagccatgatcgcaccactgttctccagccaggatgacagggcaagaccctgtcttagaccactctgtggtcagtggttatcaggaaggaatgctagtcagttgtgctgaaaccactaaaaaggaagggcagaattaggtgatgagttgataccagtggtgaagtgagtcttttttttttttttctttttgagatggagtcttgctctgttgcccaggctggagtgtagtggtgtgatctcagctcatcgcaacctccacctcctgggttcaagtgattctcttgcctcagcctcccgagtagctgggattacaggcgcctgccaccacgcctggctaatttttttatatttttagtagagactgggttttgccatgttgtcaggctagtcttgaactcctgacctcaggtaatccaactgctttggcctcccaaagtgctgggattacaggcagctccaaagtgctgggattacaggcatgagccaccatgcatggcctgaaataatttttttgaaagggctagtttctatttagcccttaggggaaaaaaaactaatggcagttagggagggaatagaacgagtcctgtttgaactcctttcccatcatggccaaaacttaaaattttttttagatatctctgggctccccttggccaaaagatagtttgttgagtcagttgggagcttagaattttgtttttatttctcacatcattgaatcaatttgaaccaggcgacaaaaccttctgctcccagtagtgggtcagagaaccttcctgattcctgccctgagattgtctctctgaagacaacattaggctagtaggctttccagattctgtaacccattctttcaaaggaagagatgcctatatttttctagccaattcatataccttgagtatcactcaagggcaaaattatttctaacaaatcatttactaattagcaaatgcttaagtgtagatttagaaagctaaagctatacagtggctgccatctatagtttggacttgtgattaactacattgaaatgctaactctgtaccctagagtatgaattcctgattagagtccttcaggtgctaactaatttatgtatttcatgtttgataatattattacttgagctttgtgggagagcagtcttttcctcccctgagatatagctagaagttacctcctttgtgaagccttcctagatactccaagcagacacggtccttcctttctcccttgcccagcactctgaggttgactctgtggagcactgatccctctgtgttataattgtctatttacacgtcagctaccacctataacacactgagttcctcaacagcagggacactgtccattctttgatcccagtgtctggaacagtgccaagtacatagtagggacttaataaatattgattcatatgtaaatgagacttttccaaaacatgctttcgttgatgcctctcagcatttatacaccttttaccaactcgctactggccacatagacaaatgaaagcagtaatccagatacacccaagaggacatctgttcttttttctctctgtggagtgggagacttaagtggcttcttaactggtgtgtcgtctgatcaagtggtccaggtaacaggtggatgccaatgtctggcccaggcatcaccccttactggcactggtcattacagaagacactctaccagagctgaaaggacctcttgtcactaggcagctgtggagtccgctctacttgacctagtaaaatctgcctggagactgttagagtcaccccactacctgaagttacctccaggctgacctcttttttttcccaggtggagtcctggcatcttagatattttaataaggatttgcttgttgacatgttctttattcactaaggtgtcagcatattactgtcttagaactgagggttcttcatcttttttggatcaggacctccctctaagaatctgatgactgctctggtccctctcccaataaaaacttccatactcacctgttaaaaaaaaaaaaaactttaaacaaattaacagagttttattcagcaaagaatgattcataaatcgggaaggctgcaaccagaataggttcagagagactccacggtgtgccacgtggttggagaggatttaggatttatgcacagaaaaaggaaagtgacatgcagaaaatgaaagtgagggcctggtgctggtgcggtgcctcacgcctgtaatcccagcactttgggaggccgaggcgggcagatcatgaggtcaggagatcgagaccatcctggctaacacggtgaaaccctgtctctactaaaaatgcaaaaacttagccgggcgtggtggcaggcacctgtagtcccagctacttgggaggctgaggcaggagaatggtgtgaacctgggaggcggagcttgcagtgagccaggatcccgccactgcactccagcctgggcgacagagcgagacttcatcttaaaaaaaaagaaaagaaaaaggaaaatgaaagtgaggtacagaaacagccaggttggttacagcttggtgtttgccttaaacttggtttgaacagttggccgcctttgattagccaaaactcggtgattggtacaagagtagattgcagttcactatgtacagagaagcccttagatccgaactcaaaataggtaaggaggcagttttagctacacttaagttaacatactcaggagtaccattccagcttcaagctggaagtgtctgcagccccctgagaccacttaatcccaagttaaaaacccctgctcagaggcagcatctttttttttttttttttttttttttttgagagagatctcactctgtcacccaggctggagtgcagtggcacgatctcagctcactgcaaccaccacctcctgggctcaagggattctcttgcctcagtctcccgagtaactgggattacaggcgcgtgccactatgtccagctaatttttttttttgtatttttagtagagatggggtttcaccatgttggcctggctggtcttgaactcttgacctcaagtgatccactggcctcagcctcccaaagtgctggcattagaggtgtgagtcactgttcctggcccagtgaggcaccatctcattggatatggagacaaaggatctggcttagcatcctggatttgtattttctttccaagagtccttaagtgatatctaacttttgcgagctgcagtttcctcagctatgagatgagtgacattaacctcctctcttcagatttataagaggatcaattaaaatggcataggtaaaagtgcatcctagcaagttggtatctactttagaaatgaaggaggtcatatgtatgtgaagtctccagacccaacatgccatcttatatgtgtctatttctacaagtgagctagtgacaacagtaattgctatttttgctcctacatgggtagggctgatcttgactaggaggagtcaataagactcaccagccgggcgtggtggctcacgcctgtaatcccagcactttgggaggccaaggcgggcggatcacgaggtcaggagatcgagaccattctggctaacacggtgaaaccccgtctctactaaaaaaatacaaaaaaattagctgggcgtggtggtgggcgcctgtagtcccagctactcgggaagctgaggcaggagaatggcgtgaacccgggaggcagagcttgcagtgaaccaagatcgagccactgcactctagcctgggtgacagagcgagactccatctcaaaaaaaaaaaaaagactcaccagctgtggccactgtctgtgctaattggctagtgcctgcatctcagaaactgctacatattttgactattccccctgcacttaagggcatgcacactcccaaaatagactcagattgtctaaggaataatgatgatgatgaagagaaagccctctttatctggtctatttgtagtcagttccaaaagcattaagaatttctgctgaactaatgcagctagtttctttcctgtcaccactttccttccaaaatagtttcaagatctgtgggggaaaaaatctatttacagtgaacagactggtgggaggaagttgagcattggggttttctgccctgtgtaaccttgccctaagttgggcagatggtatcacactacctggacatcatctgctcattcactatttgaccagttggtcattcattcacaaatgtcctttttgcaggagggatggaggtgctagacctgcagatgctagcatgaaaagacagatctcctgctgctaaggtgcttaaagtagtggaggtcaggggacaagcaagcagtcaggcagctctgaatgcagaggcaggaagcaccacgaggcaatgggacccacagaggggtagcagggtagaggtgagtgggtctcatgtggggagggaggaagttgactgcagagaaggtgccagggggtgaaaatagcttgagagctgtggagctagaagggctctcacatttgcttattaatatgccctttgaaaaagagtggcctgatacctggagtcactcaaaagatttccaattccgataggaaaaagtcaattttggcttcagtggttgcatgtgcaccccctgatttgctgtatgctgaggcattgtggtgatggacgcaagtgcggagaccttgagcacgcatctgcccctagttcttgccctgagtcctcgaaggaggcaggagagacatcaaggcagacaggcgccgctcatcagtgatgagaccagacctggaactcgcgtcttatactcagtcctctgccctttctgctggattgtggccccccagtatagggtgcaacacacaactggagcatttaagggccacaaagagaacaaattaccaatgattgtgtgttgattctttgagctctttttttttattattatactttaagtgttagggtacatgtgcacaatgtgcaggttagttacatatgtatacatgtgccatgctggtgtgctgcacccattaactcgtcatttagcattaggtatagctcctaaagctatccctccccccttccccctccctccaccccacaacagtccccagagtgtgatgttccccttcctgtgaccatgtgttctcattgttcagttcccacctatgagtgagaatatgcagtgtttgattttttgttcttgcgatagtttactgagaatgatgatttccagtttcatccatgtccctacaaaggacatgaactcatcattttttattgctgcatagtattccatggtgtatatgtgccacattttcttaatccagtctatcattgttggatgagctctttatctcatggaaaaataatttataaaactctgtatgagaggagtgggaaatagtattaacgggtgcggggtttctttttgggacaatggaaatagctggaattagatagtggtgatgtttgcacactttgtgaaatactaaaaactcctgaattatacagttttaagaaacttttatttatttgtttttgagagaagttctctgtgtcacccaggctgaagtgtggtggcgtgatcaccggttattgcagcctcaatctctgaggctcaagcgattctcccacctcagcctaccaagtagatgtgactataggtgcgcaccaccacacccagtgaatttgtaattttttgtaaaaacaaggttttaccatgttgcccagtctggtcttgaactcctgggcccaagcgatcctccctccttgggctcccgaagtgccaggatacaagcatgagtcaccacatgcagcctcagttttaagaaacttttaaataaatgaaatatagtcataccaaaacagtaaaaatgggtttcaggaaaaaaaatgtttttttaaacaaacttacgtattgtataatcccagcccttttaaaaaatgctttcaaaaactggcagtcaactcataaaaggacaaatacttatgattccactgatgaagtagtcaaaagtagtcaaaaatcacagaaacaccaccataaatgtataatttttattttcaattaaaaaaacatcttttttttagtcaaaatcatagaaatagaaagtagacaggtggttactaagggctatgggatggggaaattagtgtctaatgggcatagagtttcagtgttacaaggtgaaaagttctagagttatgctgcccagcagtgtgaatatactttattgttctgtacacttaacatggttaatatggtaaatttagcgttatgtgctttttactatagtaaaattaaaaaaaaaaaaaatggggccgagtgcagtagctcacacctgtaacataatcccagcactttgggaggccgaggtaggaggatcacttgaggccagaagtttgaaaccagcctggtcaatatagcgagacctcatctctacaaaagaaaaatgttaaaattagacaggtgtggtgtctgtagtcccagctctctggaggcagggactgagtcagaggatcacttgagcataggggtttgaggctgcagtgagccatgatcctgccactgctgcagcctgagcaacagagcaagaccctgttgtaaaaacaaacaaacaaaaactggcagctgatacctgagagtgaatatcttttatcgctggttaatgggattgagagaatgcttcatcttatagaaagaacagtgtctttggacccacagagacctggatttaagattagctctgccaattactgagtactctttactatgaacctctgttttcctcatctgtgaaactggaataatgaatcctaccgccaacaattgtagtcaagttggaaacaatttacacaaagtgccaaacaccaagcctggcacagtaggaaccgagtaaatagtggttaatatttttatcagtgtctgcattgctgacgtctccatcatttctatacatttgtttttgaatcagaaaaagatgttattttaaaaaaataacccagtagtgccccttgtcccattcctatcagttatattattattgttactaccctctggaatttcaataactctttgttttttgggttttttgttttgttttgctttgcttttgagacaggatctctgtcgcccagtctggtgtgtagtggtgtgatctcagctcactgcagcctcaacctcctgggctcaggtgatcctcccacttcagcctcccaagtagctgggaccacaggcgcatgccaccacacttggctaatttttgcatttttagtagagacagggttttgccatattgcctaggccggtctggaacttctgggctcaagccatctgcctgcctcggcctcccaaagtgctggaatttcaggcatgagccatgcctggcctaaatagctctctgtgtttgcaaaagtgtgttataagaatcattcagagcctctcgattggatggaggctctagaatgcacagaaaaaggctgccaccgtgtatctctgcaagtcatgcacaagatggggaacagcaggcttccccctgcttaccagttcaaatacagagaactagccctgtagctgtttctttcatatctcacccattctaaagagaccacaggccttagaagtaaaggactcttttgttgaaagagtgttttcaaatttaaatgagcatttattggtcaaagatgcaccaactagtcttttgaagaattcaaggctctttagagaaaaataaagccttggaggagtatctgagaagcttgttagatgcgtgggaagagtctggaaataaaaaacttcatctggagtttctgccttctaccaacagagctgaagctaatgctctcctaagacaagcaaagcagatggtttgcatacttccttaccttccttttacttcctctgtaatagacttgtcatgtctgatgtttgagttgacgtggtactctaatagagttagagtctgcattttttttatgtcctctagtatgttctggttgatggttgagggcaacaaaccagcagtcccagatgccagcaccaagacctgagacaggtcacttaactctccgagcttcaccaccattctcaccttgcagacctcacagggaacagggaaagctctatgagatacaacatcattatgattaatcctattctgattctgaaagcaaagctcttcctacacaaactcctatttctaaatactaaaagacatttctttatggtgtattttgtgtacttgtagaaatggaaagtgttgagataaaacatgaagcaatgatgacaaagtgctaactttttcttgttttaatttctttatgctttttttccacctaatcccctagagtggtgtcttaactgtcaaactgggtggagatctaggaacctatgtgatcaacaagcagacgccaaacaagcaaatctggctatcttctccatccaggtatgtaggtatgttcagaagtcaacatatgtaattcttaaagacttccgaaatgtgacattgtggaccatttaagaaatgtcggctgagcacagtggctgacacctgtaatcccaacactttgagaggctgaggtaggaggatcacttgaggacaggagttcagaaccatcctgggcaacatagtgagtccctgtctctgtaaagaaaataaaaataaagtcacagctgggtgcaggcttacacctgtaatcccagcactttgggaggccaaggcctgtggatcacttgagctcaggagtttgagaccagcctgggcaatgtcacaaagccccacctctactaaaaatataaaaattagccaggtgtggtggcacacgcctatagtcccaactacttggaaggctgaggttgagcctcagcctgagcccaggaggtggaggttgcagtgagccaagatcgcgccactgcactccagcctgggcaacagggccagaccctgtcccaaaaaaaaaaaaaaagtcatcgtcttatgttagcatccttgtaagtgagcctttcctgatattttgcagcctgtctcattctcagtagaaaagtttactctagttacataacttctccctgctgacaatttggatactgtaagcaggcatcaggatattaagatctgaagtgagtagcttataacttttccaaatccagcctagacagttttcctctattaaattattgccctgactttaaaagaagctacttttgaccttgtagcgtttgaacaagttgcactttgtcttcaaagcaagttaaagtttgacctctacttgttttgagcctctcaggtaaagggttatttgaattccctttgcaggttggggttgtgtaccctgtggaggtggtagagtgttatatattgctgctccagggcatttaatccctcctgccttttccattgatgtgctttcaatctagaggaataaaagattgtgttggagacacaatgtggcctgcatagcatctgaaagcctgagaacatgcagggagagacatccctcatccctcagcagcctggctgctgttgaagtggttgtaagaaagtaaaagagaaatgcccacaaaacgttctcagatccagtcattcattagcacttccaaagagagcatgttgactgtgaattgggaaagggccagataaaactagcatagaattctttgaaagactaacggtatttgcattttttaaaaattataaccttactctaccccctaacattgacatcatttttaggtaattaatattttcccatttattattctgtgatctctaatgctttgttcagaataaatagtgtgtttcctttccccacactttcatccaagaagtgtgctagagttcaacaaaaacagcactagaaatcactgtcattctaggaaggccctaattcacagattgtattggtttttagacccagttagtgtgctggaggttggaggattttaacctctgtgggccaactagcctctgtggcctcagtcattcttcctgaccctggctgtgcttgagcctgtgtgttcttatccttcatctccgggggaacgaagtggatcagctcggtccagcgatcacttttggggatcagtggctttgtagatatcgggcaggcacttaccccaaaagaactttccccatatctgaagactgaaaacgtccatatcgtatttggacacactgcccagcaatacgctctagctgtgttcagaagcatgggaatttggaaagatctgctgagcatgccgtttactgtcacagatactatcttcctcaaaaaaaaaaaatatatatatatatatgggggacggggcaggttgagactgggtgagactgaagaggtgccttggccagagcaggccacacccagagaccacaggctccccggtccacctcaggcccctccccttcctgcgccgtttccggcagatccagagtggccaccgccggatgggagtcgggggaagggaggcagagaagcgggccctgaggacaagctctcagtgcttctgtgggaagtggcggcaagacggcagctcccagcgggggatggaggccgagtcagtctgctggtcactggaggccaggatgctgcctaacacagccgtcccgctccgggcctcaccaccagggcggctctccccactcccggcctgctgcccacacagactgcggggttccgggggagcaggacccaggccgttctgcgcctgtcttcttggaaggagcaggccggagcgcgggagcgccgtgtagctgtacctgcgaaggcacaggattccgcgggaagatcccgcagtttcgggccgtcgtcattgtttttatacctgtggcaaatggcatgaccagacacacggttatgtctggagaaacccctgtagaggagcaggaggttgtggacatgctgtggcccggacagtggctgccgagcagttggagcctgcacccgcccaacttggctaaagaagtccccatactctctgtggaaaagatttccagaagctgttgtgtcaatatcaaagcctcaaaacaacaacaacaacaacaaaaacatgaaattatcaacaataaagatcatccttgagtctgctttgaaaagtagggtgaaattctgcagaggcattcaactggcaagataccaccctcatagccagatctgcaggtctcagccatcatgccagggaaaatgctccattcaccactcctcagcttctgcttctggtttcagaggtctctgtattggaggggctttaaagcaagaagggtctttacccacttactcttattcacagatgtgaatatgcaggtccagtggggaaagtgacatgtcctaagtcagaatagagtcaacaagaaaacagggcccaaaatgacttagcctctagtgtataatgggcattgatgagctactggaaatacagagatgaagaaaacacagtcccatcttcaaggagctcaatctagcaagggagacagactctttgtaggtgggaccgggcttccctgcagcagaaggaagcttgaaattggtaacgagcctcagaagggacagaggcaggccaccatgctaccctgagaggatcgcatgtggacacggggctatgacctggccctgctttgacccactagctgtgctgtagggccaggtggagcctggagtggcctgtgctaaggggctactatgagctctttccactcccccaaggcattgcataaataatgtcactttctgtttgcacagcaaaatcagggacacaattttctagaacatggggtgcctcccctccccccagcccaacagaagttctacaatgactgatgggcccttgtttttgtttgagacggaacaccccacagggttccgagtggtgatttgtggcccacaggccactggcaagtggaggcagagctgcagagccctcgggagccacagagggcctgctggccgccacgacatgccaactcagctgctgctggccctcctgtgggcggcagtgctagtgatgtgcagaatcttaggactagtgccaaggaacctataaataccctgggtgacccaggcgtgcactgctgtggtggccttcacagtcagaagatgacaagctgagaaggggagaatcggcccaaggtgagatccacagaaaggccagggccaagatgcggccagcacctcaggctggtggtggtcttacgttgaccatgccagaggccagtccttgattgctccaaaccctctgttcgagggttccaaatgaaatgagcaggtcctcgtgtcaggacctaggttagtttctgaaaaagcatgaaaagcaggcctcctgaacttccccgagtgactgatgcaaagtgcgtcctgcatgcttcacagcaccatggagaggatcttcaggggcaaactgcagactatctgaatgacggcactgaccatcagcaaaccgcagagctgcctgaccaagaaattgcgagacagaagcaatgcttgcaggcgaagaagaaggggccagacacagtggctcacgcctgtaatcccagcactttgggaggccaaggcaggcggatcacttgaggtcaggagtttgagaccagcctgggcaacatagtgaaaccctgtctctactaaaaatacaaaaaattcgccaggcatggtggcaggcacctgtaatcccagctgcttgggagactgagacaggagaattgcttgaacccaggaggcgaaggttgtaacgaactgaaatcgtgccacagcactccatcctgggcgacagagtgagactgtctcaaaaaaaggaggagaagaaggaaaggccaaggcaggaatgaaacaggccatgaatgttggagtgaagcaactggcctcctcgtgctaagcggctactgtgagttctttccactcccccaagacattgcataaataatgtcactttctgacactcaccccgctgaatgtcctgcctctgctcaagggtggtatgatggggacttggcagtggaggggaacagggaaaccagacatggtggtctccccgcttcctggctacaagtccctctgaagaaatccaaaggagtaaagagcttggagagtaggcctctgtagggtgcaagggcacagctggagacggagctcctgaggctgcagctgatgctgcccgctctgcctgaactgcaccaaaaacgtgatgaggccatagcgggagtccacggaggaggatgcctactgcccgacctctagcagagactaagcaaggtgcatgaaaacttgaaccacatgtgtcacacccatgaccactacatgaagatggcccaaaacctggcccaggaattgaagaaagactcttccaatttgctgtaagaaaatggcccagggggcaagcacggtagctcacacctgtaatcctagcactttgggaagctgacgcaggcagatggcttgagctcaggagttccagaccagcctgggcaacatggtgaaaccccgtctctaccaaaaatacaaaaattagccgggtgtggtgatgcatgcctgtggtcccagctactcaggaggctgaggtggaaggattgcctgagtctgtggggcagaggttgcagtgagctgagatcacaccactgcactccagcctgggtgacacagtgagaccccatctcaaaaaaaaaaaaaagaaagaaaacggcccaggaaggctggagggccgccgtgtccattgagagagtgctccaggcactccaaaaagaaaatgaccacaatgggaagaaaccagctgaccatgagaccaagttccaaccttttacaagtggcctgtggctcctggcgccccgcccacagctgacaggggctcagaagtgctagggggaccatgggccaccagggccaccaggagggaggcaggtaacgatgcgagggcttggatgcagaacaccagctggtttgattctgttttccctgtacctgggtcctgaatgcccagaggctcagggaaacaccagccagtgctgctgcctttaaagcacttttgactgatctcttgttaatttagcaactgttattggttgatgctgcagttgctcttattgaagtttgattgatagcattaggatggtaaggcactatttttcaaataaaggttgtttaatataaaaaaaattttgtttttttttctctcagcctttcacattggttcaaaatatctttcatctggctgcatttctgatttttgttttgttttttttttcttaattttatttatttttaattaaaaataattttttttgtcaacatggggtctcactttgttgcctaggttggtctgaaactcgtggcttcaagcaatcctcccacatcagcctcccaaagtgctggggttatgggtgtgagccactgcagcagcctgttttttttgtttgtttgttttttttaatttgacaagttttcaggtcctgtgaaatcagcagtcttacctcccaccttgcgcaccctgaggaggttgcagaataaaggagaattctagggacacgtgggcatcagtgcctgtgctcagagcacctcaggcagtgtggaggggtctagaggttactcaggctctgcctggcaacccgatagcagtatcagagtatagggccaaggggacggtccttgggcttggtgtggtttattagtccttttcctgtgaccctgatggtttggttcactcatttttatctccatactgggaacaggttcaagccccagcatttggttgataatgcaggaatccttgatacttttattgcccaagcttcccttcctggtgacctcatcctagcctcagtctttggaaaagccctccttgagtgctcaggcagactcaggtgccctttcttctgggctcccatgcactctgttcttacctccatcagggtgccacatgcactagtgttatctgctgccgtggccaatcatccatgaggccatgaggaagtggaatgtacatctggtataagaagacatggcagaagccagcctccgatctgtccacacgaatacagcattcccaaagcaacgtgcatgtgccattattcactggatgagcttgaggtggatgaactagcccaccaggctctcaatgtcatgaatttaacactgaattaagaaaaatatgttttaaaaataatagtttaggtgattgctggggtgctaggagaggaaggaatggggaataactgtttaatgggtatagttggccttgtgtatctgtgggttccacatctgattcaaccaaccgtggatcaaaatatttgaaaataaaaaacaaaacaaaaatgatacaaataaaaaccaatataacaactattaacagcatttacattgtactaggcattataagtaatctggagatgacttaaagcatacagaaggatgtgcctaggttagatgcatgtatcgtaccatttcatatcagggacttgagtacccacggattttggtatctgcagatcctggaaccccttccctatggataccaaggaacaacagcactgggtctccttttggggtgatgcagatgttttgaagctaggcagaggtagtggttgcacaacattgtaaatgtactaaatgccaccaaattattcatttttaaatggttaatgtgttatgtgaatttcaccttaacaactaataatattataggtaaggcacaagttacatctgtagcacaaaaatggccctaatttttaaaacactgctccagcatagcaggtatcacatgtgaggtagcaaaagctggagatcaaagtgtgatacctggagacttatcagtaagggtcaaatgttttttcaggttttgagaatcattcttggaattgttccagaagatatatcgtataactcttcttagatgctaagataagaaggcagatatacactagctcattttgtgttattttctagagctttactccagtcaatttcttgggggcagcatttgtggaatcagtggttcatctgaagggctgtgctgtggaattactatgcatttgttttgtcttccagtggacctaagcgttatgactggactgggaaaaactgggtgtactcccacgacggcgtgtccctccatgagctgctggccgcagagctcactaaagccttaaaaaccaaactggacttgtcttccttggcctattccggaaaagatgcttgatgcccagccccgttttaaggacattaaaagctatcaggccaagaccccagcttcattatgcagctgaggtctgttttttgttgttgttgttgtttattttttttattcctgcttttgaggacagttgggctatgtgtcacagctctgtagaaagaatgtgttgcctcctaccttgcccccaagttctgatttttaatttctatggaagattttttggattgtcggatttcctccctcacatgataccccttatcttttataatgtcttatgcctatacctgaatataacaacctttaaaaaagcaaaataataagaaggaaaaattccaggagggaaaatgaattgtcttcactcttcattctttgaaggatttactgcaagaagtacatgaagagcagctggtcaacctgctcactgttctatctccaaatgagacacattaaagggtagcctacaaatgttttcaggcttctttcaaagtgtaagcacttctgagctctttagcattgaagtgtcgaaagcaactcacacgggaagatcatttcttatttgtgctctgtgactgccaaggtgtggcctgcactgggttgtccagggagacctagtgctgtttctcccacatattcacatacgtgtctgtgtgtatatatattttttcaatttaaaggttagtatggaatcagctgctacaagaatgcaaaaaatcttccaaagacaagaaaagaggaaaaaaagccgttttcatgagctgagtgatgtagcgtaacaaacaaaatcatggagctgaggaggtgccttgtaaacatgaaggggcagataaaggaaggagatactcatgttgataaagagagccctggtcctagacatagttcagccacaaagtagttgtccctttgtggacaagtttcccaaattccctggacctctgcttccccatctgttaaatgagagaatagagtatggttgattcccagcattcagtggtcctgtcaagcaacctaacaggctagttctaattccctattgggtagatgaggggatgacaaagaacagtttttaagctatataggaaacattgttattggtgttgccctatcgtgatttcagttgaattcatgtgaaaataatagccatccttggcctggcgcggtggctcacacctgtaatcccagcacttttggaggccaaggtgggtggatcacctgaggtcaggagttcaagaccagcctggccaacatgatgaaaccccgtctctactaaaaatacaaaaaattagccgggcatgatggcaggtgcctgtaatcccagctacttgggaggctgaagcggaagaatcgcttgaacccagaggtggaggttgcagtgagccgagatcgtgccattgcactgtaacctgggtgactgagcaaaactctgtctcaaaataataataacaatataataataataatagccatcctttattgtacccttactgggttaatcgtattataccacattacctcattttaatttttactgacctgcactttatacaaagcaacaagcctccaggacattaaaattcatgcaaagttatgctcatgttatattattttcttacttaaagaaggatttattagtggctgggcatggtggcgtgcacctgtaatcccaggtactcaggaggctgagacgggagaattgcttgaccccaggcggaggaggttacagtgagtcgagatcgtacctgagcgacagagcgagactccgtctcaaaaaaaaaaaaaaggagggtttattaatgagaagtttgtattaatatgtagcaaaggcttttccaatgggtgaataaaaacacattccattaagtcaagctgggagcagtggcatatacctatagtcccagctgcacaggaggctgagacaggaggattgcttgaagccaggaattggagatcagcctgggcaacacagcaagatcctatctcttaaaaaaagaaaaaaaaacctattaataataaaacagtataaacaaaagctaaataggtaaaatattttttctgaaataaaattattttttgagtctgatggaaatgtttaagtgcagtaggccagtgccagtgagaaaataaataacatcatacatgtttgtatgtgtttgcatcttgcttctactgaaagtttcagtgcaccccacttacttagaactcggtgacatgatgtactcctttatctgggacacagcacaaaagaggtatgcagtggggctgctctgacatgaaagtggaagttaaggaatctgggctcttatggggtccttgtgggccagcccttcaggcctattttactttcattttacatatagctctaattggtttgattatctcgttcccaaggcagtgggagatccccatttaaggaaagaaaaggggcctggcacagtggctcatgcctgtaatcccagcactttgggaggctgaggcaagtgtatcacctgaggtcaggagttcaagaccagcctggccaacatggcaaaatcccgtctctactaaaaatattaaaaaattggctgggcgtggtggttcgtgcctataatttcagctactcaggaggctgaggcaggagaatcgctgtaacctggggggtggaggttgcagtgagacgagatcatgccacttcactccagcctggccaacagagccatactccgtctcaaataaataaataaataaataaagggacttcaaacacatgaacagcagccaggggaagaatcaaaatcatattctgtcaagcaaactggaaaagtaccactgtgtgtaccaatagcctccccaccacagaccctgggagcatcgcctcatttatggtgtggtccagtcatccatgtgaaggatgagtttccaggaaaaggttattaaatattcactgtaacatactggaggaggtgaggaattgcataatacaatcttagaaaacttttttttcccctttctattttttgagacaggatctcactttggcactcaggctggaggacagtggtacaatcaaagctcatggcagcctcgacctccctgggcttgggcaatcctcccacaggtgtgcacctccatagctggctaatttgtgtattttttgtagagatggggtttcaccatgttgcccaggctggtctctaacacttaggctcaagtgatccacctgcctcgtcctcccaagatgctgggattacaggtgtgtgccacaggtgttcatcagaaagctttttctattatttttaccttcttgagtgggtagaacctcagccacatagaaaataaaatgttctggcatgacttatttagctctctggaattacaaagaaggaatgaggtgtgtaaaagagaacctgggtttttgaatcacaaatttagaatttaatcgaaactctgcctcttacttgtttgtagacactgacagtggcctcatgttttttttttttttaatctataaaatggagatatctaacatgttgagcctgggcccacaggcaaagcacaatcctgatgtgagaagtactcagttcatgacaactgttgttctcacatgcatagcataatttcatattcacattggaggacttctcccaaaatatggatgacgttccctactcaaccttgaacttaatcaaaatactcagtttacttaacttcgtattagattctgattccctggaaccatttatcgtgtgccttaccatgcttatattttacttgatcttttgcataccttctaaaactattttagccaatttaaaatttgacagtttgcattaaattataggtttacaatatgctttatccagctatacctgccccaaattctgacagatgcttttgccacctctaaaggaagacccatgttcatagtgatggagtttgtgtggactaaccatgcaaggttgccaaggaaaaatcgctttacgcttccaaggtacacactaagatgaaagtaattttagtccgtgtccagttggattcttggcacatagttatcttctgctagaacaaactaaaacagctacatgccagcaagggagaaaggggaaggaggggcaaagttttgaaatttcatgtaaatttatgctgttcaaaacgacgagttcatgactttgtgtatagagtaagaaatgccttttcttttttgagacagagtcttgctctgtcacccaggctggagtgcagtggcacgatctgggctcactacaacctccgcctcctgggttcaagcaattctctgcctcagcctcccgagtagctgggattacaggtgcctgccaccacacccggctaatttttgtatttttagtagagacggggtttcaccatcatggccaggctggtcttgaactcctgacctagtaatccacctgcctccgcctcccaaagtgctgggattacaggcgtgagccactgcacccagccagaaatgccttctaatctttggtttatcttaattagccaggacacttggagtgcatcccgaagtacctgatcagtggcccctttggaatgtgtaaaactcagctcacttatatccctgcatccgctacagagacagaatccaagctcatatgttccatcttctctggctgtatagtttaaggaatggaaggcaccagaacagatttattgaaatgtttattagctgaagatttatttagacagttgaggaaaacatcagcacccagcagtaaaattggctctcaaagattttcttctcctgtggaaagtcagacctctgaggccccatccaggtagaagtactagtgcaagaagggcctctgctgtccacttgtgtttctgtgatctgtgggaacattgttaacgccacatcttgacctcaaattgtttagctcctggccagacacggtggctcacacctgtaatcccagcactttgagaggctgaggcaggtggatcacctgaggttaggagttcgaggccagcctggtcaacatggtaaaaccccgcctctactaaaaatacaaaaattagctggccgtagtggcgcacgcctgttatcccagctactcgggaggctgaggcaggagaattgcttgaacctgggtggtggaggttgcagtgagccgagattacaccactgcactccagcctgggtgacaagagggaaactccattaaaaaaatgtaattcccgtgtctgccatcttaagtgtaaaggtggctaaattatatagaaaaataagacaatatcatttcccaattacattcctttcctaccgcactctatgatgctagctgagatttttccaaaagaaaatggcttaaataaaaccctaagagaaagaaaaactttaaatccctccaaagctcaaaagtaatagaaacagatgagtttggagtcaggatttctctgtaagattgcctaggctgtgtactgcacatctccaggtgccactgttgacagagattataactacaatgtgaagtgaatggtgccactgacagttatgcaaaccgtccagagcatagccacctgatcctgctgggattcctcttgccagtccatcagcagttccccttgaaagtttcaccaaacatcccttaaatctgccctctcctgcccgtccccagtggaggtcctcatcatttttcacctgcatttttgcaggagctttcttatatccaccttcctccttttctctcagcccatcatctagctacacagtctccagggtaagctttcagaaaggcaatctcttgtctgtaaaacctaagcaggaccaaggccaagtttcttagcctgaaaaatgtgcttttctgactgaactgttcaggcactgactctacatataattatgcttttctaccccctcacactcaacactttgactccagcaatcccaaatccccagatccctaagtgtgctgtgctattttcacgtggctctcagacttggccagtgctgtttccattttggtctttattccccacatctctgcctggggggtagattctaccctgaaaaatgttcttggcacagccttgcaaactcctcctccactcagcctctgcctggatgcccttgattgttccatgtcctcagcataccatgtttgtctttcccagcactgacctaccatgtgtcacccctgcttggctgtaccttccatgaggctaggactatgtgtctcctttgttgactgctgttgccctagcatcttgcacagttccttgcacacaattagagctctataaatgtcaaataaatgtgttataattatatgtttaagatagttgttcaaataaactctaaataaccccaactccaagagtgttagcaagaaatataaattttacagaagaatggttggaggtggggagggtgtccacggagtgagttacctcacacaggcacggaaaaacttgaacctcctaaggacatttttaagctctctttcccattttctctcctggattcccattgcctggtctcatttctctcttctccaccacaccacttcctcaaaaattcctttagggtttgttcttaagcttagataggtttcccattctgaaatacaaaggcctgataattagccaacttaccttgttggggatgtggaaggcaagactctcagactccatgactcaggtatattgcaacaattaggctgaaagttccttgagagtaagtgtccaaatcttttcatgtttggttcccagggctcactacagttgttggtatatcataggcactctaatatcttcttaaagaatcaatatcattaaaatggccataactgcccatagcaatttacagattcaatgctatttctatcaaactatcaaggtcatttttgttttattttttttctttgagatagaatctcgctattgtcacccaggctggagtgcagtggcgcgatctcgactcactgcaacctccgcctcccgggttcaagtaattctcctgcctcagcctcccgagtagctgggattacacgtgcctgccaccacacctggctaatttttgtatttttagtagagacaaggcttcaacatgttggccaggctggtcttgaactcctgacctcaggtgatccacctgccttggcctcccaaagtgcagggattacagcatgagccactgtgcccggcccatggtaatttttcacagaatcagaagaaactattctaaaattcatatagcggccaggcgaggtggctcacgcctgtaatcccagcactttgggagacagaggcaggaggatcatctgaggtcaggagttcgagaccagcctgtccaacatggtgaaaccctgtctctactaaaaatacaaaaatttgccagtcgtgatggcgggcacctgtagtcccagctactcgagaggctgaggcaggagaattgcttgaacccgggaggtggaggttgcagtgagccgagatcacgccactgcactccagcctgggcaacagagtgagactccatctcaaaaaaataaataaaataaaataaaataaaattcatatagaaccaaaaaagagcccaaatagccaaagtaatcctgagcaaaaagaacaaagctggaagcatcacattacccaacttcaaactctactacaaggctatagcaactaaaacagcatggcactgctacaaaaacagacaggtagactaacggaacagaatagacaactcagaaataaagccacacacctacagccatctgaacttggacaaactcaacaatattaagtaatggggaaaggactccctattcaaaaagtagtgctgggataactggctatccatatacagaagaatgaaactagactgctacctatccccatatacaaaaattaaatcaagatggattaaagacttaaatgtaagatctcaaactaaaaaatcctagaagagccaggcgcggtggctcatgcctgtaatcccagcactctgggaggctgaggcggatggatcacctgaggataggagttcgaggccaggctggccaacatggtgaaaccctgtctctactaaaaatacaaaaattagctgggcatggtagtgtgtgcctgtaatctcagctactcgggaggctgagacaggagaatcgcttgagcctgggaggcagagtgagcccagatcgcaccattacactccagcctgggtgacaggagcaagattccatctcaaaaaaagaaaaagaaaaaaaaaatcctagaagaaaacctagtaaatgcccttcttatatcagccttgacaaagaagttatgactaaatcctagaaagcaattgcaacaaaaacaaaaatttacaagtgggatctaattaaactaaagagattctgcacagcaagagaagctatcaagggagtaaacagacagcctacagaatgggagaaaatattcacaaattatgcatctgacaaaggtctaatatccagaatctataaggaacttaaatcaacaagcaaaaaccaaataaccccattaaaaagtaggcaaaggacacgaacagacatgtctcaaaagaagaaatacaagtgaccaacgaacatgaaaaaatcctcatcatcactaatcatgagagaaatgcaaatcaaaagcacagtgagatatcatttcataccagcaagaatgactattaaaaaagtcaaaaaataacagatgttgcaagactgcagagaaaagagaacgtttatacactgttggtaggaatgtaaatacattcaaccactgtggagaacagtttggagatttctcaaagaactgaattgaactaccagtcgacccagcaatgccattattgagtatatgcccaaaggaaaataaattgttctatcaaaaagacaaatacacccatgtgttcatcacagcactattcacaatggcaaagacatgaaaccaaaccaggtgctcatcaatggtggattagattgtgtacatatataccaccatatggtacatatacactgtggaatactatgctgccataaaaaagaatgtaatcatgtattttgcagcaatatggatgtagctagaggccattattctaaacaaactaacacagaaacagaaaccaaataatgcatgttctgacttaaaagtgggagctaaacactgaatacacatgggcataaagatgggaacaatagacagtgggggctattagagaggcaagggctgaaaaactacctattcggtgccctgctcactatctgggtgacagagtcattagcactccaaagctcagcatcacacagtatacctttgtaacaaacctgcacatgtaccccctgattctaaaataaaagtcgaaggaaaacaacaaaaacaaaaagaaataactcctgagttggggtctccatctcttagttcagcctattggcagtcccctttttcaagttctaaggagcctgtactagactactcttcatttagtcccataataatccctctttcaattattttgccttcaaacctatagggaagggattggaaatgaagtttcagtcattccctaagtaaaatgtatatacatattttaattgaaacaggatttcactctgttgcccaggctggagtgcagtggtgtggtcatggctcactgcagcctcaacctcctgggctcaagcaatgcttccatctcatcctcccaagtagctgggactacaggctcgtaaattttttagagaacaaaaacacagtctttagatttaaacatgtgaaagcagaaattttaaaaatacaatgaaagagttggaagacagagttgaaattgttcagaaattacagtaaaaatactaagagataggaaatagtcaacttccaaatgagaagaatcacgaaagagagaacagaaaagatagaaaaaaaattatcaaagaaataattcaagaacatttccttaaagtgaagggcatgagattccaggtatattccacatatagaaaaatatcccatacaaaatcacattgttatgaattttcataacatgagggacaaaaaaagataatataagtaaccagagagggaaaaaataaataaacaaaacaagacaaataggtcatatacaaagtaatattcatcacaatagcttcatagttctcaataataacaaaaagcctttaaaattctggttgaagcagttcagacaatgccatcacccaaaaatatgccattttggcatactgattattattagctgaaagcacttgagaaacagcagactgtacaggaagggctttccaacctcctcttttctacctaaaaacaggctagaaaatttcccatgataaaggtgccctccctctactagaaagagaaaaacatccttatcaccagagatagggaatcaatgccaaaatggatctgaacaaacttattggaataacccttgtcttccactacttatccccaatatagctcttagtaatttccccaagcccctttgtcttgtcatttcttcacaaatttatcatttctttgtctaaaacatatataaacttgtctgctatggtgacttcttcgggtctacatttgcttgtgaggactcccaggtacatgtaaaattgtaataagacttgcgtgcttttctactgttaatctttcctgtgtcagtttaattcttaggcctagctggaaacttaagagggtagaacagaaatttttcctttcctacatggtgaagggacattctgtaataaaactagcctcaacattaaaaaaatgtgatgtaataaaaaacaaaggaaaaagaaaacaaaacagaaaagcaattaataacactaggaaacacgaggcattgtacaggataggaaacgtcctgttatgttacacaatgcaacagtgggtattgttttcatcattattataatgaaaatgctaaatagtgatttgaccaacaatccagtttaaaacatttggaggaatgtgaatgtttatggccagaaaatggggagaaaaatggttaaggaaacaaaatctcatcatctagagtgggaaggagactgataattcctaatatgaaccaaaaactcaaacttttttttttttttttgagatggggtctcgctctgtcgcccaggctggagtacagtggcacgatctcagctcactgcaacctctgcctcccaggttcaagagattctcctgcctcagcctcttcagtatttgggactacagttgcacactatgatgtctggctaatttttgtatttttagtagagatggggtttcgccatgttggccaggctggtctcgaactcctgacctcagatg

SEQ ID NO: 281 - DNA, 62593 bp, Homo sapiens
tggtagcttgatggggatggcattgaatctataaattaccgtgggcagtatggccattttcacgatattgattcttcctacccatgagcatggaatgttcttccatttgtttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgttattggtgtataagaatgcttgtgatttttgtacattgatttcgtgtcctgagactttgctgaaattgcttatcagcttaaggagattttgggctgagacaacggggttttctagatatacaatcatgtcatctgcaaacagggacaactagactcccacacaataataatgggagactttaacaccccactgtcaacattagacagatcaatgagacagaaagttaacaaggatacccaggaattgaactcagctctgcaccaagcagacctaatagacatctacagaactctccaccccaaatcaacagaatatacattttttgcagcaccacaccacacctattccaaaattgaccacatacttggaagtaaagctctcctcagcaaatgtaaaagaacagagattataacaaactgtctctcagaccacagtgcaatcaaactagaactgaggattaagaaactcactcaaaaccgctcaactacatggaaactgaacaacctgctcctgaatgactactgggtacataacgaaatgaaggcagaaataaagatgttctttgaaaccaacgagagcaaagacacaacataccagaatctctgggacacattcaaagcagtgtgtagagggaaatttatagcactaaatgcccacaagagaaagcaggaaagatctaaaattgacaccctaacatcacaattaaaagaactagaaaagcaagagcaaacacattcaaaagctagcagaagcaagaaataactaaaatcagagcagaactgaaggaaatggagacgcaaaaaacccttcaaaaaattaatgaatccaggaactggttttttaaaaggatcaacaaaattgatagaccgctagcaagactaataaagaagaaaagagagaagaatcaaatagacacaataaaaaatgataaaggggatatcaccaccgatcccacagaaatacaaactaccatcagagaatactacaaacacctctatgcaaataaactagaaaatctagaagaaatggataaattcctcgacacatgcaccctcccaagactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagccaggcagagacacaaccaaaaaagagaattttagaccaatatccttgatgaacattgatgcaaaaatcctcaataaaatactggcaaactgaatccagcagcacatcaaaaagcttatccaccatgatcaagtgggcttcatccctgggatgcaaggctggttcaatatacacaaatcaataaatgtaatccagcatataaacagaaccaaagacaaaaaccacatggttatctcaatagatgcagaaaaggcctttgacaaaattcaacaacccttcatgctaaaaactctcaatcaatcaggtattgatgggacgtatctcaaaatagtaagagctatctgtgacaaacccacagccaatatcatactgaatgggcaaaaactggaagcattccctttgaaaactggcacaagacagggatgccctctctcaccactcctatttaacatagtgttggaagttctggccagggcaatcaggcaggagaaggaaataaagggtattcaatttggaaaagaggaagtcaaattgtccctgtttgcagatgacatgattgtatatctagagactgacctacttcttttcacttcccatccccagctccatccacgatttaaggggccgcaaatgcatgtgtgtggacatcccagcccgcacatccccattatccataccttcagcaaacagcgcctccttgggcagcccttggggatgaggtacatgccctctggagggtggtctcagggaagactccatttgcagagtgttccaggatcatggacatctggaatatatggagaagtgggggagataagttcctgttgggcatggcactatggattcctcattttgtagagaagggctatgtctacagaaggctgtttgatcatagaaaccaaaatgggggcccctcttgcctgggtctaagtgcactactggtgagtggtaggagcctaagaaatagctccagtgtgttttcaggtcccttgtgtgtttctttggcttactctactccaaactcattaaaacaagcctcatcataatgtgaggcacaaccaaggcaagggaacacacattttttcagaacatcttttgaaattaaaggatctggatgcttgtcagtcatgtactggaggcagctgctaccagttcacaaaaaccagttctgaaatatttaggaattttgtaagccagtccttaaatcattgacagcttgaaatcagatggaaatatttacaccacaaaaattggcaaactctgcaaatcatgtttggatttttttgttgttgttttgagaataagtttccagcacaccactacctcccaacccctctctttccagcctcatctcctgtgcctccatgtgcatatcctctgccctcaccatgccgaagttcccacagatccctggatgttccaggccttctcatgctgctgttcttttgcacgcagtgttctctctgattggaaaacccttccctgtttttttgattaaattcctattgatccttttaagacctttttcaaaaattatctctgctgtaaaacattccagaactcctctgaaacagtttctccctcttccgtgtccccacatcactttcaaaatagtaccataccggtcttattttcaatctctgtatcctcaagcctgaaaatggtgaccaaggtgtagtagatgtttagccattttaaaacatattaatcaattattaaaagataatgcagattaaataagagtgaaatggaaatttttttctttctttctaagaaagaaccctttcttagaaagggtttagttgaaagacttcaaacaatgtaagtatactgtatgtataccacatgtaatgatatgggattatatgcaaggcagggcctggctctatgggagaaaccaaagaggaaagatgtctgcatgtcctcgcaggagctcatgatgcacagaggcagtgattcctacacctggctgactatcagaatggcctggggagctttctaaacattcctgctgaatcgcagtggctaaggctgcagcccaagtgtatatacacttcagattttcctcaagtgatcttctgtagggaccccatatggaagtttaaatacataacctcctaagtggtctgtttgcctccatctctgtcctccctctgtcctctccacctgaagactattccaattgcaaatcacttgtgctgcattcctgcttcaaactttcagtggctccttctatcccctatggtgagttccaagctctgtgtaatggcattaagccctccacctcgctctcaccgtctccccttcctttctctccattttcatgtcctccccctgcctctctgtcttctagcctcagggaatgctgggtagtttccactcctttgcttagcttatacttaccttctagccgggattccttctcctcccttctcaggtggtcacatcccactactgctttaagactcatcttttgcatcacctcctccacgaagcctttgctgacaaggccccttccactgagtagctgacctttttctccatttttccctccatcattcatagaatttaacagagcctacctaagtttttttctcctggactagaccagctagaccacattgcacagctccccttacaggtggatgtggccaggtggctgagttctgatgcatggaatatgaacagaagtgagtgcagcactccaggcctggcctatgaagcatgcatcacataattcccgtactcttttcctttcgcaccaactctatgcaggtgaacatggaagtcacatgtctaagaagatggagccacagtatggaagaattaccatttggaattcagccacattataatcttgaagggaattcatattagcaagatgtaaacttccattgtagattaactgttaaaaaaactttaaaagttattctacactaatgtattcaacaaatgattattgagtacctaccacatgtctggggtgttctgggtgctggagatatgatggtgaacaactcacagtggaaaagagaatttttaaaaaatacaatgcataatttcaagtcgtaagagctgtaaaaaaatggagtatttctaccattcactttttttttttattttgagacagggtctcactctcacccaggctgtagtacagtagcaggataatggctcaccgcaccctccacctcccgggctcaagcgattctcccacttcagcctcccaagtagctggaactagaggcactcaccactatgcccagctaatttatgtactttttgtagagactgggttttgccggttgcccaggctggtctcaaactcctgggctcaagcaatccacccatgtcagtctctcaaagtgctgggattacagagattagccatcacacctaaccaacacttttaaaatttgattataagtaccccttatgtgcctgcacactagaatctgagattttgagggagagtagtggatattttcatctttctaactatagttcagtaaatgttgattaaatgaatgaagttacaaggtgtaatgtggcagggacagtgaaacatagtgcaaagggagaagaaaaaaagaggatattccttctagctgaaagtaactaggaaggcttcatggaggataatggcgtctaagctgagctttggaaactgattgccattttaacacataccttactgaagtaggggagaacatcacactaggataaaggaagaacccaaaaaagacataaatatgagaaatgcagggtgtttggggacatcgaggcactctgcttcagctggtgcataaggtgtgtgagagggaccagtgaggaataaaactgggccatggagaccctaggatctagactctaaaatgtttgaatttcaccctggatcgtcaaacaaagaaatgatgtaatctagcctttgctttgggacaaatcactttggcctaggttgcttaccatttttcacttcaccaagcatctgttaagtgccttcaatgtgttagacattgagctaggcactacaggtcatgaactggtgagacactgcccttccctcacagtctagttggggaagacaactatgtagacacaatttcaatgcaacaaatatgcaaatacaatttacagaagtagtacagaaaaaggtatgatattttgctttggttctggggcagaggtgggagtggggagagtgtcttggaagaacatatgtgagttttccagcgaacatgggcaggctttccagacagaggagtaaatgcaagcacacagagggaggagacaccatgtacgcccatcatgttaatttgaccctgattccaagattgcacagtaaaaacatcagtgttccaaattttctctatcgaacctattaataaatagtataattcaagttatcactcaactttgaaataacaaacacctccaagggaattctgcacactgattcttcagagcttgacctccccccgcctcatttccccagagcagggcttttctgatccccttcaggacctggagctccctaaggaagtaagatacctagtcttgctcatctcatttctgcagcttgtatggcccagttcgagggttcaccaggtatttgaggtacaaagagatccactttatgcacacaaaaagcacataaagtggaacctattgacaagtgagttttccatgtgttcacagagcaaaacaaaatatgaaattcccaagtctttcccattttctgtgaagtagcggaagatgtattgaatgaatgcacctctgatatgaatgccacaatgacaacatgtgttctgatatgttttaataagaccccaaaggaaagccacaccttgggagaggcaggctgaattaaccttcagtgtctatgtctattatctgctaagtgtactagataattcacagtaggttgaagaaagctttatttttttcctgatgttggtcattaattttaggtgaggttgcatgctttcaattgttgccaaaattgagagcccaatacaaatgtcatttaaggatcctcatactgctcattctatattatttaagattaaagttttattcataactttattattgcaatcatatttttggtcatctcattctgtgagtgagttaacagaccctgagagtacagataagtcctgactgaaatgttgtcacctttccacagaggtcatcagctgccgtctaaggtcctgactgtcattagctgattggctgggagggagggttcactgggaagcctggagtttgcactaccatctaagcctacatttaggtctgaaagatgaagtaacatttccaagatcacaatattataagtgataaagttgaggccttagtccaatcatttttgcggttaggctgaaccctagaagtgcaatgcaaatgctgccactccagttgcaaagtaaatctttgagctaatgtcttccctgtttttgatgacctcagtgtgatatttaaactctgtgacagactatgaatgggcacccttgtgctggtggctctaactcaggaaattatctgtccttaataggatcacgtgaagcctccagatcttattagaactgtaatttttttcagcaaggactccatatttaacaacaacaacaaaaagtagagaccaagcatcaatttctggaagtaataacaatgacttaggctggtgcataaggtgtatgagagggaccagtgaagaataaaactgggccatggagaccctaggacctagactctaaaatgtgtgaatttcaccctgtatcatcaaagaaatgacataatctagcctctgctttgggaccaatcacttttagttctccatcacactaaaagcaagtctctgcctggtgcagtgactcacgcctgtaatcccagaactttaggaggccaaggtgggaggattgcttgaggtcaggagtttgagaccagcctggccaatgtagtgaaacctggccaacatagcgaaacctgtctctactaaaaatacaaaaattacccaggtgtggtggtgtgcacctgtaatcctagctactcaggaggctgaggcagaagaattgcttgaacctgggaggcggaggttgcagtgagctgagattgcaccactgcactccagtctgggcagaagagggaaactctgtccccccgcaaaaaaaagaaagaaagagaagaaaaaaagcaagtctctacccatcctccttgctggtgaggacaggagatggctctagctgagcagtcttgctgaatcctagggaggagcagcagagagcactagacatgtaacttccccacagtctcaggactcaggggttgggcagcattgcctttcatgcagggcagttagtggccctgcccaggccctgtgcttagagggccctgatctagccctcctctgcctgtccctccgcatggtgtgaggagtctgaagggcaagggtatgagccctctacaaactgcagatagggtctgtatgggcctcttccctgttctcctgaaggtagaccatgactgcctttatgagcacctctacgcctgaggagtggatgaggcgcagctgtttgcataggctgaaaacagagcttggatgtgtgaactggggtgtcctgcaggtcccccacagttcagggaggatctggggatgggatgagaaggggcctccacgtgtggtcctgggaggtacaaatgtgctagagtggacattgggggttattgagaggaaaccccagggtgaactagactagagtacccaaaagagattagcagagctgaaaaggttattagggactagccttgaggtttagtgtcaacaatttcatgtgatgacaagggagccaaacagaagtagaaaaccagggaagaggagagaaaaagtgagaaacagagtagtccggatgaagtctgcagatgtcaaccaacacttaacaactggtggatttgcacagcaacctgggataccatcttactaaagaactctgagaattgccattcacacagaacaaaatgtgagtggtgcttccttgttgcaaatattgtggaataatatttgctattattactgctattactatataataaattgctatatttattgcaatataataaattctcccaacatttagtgtcttgcaatgacaaccattttatgatctctcacacttgctatggctcaagaattcagaagcagttcagctggtggttgtaggttacagttgctcagtgtagctgcaatcagatgatggctgggattgggtcatctttaaggctttgttattggcatatctggtaccagagttgggaagactcaaagaattgagagctgaaacacctggagtggaacacctctaaattaatatggcctttccacaaggtctcttaagcatgatggtttcaagttagctggaacttgaaatgcaccaagagaacatgcaccaagagaacaagacagccaggtggaagctgtacttcaggggtccccaacccccagagctgtggacctgtaatggtccgtggcctgttaggaaccgggctgcacagcaggaggtgagcaattggcaagtgagtcttaccacctgagcatcaccacctatcagatcagcagcagcattagattctcataggagcgcgaaccccattgtgaactgcacatgtgagggatctaggttgcacacttcttatgagaatctaatgcctgatgatctgaggtggggcagttttatcctgaaaccaccccctggcccttgtccatggaaatattgtcttccttgaaactggtcccttgtaccaaaaagcttggggaccgctgctgtattaacctggcattccatttggtagaaatgcatcactaaggccagcctatatttaatgaaagagaattagactccacattttgatagaaggagtctcaaagaactgtggacatgttctaaaatcataacagtctgccctctgatgcaagttatttatgttgattccatatgcaaaatacactcactgacccccctcctaagagccatagatatctcagctgttacagccccagtctcagggtcaagggccagtagctcatcatctgaatcaggctcaggtgctgcagctgacactcttcagcttcagatcctcatttacatcttcttgaggactgctcctcatctcaagatctgtgaactaaagtgacaagttgtttgccttccacaaacccagcatattttggtgggctagacgtaggacagtcactatagacatttcaaaaacagaacacatatggtaatcagtagtccacagcagctctgagatccagccaggaacaggttgccagttccttgattacagctcagtaatctctctaggaatgattatccctggctcttgcctccattctctaggctattggtttctccctctgaattatcgttcctgtcctattaaatgttccccgtctttatggctgagtggttttctcagtctgcttctttcccctagaatttcagaggtccaaaagcctcttttcattttgtactatctctgtctcttttagtataaattggcaatattttcattagtacacatctctttaaaactctgtgtgtttcttataaatctaactgggattcacttgtaacctcaatgagataaacttttttctactttatgcttttctctggctattgtggtactttgcccttaagattcttggaagcatttttgtttagtagagatggctgagagggatgcccttacaatctttaaggggatctttgactgtttgaaaaaaagcccatgaagtacttccttaaatctgagtcgtaacaaaggattctagagttacactgttgccttcatctttaaatgaaaattatgcattataacgttagcctcatttgccatctggagaggataagactaagaaatagttgtattttttggaaacccacagtcttggctcttttatatttaacaatttttttccttacttcatctctctgctctcatattttaccatgggcagttagaagaaccaggcagcaccttcaacattctgcctagaaatgtccttactagattgtgagatccttaggtatattttctgttttctgtgctaccacagtatctagaggatattgccaggcattctaccacctcataacccgggcctcctttcctctagctgctgatacattttgctcacttttctttcatcttttactgacagcctcttcaaaactctttgcatttccaccctccactcaggccccaaaccactgtcacatgttttaagttttgttatagcaatacctcacatctatctattgttgtgaaacaaatcaccctcaaaattggtgatgacctaaaaataaacaacttaaaaaatgtttcatggttcctgcaaatacagtattctggatcagcttgtctgggagggtctggcataagaactcttgacatcagatgattctgggattgagatccactcaaaggcttcttcactcccatatctggcacttgcatggggaaggcttgaatagctggggctattcaactactggatctctttaggcatctttctgattgtctatatggtctctctctctctctctctctctcaagggagagagcaccaggcagaagcttatcttttgtgaactagctttgaaaaccacacagaatcacttctgctacctttgcaaaatgagaagcaaattgctaaggccagcctgatatttaaagggagggcaactagactccacctcttgatgggaagtgtttccaagaattttcagacatgtgctaaaatcatcacacctctggcgttgaatgacacagaggccccatcctaatacctgtgtgcctgccaatcaggaagagtttggtagaaaatcccagactgggatattcttggaattctgggagttaggtctcccgattttaaaattacctgcaactgaatgttataccttgtaatcacttgggaaacctttgtctaccctattgcttttgaatcctgaggtgataactgcccagagtcccatttgcctcacaggaaaccacgtgttacatagaggagtgatgctgtctgtctctcattagcttcctgcttcccaaagccaggcagcaactgtcccaaaggaaaaataatctgcatcaagtagccaacaagcactctctccatctctagtctcactaagacttgctaatgcttggatttgacttagcctaggtaagtagctttttaatactaatttttaaaaaccctgctgtgccaaagaattaaataagcagtcatctagctttaaatgtttcacaaggaactaaaataacaccttttgggacaggcaatcaagttttccaccctacctcatccaaggcaaaaagaactctcttgtctacaaggttttgattgtgtagaatgtaagttttgtggccatagctaggacagtatacagtcaattttctaaatgtaaagaaatgcttggggaacagggatttttattcacaggctaacaaatgaaaatgtgtatgtgggtatgggagctggtgcaaggaagtgagatattcaacccttggagatgacaggagtccccttttctgtatttagactacgtctccgcagttcatgaaaatacatggcttgttcttttcccctttaaactattctctctctgaccttcttttcccccagctttatttgtttatttttaaaaataactgagtcacatgtgattcatttctaaagcttaatacttatgctcaaacacaaatcccattgttcacctccttagggagagtgagctactccagaagaaaaaagtagagattttgtatatgtttttgattctgtgaatttatattaaaataaattgtgcagaaaatgtgacagacctttgagtaatctgaaggtactgtattatggaccagaagggaaatgactgaaatacacaaagctttggagggacctgggaggagagatttacattcaaagttttttgctgaatgttcttgtcgttttgaatgctgagaatgcatctattgttccaggggactcctgcatcgccaccttgttcactttctcttccccattgttaatgagtgttgtttggagcctatgtggttttaatagagactcagctaaggtaagcttcggagatcatttgtttggtatagagtaagatgagtggggaaaagtcagcaggagggaagggttggaaggacagtaggctctgatgacaaaatatcacatggaatcagatcaacttccagcttttagcctcttagttttaatcacatctttccttcctgtgtatcaacaatattgctgccaaaaccctacagctaagagtgacataaacattcaaatctcccaaagacagatggcaacataaatctccattgttgctttcttagaggattcctagcctattgccatgtgtggtgaatgggacattagaggtagctatttcccacaagagcgctttttagattcaccttcagcaagtaaagatgcttcattgttttgggggaattttgctggctaaaatcctagggattacaacagcaagagaaagctaatgcttgaatgaaagtcatcagttagcaactccacaacttcctttctgtttggcctcccagaataacagatgaggttgttacagacactggccacccactacccaaaaagtctgtcatgattatacagactggtcaggctaacaggttgctttaatcatagtgagggaaaaatgaatggccaagccctgttttgttttgtttgaaatagagtctcactctgtcacccaagctggagtgcattggcacaattatagctcactgcagcctcgaactctagggtcaaagcaatcctcccacctcagcctctcaagtagctgggaccacaggtgcatgccaccacatgtggctattttttaaattttttgtagagatgagggtctccctatattgcccaggctgatctcaaactcctgggctgtactagtccacctgcctgggcctcccaaagtgctaggatttcaggtgtgagccaacacacttgacctaagcactgtttttgatcagaaaatctcaaacatatttgaatctgcaatcatgcacttaaccagaatatggccttttgctgaatttgccttattttaaagccccacttgttctattctatgacagcctttagtcaaggctgactgatcttcactaaatacattgcagccttaacacatttttggatatacttagatattagtcccctctatctgtaaatatgtctttgtttgattttagaaatccaaatttgcacatcttcaggtattaattatggctttcatggcaatctgcatgacaggaggggtcactgaatgtgtcattactctgaaggggatacctggtccctgggatgttcacatctgtcttgagtgccagggcagagcaaaatgagcccacatcagtcttaggagagagaacagaggaaatgtgaaacagccaatttaagaatcatactgagaacactaagacagaatagagacctgacatttcatgagacacatggtactgagaaacaaagatctagctttagaagacgagatggagtccataatctctggttaaaatctcttcctccatgaacataaatgttaaaacaagcaacttctcactgccaaggaactccagcggaatttaaacacatccaaagaaggatgtatttaaggaaggaccctagcacaaagatgtacctagcatgcagaatcctttgtttagaaagataattgaagctttctagagattaaaccaattaaaacaaagcacctgtgtctcacagaatacctcgagtactgtaatgggtaattctcagggtttactcagctctgaacttgattgaacatgagcgtcagtatttccactgcctctatgaaacacaggccctcaacatttccacctgaacagctcaagttgttcttcctgccactcactcatcaccctcctaatcttgctccatgatgaagctgagggaatcctcagaagccctcacctgctgtacacgctccactggtttctcctgcattggggatcagtccataccaggcaccagggcccttcctgacagcacgcacctcctctctcttgctccccagcttggaattcagtgctcccaccagcctgagcactggcctattctttctctcacctagaggcctttgttgggtaccctcaacacttcactacaccacaactcatactccatcttgtaactgtcccctctgcacgatttgaagctctgcttgctctacagcaacatagggtctggaaatgacaaagatgtgtctcccagctacatcctgagttgtggggttttttgttttgttttactagctattgcttgtttttaaactatattttcacaagacttgtgacacacatacagaaatgggttttttaatattactgtttacataaaggataatcatgtaaacaaaccagagactgagaggtgatttttcccatttcacccttcattccttctttgttcattccacaagccttctatgtgcaaggcactgtgtacgtaaggaatgtttgggagagaaacaaccacctgcagccacactgttttatggccctctgctttaggattttgtttctcctaccttctaacttatgtccttatgcacatttattcatttacttaagaaacgtttgtcaagaaccaactgtgaactaggacctacgatgggcattgagaactcagtgataaacagaagttgtctcagcctctgtttccatgaaatttgaagtccaatggcgaggacaggcagtatcaaactgtcctataactatacaatcaaactgcaattactgcaacaaaggaaaaaagagggtacaatgagaagatacagcaggggggcctgacctggggacttaggaaatgtttccttcaagaagtaactttttcaccgagatctgaggttagaggaagagaaggagcaggtgaattgagagaagccagttttgggagtggaatgggctggggatctgtggtggtgaagctggagagttgggcagggaccagggaaattcaggtcatattaagacttttaaagaatgtgaagaaaggatgtgatctgctcaaattgagatttctcagtttaccatccactagattgtaggttcttcatgtcctgaggctgcatcaaactccagcagagggttttgaatgcagttggtgctaaactgatactgcttgagcaaggggaaaggttgtcagtgctgtgaccatgcactgggatgttaatggtgacctatctacttcagtggatacttgtacctccaaaccaggagatgctgccagaagccacagtgctttcccctaggccacacagatcagaagtgaaggggccgggacactctttttttttttttttctttttgagacagggtctcgctgtcacccaggcagcatgcagtggtataatctcagtttacagcaacctccacttcctgggacttaagcaatcctccagcctcagcctcctgagtagctgggaccacaggtgcgagccaccacacctggctaattttttttttttttttttttttttttttttactttttgtagaaacaatgtttcaccatgtagcccaggctggtctcaaactcctgagctcaaagcaatccacctgcctcagcctcccaaaatgctgggattacagacatgagccacggcacccggcccactctattttcagttaagaaatgtttcagtttagataatttctctagaacagaaagaggtctgagctatcccctgtctggatgctcattaggagggtcattatttggccactatctcgtctgcaaaacatgttgtgcattattctaatggcagtggggcgagtggggtgggaagtggattctctttctctggtccttccagctcttctctttcactcagagagtctgtgataagcgacacatggttccatattccccgactttgctctttcatattctgaaggctttcgacacccgttaattcatcaccacccacaggctggccagtgggaatttgggtgtcctagtgggattctgacttctatgggattgacttcttttatatcttggaattgatgctcagcaaatatggcaaatgctcccattctctgctagagaaaatgtcacctttgaggtcattaacaatacatttgccatcaccatctttagatagtaagggaaaggctttttggaacagagagaacagatagagataaatttcagaagcccttttcatgcaataatgattttctcaaaatggaaacagatttcaaggatctttgtcccctctggagaagcttttcttccctgtgtgtgcacagtatgtgaatatgattatataaatgcagtgggaagacaagctcctgatcactctttaaatcacttcatgctatgatctcatttttaaagccactagaaaccatcgttgatggctaaattactgacatatttttaaacagcttctgtatttagctgtttggctgttttcatcccttcttctccctcatgccattctgtgatgccgcctcagcctcagagattcagcctcagaaattcagcgtggccgtctgctgaacacatgaatactaaagaattggtttccttagtaacaataaccatgaggcagctcgcagaacttcctgccttctgtctgtccgaatttgttttctgttggtcacatggaaaagacacccaaaccgcgcctgcctatataggatgcacataaatgttgtgacccatgagcagaagggaaacttgtctctgctgatttcctatttcttttctccacatgtttgttgccctgttctgtgtggacagggctaagccagggcacctgtgaagggccatgggccatgtcggagctcatcgtctttcttctaataaaaatctggaaccacaaaaccataatgcaagacacataaacgagatgaccctttgtctgtgggtcactagtgtggaactttacaaaatagaatacataccattaacgatattttaagtgctaaaaagaaaatgttaattgcatagagaaagctttgctggttttccaggtttgtttttcaagcatctttctgttgtgagaaattgctagaaccagtcctgtggggcatatcatcgcacttcacaaactgaggcttaaggaggcaaaatgactcccgcaccgtgacaatgctaggcagctgcagagccagtagtcagacccagagctgtctgaaggcaaagtccagggtcttaagcacaggcagagggaaagtggttgtccaaagtgctctggtgtgatgggcacactggcagttcgcttttgccagggcatgagatgtagggtgaagtgccgaaagaggcaggcaggctagctcagggaggccttgccgatgagtgtggctgtgaagggaacctacagaagggttttaagcaatgttggcaaatgatctgatttgcattttgggaagatcgttcttgggaattttgaggatggatttgaggggctagaactgggggcaaggagatctgttagccccttacagtcagtaggcctggtaaagagtgatgttggcctgaatctgggcaatagggatggaaaggaagggacttcccaaaactttccccacatggatccttctgcagacgccttctccatcatcgcacctgcagctgaggcttcagggtcatggggctctctctgagactcacatgctcacaagcgagggctactcttgattttgtattttcaaatctttctgattttaccctaccctttcagaccccccagggcatctcattttcttttcaactcccagagtctagtacagcgggaggcactcagcaaaagcatgttgaatgaaaggacaaatgaattggagcagcttccaatttccctccattaataaaacctgtggtcctgaccatggcagtcctattgctgccctcattcataggtgctctaggaagctggatggatgctcccatcaagcatgagatatgagcaacctggttgtcacaatgcaagcactcactgatagatatattgtatcatttcctctcttgaatttgaaactaagtgacagatgtcaaacttcatttagaccctgtggctagaaaaaaacagaactccaacaaaccatcatggcacacgtttacctatgtaacaaacctgcacatcctgcacccttaccctggaactaaaaataaaaattaaaaaaaaaaaaagaattcaaaatgttatctgtgtagtttcatatttcttagataaagaggcaaggatgggccctctctccacaatgtcctaccaaaggaaaataaggccaaagtctaacgggatggtaaccgtttgaattggacaccacacaaagagatagcagagatgttccaatcagttgaggacctgctgtgtagcgttttgagggcaggccagttcatagctaataattttaatggcttcttccatctggtggtattaatttgtcctcgtcctaaaataagtaaacattttaaaaacaagacataaaaccagaacaactgtgaggtaaactcaatgacatcagctgcaatggaatgaagcacacttactattctgtggcccagtactttagcaaataaaccaagccttcctactttttgtacttgttaacaaaaaataggtaaaccccttatccacttttttaaacagctttactgttcttctgtgttaagtgtacaactcagtgattttttttttttttttttgagacagagtctggctctgtcaccccggctggagtgcagtggcgcaatctccgttcactgcaacctctgcctcccacgttcaagcaattctcctgcctaagcaccccaagtagctgggactaaggtgtgcaccaccacacctggccaattttttgtatttttagtagatatggggtttcaccatgttggccaggctggtctcaaactcctgacctcaaatgggctgcccacctcagcctcccaaagtgctgagccccaggcatgagccaccacgcccagaccaattcaatgatttttggtaaatgtacagggttgtgccaccattaccaggatccgattttaacacatttccatcaccccaagaagatcccttatgatcatttctcctgcacattttaaagttatgtaaaatttttcatctaaatttaaacaagattaatttttgtcaataggaggtggacaaatattaaacttctaatatgaagtgatagattgaaattggagtaactatttaatggcatgagggagaaatagactttctcctattgaataacatacctcaaatctgatagaaatcatgtaaaattttatttaagatttaggattgtgtcacttgaaatctggttcataataacaatgataagagaaaaaataaatgaatataaattgaatattctccagtgccaggggctgtacaagcccctgcattcatcttctcattgaatcttcacaaacaaactataaagtagatactattaatagccacattttacagatgaggaaattgggatttagagagattaaataacttgctgaaagttagttacatagtcaataagtggtggaggcatattcaaactcaggcagtctgaccccagagcaggagctcttggcaaattttgtgttttcaaatacaaaatttgaaatttgatttgctatctgaccatcaaaggcagcactgcaagtgagttgggggaaggagttgctgagggatgagaattcaggctgatgaccttgctataatccctcctttcccattgattccctttcctgcacctagctctaccacacagcctctagatctaccacagagccccaggtttggaatgtctaaagaaagctgtgctctcccaaggactccagcttgtgagaaccgaacgccatcctttaacccaatgctccttggcatttgctgcatgttgggtagccagaagcccaactcagtacccagcatccagaagagcaggactgaaatgggcaaaagattcagggaaaaacatgtgcggaaccctatccaccttttctatgataagatgtgttcctgttaaagaaacaaaaatctgcaaataaatgcaaaggcagggaatgactgtagctttcatattctctgatgaggaggaggcttatggcctgtaaatcactgaccaaaggcaacagaccaccacgaggtctcagaaaaatactggaaaacacaactagttcttcaaaaagcacacaattaccatattttagcatatggatcctcactgaattatttcacagttataattaggttgttaatgcagtgcagaattggaccatataataatttggtatatactttatctaatctgatggaaatgcaacatttagagggcctggcttttttttcccccagaaacaattaaaaaggtctttttcaacttaagaactttaatgtcacatatcacattcttccttttttaattgtgttgggatttggggtgtgtgtatgtgtgtgagagagagagacagagagacagagaaagagagagagagattcaacccaaattatgggctcaagccttacactttcgtctctgatttgtttccagcaatcatttaagtttcttttttttttttcttgtttgcttcccccctcccgccttttcctttttgccattggtgaacagaaactagatttttttctccaggacaattctctcttccagtcatagtaaatgccaatttcatttccatcttattatttttctaattaaacatttgtcatgcagaagaagatctgaggtgcctgtgctttccattatgtaaaatattcagttatgatcatcgctctggaatggtattttgaaggtgttatggaaagaaatcaaggaaaataaaataaactgtattttaccttgggcttttgccggtttattttttccctagtttgccacagtttctaatattgactgtctcctgtcatgagggatatcatcctgcttagtatccttcaatgaggagaagtttctaaaatctgtatctaaacatttttaaaggtttaaaatctaaccctatttcatacagcattagactcctttccccttctttcttttctatccacacttagcaaaatgtatacttccatacctgaggaaatgcacttgagttcaaattatttcagaacaaatcaggaatatgccagatgtacaacctgatatttctcggacatttttttttcttcttatgacaaaacccaagggggtaggctctgtgaaaggagagtttattttctaaattcttttttttttctttgagatggagtctcgctccgtcccccaagctggagtgcagtggcgcaatctcggctcactgcaagctccgcctcccgggttcacgccattctcctgcctcagcctcccgagcagctgggactgcaggcgcccgccgccacgcccggctacttttttgtatttttagtagagacggggtttcaccgtgttagccaggatggtctctatctcctgacctcgtgatccacccacctcggcctcccaaagtgctgggattacaggcgtgagccaccacgcctggctattttctaaactctttaaacacaaagcttttccattttctggggcaagagatttttcccaaacattaacaatcacatcttacatctatgtttacatccatacatttatatctatatgttccatatatgtgtgtatgtatattatgtgtatctgtattatacttttattttatctgtctattactctataaaaacttagactgtaattttttttttttttataacagagtctcgctctgtcgcccaggctggagtgcagtggcaccgtctcggctcactgcaacttccatctcctgggttcaagcaattctcctgcctcagcctcctgggtaactggaactacaggcgcctgccaccacacccaactaatttttgtatttttagtagagattgggttttgccatgttggccaggctgatctcaaactcctcacctcaggtgatccgcctgcctcagactcccaaaggctgggattacaggcgtgagccaccatgcccggcctagactttaatttttaattattttcagagtttacacagaattagctgtgacattcagttttataaaggtgggaccatttcctcgcaaattctcacaatgtatcctgagactttgctgttgtgggaagaaaagcttgtgtactttctgcaattgccacctcctgaaacacagtgtgtacggtgtgtgtgtatgtgtgtgcgcactaggcattgtgctgttatttggatctcactgtgagtaactgtgtgtgtggtattaggaaaatggaagatgctgctgtcgtggcccctcctagattccatttactgagctagtgactctgctgcagctgctttgggtgttggctcctgaaggcccgcaaatgcctctacttctgaggaaattgccctgtgctaataggggagacacctcacccaggaagttagtgggagaaggccacagccagtgactggtggataagagcatagaagaccagcaccttggcctcaagaggaagcaattctgtggtgtggtcaatgtttcagagccctcccccatgatccaggccaagaatggaatttccatgagaccacatccttccccttccctctctggcttcactgtctccttgccaggattttcctgtggagcactttctcaataaatcacacacacccaatccctgtctcaggctctgctccaagcaacttctttcagttttggatatccaatatcctaatcggtaaaacacggataataatttttgcttagtctatttttcaaagttttggtacaaatggcaaataatgtgcaagaattttgttaacagccaaaggtgtaaaaatatttcttaggcaacatgataaatattattcatgttaatatttaactttagcttccatgaaactatagctgagttcccccagcttgggttttcacactttaggctaatgtccactgtgttcattttattccccaggaagagctggtttgtaagagttgctgccctgtctgctttgctttctgcacctgggctctgcagggtaagtgagtgaaggagacgtgagtccagtgaagggccatgtcagtctagagagcacacacctccagccaaaggctaaataaacaggaattcagacctggtcttgcctgatatttagagggttttaagtgaagctagccaccagatttttaaacaaaatctccagattcttgaatataaatattttttttgagaactccacccaggctggagttcagtggcacaatcatagctcactacagcttcaaactcctgagctcaatcgattctcccacctcagcctcctgagtaggtagaactacaggtgcgtacaaccacacccagctcattttttattttattttttggggacacagggtcttgctatgttgcccagactgtcttaaactcctgggttcaagcaatcctcctggcctggcctcccaaaatgctgcgatcgcaggcatgagccactgtgcctagcttctaacaatagatttttaaacaattttaacaccctactattcaagcaacacatgactgggggcctaactgagctagcagtgtgttacttctgtccagattttggcccttgaaagaacagaccagatgatccccactgaggcctcaatattcagcacaacactcagcataaggcagatgaaaggctctggataaacaggaccaccattagaaatatgggtttccaaggagttaaataaaggactgctggtttcagtaaatagctctctactttgtaaaaatcactaagcatatgattcttttccctaaacagtattacaacatatgcagagttttattcagttgccagcttgctattgcacaacttttcaaggacactgagtctgtttcctcgtgtattaaacggaaacaattatgtctgacctgaaaataagtgaaagcatgtaaaaatgctttacaaacagtgatgatcaatccagatggaagaaatcattgttctctaaattctgccctgggagctaaatcccacactcagaaattttaaaacaaggaacggaggctttcatctttcttctaacatagtgtttccttaactttagttgagatttttgctttaaaaatggcattattttctattactattaattactttttatttaagtcaaatacattcttttcctcactatcagccatctttttcaactaccaattttgtctttttgttgttactgtttttttgtttgcttgtttgtttgttttttgaggcagagtcttacttgcccaggctggagtgcagtggtgcaagttcagctcactgcaacctctgcttcctgggttcaagcaatcctcctgcctcagccacccaagtagctgggattacaggtgggtgccaccatgtccggctaattttttaatttttagtagagatggggtttcgtcatgctggccaggctggtctcaaacccctgacctcgggtgatactaacactttttttttttttgaggcctcctcatcctcccaaagtgctgggattacgggcgtgagccactgcacccagcctcaactacgatttttttttttttggtctaattgagacagtcttgttctgttgcccaggctgaagcacagtggcacgatctcagctcactgcaacccgcctcccgggctcaagcaattgtcctgcctcagcctcccaattagctgggattacggtgtgtgccacaacacccggctttttttttttgtatttttagtagagatggggtttcaccatgttggccaagctggtcttgaactctagatctcaggtgttccacctgccttggactcccaaagtgctgggattacaggtgtgagtcactgctcccggccctcaactaccaattttatctttgtcctaagcaataatatccataaatccacaggtttcatgtcctatatttaacttttatacacttacacacacacacacacatacatacacacatacatacacacacatgtgtgtgtaaatacatacatatgtgtgtgtgtatgtatgtgtgtgtatagaatacgcatctgtgtgccacctaaaatcaacttgcttatcaccaattttttgattctccccttttgatatattatgctccactagaaatagtaaaacttcatggaaaaattttctgcctctttcaatttattaatttacttattgaacatttgtcagctactgtctatcccacgtaaacctagaacaggcaggagagaattaaagtcacagagttccccaacattttaaactcctctaaagagctttgaaagtcaatgcagctaatgaacttcaagtaggaaacgctccaaatcttcctgctccagatttctacggacttggtaatgctagtgagtcacagagggtaagccttagagagccatatttgcaaagtgcctaagatctctcagactctaccctaggggactctaggtagtgtcacaagtgagttttaacagcagagtctggtggcgccttctcaactgcttttatgcaggaagctgtctgcaactatgttcctaactacccaagccccctaacattgtaatttctaagattggctttagtcattttataagataatggcattcaaactggtctccagtaggatatgagacaatgttaataattacaatctgcatttaggcggcgcctctcctggcaagcactagagttttacaaacgttatctcattttcatcttcatgacacccttgtgaagcaagctttttttattgcatttctacagagagagcagctgaggcgtgaagaggttaaatggattacccaatctgaaatcagagacctcaaacctggtttgatgttgtctaaagaaagtatttgtaatgtgtttgtgggggagtttaatgctaaatgcagaaaatgtctctgaaaatacttacatttaggtctgtaaactcatagactctttaaatcttgtattcaatgtggcatcaatggcatgcaccttctctaattagcaaacaaacattgaggcttaattccagagtctgacatactaaatactctctgccagataacataataaatctttatgtagcacttgcatgcaccaggcattgttcaaagagctctctaaatattaacctatttaatcctcataatgactctacgaaggaggtaccattatactactcattgtacaggtaaggaaacaagcacagagaagttagtaacttgcctaaaatccctcagctggcaagtggcagagccgggatttgaatccacacagtctgattcttttgatgagagcattctgcagtcattaggcttataatagttatttgttgcaaatgttctgtttctcatttactcaagccaaagtttttcctatgtcagtggttagcctcttaaccctatttcaggcagaatcctcctatttaggccaatgattctttcccctctgattgtgtttgtaatctaggtgatggctagctggtatactagcagagtgagtggaaaaggtgtcagaaaagggtatcagaggctcagcgactcaacccatctcattagagtcaacgaggcacctcttaaaagtatagaagaatggaaatcctttcttcatttgtgctttggaaaaagaaaaagagtaaaattctcccaccagtttgccccagaattgggatgagttgttatagtaagcaaagatgtttttcacaagtgatttatgcaatatacattatgtttgctttcaaagtgctgtacacatttattatctcatttgatccttacacaacaccccagtgaggtaatcaggaaagctatttttataatagccattctacagatgagaaaactgaggctcggcgtcattgaataaacttgtccaaagtcatccagctaatgagctgcaggagcagagtatgggcagtgtcacatgtattaataagctctgtaaattatctcacctcatattaagcttaatagcttctggtgatatcattactaaaatcagacgtttaaacaaataagtcagagcgattcatcctcagggttgcagacattcaggacacttgagaacatttaatgatttccagcttcagctcccttcctcagtgagagaacataaaacagacttttcagggtcatggaaaggagaagggcttccagatggccacttctaccaaacctgggacgtgtacttgcttgtttgcccagacactgcctactgcctgaatgaaggggagctctagtcccgagaagagccatctcccttgttgcagaaatgtgtccctcctccattgcagacactgtgctgaagaattcattccaccaaagaaggaatgaacaggcaattccctgggatgagtaatgtatgggctaggagttgaacccaggaggtcaaatctgcttttactttctctattacatgttttctatagaaaattcgttatttttctcttccagtcactggaacaattgcagtgaattaccatttgtgatttaagatattttgatacttagtctgcctattttttacacatgcaattcaattatttcactaatgggtaatgggtcagtattccaagcattgacttcgcccttcctctgcataagatctttagctccagttgacagggacccaattgtctgatatgagtccctttggcttttcctccctgctgcctcaggatctcctggattgtctcccccagatcctctttcataggagaggtggcctcctcccttctcctcagcattctctctgttgtctgtaatttctcatttggtgatttacccactcacactattattacttttgtgtctgacagaatgtttcctgtcaagtatcctttaaagccactgaccaatttcatttataaattaaaatgcaggccgggtgtggtggctcctgcctgtaatcccagcactttgggaggccaaagtgggcagatcacttaaggccaggagtttgaaaccagcctggccaacatggtgaaatcccatctctacaaaaaatataaaaattagccatgcatgttggcacatgcctgtagtctcagacactcgggaggctgaggcacgagaatcacttgaatccaggaggcgaggttgtagtgagccgagatcacaccattgcactccagcctgggtgacagagagagactctgtctcaatagatagatagagagatagataatagagagagagagatagatagatgatagatagatagagatagatagatgatagatagatatagatagatgatagatagatagatggatagatagatagatagatcctaaataaaaattggagcaacaaggaaccagaaaaatatcaagattaatataccattaccaagtatacaaggattactctaagattgtaagtatactccagcatcaggaaacctattaatgtaattcaccatattcatggattgaaagagacaaaactcatatgactattccacagatgttgaaatttgataaaatgtaacatcctttcttgataacagctctcaaagattggaatagatggacactgtttctttaaaatgataaatgtttcatctcaaatgtcagctttattctttttctcaggtttattcttaatgggaaaacagtagaagtgctctcattcaaggaagaataggacagttggccaggtgcagtggctcatgcctgtaatctatttccaacactctgggagatcgtggcaggaggatggcttgagcccaggagttcaagaccagcctgggcaacatggtgaggccccacatctaccaaaaaaaaaaaaaaaaaaacttagccagaaatggtagcacatgcctatagtcccagctactcaagaggctgaggtgggagaattgcttgagcctgggaagtcaggctgcagtgagccatgatagttccactgtattccagcctgggtgacagcacaagaccctgtctcaaaaaacaaaacaaaacaaaacaaaagaataggacagttccagtattatttaatattgttctgaaagtacgagccactataattagacaagagaaagaaataaaatacaaaacagcaaaggaaaagaggtaaaattataattattggaaaatcttagctaatcaaccatagaactataacaaacaatagaagaatttgatctagatgtgttattcaatgtgtagagatatggacattctcaccttttgctggtaagagtataatttgataccacttatatggaggttaatttggtatcaactatcaaatgtaaaatgtatataccttttggcttaacaatttcatttctaggaatatatgcatgtacatgcacatatgcaaaatgatatagttacaggatatttattgcagctttatttttaataaatgattagaagcaaatgccaatgaataggagactggttagataaattatatcacgtaatagaatattatataatcattaaaaaatgaggcggctttcagggtgttgagtattggtgttaactatttctacaatacgttggtaaatgatgagaaggaggtataaaatcacatgtaaagtaactttccatctggacgtaaaaagaaaggaatgaaaaaaagacaatacatatgtttgtgcttttatgtaaatacctaagaaactaccaaaagtgggtgcatctgggagtgaaactgggtgactgaaaagtaagaaagattcattattttgctattggtttttggtataaattgttagtaaaacagtttttaaagtattagtaaaacaaaaaatactaagaaccaaaataaacaaataagcaaaagaccaagaaatccactttctcctaaagaaatggaaaagaaatccacatggaacctgcttcagtatccattgctgtataacaaaccatcccaaaactgaatagcttaaaacaacaaaaatttattatgccttacaattctgtgagttgacttggctcagctgggcagttctgctccacagggcatagctgagatcactcaggaactgcactcagtggggagcttggctggtgctggtactcacaagatggtgcttcaacctccagaacctttccatgtcttctcatggttcagtagtctactgaagctgctggatagcatggtagctggcagagcacaaacatggcagctgcctgacgtttgaagtcttaggcctggagccagcatggtatcactctttcctcattctactagtactcaaagaccaacccagatgcaagggatggggaaataaaccccgtatcttgttgagacgaatggcaaggaatttgcagccgtctttaatccaccacagacctccacatttgctcagctcaaatcactacaagttatcacaatattatttggaattatttcttgaagtgttaataaatctgggtcaaaatctcatcttgtgcagcttttagtagttactgtttctccaaaagaacaaaaaagctcaatttctggccttaggttaatagaaaaataatttatagaatcttaaaatttaagacctgctttaaaaactgtttaaaattcagttagaatttatataggtctgttttatagatacaaagatcaggtggcacatctatgaaatctagagaaagtgggtgaaatgaattttcatcaacttttttcttttcaaaaagaaaaaccaatatgtttctgcaaaaaagatgagtatttctggaaggcaaaaacaactataaatcagaggtgtcaactagcattattactaactctagagaagagcctgctctggatgccctgcccagaaactccttgctggccaccaggagtcccactgacttcccaagaaagctgataaaaaggatgtagggcttgagataaggcctccaatccaccagagtgaaaatgccctgtcagctataatccagccttctcaccagtcctcaaatatgtcttatttcttcttgcctctgagtttctgcagatgccatttctctgtatcatgatgtcccacactctccttcccacatttttgtttctcattttgacttagctaactcctttatccgtcaggtaatgggattatatttctcatccacagtgaaactttctttgatccatccccttcccaaaactaagtcagatgctcttgggacaattaccacctctgttatatagaaagttttgcagaaactgcctgacctcttttctggggccttcacctgctgctcaggggtggccctcaacagctatgtctgtcctctaacaccaacatccctagctcagtccagttagtccaaaggcagacactaaatacagggtggaccaatgacattccctttttaactgaaatgattacagttgttgataactaagtcacactaatgaaacataatagaaggaagattcacaaactgttgccaaagaggtagagctaattttgttcctgcacttgtttatctcttccttggatcctgttagacttctccagtctctcccatgaattcagttctttcatgaagttttccagagttgtctataactcccgaccaaaagacttaacacaatttataccaactggcatgaactcacacttgcatgcatgattgaatggttaaagtatttgccctatgtcctttcttggagctagaatgtaagttctgtgaggacagggaaggtgtctgcctcgtttggtgttgcatcttgagtaccaaacagagtgcctggcacacagtcagcacttaacaaatatttgttgaatgaacgaattgatggaaataaaagactgatgcaactctttgggaagtgcctgggaaagaatgacttcactttggctggatgagaggtttaagggaccattgtggatttggattccatgttagtgagaaatgctttgaattgaaacctttgattagattgctcaggtagtctcttagctcaacttttggaaaatgatgtctcacaatcctatcttattttgtgggaggaggagtaaggtacaaacaccttgtctacatttgaatgccaagattggctgaaggagatttctcaccatggacaggaaagtctctcaaaattgagtctgggcaggaggggaagatgctctgggacgcataggacattgcaggactgtgtggcccattatagacccattcctgagagggcagctgtgcagcaggaacaaccctgatgtagcctctggtggttactatgtaaggacagagcagccatgacagccattttcagccgggagagctgctggtgggtagatgggagtgagaagataggggaaatcccatttcctgtcttcaccagtcaccacgtataaggcaaactggaaacagggctggcagggatgacatttcagtatccaaattgattctaaagccacagagctctggggttggcccctcctctccaagctgttaacacttcatggctagtatcccaagagttatactctcagctgcatgctgaggtattttagtaaaaagcagggctcctgcaggacacaggtttttaattcatcacagaagtgcatctctttgtaattttatattttttgtagcacatgagcccaccagataacttggtctgatgtgtgaaaattgacttcaggaaatgagaactttgtatttttatgttttagctatctactttctaatcgtcctgaaaggtgaaacaactttacattagaatatgtcttgataacagccaaactgtggatgaaaaaacatttctaaactatggaatgatatccaactaagagtcaaggacaggctggggcaggcacagtggctcacatctgtaatcccagcacttcaggaggccgggtcaggatgacctcttggggccaagatttcaagaccagcctgggcaacacagcaagatcctgtctctacaaaattttataataattagccagatgtggtggtgtgtgcttgtagtcctagctactctctggccaaagccagaggattgcttgagcccagcagttggaggctgcagtgggctacgatcacaccactgcactccaggctgggtgacagagtgagactgtgagaccctgtctctcttaaagaaaaaaaaaaaaagaagagagccaaggaggaatgtctgatttcccaacagtcacaatccagtaaccctcaggcctagtgactcacctcattcttcgtggggagggttccagctctgccagttcaagtttgcccaatcctgttaggaaaatactctgccaatgtacaggtgtctatgtagaggtgagacatttttgtcaattaccatgggttcaagaccaccaaatcaattttagtaacaattttattcaaaacatttcttaatatttggtgagtgcctatagctttaaaatgtttgtttaacagttcttaaaaggccttactctagttagctgagggggaattctataggccagtggctaagctcctacatgctgtagtcagacagccttggttcaaatctccattctcatgttcattaggatgtgaccagttccttaacctcgctacacctcattttcctcttcagtgagatggagataataataggacatccctcataaaattgattaactagcacatagtaggtgcttaataaatgttattactccagctatctttaaccctgataatagaaaattattgtataaattcagctttctttgtgcggcagtttttaaaaactgctacaaattctctgacactgttccccttgaggcggtgtctgtgccctccacttgcatctgggcaggattgtgactgctttgatcattagaatctatcggaagtggcactatgtaatgtccacggttcagtcataaaagaacatgcagcttgtgccttgtttgctgaaacagagccaccaggtaaagagccctcgactaccctaaggcttccatgctggagaggccactagtaagcactctggctaacagtcccatccgagtccagccatccggaagtggatcttccagccccagctgtttcagtcctcaattgctctagttacccctgctccccatcagctgtcggagtcctcccagctgagttctcagactgtggagtacagacaagtcattcccactgaccctggacacatacctggccccatgaatcataagcataatagaatggttataattttatgctactaaatttggggtgatttgatacacaacaataggaatatggaacatttcagaaataatggatatagcggtaacaatgggataagagggaaaatttaaccatatcgaaatcatcagatcctatcttgatctatgtgcacatttttcaaacacatatatagtgtctaatgattgcaaagttcactttcgaagctaaaagttctatgttaatctgcaggacctgcagcaaacagaatgtcatatgaactccacagtctgaaagggcccaaggggaagcacactagcccatgtagacagagattccccttgcttctgttcttgagagaactgaggggaaatgaaagctgaaaataaaagcccttggtttaaatggatccccattgcatttcatcctatcagatcaataatgcagagattcctaaaatcaatgtgctggggcagttttaacaaatgcacttgcctgttcattaatattctgacttttaaatataaacacacatacctctttgttgtgataagaattacagtatattaaagacagcaagataaacactacccattaggttatcagtttaattttataaatgaggaaactgaggttcagtaaagcaagaaaaacttgccatgataaaagaaacaacaatgccttttacccagcaccaaagaatatgccaatatccaggcctttctttggatgcagaaataaacatgaaaatgctgagtacatcccctaaagttctacccccggttcaactcaaatcataggaaagctacatattaaatttatggttttacctccctacgtgaacaccttccctgatctaagatggattcaccattgcagcctagttttcatcatggttaggtgtaagaaatggccttctgtcattgcctgtatggggtttgatatatttcacactaaaagatccaaatggctgtcttagagctaggttcatagaagaattttgtatttcctaatgatcttggtttaattagattacaaaagctctggaatggatcttgtttcccttggcatgcggctgtgttaatacatgtggtaaccgcatgtgaatcctctttcgtccattgacaggctgtgtgagcaagtcaccttcctaagactccatttttgtatcctgaatgagggtgactattctacaacctgcaccagagttgtgaagattaaaccaggtactatgacatgatggcaacttccacacaggaaaatgctttttctttttcttttctcttctttttacaaaagcatgatgatcttttcagctagatttctaataaagtacaaacagctgagtgcttttctttatcctggccaaaaaattattgtcatatgtgaagcaaaaatacctgggtacatgccccatttgttcttttttgaggcagggtctcactttgtcacccaggctagagtgcagtggtgcgatcacagctcactgcagcctcaaacttctgagttcaagcaaagctccagcctcagcctaccaagtatctggaattataggcatgcgccaccatgtccgactaatttttaatttctttttgtagagacagggtctctctatgttgcccaggctagtcttgaactcctggcttcaagtgattctcccgccttgccctcccaaagtgctgggatccaggcatgagtaatagcacccagcttatttgttcataattataattccaaagatatttattattattattataccctaagttctggaatacatgtgcagaatgtgcaggtttgttacataagtatacacgtgccatggtggtttgctgcacccatcaacctgtcatctacattaggtatttctcctaatgctatccctcccctaggcccccatcccccaacaggcgctggtgtgtgatgttcccctctctgtgtccatgtgttctcattgttcaactcccacttatgagtgagaacatgcggtgtttggtttcctgttcccgtgttagtttgctgagaatgatggttgcctgcttcattcatgtccctgcaaaggacatgaactcatccttttttatggctgcacagtattccatggtgtatatgtgccacaatttctttatccagtctatcattgataggcatttgggttggttccaagtctttgctattgtgaacagtgctgcaataaacatatgtgtgcatgtgtctttataatagaattatttataaatctttgtgtatgtacccagtaatgggattgctgggtcaaatggtatttctggttctagatctttgaggaattgccacactgtcttccacaatggttgaactaatttaccctcctaccaatagtgtaaaagccctcctatttctccacatcctctccagcatctgttgcttcctgactttttaatgatcaccattccaactggcgtgagatggtatctcattgtggttttgatttgcatttctctaatgaccagtgatgatgagctttttttcacatttgatggctgcataaatgtcttcttttgagaagtgtctgttcacatccttcgtccaatttttgatgatgttgtttgtttttctcttgtaaatttgtttaagttctttgtagattctggatattagccctttgtcagatggataggttgcaaacattttctcccattctttaggtttcctgttcactctgatgatagtttcttttgctgtgcagacgctctttagtttaattagatcccatttgtcaattttgacttttgttgccattgattctggtgttttagtcatgaagtgtttgcccatgcctatgtcctgaatgttattgcctagatttttcttctagggtttttatagttttaagtctttaatccatcttgagttaatttttgtaaaaggtctaaggaaggggtccagtttcagttttctgaatatggctagctagttttcccaacaccatttgtgaaataaggaatcctttccccattgcctgtttttgtcaggtttgtcaaagatcggatggttgtagatgtgtggcattatttctgaggcctctgttctgttccattggtctatatatctgttttggtaccagtaccaagctgttttggttactgtacccttgtggtatagtttgaagtcaggtagcatgatctctagcttcgttctttttgcttaggattgtcttggctacacaggctctttttttgttccatatgaaatttaaagtagttttttctaattttatgaagaaagtcaatggtagcttgatggggatagcattgaatctataaattactttgggcagtatggccattttcactatattcattcttctatccatgagcatggaatatttttccatttgtttgtgtcctctcttatttccttaagtagtggtttgtagttctccttgaagaggtcctttacatcctttgtaagttgtattcctaggtattttactctctttgtagcgattatgaatgggagttctctcatgattcagctctctgtttgtctattattggtgtataggaatgcttgtgatttttgcatattgattttgtatcttgagactttgctgaagttgcttattagcttaaggaaatttcaggctgagacgatggggttttctaaatatacaatcatgtcatctgcaaacagagacaatttaacttcctctcttcctgtttaaatacgctttatttctttctcttgcctgatttccctggccagaacttccaatactatgttgaataggagtggtgagagagggcatccttgtcttgtgctggttttcaaagggaatgcttccagcttttgcccattcagtatgatattggctgtgggtttgtcataaatagctcttattattttgagatatgttctatcgatacctggtttattgaggtttttagcatgaaggggtgttgaattttaccgaaggccttttctgcatctaatgagttaatcatgtggttttgtcattggttctgtttgtgtgatggattatgtttattgatttgcgtatgctgaaccagccttgcatcccagggatgaagccaacttgatcatggtgggtaacctttttgatgcgctactgagtttgctttgccaatattttattgaggattttcatgttgatgtttatcagggatattggcctgaaattttttttttgttgtgtctctcctaggttttggtatcaggatgatgctggcctcataaaacgagttagggaggagtccctctttttctattgtttggaatattttcagaaggaatggtaccagcaactctttgtacctctggtagaattcggctgtgaatctgtctggtcctgggctttttttggttgatagtctattaattactgcctcagcctcaaaacttcttactggcctattcagggattcaactacctcctggtttagtcttgggagggtgtgtgtgtccaggaatttatccatttcttctagattttctagattatttgtgtagaggtgtttatagtattctctaaaggtagtttgtatttctctggggccagtggtgatatctcctttatcagtttttattttgtctatttgattcttctctctctcttattagtctggctagtggtctatccattttgttaatcttttcaaaaaaccagctcctggattcactgattttttgaagggtttttcatgtctctatctccttcagtactgctctgattttagttatttcttgtcttctgctagcttttgaatgtgtttgctcttgcttctctagttcttttaattgtgatgttagagtgtcagttttagatctttcctgctttctcctgtgggcatttagtgctatgaatttccctctaaacactgctttagctgtgtcccagagattctggtacattgtgtctttgttctcattggtttcaaggaacttatttatttctgccttaattttgttatttacccagcagtcattcaggagcaggttgttcagtttctatgtagttgtgtggttttgagtgaatttcttcatcctgagttctagtttgattgcactgtggtctgagagactgtttgttatgaattgcattattttgcatttgctggggagtgtgttacttccagttatgtggtcaattttagaataagtgtgatgtggtgctgagaagaatgtatatattctgttgatctggggtggaaagttctctaaatatctattagatccacttggtccagagctgagttcatgtcctgaatatccttgctaattttctgtctcattaatctaatattgacagtggggtgttaaagtctcccactattattatgtgggagtctgagtctctttgtaggtctctaagaactttctttatgaatctggatgctctggtattgagtgcatatatatttaggatagcacttcttgttgtattgatccctttaccattatgtaatgctcttctttatcttttttgatctttgttggtttaaagtctgttttatcagagactaggattgcaactcttgctatttttttgctttccatttgcttggtaaatattcttccatccctttattttaagccgatatgtgtctttgcagtgagatgggtctcctgaaaacagcacactcgtgggtcttgactctatccaatttgccagtctgtgtcttttaattggagcatttagcccatttacatttaaggttaatattgctatgtgtgaatttgatcctgtcattatattagctggttatttttcccattagttggtacagtttcttcataatgttgatggtctttacaatttggtatgtttttacagtggctggtacccgttgttcctttccatgtttagtgcttccttcaggagcttttgtaaggcaggcctggtggtaacaaagtctctcagcatttgcttgtctgtaaataattttatttctccttcacttatgaagcttagcttgggtggatatgaaattctgggttgaaaggtttctgccaagagatccgctgttagtctgatgggcttccctttgtgggtaacccgaccattctctctggctgccttaacattttttccttcatttcaaccttggcgaatctgatgattttgtgtcttggggttgctcttctcaaggaatatctttgtggtgttctctgtatttcctgagtttgaatgttggcctgccttgctaggttggtgaagttcttctggattatatcttgaagattgttttccaacttggttccattctccccatcactttcaggtacaccaatcaaacatagatttggtcttttcatgtagttctatatttcttggaggctttgtccatttcttttcactctttttcctctaatcttgtcttctcactttatttcattgggttgatcttcaatctctgttatcctttcttcttcttgatcgattcagctattgatacttgtgtatgcttcatgaagttcttgtgctgtgtttttcagctccatcacgtcatttctgttcttctctaaactggttattctagttagcaattcatctaaccttttttcaaggttcttagcttccttgcattgggttagaacatactcctttagcttggaggagtttgttgggctccaccaagtttgaacttccaggcagctttgtttacactgtgagagaaaagctgcctactcaagcctcagtaatggctgacacccctccctcctcccaagctcaagcatcccaggtcaacttcagactgctgtgctggcagcaagaatttcaagccagtggatcttagcttgctgggctccatgggggtgaaatccactgagttagactacttggcttcctggcttcagccccctttctaggggagtgaacagttctgtcttgttggcattctaggtgccactggagtatgaaaaaaaaacttctgcagctagctcagtgtctgcccaaacagccacccagttttgtgcttgaatcccaggcccctggtggagtaggcacccaagggaatctcccggtatgtgggttgtgaagaccgtaaggaaagtgcaatatctgggccagagtgcaccgttcctcatggcacagtccctcacggcttgccttggctaggggagggaattccctgatcccttgtgcttcccgggtgaggcaatgccccaccctgcttcggctcaccctctgtggtctgcaccccctgtctaaccagtcccaatgagatgagccaggtacctcagttggaaatgcagaaatcacccaccttctgtgttgatctcgctgggaactgcagagcagagctgttcctatttgttcatcttgccagtcccccaccccaaagatgttattttaagaaatatttgtacccacactttagaaaccataaattgacttccctgttaccttcggccaggagatttcaggttaaagcaagaaacgaacaagaagaaaacgatttgatcagactgtaattttaacagatgcataacattatttccctcatacacaaacaaatcatctagaagggagaacagaaatgttgacttacagaagcacaagtcttacttattctcctaaaatgtctgcactgaaatgattgcaaactcagcaccccacatcttagccaatcagagaggcctctttaaacacatgaggcgtaaggttttaatttacaaggacccatctctatttctttcccagggcctcgaagaaggactacattctaaatctaatataaatgcctgtatgttctacaaaagttttcccagatagtgtacaccatttccaattgcacaatgacaatgacaacagaactaattaaaacagagtcatgaggtactttttatatgcacttttttttttggcgaaactgatgtttaagtaatgtatttagcaaagtctcctattatagtttaatcttttaattacaagaaaatttgggttaattattatcctaccttgatgaaaattcagtgatggtgatttttcccctttcatacttcttatcttttttttttaaataaaaaatgtgttttgtgagatttgtgtacaagtaatccatgattcatatttagaactactgagccacacctttatattaaatctttgagtcttgccatgtttaaaatgtaaattataacaaattatggctgactctcaaataataagttagttcaggatcttaatatcaatcaggatcttaatatcaatcagctgtaagtactctataagataaaagtcaaggtaatcacactgaaaatctcttttgataagtggttttacagaaagatagataaataaatatatatatatatatttttaaagagagtctacaaattgagcctctgtgtgtgaatgaattcaataactattttaccaatgtcgagagcagatttgtatgagaaagaaagaaaaaacaaagaaagaaaagacattcatttttagaattgttgcagaagaatacagatgttatggaaaataagaaatagcttatgtagtaatttctgggttggaaattcaagaagaaatgaaatagagaactatgctgaaagctttagtagagttatacctaatgtgtctctacaaagacaatataatagacccctaggtggtgccacccagaaagaagggaatagtatggtctgagttttctctaccaccatcagctccctaagcaatcaacttcccttcactaggaattcaagaagagtcaggaactcaaagcatagcaggccaagttctcactttctacaactgacattcaaaagtaatatagggtgagagtccaaccttataaaataaaaattcaaaatatagtaggtctaattcagcatttttcaagttgaatctcacagagcattaatgtcaagcaaaatattgatgcagtgtaatatatatgtgtgtctatgtatgtgtgtatgtatatacatgtgtgtattccaagtgtgtgtatgtatatgtatattccaaatgtgggaaatactaaataagaaaaaagtttaaaagggttcttaagctcagcaattctcagagattatattaggctaatgtgaatctccaataaggacacagaatatggcctttttccaaacttatttgaacaaatttatttcacagaatgcctttggagaagatattgtatttcacagaacacagtttggaaaatgctggtctaactcattagtgaatcccagcatttaagcccctagcatatatatcctggtatagaaaactatgttaaataccgagcaatcatctggtgtgctcccagaaaccacattttcttctacaattttttcagtggacatgatcacataatgttactaactggaagtccatggaccttggtcagacacaagccccactctggcacttactggctatgggatcttgtacaaattacttaattgttttgagccttcaattcttcatcaatcaaaaggagataacatagggaggctgagtgggaggacagcctgagcccaggagtttgagaccagcctgggcaacacagcaaaaccctgtctccacaaaaaattaaaaaattagatgggcatgatggtgcatacctgtagtcccagctactagtgaagctaaagtgggaagactgctcaagcccaggagtttgaggctgcagcgaactatgatcctatgatcatgccagcttgggagacagaatgggaccctgtctctaaaaaaaaagaaaaagaaaaaaaaagggataagataattagtaccttcctcaaagtttaagcaacacaacgtatggatacatcgtgcaaaataacaccaagtatacacagtaggtgttcaaaaatatagtcttaacctgtgttaatctctattcttcaacaaagacaattcaagtcagccactcacaagccagcaaaaaagcaactcacctaaaagcttaagatccttcaggttgggttgcacatggagcgttcacctaactgcctgtgtgtctgtgtacactcaactatatgtaattggaactggatctccatccctgctaattatccacattcaacctgacataagcagtctggagaaacttcagaagatttgggaaaggcctgataaaacaagatctttgatatgagaaaacttgactgagtctgatgcttgacaaagcagtatcaaggaagaattgggttatgtttatagttttgacctaactgaaatatttttattaccaagttcataatagttcatacttacttagtaattttgatctgtggatctcaaacttttccacatcttgagaaaatattacattttatattctgttaaaatacactgctcatatttgtcttctaatattttgttacccattgccttcattacctcccccaacagacctcctttcatgaccctggttattactgactaaaactcggaattgtttctgattttagtaccttcctctgtattacatagttttgataaattaaatattgtatttgtataataaatgaaaatcaagtttgttggttttttttaactttgaaagacaactctcagaaaatgattttttaaaaatgttataaggtcttttatttacacattctattgagggagaacttccacagaaaactaacttttaaaaaaagataaaaagaactatagctacttaaaataacatacaaggattaaaataagcttctaatgaaattcaagccaaatagggccatttaaagtgaggcacatcccttaatatttctggatccaatattcttaattgtagattgcagaaaattaactcatttctcgatgacatttttggttgcttccagtttcataatctggtaagaatgacattttttctctctctctctctaactctagctgtacttctgagcctcctcgtagtaaacttcactgtcaggtgaaacataaaacaagttcaagaatttcagtagaacaacttttgaagcaagagagtgtcttctactctgagaaacagaactgagtgctctgccatatctctgtgccccaaccccttaggggagaaggagaaggatttggagtgatggtagggatggatggatgtttaacacgtgatgcttcttggtaattaacacatcagaataaattcacttttcactcagcctagtcagctcgaatgacttgagagaatagaacacaggacaggttaaatctttccaagacaggagtgataggagagagatggcttgataaagttcctaaacatgggatactatcagcagaggaatgagcatcagagtggaaaggctagagaaaaagtgtccctgggagcctgggggccaggatgctagagtgaaaatgaacacttattgaacggttcaaaggacttcagagagctgtgcttcccaacctccttttcaatatcaaaatgtgtcataaattacagtcaacacacgtacacatgctcacataattgtgcatttagtacctgttgctttaaaaaaatgctagcaatcaaatactttaaagcaaaaatgcattttatgaaggtactgcttatataaacatttgaaaaacaataacatatgtatctgagacaaacagatgtcattttgctttagcaggtaaagatatgactgcaccttctttatagacaccaacatgctgggtagtgaaattctcagagacttgttagcatgtagtacaagtaacacccatctaagtagtaacctttatgtgtagatgaatgttaaagcttcctaatgacagcctgcctcaggtgccctctttcagtcaccctggaatcactccctgcttatgtggggaaagtgaccttcaatagttttctattttctgtataatttggcccaaacgttttagtctggattaaaaccttttctcctgcctcccctcaaagtgcctcagctacactcacctctctggcccccttcagcaattcaagtgaatttgagctttaatcttttgcaccttgcacctacctctccgtcagaaccccatttcatctgagctggttgctttctatgtgcctttttggctttgggatggacactgtaacaagtgatttgcatttctgtgcctcactgtactatgcccctctctaaggctggcacaggtctccttcattttatactctacgacctaagagtgcttatagcacaatgggtggttggtatctattaaacaaatgaatgtgtaaatgaatgatagaaagtaattggtgaaaagtacgctgagatagagtctgatcacaggcaaaaaaaaaaaaaaaatggaagaattaatagtccaatggcacttttcttataaaactgaattacatagtcaaaccatcatttaaaataatcttacaaggaaaacaacattaatgtgcgtctgttgagacggattatgctgttttggaattaggaagagaatgtgcagttcgctgtttgctttcagactgtttgtttgttttgtttattaaactggcgtctccagctctgcagcccagcctgtggaacctaaatggcccaggtcccaggagttcccatcggagccgtgggcgtccccagggtttagaaaggctccccaggggcccaagctgccggcgagtgcagctcccgccggcgccacctctgcggtctggagcggcgaggacgatcccagagaggcgcccccactgcctcggtcgtcgggttcttaagtttttctctccaaaaatttaatggatagttttcttttgcttctgtttctgacttgattaaagaggcggaaaaaaaggagtttgactccaagaagaatgatagtagcagaaggcgcatctggctttactttccaaattccatcaaagtttgtgttttgtttcatttgacagcgatcccgtgaacgtctcctctggggaaatggcgcgaccaaagcccgccaagcccagcctgcgaactggaggatttattaatgtaatatgttaaacaaaacctcgacagacacaaactcaaaggaaaccgtgcgctccttaagtcaaaggcatctgttctggaagcagaacccggtttgctgttggtaaccagcgttaagagcaggatttttaaacatgataatggataaaataaaagaaaagcgaagtcccgcggtcctctgactcctattcattatctccagcagcatatgggaccattctcctacgtatcctcgcctttttcttctgaaaaagcaaaagcaaccaagcctgtcccgcttcagagcaatcctactctttgtgcctgagtagtgccaccaccactacttcctcctcctcccgcctcctcctaccccgccctcctgccgctggctttcgctctggcgaggaggcggccggctccctttgcgccgggaagccggagccgcgattgggcgacggtccctgagcctccagttctgcgtcggtttcaaggctcctccctcctggtgaaagacagactacggggcgcctggaaaccggtccgagggcgcgcgaggcagaggagagggagcgagttgagggattgacacaaatggtcaggcggcggcggcggagaaggaggcggaggcgcaggggggagccgagcccgctgggctgcggagagttgcgctctctacggggccgcggccactagcgcggcgccgccagccgggagccagcgagccgagggccaggaaggcgggacacgaccccggcgcgccctagccacccgggttctccccgccgcccgcgcttcatgaatcgcaagtttccgcggcggcggcggctgcggtacgcagaacaggagccgggggagcgggccgaaagcggcttgggctcgacggagggcacccgcgcagaggtctccctggccgcagggggagccgccgccggccgtgcccctggcagccccagcggagcggcgccaagagaggagccgagaaagtatggctgaggaggaggcgcctaagaagtcccgggccgccggcggtggcgcgagctgggaactttgtgccggggcgctctcggcccggctggcggaggagggcagcggggacgccggtggccgccgccgcccgccagttgacccccggcgattggcgcgccagctgctgctgctgctttggctgctggaggctccgctgctgctgggggtccgggcccaggcggcgggccaggggccaggccaggggcccgggccggggcagcaaccgccgccgccgcctcagcagcaacagagcgggcagcagtacaacggcgagcggggcatctccgtcccggaccacggctattgccagcccatctccatcccgctgtgcacggacatcgcgtacaaccagaccatcatgcccaacctgctgggccacacgaaccaggaggacgcgggcctggaggtgcaccagttctaccctctagtgaaagtgcagtgttccgctgagctcaagttcttcctgtgctccatgtacgcgcccgtgtgcaccgtgctagagcaggcgctgccgccctgccgctccctgtgcgagcgcgcgcgccagggctgcgaggcgctcatgaacaagttcggcttccagtggccagacacgctcaagtgtgagaagttcccggtgcacggcgccggcgagctgtgcgtgggccagaacacgtccgacaagggcaccccgacgccctcgctgcttccagagttctggaccagcaaccctcagcacggcggcggagggcaccgtggcggcttcccggggggcgccggcgcgtcggagcgaggcaagttctcctgcccgcgcgccctcaaggtgccctcctacctcaactaccacttcctgggggagaaggactgcggcgcaccttgtgagccgaccaaggtgtatgggctcatgtacttcgggcccgaggagctgcgcttctcgcgcacctggattggcatttggtcagtgctgtgctgcgcctccacgctcttcacggtgcttacgtacctggtggacatgcggcgcttcagctacccggagcggcccatcatcttcttgtccggctgttacacggccgtggccgtggcctacatcgccggcttcctcctggaagaccgagtggtgtgtaatgacaagttcgccgaggacggggcacgcactgtggcgcagggcaccaagaaggagggctgcaccatcctcttcatgatgctctacttcttcagcatggccagctccatctggtgggtgatcctgtcgctcacctggttcctggcggctggcatgaagtggggccacgaggccatcgaagccaactcacagtattttcacctggccgcctgggctgtgccggccatcaagaccatcaccatcctggcgctgggccaggtggacggcgatgtgctgagcggagtgtgcttcgtggggcttaacaacgtggacgcgctgcgtggcttcgtgctggcgcccctcttcgtgtacctgtttatcggcacgtcctttctgctggccggctttgtgtcgctcttccgcatccgcaccatcatgaagcacgatggcaccaagaccgagaagctggagaagctcatggtgcgcattggcgtcttcagcgtgctgtacactgtgccagccaccatcgtcatcgcctgctacttctacgagcaggccttccgggaccagtgggaacgcagctgggtggcccagagctgcaagagctacgctatcccctgccctcacctccaggcgggcggaggcgccccgccgcacccgcccatgagcccggacttcacggtcttcatgattaagtaccttatgacgctgatcgtgggcatcacgtcgggcttctggatctggtccggcaagaccctcaactcctggaggaagttctacacgaggctcaccaacagcaaacaaggggagactacagtctgagacccggggctcagcccatgcccaggcctcggccggggcgcagcgatcccccaaagccagcgccgtggagttcgtgccaatcctgacatctcgaggtttcctcactagacaactctctttcgcaggctcctttgaacaactcagctcctgcaaaagcttccgtccctgaggcaaaaggacacgagggcccgactgccagagggaggatggacagacctcttgccctcacactctggtaccaggactgttcgcttttatgattgtaaatagcctgtgtaagatttttgtaagtatatttgtatttaaatgacgaccgatcacgcgtttttctttttcaaaagtttttaattatttagggcggtttaaccatttgaggcttttccttcttgcccttttcggagtattgcaaaggagctaaaactggtgtgcaaccgcacagcgctcctggtcgtcctcgcgcgcctctccctaccacgggtgctcgggacggctgggcgccagctccggggcgagttcagcactgcggggtgcgactagggctgcgctgccagggtcacttcccgcctcctccttttgccccctccccctccttctgtcccctccctttctttcctggcttgaggtaggggctcttaaggtacagaactccacaaaccttccaaatctggaggagggcccccatacattacaattcctcccttgctcggcggtggattgcgaaggcccgtcccttcgacttcctgaagctggatttttaactgtccagaactttcctccaacttcatgggggcccacgggtgtgggcgctggcagtctcagcctccctccacggtcaccttcaacgcccagacactcccttctcccaccttagttggttacagggtgagtgagataaccaatgccaaactttttgaagtctaatttttgaggggtgagctcatttcattctctagtgtctaaaacctggtatgggtttggccagcgtcatggaaagatgtggttactgagatttgggaagaagcatgaagctttgtgtgggttggaagagactgaagatatgggttataaaatgttaattctaattgcatacggatgcctggcaaccttgcctttgagaatgagacagcctgcgcttagattttaccggtctgtaaaatggaaatgttgaggtcacctggaaagctttgttaaggagttgatgtttgctttccttaacaagacagcaaaacgtaaacagaaattgaaaacttgaaggatatttcagtgtcatggacttcctcaaaatgaagtgctattttcttatttttaatcaaataactagacatatatcagaaactttaaaatgtaaaagttgtacactttcaacattttattacgattattattcagcagcacattctgaggggggaacaattcacaccaccaataataacctggtaagatttcaggaggtaaagaaggtggaataattgacggggagatagcgcctgaaataaacaaaatatgggcatgcatgctaaagggaaaatgtgtgcaggtctactgcattaaatcctgtgtgctcctcttttggatttacagaaatgtgtcaaatgtaaatctttcaaagccatttaaaaatattcactttagttctctgtgaagaagaggagaaaagcaatcctcctgattgtattgttttaaactttaagaatttatcaaaatgccggtacttaggacctaaatttatctatgtctgtcatacgctaaaatgatattggtctttgaatttggtatacatttattctgttcactatcacaaaatcatctatatttatagaggaatagaagtttatatatatataataccatatttttaatttcacaaataaaaaattcaaagttttgtacaaaattatatggattttgtgcctgaaaataatagagcttgagctgtctgaactattttacattttatggtgtctcatagccaatcccacagtgtaaaaattcaggaattcaatgaaaaaagtctacccttaaaccctcagatcagtctttccaaagaattactctgtttgcattgttgtgattgacatttgtgaagtcccaagaaaagatctgttttcatgacagtagaaaatagaagtttgcaaattatttctttactcaaagaggattaaaagagaactctaattttaatattaaagctttcttttctttcagggaataaatttacatgactttttatattatggaggtttatttttaaatcatcacctttctcatattttttagaggtattgtcttatctcttccataatcttggatattacaaaaccctaaataggcaatcaataaatggttaactggctatgtgttcataaacattttaaacagcaattgggtttgtaaggctgttttgttgtttgcttctgaagacccctttttttaatcgttcaaggaaccttctccagataaattatctagttggtctactcttagtcagaatttatgcatgggtgtatatatgtgtatatatagataagtatacacataagtatatatgcattaatttttataaaatagagatgtaaagtttacttacatttcataatatggaaatatggttatgagaaatggaaaatgctagatggaaaacctcaaatacctttacaggttaaaaatatctttactaaattttcccatgaaaacattttgtgataaaatgacaagggactaaaatgaagatcattgatacaatagagttactttccttgttacaatgcaattgtcttataagtcattattcattttaaggaaaatcaaaaaaattagatcttactaaaaatgtagcatttgattttaagtagcaagatgcaattttgtgttccctttttctttgttacattaacataatatagtagatagagggtttattgtatagacatacacaaaaaaatagtattcttaggccaaattcacacatatctcctcactaagtagttcaattagataatttctggaaaaacatgtttttgacattaattgctatccaaaactatattttaaagcagtcttattggaggtgtccttaacatgatgtaactataaatttgatgcagaaaggttttacatgctgtggttaaatagctttagaagacatttttaagtcaccaccagcctttattcttagaaaacaatttattctaaatgatgatgcatatagaaaaccagtgtattcttttatttcttttaatactggtggcaaaataggacgtgtctggaaaaccataaggctacttgggatactgtcccattagcattgctgtttccatgacaaaccctattttcagatggtttgatttgcctattttttttttaaaccagctataaattggggtcaatttcccccctcacagtgtacttaatttagcttttggagtaaatatataagtagtatgaaagacttctgaagctcttctttctaaaaaagcagttttccacttaagctttgtggggacagagagtcatatttttaatttcagagccagccagtgtcaaacacgtgcaaaagagccgggccggattttttcagcttgtcctatggtagtcacttgtcagcctgagtttactggcctggtccttttgtctccactgtaagtactgaagccttctggtgtagttgtatcaccttaatgtccagcatttaactaggaaaggagactacaatgaagagttggtggccaattaagaaaaataatagactacatcataaatcatttcaggacttgagtggccgcagatcactgtccctgatagcatgtttcaaccttggtatacattttttttaagatgcatatttactgtgtgtgcttttgctttctaatccatctattgactattggccacaatttatataatgcacatgcaattaattgaaacctgtgtcatggcattggatatctctgattcatttcttattataatagtctgtgtaactggggcctgagagattagaagcaaaatgtagtcgtacgtatgtctagaggtggacgctggtgatattgtcattgaatactttgcagaatacactaatgtcaaaggcttgcaggattaatgtgtaggaaccaacataagacatggaatatatataagaattatctagttacatgactaaaaaggaattgcaatactatcttaaattgaaggcttttatttcaatgtccttacatttaaaatgggatcttacaagggaagtaccaaaaaagtaaagtttattttgatgactctcaagatatatatgtttgttttgaatgttggcagatgccaatagcccttaacatttgaaaaatggtacttgaacatcaattatgtctcagagttcccttaaactttttgggcttaaatatttttattcattttggtcatacctttgacaatggatatgttaaactttaacaattatagtgacaaaacagcttgcttagaacctggaaattaaaacacaatttctagagtaatttttctaagttgtatcatgttttgtggtgacaaatgtctctactccattacagaatcaagttgctattcaaatataatacttcctctggggatctttgtttataggttggtttgggaccctaataacaggtcaaacaaaagggtttctcaaagaaatttttctaataatatataagttcaaatacaatttataagtacatgtacacaatgaacatataataagtattctgtgggtcatcgtcagttttatgagtcaagcagatccttaaattgcttgaaagaataagatacaattttccaaaagagattaagtaaactatttcattggtattctaaagaggtgtatttttgaatgataaaatgtaaataacactgcattttcttgaggtattattaatacactagttgaatggcatatttgtgtgactagtaattctaaaagcaaagtattaaaatagcaatgatttgtacattttacacacacattttttaaaagatgaaattgacttacctgaaaacaatagtttttgttttaaaatttagatgtgtattttataaaaaagacctcaagaaatttcattcatagtatagactttcaaaacatgttcatagcaatacagtgattaacatgaaaaggaatcactgttgctgctttgatatagttctctgtggcctggattttctttctttcctttttaaaaaccaagtatcctctaatttgtggatatctccatgtttcagatctcagtacctgtttgaattaaatttgcaggggaataactgcgggatccccccatagacaaagtgtggcctttatttcctttcaagttggcagtgtgtccttgcttaaatgaagcactctgaggcagactgttctcttgctcttggaaatgcttgtctttacaattgcagtagcaaatacctggaagtcatacaggctagttagatacatattctaaatgtcatgtgctgcttgatcattgtaaggattttttttcttaaaaagtagatttggggactattcttgaccttatctttccaactcttggaaatattttaaaaagttaacttcaccaaatattctgtcaaaaactgtaggcccctcagatagaatgaccaactgtccaggtttgcccagggctgggagttttcttggcatgtgggaattttaagtagtaaaaccaggaaagtcctgggcaaactgggatgactggaaaccctattccatggattaaattgtgctctcacaaaaatagagtaaaagcttacatgttggtctctggtccagcattgaaagtactccacagtggctgtagccttcttaattaccagattaaaagtcaatgaacacagccctttgtaactggtcttcatagtaccaatcaacagaagctgagtggaccatgaagataaaatggaacaaactaccttgattatcttggccattccacctttagcctttgcctcccgaagaaatgggacataggtgtaggcttccaactagccactgaaccctgttcatgaaatcaggttaaatggctgcttttagaaaaggctctcaaaaagtattcccttggaataaatcattgttttgtaaaaaattgatgttaaattttaccagattgtaagtaactatcaggctgctgcatgtgtgtgtgtgtgtgtgtgtgtgtgtgtgtatgtatgtacatatatataattgtatatgtacatatatatttgtataataaagcaatacattaggatgagattataaactcaagcagagatttccccaaatggctgtacagcaacagtttatataattattatacttttttccaaggtaagtagggttaacacccatatctttcctcaaattaaaagttgtatctacaaaaaggaaaaagtaaactaagtcttaaaaattatactgtgattattgaaaattgtagaatacattttgtggaccgtgcaatccttcacaatggatttcacgatgggtttccctggaaatgtgaatgtagaccttcacgtttctacatgaaactcttccatcagaattggttcacttcttttttgagcttactgtcatccttcttgtaaatgcacatgcagtttcactgcctttattgttgaaaccacaatactattcttgctatctcttaattaaactcaatgtaaatgaattttaaaagacacataggtaatgtaattattgcaagaggtacctacacattagactctagagctaattctcaatatgggacaattttgttctctaggagacatttggcaatattgggacacatatttgactctcataactgagcactgaagggtgctgttttagtctgctttgcatagctataaagagatacctgagaccaggtaatttataaagaaaagaggtttatttggctcacgtttctgcaggctgcataagaagcatggtgccaacatctacttctagtccacacctcaggaagactttactcatggtggaaggcaaagggggtgcaggcctgtcacctggcaagaaagggagcaagagagagggaggtgccaaactcttttaaacagccagatctcctggtaactaacagagtgagcactggctcattaccagagaagggcaccaagacattcatgaaggatccacccccatgaccctaacaccacccaccaggccccacctctaacactggggatcacatttcaacataatatttgggggggaaaatcacccaaactatatcaggtgctatgggcctttaatgcgtagaggccaagggtgctgctaaacattctagaatgcacaggacagcccatgacaatgaattatcttatccaaagtgccaaagttgagagaccttgctttggaggagtgattaaaattgcaaatatactttttaaaatagtgaaatatattgaatttataaaatacaattgagaaaaatatggatttactgtgtatacaacatgggctttatttttatctttatttttttgagacagagtctctctctgtccctcgagctggagtgcaatggtgcgatcacaactcactgcaacctgcctcctgggctcaagtgatcctctcacctcagccttctaagtagctgggtctacaagcatgcaccaccacactcggctagttttttaaactttttgtagagatgaggtctcactgtattgcctaggctggtcttgaactcgtggtctcaagtgatcctcctgccttggcctcataatgctgatattataggattgagccaccatgcctggtgggctttacttttgacctgcaaattttcttttagattgatgaatagcctgataatattgcatggtgtccaaagtcttttggcctgttttgacaaaatactgtagacttggtggcttaaacaactgacaattttcacagtcctggaggctgagaagtccaagatcaagatgccaacagattcagttcctggtgagggcctgcttcctggcttgcagacagctcttgtggctttgtgttcccatggcctttcctcagtgcatgcaggtggagagagaaaaccattgtcttcctttccttttaaggacactaaccccatcatgagagttccaccctcatgacctcatctcagccttattaccttccaaaggctccatctccaagcactatcatattgagggttaggctttaacatgcatttgggggggacataaatattcaactcatagcaggcaataaaataaaacttttattattcaaatctagacagggacatacggtatcataatttcagtgggaaaaatctgtaaataacattaagcaagtttaaaaaaaatctctgaaaggcatttagtagtattatgctgttatacttcatattctacacttccattttcttttacacatttccctgcatcatcacaggtgttatggtatggggaaaaactctggcctaggagacagaaaacctgggttctagtcttgatttatttggttaagggaccttgagtgagtctgacccacaggacctaatgaatcaaatagagacaataatgaagtaatagatataaaagccccattataaatggtgaagctctgtaaaaatgtgagaattatcattcacgttaagctaattaaggaggaagttgaggatctgaaggcttctgctcagcattgactgcctcccctttagaaaacgaagttccagtcactgaagggccgcaggatgactggagacctttctgttgtcttcctagtcacctcttctctgatttcatcaccacacttgagttctcctgtgtacacctggaatattttctgtttaagttttttccagacctggtaaatttcatatgaattagtctgcagtacagctactatggcattggagagggggctaagtcctagttagaagaaagaaggcccctcttctgaaagggctggaatggagcaagaattattacaggagtgttctgaggtcagaggagagtggggcttaagagtatgtatgttccaggtccaaatgtggcaaattcacagacagaccttctgggttgagagtcctcacagagtgggacagtgcccaggagctgtgttgcttcatttgttcattgacaagttggggtagatgtgagcatcttgccgggagaggggaggctcatgtcctacaggtagacaagttggggtcattttgctttggaagggagaaaaagggaagggatataatgaaaaccaaagtcaactactctttcctggggctagcccaggtgggagtgagtagaggaattgaatggaaacatctctcaaatagagacataaccttggattttaaatatgacctttcctcctcctcctctaaaaaggaaacaaatttcaagataatagagaattggacagagaagtcgaatgtcatctcggaaagaatcttggacttgcaagaactggcttgaatcccaaccagctcttagcctcaaatccatttacctaaaatagtaataataatcatttttcactaattcaggtctgttgggggaatcaaagaaatgaagtacataatgacatttttagcactagagtcagctacacatcttagtcttcttcaccttgcatatttcttttctctcttcctcttctccctgttcttctccccccttcctcctttctgtctcttctttcctccacctccctctctcactcctcctgcttctatcactcacccttactgctgatgtgacttgaaaaggcataaagcaaactaatgccatatttttcctgcatctcttttcaggctaagcatgttttacaagacttatttacacaaaaaattaagataatgggcaaccttaaggttaaatgacacaaatgtactttattaatcaaccggtgatgttgctcttaaagcataagtgcatctctatgcattaatgtatgctttgggatatgctatagtcacacgctacatcgtgatgtttcagtcaatgacagaccacatatatgatggtgggcccataagattataatacagtatttttgctgttccttttctactttaagatatacaaatactcaccattgtgttatggtattcagtacagtacagtaacatgctatacaggcttgtagcctaggagcaataggctataccatatagcttaggtgtgtaaggaggctatgccatctaggttgaagtaagtacactctatggtgttctcactgtgttgaaattgctaatgatgtgtttcacagcacatatccccatcattaagagatgcatgactgtatagtagttccctccttatctgtggttttgctttctgaggtttcagttacccaaaatcaaccacagtcctaaaataggtaagtactatacaatacactaagatattttgtgagagaccacattcatataccttgatagtatattgtcataattgttctattttattattagtcattgttgttgatctctttgtgtgcctaatttataaattaaacttcattcatcatagatacatatagaaaagaacataatatgtatggagctcagtactataccatttcaagtatccactgggagccttggaatgtatcccctatggataaggcggaactactaattaaatttcaatttaatttctttacaacccctaacaaattgacctaattggtaggttttatacttgagtaacatggaaacagctctttgaggccactctaattcatgaccaggaagtgattcataatttcccttcagaaatatactcctctactggattgataacaaatcgaacaattataagaatcctttgtttgtccttgttgactatattgccaaagggagcttacttcacagcaattatgaaaatgttcctttgatacaactgatatggactgaacatattttgatgcatgaagttgagcaggattgagggcttatatcaaagagattgattagtaattgtattatttcctcatataagaatagctagccattttggtgccttggtcacctctgtgatctagtgtattagttttctattgctgctgcaacaaattactaaaaacttgaaaaatacacatttatcatcttacagttctataagtgagaagcctggcacctgtctcactgggctagaatcaaggtgttgcattgttatgtttctttctgggggctctaagggagaatctgttctgtactttttccagctttatttcctctattctggaggcttattccatagcttgtgacacagttttcctgtcttcaaagccagcaacattgggtcaagctctttctgtctgattctctccatttggaaatacttgcctgcttttaaagactcatgattagatcaatacaggataattccccatctcaaggttactagccttaatgacatctgcaaaatacctcttgccatgtaaggtaacgtattcataggttccaaggatgagggcatacacattgctgggggccattattctatctgccacatctatgtttagctgttggagctagaaaatttttcttttagaagtattccttccacattctcattctttacgattacttttttttttaagtggattcctgaatttcttcagttcccatttcattctttcaaagtatgtttctgtcagtggtcaattccccattgatttcccctctccttttaccccattttctgttaagaggtctgcagatcagtccttgtgctctacctgatttctttgtatttcagatgtcatctttcttcctcgtctttgcacatattctctggattgctaccctttttgttactctatatgtcttttcaatacacatttctctaaattcatattttgtgtctgtcccagaaatagatcagaaaaagatggagattgactgatgtcaacctttttctcccaagtgaacacatataaccccactgtttttttttaagctacagatgatataattgtatggctttcatcagaagcacatctgtcaagtgattacattttt

SEQ ID NO: 282 - DNA, 59149 bp, Homo sapiens
ggctcaggataaaagccagaatatcgcatgctatgggttaagaaataggcttttgagggaattttcaattcagtgtcagcaagtaaagagaaagcatgagtccaattccttttatttttccatagaagagcaaaccaggcacactactggacatgcaggtggaggggagggatgaggcagtgtgttattgctctccattatgagtcaagcatgagagcagccttatcaatgaagaggcacacaaacagcgtaggcacctagcactcttgattagagtgtcagttattgacaggttgtgctaacctgacttctaagatggtctccagtgatcccccatcttagtattcgagtctttgtggaatccttcccaccttgagtttggtatggaccttgtcacttaattctaaccaatggaatatgacaaaggtgaaagtctatcatatccatgagtagacaataagagtttgtggcttttatcttgctagcagactcatttactgactcaagtaatcaagctgccatgttaaggaggtccatgtggtgaggaactgagagtgctctcaactcaacattcaagaggaaccaaaccttcagtcctaccacccttcgtgcttcctaccaacaactaagttagtgagcttggaagctcatcctttcctagttgagtcttcagggaagaccccaactatgattgcagccttgaggggccctgaagagaggacccagctatgctgtattgaattgctgtccttcaaatattgtgagataataagggtgtgttgttttaagccacttattttaggacaatttttatgctgtaatgataactaatatacaggagatgttcaaaaatacaagctacccaggaactggagacctaggggcccatggctagtcacacgtccctctgccaggagtgagaaaaacacccctggttccactggattctaacttttggaaaccccactcactggaagaagagggagccccaggttctaatgagtttgtttttcaggcaacccagaatgacctcccagcatcatttccagacagtgtggctcctgacatcacaaatatagtagaataacaccaaactgagtaaataggacagtaggctgcagaccccctcatgtgccaatgatctttataaagacttaaaacctcactatgcatagagttgataaaggcaccaaatgaaccagagaaaggagactcaagtcaagaaaatgtatctcaactaggaaatgtttttgtgaccacaaaggggaggaaccaggaagttgtggtaaactgtagcggaagttaaagctaaaaaaaaaaatgagagagaaccagtgaatttaaaaatacttaacagacataatgacaaaaagtagtaagtacatctctttggatcgtgagaaagaagatcaggaatgaaagatctagctgggccttcccccaccctccccagccttggttccctgattagtgctccaggcctctccagggcctgacactcaatcttctcttgggaactaattatggcaatgtaccacgaggtactgttcctcagactaaacgtggttttttgtttgtttgtttgttttttagacaggctctcactctgtcacccaggctggagtgcagtggcacaatctcagctcactgcaacctctgcctccccagttaaagcaattctcccacccacttcagcctccccagtagctgggactacaggtgcacgccaccatgccctgctttatttttattattattattattattattatttgtatttttggtagagacgaggtttcaccatgttggccaggctggtctcaaactcctgggctcaagtggtctgcccgcctcagattcccaaagtgctgggattacaggcatgagccactgtgcccagcgtaaacgtggtttcttatgtttttaaattccccttgaaaatattctcttgtgaccaaaaaagacccttgggtgtacagagaataggttttgtcataactgtaactaatgtgagcttccactaaaaacccaagatacaaatatattcacaactttatttttccagtgatccattctaatacctcttggggcttcctgtgaaatgtctaagcaccccacagccaaagggtacactcgtagtccccttcagtgctaagaacagaaaagaagctgttgcttttctctgctataggtgttgctgttgaaaattcatcccacacaattgatggagataattttcactgctttagtcacctaaacaggccttgctgatccacattcctgttcagattactaggattctctaagggagggatgattgttgaagctgagtgatggaaacactttgctattctttctaattttttataaattttaagttttcaataataaaaagttaaaaaccaaaaattaaaagaatctgacaggccagatatggtggttcacgcctgtaatactagcactttgggaggctgaggcaggaggatcgcttgaggccaggatttcgaggctagcctgggcaacatagtgagacactatctctacacaaaaaaaatttaaattgaaaacaaaacggcattccggctccttggagaaacggtcgattctaggactggggcatcctatgatgtcagaaagtatttacatgctcgattaaaaggtgagaaccatatcaaagggacacaggagccaactggaaataattccaatagttaaaatggaaacaatttgagcaacaaaataagtaataatggaattggattataacccatagaataaaataagtatccattagcccatattgataaaagaaattcttaaataaataaatgggaagatgtggcagtactttttcacagaagaattcattagcaaagcctaacggtgtggctagcctgcgtcatgacaatggttgggagaagcagcaaaatagcagactagccagaaatttaaaagggaaatcaaaggaacaaaacagacaaagaatgccttagtaaaataccatttaactttggtagtttaaaaagctatgtgcagcacacagggttataactgcttagaagagagacttgagaaggctataggaagctactcctccctgcaactaaatatgaggtctcagaaataaagagaaagccatggctcacttgtaaactctctgaactttgaaagtaccctccaaatcacacacagctccaacagcagggttagaagccttactggcttaaggcatttaagcacaaactctaacagatcactggctgaccattaagctatgctgatccaggggcaacccctaagaattcaggcttaaaaataaaaataagaattaaaaaaggacgggaggctgaggcaggagaatcgcttgaacccaggaggcagaggttgcagtgagccgagatcacgccgttgcactctagcctgggcaacaagagtgaagctctgtctcaaaaacaaaaaggaacctgagcagaaatatctgagcagaaatatctgaagcctcatactgcatactgcaagggaaaaggactccactgaattagtacaggcaagtcactataaaaatatctgaaccctcatactgcaagggaaagggactccacagaattagtacaggcaagtcactataaaaacaaacaaaacaacaaccaccttcacccccaagagaaagaaattggaatccagagctagcatatattgtctaaaattttcagttttccaaaaaagttacaaaagggcaaagaaataggaaaatgcaatccatttgcagggagaaacagtcaatagaaattgtcggccaggcacggtggctcatgcctgtaatccctgcactttgggaggctgaggtgtgtggatcatttgaggtcaggagttcgagaccagcctggccaacatggtgaaatctgtctcaataaaaatacaaaaattagctgggcatggtgatgcacacctgtaatcccagctactcgggaggctgaggcaggagaattgcttgaaccacggagtcagaggttgcaatgagctaatatcatgccactatactccagccctggaaatggagtgagactctgtctcaaaaaaaaaaaaaaaaattgattcacacctaaacattaatatattatactgaaactattaccagccaaaaatagaaatgacatcttaaaagcaatgagaaaaaactcatctcatacaaatacactcatacacacagacacaataatcttaatagctaacctcatcagtaacaatggaggttagaaggctgtaacatgggctgggtgccgtggctcatgtctataatcccagcactttgggaggctgaggcaggcagatcacgaggtcaagagttcaagaccagcctggccaacatggtgaaaccccatctctactaagaatataaaaattagctgggtgtggtggtacatgcctgtaatcccagctactcgggaggctgaggcaggagaattgcttgaacccgggaggcggaggcgcagtgagccaagattgtgccactgcactccagcctgggcaacagagcaagactctgtctcaaaaaaaaaaaaaaattaaagaagacagtaacatatgcaaatttgggggttagtggggagaagctagcaatcaagaattttacatcaagaaaaattatccttcaaaactgaagaccggtacagggacagtggtttgcacccataatcccagcactttgggaggccaaggtgggaggatcgcttgaacccaggagttcaagaccagcctgggcaacaaagtaagaccctgtctctgcaaaaaaaaaaaaaaaaaaaaaatttagccatgtgtggtagtgcacacctgtagtcctagctactcaggaggctgaggcaggaggctctcttaggcccgagagattgaggttgcaatgagacatgatcatgccactacactccggcctgggcaacagagcgagaccctgtctccaaaaccaaaatttattctaaagaaaacaaaaagagaagccaacatgaacatattcttacataaacaaagactagggagatttatctcttgcagatatgtcttacaagaaacactaatgtaatactaaagtaagttcttcagactgagaagaaatgacaccagataataatcccaatccaatgaaaaacaattattgtatgtcaattaaagataaaacttgtagctaggcacagtggcgcacacctgtaatcccagctacttgggaggctgaggcacaagaatcacttgaacccagcaggtggagtctgcagtgagccaagatcacaccactgtagtccagcctgggcaacagagcaagactccatctcaaaaatattacattaaaaaaagtaaaatttgtaaaagaaacaaacagcatcagaaaaaataatatgttggtaattattttttaaaaactaaaaactaaaaactacaaatctcttctttttctttttcttttttgagagacaaggtctcactctctcacccaggatggagtgcagtggtttgaccatcgctcactgcagcctcaaatcctggactcaagtgatcccctcacctcagcctcctcctgagtagctgggactacagatgcacaccgccatgcctggctccttttcatttcttaactgttttaaaagaaattacataaaacaacaattataaaattacagtgttgggtttgtaacatctaaagataatgtgtgtgtatatatgcactcacacacatatgacaataatggtacaaaggatagggaaaagatggagttacattgaaacaaaggaaccacatcagattgtaagtccaatccacaagaacaaatcatcagaaacactaaataagtttcatacgaaaaactttaagtgtattttactaatttcttctcttaattttttaaaagacgtagaatttggctgggcacagtggctgacgcctgtattcccagcactttgggaggccgaggtgggtggatcacctgagttcaggagttccagaccagcctgggaaacagggcaaaaccccgtctctactaaaaatacaaaaattagctgggcatggttgtgctcacctgaaatcccagttactcaggaggctgagttgggaggatctcttgagcctagaaagcagacgttgcagtgagccgagatcatgccacttcactccagcctggagtacatccctacaccccctcaggttcagtctgaactgaacaggggatacctgtgaaaggaaaataaatcttggggcccgaaaatcactaagctaaagggaaaagtcaagttgggaactgctgagagcaaacctacgtctcattctattcggtcactcctctgcttactgagataaatgctatctgattgcctcctttggagaggctaatcagaaactcaaaagaggccgggcacagtggctcacacctgtaatcctagcactttgggaggccgaggcggatggatcacccgaggccaggagttcgagaccagcctggccaacatggtgaaaccccgtctctactaaaaatacaaaaattagctcagcgtggtggcacatgcctgtaatcccagctattcgggaggctgaggaatgagaatcgcttgaacctgggaggtggaggttgcaacaagccaagatcgcaccactgcactccagcctgtgcaacaggagcgagcctccatctcaaaaaaaaagaaactcaaaagaaagtaaccatttgtctcttatctacctatgacctggaagccccctcgccacttggagttgtcccaccattgcttcaagttgtcccgcctttccagaccgaaccaatgttaatcttacatatgttgattgatgtctcatgtctccctaaaatgtataaaaccaagctgtgccctgaccaacttgggcacatgtcatcaggacttcctaaggctgtgtcaccgacacacatcctcaaccctgacaacataaactttctaaattaactgagacctgtctcagatattcagggttcacactcccctggaccccctgactttcttcagggcactggccactttcttgtctgtctttggacactctcctctagaagtctttgaaattcttgaggcaggaaggaccaattcccagccctgaatcttgcataaagtgggtcctttttaaatggaaatacggctactcctcaaaggaaggctaggaattttgctctgtgtgaccctagtcgtagttcttcacagagggctccatttcacttgcctttccttctgcttttttcttcactcgtttccccacagagcaagacaaaagaagccggcaaggatggctctggtcagggtctgccttcagccacccaaatgggattgcaaagaggaggacagggatggaaaggggaaagtttgatttggtttggtttgcttagtctttctattggtaccacttccttatcccaacctcatcatcttccccgatccctaccaacccactgcaggcatatgagccctaaaatctgggaaaggcttttttccctaggggccctggcctcacagacttgcccaggggggtaaattctcagtggctcagtggcacgtgcctcacgtcctcaccggcagcctagatagatagatagatagatagatagatagatagatagatagatgatagatagatatatagttttttttttttttttttttttgagacggagtttcgctcttgccgctgcccaggctatagtgcaatggcgccatctcggctcaccgcaacttccgcctcccaggttcaagcgattctcctgcctcagcctcccgagtagcttgtattacaggcatgcgccaccacacccggctaattttgtatttttagtagagagggggtttctccatgttgttcaggctggtctcgaactcccaacctcaggtgatccgcctgtcttggcctctcaagtgctgggattacaggggtgagccaccgcgcccagccgggagcccctattttaaggacgctattgctgtggaggagtaaccccacttttaggaatccttttccgtgcgaaaggctgtttgagatcaggcgcaacaacttctcccgctcaggttaccctcagaaaggctatggaccccggactccgccccagattgcataacaactgaggggtgggtccctatttcctctctgggatctgtagccaatcattcacgaggtaaacagaacgaccgagtttctctcagccgagaactgtggctgcccctccggtgaaaacagaggaagtgggagcggcaggaagcgctttgggaccagggcgacccctgaagcgtagaggaaccaggtcacaagcatacgtgaatgctcacattccatagttatcaaatgtattcaggtttaaattttacttttctagaaaaaatgtaaataatccgttgagaatatttaatgaaaaatgttggtcgtatctttatctggtctgcggctctgtccctgtttcctggataggagactacgtctgtatcttgtatcacaggaggcaccttcttcctgtttcctggcacagacttgtaagtgaatttcctgcccgcctccgcccacagcgtaagccgcgctggaacagctcacttattgccccagatgtatgtggagtaaccgccttcagtttcctggttctgagtttccgtgttactcaagcaatgcttctgctgaatttgtcttttttttttttttgagacagagtcttgctttgtcgcccagactggagtgaaatggcgtggtctcggctcactgcagcctccacctcctgggttcaagcgagtctcctgcctcagcctcctgagtgtgcaacttatctttttattttatttatttataattttttggctaattttggctattttgtgtctgtgtgtgtatttttagtagacatggggtttcaccatgttgggcaggctggtctcgaactcctgacctcaggtgatccgcccacctcggcctcccaaagtgctggaattacaggcgtgagccaccgcacctggcctatttatttatttatttatttgtgactgagtctcgctctgtcacccaagctggaatgcaatggcgtgatctcggctcactgctacctccacgccccaagtttaaacaattctcctgcctcagcctcccgagtagctgggactacaggtgtgcaccaccacatccagctaattttttgtatttttagtagagatggggtttcaccatgttggtcaggctggtctcgaactcctgacctcaagcgatccacccaccttggcctcccaaagtgttgggatacaggcgtgagccactgcacctggttgaatttctccttttaattggaggtttcattttatttttctttatttatttttttgagacgaagttgcactcttgttgcccaggctagagtgcagtggcgcgatctgggttcactgcaacctctgcctcccagatgcaagtgattctcctgcctcagcctcctgagtagctgggaatacaagcacccaccaccatgcccagttaatttttgtacttttagtagagacaaggttttgccatgttggccagggtggtctcaaactcctgagctcgtgatctgcccacctcagcctcccaaagtgctgggattacaggcgtgagccaccgtgcctggtctcgttctttattttttattttattttttgacaccagatctgctctgttactcaggctagagtgcagtggcattgagaggtgacaacctgctagcagcccttgcttgctcttggcgcctcctcggcctcggtgtctgctctggccgggctcgaggagcccttcagcccactgctgtgctgtgggggcccctctctggggctggctgaggccggagccgtctccctctgcttggggggaggtgtggagggagagacgccagtgggaacaggggctgcgcgtggtgctcccgggccagtggtgttccgggtgggtgcgggctaggcaggccctgcactgggggcaaggttggcgtcgcctgctgggcttgatgggggggtgggggaggagcgccctctgggctgccggagtgccccactaggcgcggcaaagtcccgggagtgccattgagaggtgaagccagctgggcttctgggtctggtggggacttggagaacttttgtgtctagctaaaggattgtaaatgcaccaatcagcactctgtgtctagctaaaggattgtaaacacaccaatcagcactctgtgtctaggtaaaggattgtaaacgcaccaatcagcactctgtgtctagctaaaagtttgtaaatgcaccaatcaccactctgtgtctagctaatctggtggggatttagagaacttttgtgtctagctaaaggattgtaaactcaccaatcagcactctgtgtctagctaaaggattgtaaacacaccaataagcactctgtcaaaacggaccaatcagctttctgtaaaatgaaccaatcagctctccgtaaaatggaccaatcagctctctgtaaaatagaacaatcagcaggatgtgggtggggccggatgggggaataaaagcaggccacccaagccagcggcggcaacgtgctcgggtcctcttccacaccgtaaaagctgctttgttcttttgctttttgcagtaaatcttagtgctcctcactctttgcgtctacgctgcttttatgaactgttaacactcactgtgaaggtctgcagcttcactccttaagccagcgagaccacaaacccactgggagggataaacaactccagacgggaggaacaaacaacttcgggtgcaccacctttatgaactgtagcactcactgtgaaggtctgcagcttcactcctgaggccagcaagaccacgaacccaccagaaggaacgaacaactccagatatgccacctttaagggctataacactcaccgcggaagtctgcagcttcactcctgaagtcagtgagaccatgaacccaccagaaggaagaaactctggacacatctgaacatctgaaggaacaaactctggacacaccatctttaagaactgtaacactcaccgcgagggtacacggcttcattcttgaagtcagcgagactaagaacccaacaattccggacacagcatgatcttggttcactacaacctggatctcccagagtcaagcaatcctctcgtctcagtctcccaagtagctggaactacaggtgtgtgccaccatgccccactaatttttgtatttattgtagagacggtttcagcatgttgcccaggctggtctccaactcctggactcaagtgatcctctccacctaggcctcccacagtgctgggattacaggaatgagccaccacgcccggcctaattggaagttttagagtgcagtggggatcacgtgcgtagaggttactgctgccttaattaaaggagacaacatgtttcataaaacttggaaattgtagagggtgtggggaaccactcaaattcagaatatcaaaacagaactttattttttgtgtatttgttgccaatctttttccctacatatgtaatgtttgtttgtttgacatgactaccatttctgttttcataatatgtttaatacttttcctccacttaacaaacatggctacgatttgccaagttgctgatcatcctttttttttttttttcgagacagagtttcacccttgttgcccaggctggagtgcagtggcagatctcagctcactacaacctctgcctgctgggttcaagtgattctccagcctcagcctcccaagtagctgggattacaggtacccgccaccactcctggctaacttttgtatttttagtagagacagagttttgtcaggttggccaggctggtctcaaactcctgacctccagagatccacccgcttcagcctcccaaagtgctgggataacaggcgtgagccactgaacctggcccagatcatccttttaagtgttctttttcatttgtaggtttaacattggctttggggtgagaaagaaaccaagactcacccagagtcataagcccaacaagagaatgggtctgtctgggctagccctgggctactggatgagcagggttggccttttcattctctgagtcttcgtttctctggcctttacatttctctggagggacttttcattttctctggaaaccaactccaagtgcacttttccagaaggcatttttgtaatgcctggttggctgcatgcgacctctggttttcctccttcaccctttcctgctcagtcactgcattttctgttctcaaaagaaccctctcatatagcacgtgcagagagcagtagcgagtcaggctgtcccgcggtgtgtgtccggactcctgtgtgctctggcagtggggccagtgggctgggaagagttgcaggagaaacccagtgggagagaaagactccaacctgggaacctcggggcatctggtagcgccagaatgactttccaaaattttggttggggcagtcacaggcccctgctcgccacggtggcctctggcaaagaaacacatgtggggcagacaagagggatgctcgccaatctcctctgaattttgcaaccctgtgtgttaaaaacaggtatttctggtctttaaagacacttggaaaagacagacttgttgaatacttagaaaggccaagccacagccagaagcttggtgtctgggatccatcatctctaaggttttaaaagcatcttgctggaataggaacagctccggtctgcagctctcagcaagaccaacacagaagatgggtgatttctgcatttccagctgaggtacctggttcatctcattgggactagttggacagtgggtgcagcccatggagggcgagccaaagcagggcagggcatcgcctcacctgggaagtgcaaggggtcaggggatttccctttcctagccaagggaagccgtgacagactgtacctggaggaacagtacactcctgcccaaatactgggcttttcccatggtcttcacaactgacagaccaggagattccctcccgtgcctggctcggtggggctcatgcccatggatccttgcttactgccagtgcagcagtcttaagattggcctggcatgctgcagcttgttgggggggtgggagggcgtccgccattcctgaggcttgagtaggcagttttatgctcacagtgtaaacaggccgggaagcttgaactgggtggagcccactgcagctcagcaaggcctactgcctctctagattccacctctgtgggcagggcatgtcagaacaaaaggcagcagacagctttggcagacctaaacgcccctgtctgacagttctgaagagagcagtggttctcccagcatggcatttgagctccgaaaatggacagactgcctcctcaagtcggtccttgacccccgtgtaccctgactgggagacacctcccagtaggggccaacagacacctcacacaggcaggtgcccctctggaacaaagcttccagaggaaggatcaggcagcaatatttgctgttctgcagcctccgctagtgatatccaggcaaacagggtctggagtggacctccagcaaattccaacagacctgcagctgagggtcctgactgttagaaggaaaactaacaaacagaaaggaatagcatcaacaccaacaaaaaggacatccacaccaaaaccccatctgtaggtcaccaacatcaaagaccaaaggtagaaaaaaccacaaagatgggaagaaaccagagcagaaaagctgaaaattccaaaaaccagattgcctcttctcctccaaaggatcacagctcctcaccagcaagggaacaaaactggatggagaatgagtttgacaagttgacagaagtaggcttcagaaggttggtaacaaacttctgcgagctaaaggaggatgttcaaacccatcgcaaggaagctgaaaaccttgaaaaaaggttagacaaatggctaactagaataaacggtatagagaagaccttaaatgacctgatggagctgaaacccatggcacgagaactacatgactcatgcacaagcttcagtagctgattcaatcaagtggaagaaagggtatcagtgattgaagatcaactcaatgaaatagagcaagaagacaagattagagaaaaaagaatgaaaagaaatgaacaaagcctccaagaaatatgggactatgtgaaaagaccaaatctacatttgactggtgtacctgaaagtgacggggagaatggaaccaagttacaaaatactcttcaggatgttatccaggaggacttccctaacctagcaaggcaggaaaacattcaaatttaggaaatacaaagaacaccacaaagatacttcttaagaagagcaactccaagacacacaattgtcagattcaccaaggatgaaatgaaggaaaaaatgttaagggcagccagagagaaaggtcgggtcacccacaaaggggagcccatcagactaacagcggatctctcagcagaaaccttacaagccagaagagagtgggggccaatattcaacatttttaagaaaagaattttcaaaccagaatttcatatccagccaaactaagcttcataagtgaaggagaaataaaatcctttacagacaagcaaatgttgagagattttgtcaccaccaggcctgctttacaagagctcctgaaggaagcactaaccatggaaaggaacaactggtatcagccactgccactgcaaaaacatgccaaagtgtaaagaccattgacactatgaagaaactgcatcaattaatgggcaaaataaccagctaacatcatagtgacaggatcaaattcacccataacaatattaatcttaaatgtaaataggctaaatgccccaactgaaaaacagactgacaaattggataaaaagtcaagacccatcgttgtactgtattcaggagacccatttcatgtgcaaagatacaaataggctcaaaataaagggatggaggaagatctaccgagcaaatggaaagcaaaaaaaaaatcaggggttgcaatcctcgtttctgactaaaaaaaaaaaaaaagatttcaaaccaacaaagatcaaaagagagaaagaagggcattacataatggtaaagggatcaattcaataagaagaactaactatcctaaatacatatgcaccccaaacaggagcacccagattcataaagcaagtccttggagacctacaaagagatttagactcccacacagtaataatgggagactttaataccccactgtcaatattagacagatcaatgagacagaaggttaacaagcatatccaggacttgaactcagctctggaccaaggggaccgaatagacatctacagaactctccaccccaaatcaacagaatatacattcttctcagcaccacatcacgcttattctaaaattgaccacataattggaagtaaaacactcctcagcaaatataaaagaacagaaatcacaacaaactgtctgtcagaccacagtgcaatcaaattagaactcaggattaagattcactcaaaactgcacaactacatggaaattgaactacctgctcctgaatgactactgggtaaataatgaaatgaaggcagaaataaagatgttgtttgaaaccaatgagaacaaagacacaacataccagaatctctgggacacatttaaagcagtgtgtagagggaaatttagagcactaaatgcccacaagagaaagcaggaaagatctaaaatcaacaccctaacatcacaattaaaagaactagagaagcaagagcaaacacattcaaaagctagcagaaggcaagaaattactaagatcagagcagaactgatggagatagagacacaaaaaacccttccaaaaaatcagtgaatctaggagctggttttttgaaaagatcaacaaaattgatagactgctagcaagactaataaagaagaaaagagagaagaatcaaatagacacaataaaaaatgataaaggggacatcaccaccaatccctcagaaatacaaactaccatcaggaatactataaacacctctacacgaataaactagaaaatctagaagaaatgaataaattcctggacacatacaccctcccaagactaaaccaggaagaagttgaatccctgaatagaccaataacaggctctgaaattgaggcaataattaatagcctaccaaccaaaaaaagtccaggaccagacggattcacagccaaattctactggaggtacaaagaggagttggtaccattccttcggaaactattccaatcaatagaaaaagagagaatcctccctaactcatttcatgagaacagcatcatcctgataccaaagcctggcagagacacaacaaaaaaagaaaatttaagccaatatccctgatgaacatcaatgcaaaaatcctcaataaaatactggcaaacgaaatccagcagcacatcaaaaagcttatccaccatgatcaagccggcttcatccctgggattcaaggctggttcaacatatgcaaatcaataaatgtaatccatcacataaacagaaccaacgacaaaaaccacatgattatctcaatagatgtagaaaaggccttcgacaaaaattcaacaacccttcatgctaaaaactctcaataaactatgtattgatgacatatttcaaaataataagagctatttatgacaaacccacagtcaatatcatactgaatgggcaaaaactggaagcattccctttgaaaattggcacaagacaaggatgccctctctcaccactcctagtcaacatagtggtggaagttctggccagggcaatcaagcaagagaaagaaataaagggtattcaattaggaaaagaggaagtcaaattgtctctgtttgcagatgacatgactgtatatttagaaaacaccatcatctcagcccaaaatctccttaagctgataagcaacttcagcaaagtctcaggacacaaaatcattgcacaaaaatcacaagtattcctatataccaataacagacaaacagagagccaaatcatgaatggactcccattcacaattactacaaagaaaataaaatacctaggaatccaacttacaagggatgtgaaggacctcttcaaggagaactacaaaccactgctcaacaaaataaaagaggacaaacaaacggaagaacattctatgctcatggataggaagaatcaatatcgtgaaaatggccatactgcccaaggtaatttatagattcaatgccatccccatcaagctaccaatgactttcttcacagaattggaaaaaactactttaaagttcatatggaacaaaaaaagagcccacattgccaagacaatcctaagcaaaaagaacaaagctggaggcagcacgctacctgacttcaaactatagtacaagactacagtaaccaaaacagcatggtagtggtaccaaaacagatatatagacaaatggaacagaacagaggccgcagaaataacaccacacatctacaaccatctgatctttgacaaacctgacaaaaacaagcatggggaaaggatttcctgtttaataaatggtgctgggaaaactggctagccatatgtagaaagctgaaacaggatcccttccttacactttatacaaaaattaactcaagatgtattaaagacttaaacataagacctaaaaccataaaaaccctagaagaaaacctaggcaatactattcaggacataggcatggataaatgcttcatgactaaaacaccaaaagcaatggcaacaaaagccaaaatagacaaatgggatctaattaaactaaagagcttctgcacagcaaaagaaactatcatcacagtgaacaggcaacctacagaatggggaaaaattttgcaatctacccatctggcaaagggctaatatccagaagctacaaagaacttaaacaaatttacaacaaaaaaatcaaacaaccccatcaacaagtgggcgaaggatatgaacagacacttctcaaaagaagacatttatgcagccaaaagacatatgaaaaaatgctcatcatcactggtcaccagagaaatgcaaatcaaaaccacaatgagatgccatctcacgccagttagaatggtgatcattaaaaagtcaggaaacaacagatgctggagaggatgtggagaaataagaacacttttacactgttggtgggagtgtaaatcagttcaaccattgtggaagacaatgcagcgattcctcaaggatctagaactagaaataccatttgacccagccatcccattactgggtatatacccaaaggattataaatcatgataaggacacatgcacatgtatgtttattgcggcactagtcacagtagcaaagacttggaaccaacccagatgtccatcaatgatagactggattaagaaaatgtggcacatatacaccgtggaatactatgcagccataaaaaaggatgagttcatgtcctttgcagggacatggatgaagctggaaaccatcattctcagcaaactatcacaaggacagaaaaccaaacactacatgttctcactcataagtgggagttgaacaatgagaatacacagacacagggcagggaacatcacacaccgaggcctgtgggggggttgggggttagggaagggatagcattaggagaactacctaatgtaaatcaccagttgatgggtgcagcaaaccaccatggcacaggtatacctatgtaacaaacatgcatgttgtgcacatgtaccccagatcttaaagtataataaaataaaaaataaaaaaaatcttccctactttttaaactgtatgttgctttgtagcaatacattatgcacattataaagtgttttaattagaaattttagaagatatgataaagaaaaataatttaaataacaatttttattcaaaatacaaataatagggctgggcgcggtggctgacgcctgtaatcctagcactttggcaggccgaggcgggcagatcacgaggtcaggagttcaagaccagcctggccaacatggtgaaaccctgtctctactaaaaatacaaaaaattagctgggcgtagtggcgggtgcctgtaatcccagctactcgggagactaaggcacaagaatcgcttgaacccgggaggcggaggttgcagtgagccgagatcgcaccactgcactccagcctaggcgacagagtgagactgtgtctcaaaaaagaaaaaaaaagaaaagaaaagaaaaagaaaaaagaatattttgcccttataacattattaattatatactttcaagtgagagcaatatgactaattatgcttaattatttttgaaaatgatgctttaacaatttgtaatgcagacatttgatggtctggttctatgttgagttcatgttgatacttggtcttaaggacagttagagctgataaaaataacttgtgcatagaccaggcgcggtggctcacgcctgtaataccagcactttgggagtctgaggcgggcggatcacgagatcaggagatggagaccatcctggctaacacggtgaagccccgtctctattaaaaatacaaaaaaaattagccaggtgcggtggcaggcacctgtagtcccagctacttggaaggctgaggcaggagaatggtgtgaaccttgcagtgagccgagatcacgccactgcactacagcctgggcaacagagcgaaaccccgtctcaaaaaaaaaaaaaaagaaagaaaaaaaaaagaaataacttctgcacacatcataacattcatacataatgaatcattgatatactcattaaaatgtgactcatccaggaaaatcccatccctaaattatttaaagtttttgttttccctcagctactatttctgttctaccttatgcaaactaatgagaaaccattgtcccaagactggtggcctcctggcatggttgtgcaacagctgttgtcaaactccagagtctaaagtgcaccacgaaagccagatggcaggccagatccagcctccctgctaaatgaaatgttcactggccagggagaaacaaccacgtggaaaattaaataaacccatgacatttgtagccagcagctcgggtgttttgtagggttttccctgagaagtggggactaatcgcatgaatcactttttttttctttttagagtcttatctatttgtgaataaatgtttccaattaaagcattgctactaagcctcagttttctcacctctaccatggagttaaaatgtctacttcacactgtccataaaagaattaagatggccgggcgcggtggctcacgcctgtaatcccagcactttgggaggccgaggcggacggatcacgaggtcaggagatcgagaccatcctggctaacacagtgaaaccccgtctctactaaaaatatgaaaaactagcctggcgtggtggtggacgcctgtagtcccagctactcaggaggctaaggcaggagaatggcgtgaacccaggaggcggagcttgcagtgagcctagattgtgccactgcactccagcctgggcgacagagcaagactccgtctcaaaaaaaaaaaaaaaaaaaaaaaaaaaaaaaaaaaaagccaggcatggttggtggctcacacctgtaatctcagaactttgggaaacaggcaggatcacttcagcccagaagtgtgggaccagtctgggcaacatagtgagatcctgtctcttaaaaaaaaaaagaaaagaatcaaaataaaacaagaaaacaaaaacacagaacaagtgcatcatcatagtggtgacaatttttaggaaactttttttgtttttttctgtgtgaacctaactcatctaataagggagtgtgtgaacatttccatgttggtccattttttatgtgcctaaatggacaaagtcacccaggacctggctgctggactcatccttaggaagaataaagaaaaaggaagtttatctctagcatctttctcttgcccttgttttcttcctggccacagtcatgccctggatttcagtgtctctaaacatctagcagcctctcacccagcataacccctgttgaggtccagggcacgatggtgggagtgggtgcagaagagacagagagaccactggtttgagtgtctagggtttgggtcctcaggaagaacttggcccggcgcggtggctcacgcccgtaatccaaacacttcggagaccgaggcggttggatcacctgaggtcaggagtttgagaccagcctggccaacatggtgaaacaacgtctctactaaaaatacaaaaaattagccaggcgtggtggcaggcacctgtaatcccagctactcaggagcttgaggcaggagaatcacctgaactcgggccgcggaggttgcagtgagccgagattgcgccagtgcactccaccctgggcaacaagagtgaaactccgtctcaaaaaaagaaaaaaaaagaagaagaacttcttgacttgactcagcaggactttttccatgggtctaaagctaggtgtgaagagagtgagctcgtggtgagaggaacttgttcatcaaaaggagtccatgcccagtggcagaagtggagaggtgggtatgggacacacagggaagctgctctcttctgttgtctgtggcttctgttggaggatgtgctgtgggaatgcaaggaggagatggaaggaaggtgtcaatatagctttaacaaaggaaaaaaaaatgaaaacaccgaaaccacccttgcaaaaattgtaacagtgagaaaattatgacattgaaagatatccaatctaacccaactccttcttgcctttaacctccaaattgcacttagtcattcctgagcaaaggccaagctaactttgggagaaatttcgtttacagtttaaatgataatagcccttcccaaaactaacctgtctttgtaaaaatgatgaaaggccaccaggttagggaggatgagaggggcctgaatgcaggcttagataaacaattacccgccattgtttcagaggtcacaagatttgtaacttccccaattagtcctgtaaaatgatatcactgtggccttttgagatgtctttgcagttattttttgttttgtttgctttgagacaaggtcttgctctgtcaccaaggctggagtgcagtgatcatagctcactgcagtctctatctcctgggctcaagtgaaccttccacctcagccttccaagtagctgggactgcaggtgcatgccaccatgcctggccagttttgttgttttttggttctggggtgttttttgcttgtttgtttgttttgtttttgtatttttagtagacatgatgtctggctctgttgttcaggctggtctcaaactcctggactcaagcgatcctcctgcctcagcctcccaaactgctggggttacaggcacgagccaccttgcccagctcaggcttttccattttggaaaaccagatgactccacccagatccaagaccggtcctatggccccactcagaagtggactcagtgcacgaggaccattttccacatccctatgattgcatcccaatcaatcagcagcacccattccctagccacctgcccagcaaactatctttttttttctttttttcttgagactctgtcgcccaggctgtagtgcagtggtgcaatcatggctcacagcagcttcaacctccctggcccagcctcccaagtcactgggactacaggtgtacaccaccacacctggctaatttttaaattttttgtagagatggtgtcttgctgtgttgtccaggctgatctcaaactcaaggactcaagcaatcctcctacctcagactcgaaaagtgctgggattacaggtgtaagctgccatgcccaacccaaactatcttgaaaaagccttcaaatttgagaggaggctgatataagtaataataagacttcagtctcctgtttaactggctctatgtatataaaactctttctctattgcaattcccctgtcttcataaattggctctatctgagcagcaggcaaaatgaaccaattgggtggttacaacagtatcagcatatacagtagaattgtaatatccatcatataccaactgcaaattaattttaaaagatatattgttaaaaccatataagtgatataagtaatttacagaagaataaattcaattgaacaataaatatgaaattattttcaacccctccagtcatatagtaaaagtaaattaaaactttttttttttttagacagagtctcactctgtcgcccagggtggagtgcagtggcgcgatctcagcccaccgaaacctctgcctcctgggttcaagcgattctcctgcctcagcctcctgagtagctgggattacaggcgcccgccaccatgcccggctaatttttgtatttttagtagagacgaggttccaccatgttggccaggctggtctcgaactcctgatctcaagtgatccatcaaccttggcctcccaaaatgctgggattacaggcatgagccactgcacccagcttaaaacaatgttttaacctcttgttgataagagtgtaaacttatcacctttgggggaagtaatttagtacctattaatattaaacattttcataacctttgatttagcatttccacttaaattagtgccttagttagtttgggctgctataacaacaccacagcctggatggcttatagacaacagaggtttatttttcacagttcatggggctgggaagttcaggtatcaaggcactggcagttaaggtgcttggtgaaggtcctttttctgttcccagttcacagatgtcccaccttcattttctttcttttccttctttttctttctttctttttctctttctctttctttctttctctctgtctttcttccttctttcttctttctttcttttttttttttttttttaacagatgagggttttctctgtcacccaggtggctggagtgcaatggtgtaagcttggctcactgcagcctcaacctcctgggctcaactgatcttcccacctcagccgcccgagtagctgggactacaggtgcatgccaccaggcccagctaaatttttgtaattttgtagagacgaggtctcattatgttgcccaggctggtcttgaactcctgggctgaagcagtcctcccacctcggcctcccagatgctgggattacagacgtgagccaccacacccggcccatcccaccgccttgctgtggcagggagagcaatagcctctcttcatctctttataagggcaccaatcccattatgcccccatgactttatccaaacctcattatagcccaggccccacctccaaagactatcacattgggaattagagagcttcaacatacagtttgaggggactacaaacattccattcatggcaactaggaatttatagaaacactccctctagtgtgcaaaaaagtaagtacaagaatttttggggtttttttgttttttgttttgttttgttttgttttgttttctgagacagggtctcgctgtcacccaggcatggtacagtagcataatcacagctcattgaagcctcaacttcccaggctcaagcaatcctccccgctcagcttcccgaatagctaggactataggcatacaccaccacacccagctaattttttttttttttttgagatggagtctcgctctgtcacccaggctggagtgcaatggcacgatctcagctcatggcaacctccgcctcctggattcaagcagttctcctgcctcagcctcctgagtagctgggactacaggcgcatgccaccacacccagctaattttcatacttttagaagagacagggtttcaccatgttggccaggctggtctcgaactcctgacctcgtgatccacctgcctcagcctcccaaagtgctgggattacaggtgtgagccaccgcgcccagcctaatttttgtattttttgtagagatagggtttcaccatgttgcccaggctggtttccaatatctgggttcaagcaatctgcccgccttagcctcccaaagtgctgggattagagatgtgagccacggcacccacccaagaatgtttttttgaggcattatgtctactagtgaataatgggggggggggccgtggggggagtaccagaatagttaaagtaggctgtgtatatacaatgaaatatcacagtatcattttgtaaagatctatatgtattgacatgggaaaatgagcacatcataaataaataataaaagttgcagaacaatataaactggaagaaacatttttttcaatcttcccctccatccatctttgctgatatataaacaggaaaaagttgggggagagaatacaggaacacggaacaaacagtaaacaatggttatctcatagacgtgattggcggcatttttggttttggttttctttttgagacggagtttcgctctctcacccaggctggagtgaagtggcacgtttttggctccctgcaacctccgccccccaggttcaagcgattctcctgcctcagcctcctgagtagctgggattataggcacctgccaccatgcccggctaatttttgtgtgtgtgtgtttttttcagtagagacggagtttcactatgttggccaggctggtcttgaactcctgacctcaggtgatctgcccgcctcggcctcccaaagtgctacgattacgggcatgagccactgcaccctgccatagagggcatttttgctttctgagttagtcagggttctccagagaaatagaatatacatacatacgtacatacatacatacttgcagagagagaaagagagagtgtgacttattttaaggaattagttcacaaaattgtggaggcttggtgagtccaaagtctgataggagagcccagcaggctggagacacaggaaagagttgcagttcaagtccaaaggtggtgtgctggaaacttctgaccagaacaaaagagagaggacagccttttgttctaaccaggtcttcaactgattggatgaagcccaccctcattacatttaaagttcaccaatttaaatgtaaatctcatccaaaaacaccttcacagaaacatccagaataatgtttgactaaatatctggacaccatggcccagacaagttgacacataaaattaaacatcgtaatgagatctgctgctatctatgaatttatgtttctagtgtatttgtaaggtacatggatcattcctttatttctctctctatatatatagatatatatatactttttataatcataaatatgtgtatgcatgcatatgtatgtataagaaaatatatatacatatagacataaaattatgcatttgtgctaggtacttgtgatggttaattttatttgtcaacttggctaagccatggtattcagatatttggtcaaacattgtggatggttttgtgagggtattttggatgtttcaaattggtgcattttgaataaagcagactgccctccacaatgtgagtgggcctcatccaatcattcaaaggcctaagacaaaaagactgaggtccctgaggaagagggaattctgcctccacaccgcctttggacctgagctgtaacatcaactctttgctgctggcctgcctgctctgcagattttggatttgccaacccctatgatagcatgaaacagttctttcatctgattggttctaactctctggaacaccctaactaatacagtgctgttataggtactgagaatagagtgatcaacagggaagaaaacgtgctgtcttggggccttgctggcgggtggatggtagacactcaattgtgtgaggctcattggccatagaggaactcatgcaggagaaactcaccttgcctaggttgaaaggaggggaatcaggcacatattcccctctgaggaatatgtcagcagagactggatgtggcaagactacaggtggcgggtaggtgggacagagtattccagaccagggaacaaaaagggataaaagtcttggggtggaaaggacatgtttgagaaacagaaataagaccaggtgctgggaccaggagtcctacactcatcacactcagttactcatggggtgacttcagaagccctaaaagattttgtttcccaatttttttttttttttgacaagatcttgctctgttgcccaggctagagtgcagtggcacgatcatagctcacagcagcctcaatctctcgggctcaagtgatccacccacctcagcctcctgagtagctgggactacagatgaatgcatcatgcccagccgatttcttttgtttgtttgagatggagtctcgctctgtcaccccgagtggagtgcagtggcataatcttggctcactgcaacctccacttcccaagttcaagctattctcctgcctcagcctccctagtagctgggattacagatgcccaccaccacacccagctaatttttgtattttgagtagggacggggttttgccatgttggccaggctggtctcgaactactgacctcaagtgataacgcccgcctcagcctcccaaaatgctgggattacaggcatgagccactgtgcctggcccaatgcaattttaagatgattttatgtatattgtaggagagaaaaataggtaaatatattaagagtattaagagccaaggctttcgattgccctgataaaagatatacaaatacaaagtccaagaagagggaaaaacctataatgtacaatttgaattggaaataccaatatgaattcatgattttttttaaaccctaaatgtgacttaaagcgatgacacctctgtagcaacgagctctcccagcactaaagaccattcctcactaaaacgaatcaatgttccttagaaagatggctgattttggccaggtgcagtggctcacgcctgtaatcccagcactttgggaggccgaggcgggcagatcacaaggtcaggagatcgagaccatcctggcgaacacagtgagaccctgtctctactaaaaatacaaaaaagtagacaggcatggtggtgggcacctgtagtcccagctacttgggaggctgaggcaggagaatggcatgaacctggggacagagcttgcagtgcgctgagatcacgccactgcattccagcctgggcgacagagcaagactcggcctcaaaaaaaaaaaaaaaaaaaaaaaaagatggctgattttggccaagtgcagtggctcatgcctgtaatcccagcaatttgggaggctaaaggcaggcagatgcagatcacttgaggccaagagtttgagaccagcctggccaacataatgaaaccccatctctactaaaagtacaaaaattagccaggcgtagtggcaatgcctataatcccagttactcaggaggctgaggtgggaggatcacttgaactctggaggcagaggttgcagtgagctgagatcatgccactacacttcagcctgggtgacagagtgagactctgtctcaagaaaaaaaaaggaaagaaagaaagaaaaaagaaaaagaaaaatggctgattccacatctggagctgggaaagtaaaaaaaaattgtgcctgggacatctagttgtgtcaaaagcaagcaagtgctcacagaacttttggggtatgtcagaatggatgtaggagttagcttaaaagggctcccactggggccctctcccaatctagatcattctggccaataaggtgaaaccccgtctgtactaaaaatacaaaaattagctggccatggtggcatgcacctgtagtcccagctactcaggaggctgaggcaggagaattgcttgaacccaggaggcagaggttgcagtgagccgagatcgtaccactgcactccagcctggtgacagagtgagactccatctcaaattaaaaaaaaaaaaaaaggctcccactggacacataaggtacagttcgagcacaaaaaaataatgactgtaaccaattgtgaaatattaaatggatacctggcatggtgtagtcccagcactttgaggccaaggcaggtggatcacttaatctcaggcaacatggcaaaaccccatctctacaaaaaatacaaaaatcatctgggtgtggtggcatgcacctgtggtcccagctactcaggaggctgaggtaggaggatcacttgagcctggcaggttgaggctgcagtgagtggtaattgcgccactgcactccagcctgggcaacagaccgtgatgctgtctcaaaaaataaaagaaatactgaatggataaaaaccctaaatctatagtttaaaaaaagaaaaaaaataaattttctacctttggagattaatatcataccaataccttattctgaaaactggtaaagggaaataagcatttaccttgccttttagaaggaccctactttggccgggcgctgtggctcatgtctgtaatcccagcactttgggaggctgaggcaggtggatcacttgaggtcaggagtttgagaaggaccctactttttccagttggtgagagaaagctccttcctaggtaattatgcccttataaatgtagaagtgggagaattagaaaagcaccttttgtaatttctgatgaaataaccaattcaagcaagaatcactgtagatggcgataagagaaagtttttcagcgtatacacacagtgtcaaagaaccatgcagacgacttgctaattgccaagagggaaacataacctttacagaaaagatctgaccgtgtccatcctaaccaagcaatcatacttagcatcactgcttgtgggatggcttcatatcatatgccttctgatgtgaggcaatgtgacatatatagcaagtttgaggaattagtcccaagactgggtaacctgaatctaaccaagaaattgggggaaaacccctcaaaactcagggagacagatgaacacattaagtgacatcaaagaaacagtaagacaaatctagaatgttgaacagtctaaaagacaactgccctagtatcctcaaagatccaattccaagaagaaaaaaactggatgattgtagattaaaaagaaaggggtgagaaaaggacataaaaaaatgcaatgttgaaacttgattggttcctgttctgggagttttttaaaagctatatattaaaacatcatgctatacaccataaatctatacaatttttatttggtaattatacttaggaaaaattaaatgctataaaaggcattcaaattggagaagtttaatgctagatgacattaaaaattattaactcattaaacatgatgattctattatgattgtgtaagagatgtatatgaagtatttaggggtgaatggtcatgatgtctgcaagtttctttttttttgagatggagttttgctctgtcacccaggctagagtgcagtggcactatcttggctcactgcaacctccacctcccaggtttgagcaattttcccacctcagcgtcctgagtagctgggatcataggcatgtaccaccatgcccggctaattttttgtatttttagtagagacggggtttcaccatgttggccaggctggtctccaactcctggcctcaggtgatccgcctacctcggcctcccaaagtactgggattacaggtatgagccaccatgcccagccgatgtctccaactttcaaatggttcagggctgggtgcagtgcaatcccagcactttgggaggccgaaggaggcggatcacctgaggtcaggagtttgaggccaccttggccaacgtggtgtaatctcgtctccactaaaaatacaaaaattagccaggcatggtggtgcacacctgtagtcccagctaatggggaggctgaggcaagagaatcacttgaacccgggaggcagaggttgcagtgaaccaagattgcaccactgcactccaacctgggtgacagagcaaaactccatctcaaaaagaaaaaaaaagttcaaatggttgagaaaagacaacacttgtatactgttggtaggaatgtaaattagtacagctattatggaaaactgtatggcggttcctcaaaaaactaaaaatagaattaccatatggggctgggcacagtggctcacacctctaatcccatcattttgggaggccaaggtgagcggatcacctgaagtcgggagctcgagaccagcctggccaatatggtgaaaccccatttctactaaaaatacaaaaattagttgggcgtggtggtgggcgcctgtaatcccagctacttgagaggctgaggcaggagaaccgcttgaacccgggaggcggaggttgcagtgagctgagaccgtgccatcgcactccagcctgggcaacaagagtgaaactccatctcaaaaaaaaaaaaaagaattaccatatgatccagcaatcttgcgtctgggtatttactaaagagatttgaaatcagtatgtcgaggagatacctgcactctcatgttcgctgcagcactattaaccacagtgaagttacatagtcaaacgagtgttcatcagcagatgaatggataaagaaaatatggtatataggccgggcgcagtggctcaagcctgtaatcccagcactttgggaggtcgaggcaggcggatcacgaggtcaggatatcgagagcatcctggctaacacggtgaaaccccatctctactaaaagtacaaaagaattagctgggcgtggtggcaggcgcctgtagtcccagctactctggaggctgaggcaggagaatcacttcaacctgggaggcggagtttgcagtgagctgagattgcaccagtgcactccaacctgggtgacagagcaagactccgtctcaaaaaaaaaaaaaaaaaagaaagaaagaaagaaaatatggtatatataccgtggaatgctattcagcctttaaaaagaaattttgtcatttgagacagcgttaatggaattggagaacattatgctgagtgaagtaagccaggcacagaaagacaaatactgtatgttctcacttataagtggaatctaaaacaatcgaacttaaaggaggagagagcagaatagtagttaccagaggctgggggtctggggtaaatggggatatgatggttaaaggttacaaagcttcattggactggaaaaataagcttttctttttctttgagatatactgcacagcaaagtgaatatagtaaataattcttggacatttcataagtgttgagggtaaatatcttttttacatttttaacatattccctcctctgaatgtagagagtaaatttcaaacattctcaccacaaaaaaagtaagtatttaaaagtgatagatgttgggccgggtgcagtggctcacgtctgtaatcccagcactttgggaggtggaggtgggtggatcacctgaggtcaggagttggagaccagcctggccaacatggtgaaaccccgtctctactaaaaatacaaaaaattagccgggcatggtggcggacgcctgtaatgccagctactcgggaggctgaggcagaagaatcacttgaacccgggaggcggaagttgcagtgagccgagattgcaccactgcactccagcctgggcaacaagagtgaaactccatctcaaaaaaaaaaaagtgatagatgttaatttgcttgatttaatcatcccacagtgtattcatgaatcataacatcactttgtacgccataaatatatacaactataatttgccaatttacaattaaaggttaaaatttttaaaaataaaaggtaatgacaacaaaaaaaatggataagtagacagaaaaatcgattaatacagaagctggcaaaaactagtaaagcaaatatggcaaaatgtagaatttgttgaatctttcagtatttgggtgtttattgttctttttctatgttagaaatttttcaaaataaaaagttgcaaatgatttccatattattctgatttttacacagtaacagaaaacattcctggctgcagctcattaatatttcttctttgttctcctgaggaatcaaaagattctcatttatgatatgtcaaaaggcacataaagaaacatatccaaactttgttgtctcttcattcaagtttggctttaatattttattaaaaatttttgtatttgtaaatattaaaacactgaaacttgctactgacacaagaacgacaatgcactaacaataaaatcaaagtagaagctaaactattcagaagcagtagcaactccatgattccaaggtaatttaaacaggcaatttcagagtgcttcaagatgaaggcgcaaagcagcctctcagcctgcagtgatgctacgacaccggcagatggcgctgcaaagcttctcaaatgcagcgggaagtccatttaccaacggctgttgcgatctcttaattagcttgaactgagtttgtattagaatttataatttttactgcatattgcagttactcgtatattactgacactggaacagacatgttttaacaaactggttgagccgtatcagtgcgaaccagctgaatgtcagcgctgttccctcctgtgacagaagccaccggcgcctgcctgagggcactcccctcactgggactctcagtaccacgcccacctgtccccaaggtttgtttcatcactaagccccaccttccagcattttcacctttctccttcacttgatccttcttcctaacatcgtgttaacacactccaaactaaaaaagttcctcaactgcatatactctgctccctccatttttttctttcattgcaatcactgccaaacattttgaaaattctctcctcacctccactgcctttacgcttttcctccaaattattccttaaccctctgacatctggggcttctgattccacctctccaaagaaatgctcccaccaagaccatggaggcccctctcgttgctggtggatactcgttcattttccccgccaccacccatcagcagcgttccacgccgcccttccttccttccttcctcccctagcttcatcacaccacgttactaggtttttcctgtctcactggctcctttccctgctctcctttttatatgtttcctgctttcttcctcagccttctctgctccccacacctatatgttgatgatgcccaaatctctgtctccagccacgacctctctttccccaagctccatttgcataaactgtctctgatgagatttagggcgcttacggtggtatggctgtagacaactgtctcaggaaacagacccatgacccacccagttgccaagtcagaaacaggatgtatactcttgacttgtctctctcccctacacagcaaaacaatcccaagacatgtcaattctatctcctgagcaacccataaaacgatttctcttctttccatcttccattaccctaattctggtgttcattctctctccctgggatggctgtaaaagcctctgatttctcccctttccaaaccagtctccacactgcaaccatagtgatctaaggcacaattctcaccttttcagtcttaggcttaaagttcaacatccctctggatacagtctaaatctttaacacggctgaaaaggcccagcaagagctggaccaagcccacctctccagcttcacctttcctcatttctcctttgcaccctctgcctctgaacaagttacagtcttccaaagttgtcatgtttcttgacctttgctgtctcctctgcccagaatgcaatttccctgtctggctaactcctgtccagcatttggcctcagcatggacatctgttcctctaggacgcttcccctgattcaccaagaccagcttaactgcccctactggctgttcctatagcaattctttaccacagactactgattttttgtgtttgttttgttttggcagtctgacataactttatactaatgcagcttctagccctgtcccccactccttcctgatcagtatcccaatgtccctcctatatggagccaccactaccccacaggatcctgtaccacccttctcccagaacttatcacactttttttttgtaattgtgtttccattctccaataaattgtgagcgccacaaagaaccatttctatctcacttaccacttggaagtgactggcaggtagtaattgctcaacaaatgttctatgagtgaatgaatccttgggataattatagtactaaccatcttatttagttatgacagttcaatagaaacacgtaaaataatgcttttatagtttacatactgctatagagctattgtattatattattattattctattcctaccctctattgcttgagagtaggatattgccttattcaattttggttattgtcccagaactcagggatatatgtctggcatatattgtttttaaccaatttttgttgactgtatcaatgattgtaagaagtgaacaaagggccagataattgaactatcctggaccacacacagctaccctgttccagaagcaggactataatcccatctggaaaaagggaaacttggaagttgacatctaaatgaaattccagcatggatgagagaagccctgatttctctccatcaagagactagccagctatggaagccaccagagccccagacctccatggtcaagtattcacatagtagacatgacccagacaagagggtgcgtatttcagcgtggaggggagactgggcccttggtttcctgtgtctttgtagtcagttctaacctcagcctcaggcactggtgttggggccctattcatcctcatctgcacgtccctcagttcttttcctgttgctattatcctatagagtcagcaagtcatggaagaggttttacagtctaaccctgtgggggtgtcaggagttgcctcctgccaggtcttcagcataaaaatcccccctcctcagctcccagtcaattcttcatccccacccctagactctcccaaatacccctgatgaaacccctgaggtggaaaaagataaagacaagcaaagataaacagcacaggaagcagaggtacaaatagaattctgatttttctcctttctctccatattttgaggaaatgaatccaatgtcctcaccccacctcctgcagcggagaagtcccctgagcatctctgaacatcatgaaccctcaaagtaagcttagcttgggccccttttccttttctatcagtgaggccaaagagccccagatgggagacaggtggatttttctctcagctgggaccttttctctttcttgtctagcacattttgggaaaccttcaagtacattctcatgctggtattatttaaactttgcactggagtgaattccaggagttatgtccacactgagaccaatggagatgaacctaaagcaatatgtggccaaacaccttagcctctttaaatatactttcctttgctccttggttaacagggtctgtctgctcgcattagagaaactgcccagtgactcagatcctgaaaggatctgctttagagaaaaaaggagtctggtacttctcactccatctagtgggcaacctgtccaactacactttttgctatcatccaatacagacaacactggcagtcaataaaaaagctcattctcccatttctaaaagaattcaatctaggagtctagctgctggcttaacaaagggatatacagcaaagcctaaggtgccctgactcacgagagagctgatttctgccgaaatgctgaggtgaaaccctaaaatggttctggccacctgctaggttctagctcagaccctgcactggatcatctttgttccacccccaaaccagagtaaatggaattcaggaggctggttctgtgcccgcccctatgtacctcaaatactcgtagctgccaagcttttaaacaatgaaacttaacactgtacttaaagggctgttctgctcaaatcataaatgtgcacgctagttgttcaccagtaattaaaactactcgtacacatttaatcaacattttcacaagcgttttgccttaactaaaaatttgtatcaacatgaagtcctagaattatactgcatgagcccccaggatttggagaacatcattcacccttcttaatccaaaaacttgggtgcctgaaggtggggttttgatcatggccaggcttcaaatttaggtcaggctctggtggtacatccttatatgcttggtgctcagcacaggtcaagacacacaatagaccctcaataaatatttgctgaatttgaacaattcctgtaaaaatctcattaagagacatcagcttgggacacagttcctctcttactgttccttctcccagaagctcctggaatgagcaggtctggcggcagggggcacacagggctgctgctcaaatcggagaatggcacaaactccaaaagggagctggatttagacctcccctccccatgtagataacgggattcctaaggtgcagagtgggagaatgggtagaggaagcaggtttcagagactgagaacctactaaactcctaagagaactttcccttgcaaagagaatgcatgaaaaaagaagggagaagaggagagaagcctcccacagctgttagcctggaacagccgctctcacctcagttcatctggggaaggggctacaaagcaaacaatctttattcacaattggggtggcagaggggagatacccccaggtcagtccaaaagcaaagatactgggagggaagatggcgctgggcgaggaactcagcactcatcctcacccagcagggcataagggtttcggccagccaggctggaccctggagccgaggttggggtctcctcatccccttctccctcctcatccgcatcccggtcctcctctccctcctcctcacaggagctgctcagctcttcctcttcctcctcctcctcgtcacctgctggccccaccctgccctgcaaaaccaccagctccgtggtctctggatgggactcccaggtgcctggggaaccaaaacaagaaaaaaatggaggagagttttgagcaagaactaaagccaaggaaagatggggaagaggcaaagactaggaataacaataatctttagagctgctggcattcattcattcatccattcattcaacttcctatgtgcagattgctgaacagaacctttgtgcacatcaacttcaatctttacaatcactatgctaagggtcaattattaccctcagtttgcagatcaggaaaatatcacagatgttaagtaacagagctagccaacaggtacagaatccaggtttgaccctctctctggccacaaagcccacacccttttacctacgctatagcagggggctggggaagaatatctgggctctgacctttctgttcactgtagcctgggggatgaaaacacaggctgaggcggccgtccactgccagccgcaagagactgttggctgctctgtacacatcattccgagccgccttggctgtcttgtaaccacgtttctctgcccaggctggaggaagaaaagaataatggaaagggaaagcattaaccaggtaccagttatactcccactcccataacacagtccttccagttttccccaaaacattccaggccagagatcttactggctatgcaacaaaaatctaggggtgagtggacagcagcttcatcaatggcagaatctctgaggagaggaaaggagacagggaagggtaaaaggcgaggcaggtaaggaagagcagctgaaaccaggtggggcgaagccaggcacatggaactcaccttcacagatgtcccaggcacaccaggggtgttccgctgaggggtcctcagcctctgggtggcgcaggtggagcagggcctgcacgggaattcgggaggccaggtagcccacagcagtgtagggctcctggatctgggcgatagggtagatccctgccagaacctgagggaaatgagcactcagtactttcctcaatgtcccaccttctctctttcccttacccaccctccccgtcatacctgcaactgcctaggcagaagagatgggaagatgaggcctgggcagtcacagagcttcacagagggggtaagaaagtaggtctgaaagtatcgggtatggcccggggttctggagacactcacgactttccgccccaccagcccattgatcagcgaggactttcccacattagggaaacctgaggaaggcaaggaaaattaacgtttaacaggtttctactctgtgatgggacttggtgctatacctataggtaaaaggggaactaaggctcagaaattaaggaaatggtattgcagaatacaaatcacgctctgggctgccagggttaaatcctggcccttccacttaccagctttgtgatgtcagggcaactaactttctgagcctctgtttcttcattttacagtgtggacacctccctacctcagggtggtcaggattaaatgagataaccaatacaacttgtgtgggtcagtgcctgcagtacagtaagtacccagtaccagtgatccacatctcataattactatgacttggcctggcacagtggctcacgcttgtaatcccagcgtgattactttgggaggccaaggcgggtggatcacctgaggtcaggacttcaagaccagcctggccaacatggtgaaaccccatctctactaaaaatacaaaaattagctgggcgtggtggtgggcgcctgtaattgcagctacttgggaggctgaggcaggagaaccacttgaacccaggaggcggaggttgcagtgagctgagattgcaccattgcactccagcctgggcaataagagggaaactccatctcaaaaaataataataataattacgatgacttgtccaaggagaaaactggaagccttggggctcactgccactctgctcactcaccaccaccagtttttgtgtttctggctgacttcagtgccttcatctcccttccacagagcatctcctttaccccacctcagctgcccactcccatggtaatacctgcatcttgtcacttcacagctccaaagcctcaattccaagcacccctctctgccctgacaactcatctttccagctcacttactctggttactccatgccagtaagtctttgacccctgaccttaacacagtaacactatgcaatacccaactcgtgtcctcaatttccttcttacttgactcagatttcatgatccagctcctcagccaggcccgttcacagacctggaactccctggtcccacttctcccctctatcttactcacctggcaaaatcccaaccctgtaaaatccagctctgcccattcagcactgctcctgggcagctgactgtggctaagaaaagatgtaccactgtgctcactctttacaacacatgcaagtatctaggaggaagggagggaaggagggagaaaaaagttctcctttgacgaccaccaccagacctagttctctgtccgctttgcaggaaaactccttaaaagacttacctacttttttcaccatttcttcctgctatcttctttgtaactgtaaactacaacatacaaaaaaatgcacagaacatacatgtgcagcctgatgaaccccataccacccaatgtgtgacaacatgttccatctgtccttgttttttttgtttttgtttttgagacagagtctcactccctcacccgggctggagtgcagtggtgcgatgttggctcactacaacctcatcctcccaggttcaagcgattctcgtgcctcaacctcctgagtagctgagaccacaggcgtgcggctccacacctggctaactttttgtatttttagtagagatagggttttgccatgttggccaggctggtctcaaactcctgacctcaagtaatgcgcctgcctcagcctcccaaagtgctaggattacagggatgagccaccataccggccgccactcatccttcttgatcataatcctctccctctatacatgcaagctttatccttttaaggaaatcaactccttacatttctctttagtttatgacctgtgtatctctcaacaatgcagcttaattttgcagctttcaaacttgatagaactgaaattgtgcagtatggatgctattgggtcagactcttttcacacaatgttatgtgaagttgttgcaccttctctcatgggcctactccagtttggctttctccaccccactgaaaccacggatcttcacattgccaagcctgctgagcagctctctgttctctcatttggcctgtcagcaacagttgacacagctgattcctcctttcctcttcaaacaccttcttcatttgacttctgggacgctcccttggttttcctccttctcactgtcctttgcccaactaaatgctggcttgtcctaaggctcagtccttgacctcctcttctccaactatttcctttctctcctacatctcatccaattccatggcttttttttttttttttttgacgaagtcttgctctgtcacccaggctggagtgcagtggtatgatcttggctcaccgtaacctctgcctccaggattcaagcaattctcctgcctcaccctcctgagtatctgggactacaggcacgcaccaccacacacggctaattttctgtattttttggtagagacagggtttcaccatgttggccaggctggtctcaaactcctggcctcaagtgatccacctgcctcagcctcccaaagggctgggattataggcatgagccactgtgcccagcctaatcctgtggctttaaataccacttatatccatcaatggttccccaaatttaaatctttcccaaattcaaatttccgtcctcttctctcccctaagctgctgactacttacccactgcctattcaacatctccactagggatatttaaaaagaatctgaaatttcatttctgattcccctctcctccccaaagccttcaaatctgcttctcccccagtcttcccatctcagtatttccagttgctcaagacaaaaacctggaagtccttctttatcctcactttccttcacgtgccaactgcaagccatcagcgatctcattttctctaccttcaaaatatatcatgcttccggccctgtctcaccacctccagctccagcatcctactctaagcaactcttatttctctcctagattactgaaatagcctcaactgctctctctgctccctttcttgcccaccccccatcatttattctctactcaggaggtaaacttataagaaacaaaatcagatcctatcattcccctgttcaaaacctacccttggcttctcatgagacttggaataaaatccaaaatggctgtcacagcctcagggctctacatgatgtgggccctggtgatcttgctgacctcatccccagtactttatcctggctcccatactccaatcccctgggcactcttgctggtcctagaatctccaagcccgttccctcctcaagaccctttccccacagttctgaatggctcacttcatctcatcatccagttctctcctcagggaggttttccctgagcacctctcctctcagtcactctctatcccctttcattgctttattgccttcactgcccctacatgatttcggatcacaaaatctatttactcacaagaaaataagctccatgaatctacagacctttttgccatttccacagcagtatgtcccatccctagaatatctggcacctggttaagtgttcagtacatatttgttgaatgggtaaatgaatgagagctggagggaaatccaaactcaggggtgcctgtgccacagcaaacactctccctctcacaccacctggaatagagatcagctagagcagaggctgctaagagagggaacagaggctccttgtgacagggagactaggatcagaagtcagggaagggacagccgggtgaaatgactggaaagaggagcaatcactcagcagtaaggcaggttcttccaaagacaaaaaggacacagagataagtcagggcacttccaaggaacccaactacctactccacactcccaaatttattctgggttgggccctttttggttccaatatcacctcagataccataacttgtccaaggtctcttcttacctctcccaccctaaatgaagacgggccctgggtcctaatcatacattcctttttcctccactgtgagctgagacaaagcccttaagaggagattctccttggcaacaaacttaaagggttaaaacctagaagaatactaattcttgctgagctcctactatgatttgataatcactgtactacagactaattactacaattcaaatggtttatataaaccacttaaaacagtgcctgttacatagtaagcaccatataaatactgagttttaacaataataattgttattattgttatcactatttgtcaggcattcttacactctcttaacactattcccatcattcctcacatccattctttttttttaaagacagggtctctatcagccaggctggagtgcagtggcacaatcatagctcactgcagccttgaactcttgggctcaagtgatcctcctgcctcagcctctgaagtagcagagactacaggcacataccaccacacttggctagttttctttatcttttgtaaagatggggtttcactatgttgcccagactagtcttgagctcctggtctcaagcaatcctcccacctcagcctcccaaagcgctgggactatataggcatgagccctcacacatggccgtcatccattcttttactcaggtatcaatgtccttatttttaaaatcaaagtaactaagactcagagtagcaaaatcacttactcaagacctcacagctgagaagaggtggaatttaactcaggctgtcatgatccttccactgcagcagacgcctcttctgccttgcccaccgccactggcagagatcacccctcagacaccctggggcctaatgagacctgatcgccctctctcttctccgaatatgaaaactctgtacctccttggaggccaccacgcacaagctgccacttccttacccacacagccgatggtcaccaccccatccttgtagcgctcttgggttgggccagttggctccattgctgaatcagtctgctgctccaccaggactgctgggccatcctcctcttcctcctcctccccagagccattaccccaggtggccccagccacatcccgagcaatcttctcccgccagctgctcaagtccactgctcaaagaaggagaagattaaagaggttctccccagggctgctgtgcatgatggcacatactgtgccctgcacagattatgtaactggcaccctctggagttgtacagtgccaacctaaataagagcaggtcagagaatctcccaaaagtcatttgaccctaccctccctggaatcacgcacgtttctctgagcttctgaaaagtactgggaaggctaaaggcagcaagccactgaggctcctgactacctgctgcctctcgtcccaccaagtcagtctgctccttattctgtcccttcccctggcctcttgcacatatccaccatagaggggttggcttcaggaaaggtgagcaaaatgattctgcatctttggtctcccccatgtcctcctacagccctcctctaagggccacatacctttccccacagtgatggcttcacaggctctcagcaactgctctggccccagggcccgagtccatcctctcccccgcctccgactcttcttcaagactgagatcagagggcacaaaaggatgggcacacgggcttaggcctctcatctctcccaccacccttaggcccaagaccaggtgcccccttgtcaataagcctctctgttctcccctttgtcccctgccaactcacctctcccaagttgccctctctcattgcccactcaccactactagggtcctgtggggtgcgggggtcccgaggaaaagaggtgaaaaggacgacgtggagctggggatagtgttgatggaaataatgcttccaggcaaccacaagagctggcggggccagatccaccttgttcaaaaccagcaccagggccagtccaagttctccagtcacatactcataaagtgctggcgggaaattcacaacctaggacagagttgataagaggatggagcagtgaaagtcaacccagagttctctgcctccagctccccactcagcaggtgtagctcagagacaaggccctggtggtagcagactctgggctaaaaactataaaccagacaaactgaaaaacaaagacaaaacaggggttagtaatacttctgagtctcagagggcttcctataggtcatgattagagatggaaatgaacccaaaacaagacaaggaaacagcatcacttagcacactgaggtaaaggctgggatcggaaacagggatgggggttagggtagaaattagtctgcttttttgtgtgtgcacaactatgtaagtgtgtacacgtgcatatatgcatgcatgcaagtacgtgcacatgtgtgcatgtttgtgtgttaatgtgactgtgaacatgtgtgcaaacatgcctgtgtatattgatgtgcacatgatgtacgtgtgagtatgtgtgtgtacatattattaaggacctccaacctaaatggtcctcacagacctccctttctcccactggaggacaagagtgaagttgcagagctaggattcacacagggcagtccagcagcagtctacagccttaactactactctagcattccaggtgggttctgtagcaactgatgtggcagtgctagagaaatgagataaggaagaaagggcatctttgggctgggcaggaggaagtccccagctgcattcatagaatccctggagctccaacacttggattttctattggtctgtgatgagctaaaggacaggacatggctgttttgaagagaagagtgagctggccaagggaggaatgacaggctataagagaataaaaaactgagttcctaactgcggacatcagcactaggtagagattagaaagacaggaagatagatacctctctgtctcccaactcttgcctctgacctttgcccctgaaaaacctttctccctcctccttgcccacccttatccctagtactcactggatgtcggatatcagtgataagcaggacgatgtcagacatctctaacacccgccacagctgcctccatgtctaaaaagacaggatcaggaagagaaactgaaaacagagtccctctccagcctgatcccaaaccaatttgaccataggtcactatgccccactcctgtccctagagtacactgtcacctccagattgtgctcaaagtagctgagtttctcagaggagtaagccccatgaatcttcccaagatagtcttggaagctccgttcctcttggctcattagttgctccttggacatctcatagctccaaggaggacgtcgaggaaagtccagaactgggaattcaggaaaaagtccaagtgtgaggaaatcttcaggattcaagagtacatcccagacccctccttcctcacagtcggcttttacctttccaaactccttccccagcccaatgcctgtcttgctctcactcacctgagccaggctgatacacctcccggatgtccagctccaacaactcagcactgaccggctgtagaacttgctcccgggctgctctctttctcctctctacctcctccctgctgtctctctcaaaatgcagtcggtatctaagggaacagggaccgagacatccagagcaatcctgtggccacaaactcctattttctcccctcttgtacaatcaacttcgcaaaccattctctccagagtcgttcaagtctcctctctcaagtcagacttcccccaagtccttctttcaggcaatactcagccttctccttctaaaagcccaactctctccagcccctctggaaaggaagactgtggcccgctgtggggagccgagtggctagcggagaactgtggcatcccaggcccaccgtcttcaccagtagcagcccgctttcccccaaagctctgacttccgggtaggcgggaaagccgggaccagcgccccctcccaccctcaccgatttgggtcgtagcctcgtggacccagcccctgagaaggctgctggttaagcctgcggatatgatgggtcacagactccccgtccgaggtgtcggtctgttcctctcgccgctcccggctcccgctgcggctgttggaactggagcgcagcccatcttgaagccctgcggggaggggccggtgacgccagtgctggccagctctcaggggccataagaccctctcccccatcggcctgactccctttcatcccactcaacttcttccgatgttcagtcctcccagacaccctatttgggaccctcccggatgtgcgtggggggagtcactccttcagggagcagtggggacggcgccccgtgctagctggagggattcccctcccccaactctccatccttccccaccccttccagatgtagggggggtgggggatcccctccgcgataggccgcgagggttgacgcggtcccacgaccccctcccacgatccccagaggtgcagcgggcacacccctccttccagatgtgcggaagcccgagccccgccccctcctcccgctcccgcactgacctctcttccgctcccgtttgtcctgcaactgcttcttcttctgcttcacgctgaatggcttcttcctcggcatggcccggaccagtcacctggcccgccctccgccgagctcccgccgcctcaactgactgccccccggggcagcccccgccgcaggggcccgggaccctagaggaggcggggctagcaggtgacgtcagcgggcgggcccgacagaattaccgccgcggcggcgatggaaggcggacgggggagatatagtcacttccctccaggagcgaggcgagaggatgatgcggggtgggctactggcacgtgagagccagtggcaccgagagggcgccccggcggcgaggaaggaggcgcgcgtgggaggaccaggctaactccgtcacggacgctaccaactcgcgttcggaggagggggggcgcgtgtcatcactaccttgcgctcccgggagaacctaccactcacctggagggggcggcggagcggagggcggggcctactacctaggggagagggggcgtggacacgctgaggctatactacaaagccccgggcttgaccttagtggaaagccgagactgcgtccaggttgctggactacaccgggggcacggtcagaggtctttaggggagggcggcggtctgagagtcctgggtgccgacctgttgggacccaaattccttgtgggaacgatgataaggagcaggtttacagatcataagtgcaaaagcgggcgagaagggaaacccaagcgggacaaggacttttggggggaggtcaaagggcacgaagttgtgcctgcagctgttaccatagtaaccgaggaccggatgtggcgatcttacggtgcgacagtcctcttctcaggccctctggcccgagagcctgttgactctgtgacacactctgaggagctggttgtggtgttttccagcgagggaagaaaagagtaattttttcaaagcatttatagaaacgcagcaaagggaaggtgtgaggttgccgccatgcctggcagagacggagggaggcagttggctccggaatgcggccgccgcagatgttctccgcaaccttccggaagtggaatggcgggagcctcagcattgctgcccaccgaccccccggaagcggaaacagaatccccgcgtgccccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcggtgaggggtctgggagggatgtgcacatgcctgtcaagcccgtccgggcaaggggctaggggctaataaggtgcgaaggagggggctgtaacggaaggaggaagggcgcacgcgctggggagggatggaagtggggctctcccaaatggagccttgaaccaggagttctcttactggaaccatcaacctcaatacggccccagacctttctggagaaggcgggggtggagagaataaagagctcttttgcgcagccgcagaacagtaggggaaaggggtagtagagatgttgcagattgcgatgactgggatgacagtttgtatccagactttgactgaaaaggtacaggtgcagctttctctaaactagtcctctggccagcagttaaggtgagggattggttcatgtctggagacacttaggttgttttggatagcgacggtacggtgaagaaaaaaagttgtcagtatcttttcctgcattatcccctttgattgaatatctactttttgcaaaccctgaaacagctttgcagaaaaaagggcagatagatggggtgagaactcccaagactgctgaaaatatacctgactttactggttgaattaagaaataagtaatacaagaaaaacacctaagaacagaatcatcagtcctttaatccattctgatgaccatattttcatgtctgctcttaggaccacccagccttctgggccctccccccatggccaatggaaaacctggcgaccctaagtcaggtgaggaggaaggggccctgatccttgtattaggtcgtagagaagacagcaagggaggggataaaacccaggaaggacttaaaaataaaagatcagggattccatccctaaatgaatggagagaagttgtatatttgctgatttaaaaactcaatgttgtaaaaatgtcacttcttcccaaattgataaacagatttcatgcattccaagtcagaacacccataatgtttttgtggaaatacacattattatagggaaatgcaaaatatcaaggcgactatcaagacaatcttgaagtgggagggcttactatgaatatcaagatttgtaagctgggcatggtggcacacgcctgtagtcccagttactcaggaggctgaggtgcgaggatcctttgagcccaggagtttttgaggccactctgggcaacatagtgagatcctgtctctaaatacaagaagaaaaaaagacttactataaagctacaatagttacaacgatgcagtttggaaacaatgatagacataagtcaataggacttatgtcccgaagagtccaataacaggcccatacatgtgtggacacttcatttatgatgaagatggaactgaaaagttggtcttttcaataaatgatattggatcaattggatattcatgtgaaaaaaatggaatttcaccttgcactcataatcatatacaaagatctatttcaaatggactgtagatctaagtataaaaggtaagagaataattattctagaaagtaaatgtattttctaagagtagctaagagttcttaaacagacaagaaatgcacgtatacacactaaccataaaggaaagattgataaattgaactccgttagaaaatataaatttgcggctgggtacagtggctcacgcctgtaatcccagcactttgggaggccgaggcgggcgaatcacgaggtcagcagttcaagaccagcctgaccaacatggtgaaacccctgtctctactaaaaatacaaaaattagccgggcatggtggtgtgtgcctgtaatcccagctactgaggaggctgagacaggagaatcgcttgaacctggaaggcggaggttgcagtgagctgagattgcaccactgcactccagcctgggggacagagtgagactgtctcaaaaaaaagaaaaaacaaaatacaaacttgccaaataataccattaagaaattaacaggaagccatacaatagaagatatttgcaataaatataacaaataaagatcctgtatctataatatataaagaactcttccagacaagccatttgaaaaattgacaaaaacacaggacaccttattaaaatggagatctaaatgaactaaaggtctaaatgaacaagtactcaatatcattaattgtcaagtaaatgcaagataaaaatataccactttgaaattagaactcttgtgtactgctgctgggattataaaatggtgaaactactatagaaaacaatatgaagaggttcctcttaattaaaaatagaactaccagatgacaaaaaaattaaaaatagaattaccccagaactcctgcttccaggtatatatcaaaaaaaaaaaaatggaaagcagggtcttgagatatttgcagactcatgttcatagcagcagtattcacaataacaaagaggtggaagcaacccacatgtccactgatggaaggataaatgtggcgtgtacatacaatggaatattattcagccttatgaaggaagaaagtgctgtcacatactacaacatggatgaactttgaggactttatgttaagtaaagacatagtgtattattccacttatctgaggtgtctaaagtcaaattcaggggctgggcatggtgcttcacgcctgtaatcccagcactttgggaggccaaggcaggcagatcacttgaggtcaggagttcgagaacagcctggccaatatggcaaaaccctgtctctactaaaaatagaaaaattagctgggcatggtggtgcacacctgtaatcccagctactcgggtagctgaggcatgagaattgcttgaacctgggaggcagaggttgcagtgagtcgagatcacgccactgcactccagcctggatgacagagcaagattgtcaaaacaaaaaataaaaataaagtcaacttcaaagaaacagtagaatgatggttaccagaggctgggggaaggaagctggaggaaggggagttttgtttaatgggtacagagtttcagttttgcaagataaaaaacttttggaggtcgggcatggtggctcgtgcctgtaatcccagcactttgggaggccaagtcgggcggatcatgagatcaggaattcaagaccagcctggccaatatggtaaaactccatctctactaaaaatacaaaaattagccaggcgtggtggtgggcgcctgtaatcccagctacttgggaggctgaggcaggagaatcacttgaacccaggaggcagaggttgcagtgagccaagatcgcgccactgcactccagcctgggcgacagagcgagactccatctcaaaaaacaaacaaaaacttggagatctgtttcacatcaatatgaatatatgtaacactactgaactgtacacttaaaaatagttaagatggtaatttttatgtgttttttaccacaataaaaaccgaacaaaacaaggcatgatgattcatgcctgtaatcccagcactttaggagaccaaggtgggaggatcacttgagcccaagagttcaagaccagcctgggcagtgtggcaagacccaatctctcattaaataaataataataaccaaacaaaaaaataaccaccacttttcacactcaccatggcaaaatttaaaaacctaacaattccaagtgttgtcaaggctataggacaactgctggtgagagtgcaaattggtataaccactgtgaaaaaaaagtttggcattatgtatgaaacttgagcataacatatactttataagccagtaatacctctactacgtatatattcaacagaaatgcatacgtatgtgtaacaacatgtataaaaatgtttatagtggcatttctcgttatagccccaaactggataccacccacatgtccatcatcagtagaatggataaataaattgttgtgtatgcatgcaatgggactacactgcaacgaaaatgaatgaactgctgctacaggcaacctggatgaatctcacaaacatgatgttgagcgaaaggagccagacataaaagaatgcagactgtatgattccatttttgtgaagttcaaaaacaggcaaaaactaacctatggtgtcaggatagtggttacctttggggaggagggtgggtaatgggaaaaggggcacaaggggaggatcttttgaggtgctaataaggctttatctcttcacctggtggtggaaactcaagtgtgtctactttgtgagaactgggttgtgcacttaaaactggtgtgtctttatgtatgctgttcttcaataaaaaaaatttttttaatcacggtttatcaggattcagctgcccattagacacctttctgtgtctctctctctctctctctccagctcttcacagaggtcctccaggatcaaggggaccactgattccaccactgctgagtctcccacctcctccttggggtagaggcccaattcggagagggcttggccccaggtctagcccatatggtcgtggttggtggggagtcaatgcagaacctccttttccggggccaggccatgggggtcccaccaggggaagctttcacaaggaacagagaaaccctcgaaggctcaaaagctggtctcttatcaagaatacctgcccgcccaaggatgacccccaggttatggaaggtgaggtccattttgttatgcccattactcccagagtgacctaattttcagaagatcattcacaatcttctctgggctttcctttttgcttttgaagcagaagtagacctcaatgttatttctcccaggagaaagactaccattccaaaatacctggaaatggtagggggtagaaaatcagttctccttctgtctctgcgtttcattgtatttgttttctttgttgctcaaatttttaactgttccattttcacttgttcacagacaaatccgaccgccctgtctgccgacattttgccaaaaagggccactgtcgatatgaggacctctgtgccttctaccatccaggcgtcaatggacctcctctgtgagactgtgccttcccatccaggctggaaggagctctctgtgacctagcggccatttatttctctgtagccctatgatggctactgtgaggctcttctaacaccctcagtcagtgacacacccatcccatccaccacttcccccgtgtggggtccagagtggtgttgcatcactggtgcgcggcatacgcgctttcttctgatccagcctgtagagactcgcctttgggacccatctttgcttcctttcagttgcctcctggatcttctttcccgtcatcaaatgactgctgaacaggaaacctctttggtgctgtttcttgtgcatctgtccacctgttccccagtattgccctcaattcctgagagccctggagcggtttcctaccattcccttcttttagctgcttgttttaagtcctttttatgtgacattccctacccccaatgttgtcagctgcttgtgaaactcagccaggttgtctaacctggggtcaagtttgggtgactggtgcagagttacttcctaaaaggccactctccctgcctttggatttcatagtttctctgtcagtagcatgatccccaccgctatggtctatctatgatcaccgtgctttgtgaaactgtgcatccccttgtagcctttctcagtgtccgtggcatttttgtgacttcccagcactagaataagttttcctgccaaaatgagtgaggcgcttggtgccctctggactttcccacttcccaacatgggagaattgtgaactttccatcagactgcctccctggccctccccattcttctcctgttggttattctgagtctgacacagacccatgacatgtcttataaagcctccaatggctttatcctacctagatcccttccagcccattttaattagactatgtcattgtgaggccaccagtccattcatttgaattctgtgaatctccaccttgcctatctttgggtagaagctggacagtactgttgccctcttccaatcctcttcccctacatccctggcactggttgttttctgtgaaaacagcagtgaacaggttcagttttgaactggccctgaggaaatgggtcaggagttgtattggcaagagggaggggtgagagctgttggagaactgagaatgaggttttttttttttttttctttttaactttttttatattagtaataaatgcagtggaaaccagcattttatttaatccctgtgttctagtcatctctggagttgcagatgaagctgttctcacctggtggagtcagcttattctttagttcatacacactagtgatggggaatgacaaagcttaaggttcttccaggctgaaaaaaaccaatggaggttccattagcctgtaggcatcaaccagaacaagctgccttatgttcaagggcaaagttttgtaagaaaaaggaaaggccaggtgtccgtggagttatttttaaatattttactttgcagagtttgtgtttatggagtggtaatgatgaaggagtctttcagcagcaatttgcagaatgcctgtgggccaggcaatataccaagcactagagataactgacagccaaagccaatggatttaaaatgtacagggaagacaggtttctcataatcacaaatagcatgtaaagttaaacctgtcaaaagtgctgggaagaagacagggaagaaaagagggtgaaagagagttgtgtaataaagggagtcagggtaggagatgcaactgagacaagctccaaaggataaacaggaggtggggtgggagagggaagtcaaggcaaaggtcttcgctaaaagacctaggggaagaggagctaagaaacctagggacagtgggagatgatgcagaagaaagaggagttagaccactcagggccttggaaaacatgaagatttggctcttttcttagaacagaagcctttgaagaattttagacaggagtatcatggcttaggctggcttttcaaaaaaaatcagcttgtatggagagggcccaccttggacctggaagttaattagaaggctactggctacttcagtagtacaagtgagccatgatggtgacatagacttgggtagtagagttggagaaaagtagacatttgaaaattacaggtcaaaataaaagtatcagatttctccaggtagttctggcttatgtaactgccatttaaaaagaagtcttaagatagaagtttatggctgggcgcggtggctcacgcctgtaatcccagcactttgggaggccaaggtgggtggatcacgaggtcaggagatcaagaccatcctggctaacatggtgaaaccccatctctactaaaaatagaaaaaaaattagccaggcgtggtggccggcgtctgtagtcccagctactcgggaggctgacgcaggagaatggcgtgaacccaggaggcggagcttgcagtgagccgagatcgcaccactgcactccagcatgggcgacagcgcaagactccatctcaaaaataaataaataaaaaataaaaataaaaataaataatttttaaaaagatagaagtttatttctctcacaggtcaagaggtggacaatcaacaatccaagatgtgtgacaatgccaccactacaaggtccctgagtattcagaacctcaacccccaactttcagattcacaaccacaagcttctattcactgtccaaagtgaagctctggcttcctcatccatgttcaaagcctcaggatggaggaagggctgagaacaccagttgtctgggaagaaacttctttttttttttttttttttttttgagacggagtctcagctctgtcgcccaggctggagtgcagtggcatgatcttggctcactgcaagctccgcctcccaggttcacgccattctcctgcctcagcctcccgagtagctgggactacaggcgcccaccaccatgcccagctaattttttgtgtttttagtagagatggggtttcaccgtgttagccaggatggtctcgatctcctgacctggtgatctgcttgcctcggcctcccaaagtgctgggattacaggtgtgagccaccacgcccagccggaagaaacttcttaaaagttaacttataactcctcaacttatgggcaagcatttaagttgagtttattaattctacagaggttatctccctaaaagggggctaggaatgacaggattagggtttgtgtttggtgatttcaaaagaaacaggaaattgttctggcttagatgctgtcagaaagatgactacttcttaatcttatctagaaggagggagaaatgaaatatggctaaagctgtaaggtaaaaaagccaacacattttagctgacagggaactgtgtggtgtttttgtgcttagacaagattttgaagtttgtctaatttcatcacaaacacaggatgaccttgtttgacactgattttctgtgagatagtttatgttcaacaagagtaccatggcctaactatgggcaacaggccagctcccagcaacaccaaagcctgccagttattgtcaggccagttcccaattctcagggactgtttttcttaaaagtatgcaaacatataattacaggttgagatgaatcatatgaaggaaataaatggggtactgaatagaaacagtagttggggagctactcaagacatggtggccgggcgcggtaggtcacgcctgtaatcccagtactctgggaggctgaggcgggtggatcgcctgaggtcaggaattcgagaccagcctggccaacatggtgaaaccctgtctctactaaaataacaacaactagcgaggcgtggtggtgggcatttataaataatcccagctacttgggaggctgaggcaggagaatggcttgaacccaggaagcagaggttgcagttagccgagattgcaccattgtactccaccctgggcaacagagcgagactccatatccaaaaaaaaaaaagacatggtggctaggatagacctctctgaggaatctgtagatgaagggcccagaacttagccttgaggaactctgacattgaattgctaagtgaagaaggacaaggataagccagacaaggagactaaggagggatgacggagaggcagggagagatctcagagtgtggcgtcacctggctgcttgctcagtgccaggtaccctgctaagctctttatagacattgtctttgtcttatttaagcttcacatacttttttggggggggagagggggtggttcaagcgattctcctgcctcagcctcccgagtagctggaattacaggtgcccaccaccacacccggctaattttttgtattttagtagagatggggtttcaccatgttggccaggccggtctcgaactcctgacctcaggtgatctacctgcctcggcctcccaaagtgctgggattataggcatgagccaccgcacctggccaagctttgcatactttcagtgaacactttagtgcctactgtagggcaagcactgttttaggagctggagctacatcaataaaaaggacaaaatccctgcccatatggagcttacattgctttgaggatgatagacaatatacataggtaatataattttaagtaatagtaaatgcttcaaatgaaaataaagtgaaaaaagaggttagagagtgacaggtggaagagaacaggttgatacaaagagagagctgcttt

SEQ ID NO: 283 - DNA, 91496 bp, Homo sapiens
acgagacagaaagtcaacaaggatacccaggaattgaactcagctctgcaccaagcggacctaatagacatctacagaactctccaccccaattccacagaatatacatttttttcagcaccacaccacacctattccaaaattgaccacatacttggaagtaaagctctcctcagcaaatgtaaaagaacagacattataacaaactatctctcagaccacagtgcaatcaaactagaactcaggattaagaatctcactcaaaactgctcaactacatggaaactgaacaacctgctcctgaataactactgggtacatgacgaaatgaaggcagaaataaagatgttctttgaaaccaacgagaacaaagacacaacgtaccagaatctctgggacacattcaaagcagtgtgtagagggaaatttatagcactaaatgcccacaagagaaagcaggaaagatccaaaattgacaccctaatatcacaatgaaaagaactagaaaagcaagagcaaacacattcaaaagctagcagaaggcaagaaataactaaaatcagagcagaactgaaggaaatagagacacaaaaaacccttcaaaaaattaatgagtccaggagctggttttttgaaaggatcaacaaaattgatagactgctagcaagactaataaagaaaaaaagagagaagaatcaaatagatgcaataaaaaatgataaaggggatatcaccaccgatcccacagaaatacaaactaccatcagagaatactacaaacacctctacacaaataaactggaaaatctagaagaaatggataaattcctcgacacatacactctcccaagactaaaccaggaagaagttgaatctctgaatagaccaataacaggatctgaaattgaagcaataatcaataggttaccaactaaaaagagtccaggaccagatggattcacagccgaattctaccagaggtacaaggaggaactggtaccattccttctgaaactattccaatcaatagaaaaagagggaatcctccctaactctttttatgaggccagcatcattctgataccaaagccaggcagagacacaacaaaaaaagagaattttagaccaatatccttgatgaacattgatgcaaaaatcctcaataaaatactggcaaaatgaatccagcagcacatcaaaaagcttattcaccatgttcaccatgatcaagtgggcttcatccctgggatgcaaggctggttcaatatacacaaatcaataaatgtaatccagcatacaaacaaagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattctatatctagaaaaccccattgtctcagcccaaaatctccttaagctgataagcaacttcagcaaagtctcaggatacaaaatcaatgtacaaaaatcacaagcatccttatataccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaaatggccatactgcccaaggtaatttacagattcaatgccatccccatcaagctaccaatgactttcttcacagaattggaaaaaactactttaaagttcatatggaaccaaaaaagagcccacatcgccaagtcaatcctaagccaaaagaacaaagctgggggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagcttacaccttatacaaaaatcaattcaagatggattaaagacttaaacattagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaagagaaactaccaccagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcaaaggacatgaacagacacttcgcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaatatcatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgatattggaaatcatcattgtcagtaaactatcacaagaacaaaaaaccaaacactgcatattctcactcataggtgggaattgaacaatgagatcacatggacacaggaaggggaatatcacactctggggactgttgtggggtgggaggaggggggagggatagcatcgggagatatacctaatgctagatgacgagttagtgggtgcagtgcaccagcatggcacatgtatacatatgtaacctgcacaatgtgcacatgtaccctagaacttaaagtataataaaaaaaagtcataatcacaagattattttaatcagagaaaattattaaaattttatttcctaaaataagttgatggccaaaagcttttgaatggctttctaaatgattttctctacttgggaagttaaactgactaatgattgtgtgtctgtttctgatgttcattaatcacaggtaaattagtagacacctcaggttctgtttaattaataaatcatctctgcaattgtgcatcttgaacttcaaaatagcacttgttgaatctggggaagcattcaagattcctctgtaaatgaatcttactttttgtttaatgcttaatttaaaatactttttgatatgtaaaaaacttgtcatgaagatgttaaccaaatttatttgtggaaagctattatgtgaaaataattgattatggacattaaccaattgtatgacatcagctatgacatgtattttgagggccgttgacctcgatttttgttcttgagattttttgtgtgtgtgtgtgtgacgaagttttgctcgtcacccaggctggagtgcaatgatgcgatctcggctcaccgcaacctccacctccagggttcaagcgattctcctgcctcagactcccgggtagctgggattacaggcatgtgccaccacgcccggctaattttttgtatttttagtagagacggggtttctccatgttggtcaggctggtctcaaactcccaacttcaggtgatctgcccgcctcggcctcccaaagtgctgggattacaggcgtgagccaccgcgcccatcctcttcagattttttaatgctggccttgaattggttttcccgttttcttctctctgttttgattcccttcattctttagtgtttggtctctgtggaacaagagttgttcattctgactatcccagaccttgcatcagccctcccatggcttgatgttcctgttgttttcttgagctctcgagtgatccgttcttgagtgagctatgactttgtctctttcgtgcttttccctagtatttgaatccttttaattaaggtgtttattggaaaggatactttaatagtactttttgtttttgtaacgcaagtttattatgctaatgctttcaaaccaatgtgttcaatagagatgaaaaaagaaaactaattcctccataagcatgtttatttttttttcctcacctaagacaaagctaatgctctaaaaggttgtgagtctccttacttatgtctttacccttggacaaggtaaaacaagttataatggagggtgttgtgggtgtgactgatgtttattagtccctagcaaattagtagatgttttgtctcctgatacctctggctttgattcatgtttgctcactacagaggggcctcatggactttcaggatggcactcattcatcggagaaagcattggagattagtacataaatctgttgtatttattttatcatttgtttggtttaaaacatacttttcctgagggataaaacgtcctcccttttttctgtgttctaattggcatcagcttccgtgtatttcaaggcagctgcttagtgaggaagcgcagggggcgctgaagtccaaacacaccctcgcctgctccctgactcctccacaatagaagagagcaatgaccagtagttggaggcactttacttttttataaaataaactaatgtaaacccagctttggacacattgaataatgaccctttttcaggctccaaatgaactgtctgtttaaacagctggatatgtcagggaaaaaaatcaagttttaacttttattagatctctcctgtttagttcacaccaactatatgtgtctgtcatgatgagagtgctttatacagggtgtgagtgagtagttacctttcttcctgctggaacattggagaggaccggggcccagtggctgagagctaaggtcagagttaggcagagctaggtctgaaggccacttcttccacttagccccaagcctcagtttcccctctgtgaaacaaggataataatactatatacgtcacactcacgggactataagaggccacctatggagaataattagctgggtgcttgatgcaaaacaagcatcaaccaacaatagccacaatgatatagttaccatgtttttcagtttgagttcccaggtggataccactgatattagataacactgatattacacaccactggtatctgtagataccactgtggttagctaacagtgaatgtagacacgacagtgcttcatcaggtagacatcagacttggaacatgcctccatctttctccaaccagaacccctgcgagggggaaacagagcaagttaaaatactgcaaagctttgcatttagaaaccggaaaacagatgcacagagcagtctgcctctgtgtaaatgcacattgtaatcagttttctaacgctgcctttacaaggatgagttaagtggttcgttgacatatcattatcacattctgaagataaacagccacaggatctatgaactctcatcaggcagttaattattcttgaatttttctgcactcttgaaacatattctatttatttaaccgtcccctgggagccctggtcgcctttgtccctgccacacggccagtggtgtaaaacctctgcatctgtcagatttctccatgtggagcgtaattgcctgatttccatttgaaagtacagccctgacattaaaatgacatagacccaccaatgataacaatggcttcctgacacctaccagaggagagggggcgagggggcataatgcaggaataaataagtgcatgaatgaacgctcgccttcacggggccaggtctgaatttacagctgcagatgaagtgttccttgggagcaaacaaaaagaaagaatgaaagaataaaagaaaaagaaaccaatagattagcatccgcgtgagtctgttggagccagatggctctctgtggagagcgagctggcctgctttctcccagtaaccctgaccagcagacagcaagcccgctacacggggagagaaatgatctcattcctcagccgggcacgtgagccgccttctttctctcacacacaactcgagctgaaggggagttggaaaagagagaaagggtgaaaaagaaagggcgggggagaacgggtgattgtaaagaacaagcaggtcctcgtagcccagaggaagagtgagactccaggccttggccagccctgagcgtccaagaactgtctccagatgtccacgaaggagaagacagggagacagaggggacacccgacacattgttgtctcctccacacacatccgtgaacttcacctccacgatccaatgttgcctggaaggcttgatgtggagaggctgagaggaggggcgcaggctgctgtagaggccatgggattaagttctgtgccccactggaaaggggcagtgaacaatgttttcaattcttcctaatgacaatgtctgcctgtctctgtgggccacaggcgaatgagtctgtcagtcctcagcctgcaggaccagccatctgctgggatcctggtctgccatgctcctgaacaggtgcctgagatggaggcagctggagtaagggggcagtcaaatgaaactgacaggttgtaggtgtgggagggctcctatccttgaagattctgaggctgagaggggcttggtctggggtcattctgcctgctctgctgagcaaagcattcactgcttgtaaacaagtctgttgtctggagtgacagccacacgtgggggttggtggacatcagacagaccaccagatgctggtgttagagcctagcacttgcagatgtgtgcagaggtgcaggcctccttcaagtgaatctgccctcttagtgagtgttcacacacccagcttggtaccagggctcctgaggcctccaacccagagaagcagactaagagagaatgaaggtgcccgtgcgagtgagtgctgggggctcacagagcacttcatcagcctggctaggttgcttgggcacctgaagcttgtctccagcagtgtttactcaaaagaataaatagtttccagggtgacaccaaatgcggggagatgtagtcattcctttaaagctggaaactattattttactcctaataaatattgagcaaaattctcttcattttcagcccaggatgagagcacctgcttcacaattcctggcagttgtcggtacaaatgaacattaagctggcatattctatcagggccaaggaagcaaagcaagctgccagctgggggctaaaaccacaggctctggcttttcttctttctaaaaatgaaacagaaagccaccaccccaccaactgttttgctctttatctcccaggcaatgctaccacataacagggttcctcgttctgtatgggattctcactcacagcagagctaaggatttcaaaggaaaccgtatcactaaagtaacaagagcgtgagctccaacatcgttccttgcctccacttaagcagggagatcagtcactcaataggagcatttaagaaaattttaaaatgctagcatttaaggagcacttaccaaagtgtcggccctgcctctaagcgttttgtggacatctcaggtaatcttcatgacaaccctatgcagcaggttctctgattacccttattttacaaataggatgccaagtcccagagatgttaagcaactttgccaaagttgcacagctagtcccgggtccataccaccaggctttcccacctcttttgatggtgtaataactgagctttaggctccctattttggctgctcaccagtggtgccatcttgggctactaagtctccctgagttcccatttccttgtctgtcaagtaaggactggaatagtggtcttatagggttgctgtcaggagcagaagtaatgtgtaacatacatgcatgcagggccagtgcccggcacatgtttgaggctccataaatgttagtacagatggtcccctgatggtttgatttaacagtttttcaactctacagtgggtttgttgggaagtaatcctgtcgtgtgtcaaggagcatctgagttaagctagtttgatttacagtttcaactttaccatgggtttatcaggatataaacattttatcaggatataaacctgatgcatttttgtattttcagcttacaatgggtttatctggacagaaccctcatcgtaagtggaggagcatctgtggttattactactgtaagcattgtcattatctttgtgctcttagatttcactgaattctcacacgcacacatgcacacataaaactatgaggtaggtggggcagctgtcactaaccccattttatagctggtgtatcaggtggtaaagcttgggcaagaacccccatctcttgactctgcactttgtctaatctgagcttgctgtttcccgctggactgcaggtcacacctgtccatttctagacaccaaacacagttgctgtctagaaagattgcagcaaggaattcaacccttgtcactttccctttgtctccaggccctgggattggctgaagacagagccaggtcctgcctgtgccctcctgggaattgctgagacagttaatgcctcttgggacaagtaaggtactagcttaaatggatcacaagctcctgtgtgcccttaagattttcgttaatgtctaggtcaaaaaaaatacttattttcttatcatcacgaaatgcagatgcatagccccatctcatgcctcgcttctcctagttgggatagcctctgagaacatttccaacactcttctttgcagaaggtattctgcacctacagctggaagcaggagacgaaccggccaaaggtgtcttggctgtgctctgccttctttccttagctttcctaactctgcctttccggtgattttcatgttttccctttcattttacattcagaaaatctctggggaatgcagcttttgttctgttgcttcacgtaattcccagggcagggaatgaaaattatttgctttcacaacttctggctgagtgcctttcacagcctggctgtgttctggggtgatttataaactgcagagcctgggtctctttcctcctccttttcctcctcctcctcccccccctccccctccccctccgccttcccctcctcctccctttctccttcccaccaccctttaaaacaaggtgagcctccagagtcagggtgtcagccactggggctcttgttcaggcaaaggttcagtggaaccatagtgatgagagcttgaagccattcattcctgttagaagaagacagaaataggcctcaaggccgaacttacgtctctgagaacaaatttgacccaaaatctcaaagtttagggttggctttgaactaagaatataaaagcacattttccaaacttgtcaggattgtgtttcatttctagacttttattctcaaagggatgatgaggaagagacacggcttaagaagttttgagctgagaaatgaaaagaagtcacttttctttgctgccacagaactaagtagggggaaaattaagcccaggggttcatttaacctgttacaacaaaacacagaaaccagacggcaaagtgtcatttgcaaggtgatgtgtctttgtcggagctgaaggctgtcgccggtcggctgtctccatggagtccccatctggccctgcactccccacagggatgatttcatcaggagctgaaagaacacagaggggtgagcaagtgatcgagcctcagactgtctgtctgggccagaccctggggaacacgtgtggacactacgggcctccttttctactcagtgtgatcctggacaggaagaattcttcacagccaaggccaaacagcccggacagaccactgccttgtggctatatgagttctttgaactgccctgtgccatctttttggtcatacccacatctttgcttctgcataactcacacaatagcaccaagtctccttgtcttctggcctgtggctgtctgtgacttctgagcagcagacacggaggctgaaggtcagagccagcattgccactacttgacctgtaaccctggatgagttactgaagctctctgggcctcagttttcctcatatgaaaaatggagaaataacacctgccttccagggttgttatgatcattaaactagatgatttataccaagtgagtcacgcaatgccccatagagcacaaactcaaagatgccaattagtatttctaagcatgggagggagccctgggagaaggccctggagaaaaaccgcctccgggactgtgagccaaggcaagagagagagtgggatcagagaaggaatgggatagaggccgggtggaggacactgaatctatctcctcccgcgttccctgcagtttcatttggaagggcagcgtctgagattttaaagtcatatatcattgccatttccttttttaaaaatataaatcattgtcccagagatattcaagttcagaaaggcgcatgtattaggtctgaggctcacgtacatctagtattatagaaagcgggaaatcaagaggggctcctgtcttcggccttctcttcccaaaataatggatgacttttttttttcactattagaggctgttagcactcagacttcatcctgaacctggattagtgatcggttttgttttaagatcctaagagcacaaacaatgagacagaaacaggctccattcgctaatgcactgctcattgaggaatgtcagtgatgacatacatgtggaaaatttggggctaccagacctctccccagtctcatctcagtctcaggcccagaatgaggtgaaaattggagagagggccctggagcagagaaagggggattcctgggacatgtagggccatgtcactgaggcaacttccagcaatgatttacaggaagcgtttagctcatgcatatattggggccaatctgaaaaggaatcaaggttcatgaaactctcaactgtgacattttatagggtatggcgcaaccagagttagctaagtacagatatcattagctatatgttcatttgattgctattacatattctctctctctgacacacacatacacacacacacacacacgcacacacacacgactgaattatattcagcagtattttatgctctttggaaactgttacttattcagatacaggatgttttgtttttgctttttgctgattctctactaattttattattcccaatactctctttcattttgaattatggagtttattgcagtattgtattttttgagatgtaaaaactattataattagaactaaatttttcaaaaatggaaacatgcaggttaaatgataaaaatagtgtatttgtgaaatttgggttccgttttgttttgtcatcatagcaaatagagaaaaaatgagttgattacagatggaagtgtaatttttttctgttgagaagacctggtcatctgcctccacatccatcaccacccaacagcactacaaagagcagctgaactctcccccaatactcctctgtgccccagtttctccagatgtaaaacaacaccacacaacacatctgtctccccctcaactcaaagaaatgttataagaatctttgagagaaaaaaatatccacaaaagtgttgtgatcccagaacttatttgttttgtatgtttgtaattgtatgaaaagtggaggtcactctagtgaaaatgaaaactgagctggaaagggctggaattgctaaaatgagcagaaatacggtaaaggaaaccattccctgtacccagcagctgtcaggctgtgttcatgatctgctcttgcttcctgagagcaccatgatttctttgtaaccaaaaggaataatctattttctggcctaacctctcataaggtattttggagtaagctcaacactaggaaacaatattttacagatatcttcgtctcctctttattcaacactctaattttttccccttgcaatttctcttctcagaaatgtagcttttcagcgttgattcatctctcctgcctcatagcacatttttctctcttctagcctgaccatttttcatttctctcacttgtatcttaactggatcttccatctcctccacttctactcctatttcctttaaattcattttcttctttcccttttctctccctaaagagtgaacagagaacagacagaaaggacaatcagctaggactgtgctgagaaaatgaactgaaacagcacagtgaaagttggacaagccaaacctgactccatcaatttgggttgatgcctctgacaattcaaacaagacttggtcagcgcagaactgcaaggctgtcttggaattttcacacatatatgtttgacattctactccaattcagttccacaatccagatgctggaagaattttgtttacttgagatggattctcgtccatcatctttcgctcccacaaaaccattgttcacaacccccaaggactgcctatgagtaccatcattttgttacagttaatgctcattgttgtgcacagttgggaaatgtagccttctggttaattacattttccaattaatagaaattacaaggtacatcttccatgtgttgctgacatctagacacctgggatactctaagcaccaaagctaacttgaacaagtttagtctttcttggaaaatttagaggaaacttcaggactcatggaacatcaagggtaccaaagtgtgttgtagatgtgggtagtataagataattgggattttcatttggtacaatgtaaaagtggtttgggggtatgtaatagcacaagtcacatgggaaataagggtaccatgtgaagcacattatatctttttaaaattatcctcctcagtattattaagtgtttaaatgttcaaaggaaagaaattcatgccctgccagattacaaaacagtatatacatgacaattccatttttgtaagaaaaagcatgtctgtatacacatatacacagcctcccatataaaagtcagggaagatatgacccatattttaatagtagtctctctgaatgatgtaattataggtgctttggttttcttcttttggtttatccatacttattaaaaattaaatatttcttctataatacaaataaacaaatagtctttaattggaaaaatcacatagctcagtattaaaatcagcacagaaatctatctcaatgtagatcaagaacagattaaatgaaaagaatggttgcagaagaaatcttcccatttggaaaacacctatcatgtgagattgtcaaacacaaacttggaggctggggagttgggggtggtagtggctgcagcgatagcagcatggaatgtgaggaaatgctgttgccttggggaatagaggtgggatgtggatcatcacctgttatcacaggcaggctctatgaatcatacacgatatgatatggggttacaagaaggattcttacaattgccattaagataatcacttcatagcatttctgcatctgtttctaaccttctaaacagaataagatatggaagaccacatcttggtttcaacactgattctccacgactggggtggagggtttggcctgagcctgaaatcaggcactcagtcttctccagggccctgcaccaccacggcttcaccccattcaccgcttcaccccattcaccgcttcaccccatcctggtccttgacagcacagggcttgtgccaccgtcccacctctctccccaccctggactggcctttgctctgtgtggtctccacttgtgcagagccctgtaccgctcccacttgcttccatctcagttttcccagcgttcaccctcatcctagaggaagagcaggggatgtgtgaacagacaaaagagacacaaattccaaaaatgaaattttaggggaaattctaccagtgagtgtatacttctaccctagcgatacaaagagtgcagtggcatttccaggatgagggaaggggtggctgttctaggatcacactgcctggttgcctctttccatccatgaacaaaagaggccatgccgtgcaggaaataaattcccagcttccagaagtccccacattttccagagaccagagcagatccttgcctattcttgtttctgctgttgcatgcaccttgtctaagaggttttccaaatcccagtgtgtgtttcagcatcacttgtgcacactgtcatgctggagcgccctgcacaaggctgggagcctgacttcccatgtggattcctctgtcccatttgtctgaagctcttcgcacacaacagatcgtatttaaaaaaaaaaaaacaaacctctgcagtacctcttacagttttgtgttaagacccatatatttgttaagcgaatgaatgcccaagtgactcagcagtccgcacacctgacactctgctgttttcaggtgctacatactatctcatctatttctcaaagcaaccctgtgaagaaggcccgccattacccctgccttcaggatgagaaaaatgtcttgaagaggacttgcccgaagtaacacacaggtcgctgactgccaggacctggaattctgatttcagtctattgccctttccatcacgatggtgatccccaagccagttggctcatcagaatcccctataaagttggttaacgaaccagtcacagccctactgcagacttgccaaatccctctcaggtgaggctcagccgtctatactatgaacaggttgttccacagatggtctggctgccctcccacccatgccgcctgtgctgaccagctctgatttgacatctggtcgatgctatcaagggtgtcaacacaaaacttcaaggctagccctgacactgaaaatcctatgttcctccattagtcacctccttgtgtgtgaagagttcatttatacctcccaggatcctccttctgtaggagctaggttaacggctcaacttctagaaaacccaaggttaaaaatagctgtgacactcattagccccaagggggaaaggtcagcaaagtttgacagccacacttaggaaggactgagagaggctgcagaaagggctcggagctgagaacagggacccagccttccttagaagcctggctccaaaccagctgggccccccctaattggccacgtctgggaaaggtgctcgtatagtcacgactctgtaaagcaaggggcaagggccctggtaattaagtgaccacaaacccatccaataattactcatcagggagactgcaaatggtggaaaagttcttcctgtttggaagagtgagtgaaatttggagggaatcagcaacccaacccctccagcagcagaccgctaaagtctaacctcatcaggagagagaccctcaccactcaagttctccagaggaacaattaggagttgcttgagaagtcccccaagctgacttaacctgccatgaacccagcaagcagacgccctctgactgtgatttataaggaaggggtcgcctccagagaggggcctgggctgcttgcctaagtgctgtgtgcaggtcagcctggaaaccattattgtcatcaacaggaggatcagttaggagacaagttgaagcaagttgaaatttgaaaaacacattaacagcggcctgacgagatgccagaagagtctgccagcagggacagctggaaggccaatttctgagtcaatactgaaaggtggttgcttaaatatctgagtcaacacacactgatttctctccggctcaatactcccgtttaattgcactagggagtctctccactgacaaatctaacaccaagatatatagttaagtgaaagaaaagcatgttattgaagtgcaaatgaggtcctccatgcagcctgcaggcctgggtcccgctgagcgctccctactgccctggcagaaggtggttgggccttgcagggactccctgtggccccctttttaaagagggtcgagatacgcgtgagccccaggcctcagctggccagcagagagaagtctaggtgcgctgcagctgcacaggctaccaagactctgagatactttgtcaggatccacggtcctctccggggagagggggccaggagtgcccgtttcccacccaagagggccaagtcagatggaatggtgtgccactgaagagccatcatgtttggcagccaggtgaccacctggtgagattggtggcagagatgatgaacgaagcaagtcttgaacgtccacccagctgcctggagcctgagaagcaggttggtctctgaggagtcctgacaggtcatggctactgatgcagacacttccccatcgcgatgcccacataggggccgggcaggatggcccaggggtagtgacgaggctgggggctcccacagtgaccctctggcagccttcactgacttcagagctaagcatgatataggagacctagctagacctgaaaacccatgagaaccgggacccgaaccacagtgaagaggcagctcccatgagcaggtggcatgagtcctccactgctaaattctatgtctgctgccaactgtcaaagatgaggaagaagcccatgtcagtggtaaacccaaactcaaattactggggcacattgtgaaagggcagtttctggttcagtacgtctcggtgtgggtagctttgggtccagtggcactcctggtgcacaccagtctgtcatgaacccacagtgtgggagtgcttcctcattaatacacctgctaatcacaccgaacaatcagagatctgttcagatggggcccagaggatctgagagacaaatggctgggccattgtcaacccaagcagttcaagtgcagtggccaccacttagggaaactatggaattgtcttggtctgatgctcaaaatgaactcacacggacgtgatctgccctagacaaacaagtctgaaatgaagatcaaatgctatttcttccacttactagttgtgggaccttatataactgttgtgtaaataagataatgtgggtaaaatgcctggcacaaagtagttgccaaaaaaatgccagttcaccgctcgagtttccccccaaaactgaggtggcctcaatttttccttctctagttcagtgttgctttttgtccaggaaagccacagttagaagaggtgctgtgaaatttctatctctcacctctaagcaagacatccagccctgctggtccctgtggcaggacctccccatctcccacgcagcagaagtttgaaaaattaatttactcatcttcctggagcataaagagttttttagaccttcccttctgaactgtttatggaaccgccatttaggaattcaaatggcagagccgttctccctctgaaggtctccgggagccccagcgcctcctcacctaccccttatttcatgctcatgcttttttgcacgttgataagcagtctcaaggccaagactgtcccaggccccgacacacctgtctgatttcatccctatgtctcccttcctcttgcagccctttccaggcacactggtcttcttgtctcctgtgaacttgccaaggctgtttctgccttgggcacagcgctgcctggaagcccctacccaggtagccacatggggtttcttccttcatccaagtctcagctgaaatgctgctccctctcagaagacttcactggccctctactgagttttatttttttcttaacattcatcactaccccaatgatcttatttgtttagttacatgttaattgtctgtttccctctactaaaccacaagctgcccaaaggcaggaatctcatgtgtttagttcagtgagcattgcagatcccaggacagtgactagatgctttgtccattcctgcagcagcaacagttttccaaggaacactatcaaatggacctatgagtgttataattctatcctgtaatacgttggacaactattcagggttttgggcactgccagaaacatgcaactccaggaaggagaggagtggggacgggagggaaatgcctccaggcaatggcaaaaactttgctttgagcttctcatgtcccagaatgcaaatgtccatctgaccccaggatcagagtgagagaagttttgctctgtctcctctcacctgaaatgaacaggaggctgctattcattccctcaacctcaggttctaggatcaagctagagggaagcctttgggcatcagggcagtgccaatgccaagggctcaagcaacactcaactttagagatattgtctaataaagataacgagagctagactttttatatggattattaagctgttctaactcatcacatggatcatttcatttgtcttaagaaattgtctcagtgaccagagatggtttttagaaaatgcatgagatgtgatcccctctatactgtggccgtgccgcttttaactccacacggatcacctagcatgagggttctagaaaaagatgggggagctgctgctacaggggttcatgttgtccacccatccctggttcttcattattcctttgtgactccatactcaaaaaccaagccttgtcagtcctgagaatggctctggctctgagggagctgaatgactgccaaggccgtccagaataagcatgaattaagcaaaccctcctgtccctacgaccctcaggacaaagtggagaagagagtaactgggctactctgcggaagtgtcaatgccctgaggtctctgtaaagcaccagatagtgcaggaagaggaagtctcagctctccttagcaagacaaggcaagctactgagggccacgctgtccagagaaactttgttttgtggatgcacagaaagtaatacgtttttctggtattagagattcttttggaagcgagtatagatggccctgccggaatgagagcccttgggacacctgggataggggtgctcaaaacaacagtttattcaaaatacagcaagcaagtcagtagcgtcctgccccgggacaccaaactccacctgtgctatcccttcccggctctttctcactgcctatgaagtgacctctgaagtgtccgattgtctttatgagcaatgcaaggctggaagtattttagaccaggcctgctgcactcaccgtctgcatctgctgcgtttctgtcggggatcagctgctgactgtcggcatagctcatgacggcagcagttctcctgtcttcatttccctgagcacttgcttctgcaaaaaaccgtgagaggaaggaaaagtgaggacggttgcatgagtgggcttcatggctgccgaagtgggagactttttttggatgcctctgaacatcggctgcccctggcaggtttcccacaggtgcccatcatgtgaaggactggatggaagttccagctgttggatgtcgtggtagggaggctgaaggacatttaacgtgtttcatgtactcattacctagaacgaggaaatgcactgtcttgagaacgaagtggaggagaggaggctcatttgaggaagagctctcctggacactatcctttcttgtttctgtcaccttctgggtctttttgtgctagggtggagtggggcacaagaaagaccctgcagggccctttcttctgcattgctttggtcttagacatagttcttaatgctgactgcacactagaatcactgaagtgccctcgctgctgctcctccctaagtaacccccccaaaaaagtcgtgtgtgtcccatgggagataatctgagggaatagacccatgtgaaaagagtatcagtgaacataacagtgtttccatgcccctcccccatcactgtctttgagaggctctatcttgcctcatggagatgtcagtggtcactgggagaaaacaccctggaccccggaagttaatggggttccttaggaagcagtatctgcatgaggtctcccctgagagttcctggccttcctgctagagcccccatgctgcagatgaaggcaggcagggagagacagactcaccctcccccagagcctggtggctgaggctcacagcaggaaatccaaggctgctggggaaagggagaggggactgggaaatgcacagaagcatgaaaagggttgggatccttccttcctgggaccacatatatgtttgtgcagttttctctacatggaggcacctggccaaggggttcagggtgaggactgacctcagtccacacagaggttgccattttcctctatgataagccatgtctgggggctgtcgaccccatagcccacaaaggggtccttgttcttaatttgcacagagacactgactggggcctcgggggatgggggctgctatcccctgccctcctttcacacctaccctccctcctctttctcaggctccattctgagggctcccagttgaggcacccttcctcactttctactcagggttgcttttccctagctcagaactgaaagtgggtttgattctactgactcagaccttgctccggaatactgtttctctaagaagtgtgggaaccctcagtgaacgagtgggagagagcagtgtggggttacagccaggcacagctgagacccatctgccctgtcctgtgccaaagcctccagccctgccttcccctctccaatgatcacgtgatatgatgccccctccccactttactttgttcatttcttgacaacgaagaagagaaaagggggggatgtttgtttgccttctctctagaaaccctctgtactgtggggctggcatgatggtgggtgggagggagtgggagatagcagtggatgaggtgcccagagcctggaaattctggggctaaaacctctaatgaggactgctcctcgtccttattaccaaagttatttcttgttttttatttagatatttgtatctcagtgtctacaacagtaaaatgtggcctaaaccaactatagctcacagggatactacagtgagctgatattagaatgaaagcattatgacaacaattttaaaaattcttcaaataatccatcttttctttgggatagccccacttttaaaaatagtcatcataatccacatgtcccaaagagacatactgcgtgtaatagctgtgtaaataaggaacctctggactttgagattccccttgtgggcctctggagtggctaaagattagctcctgtcagaaggaattcattcccttcttggaggttcagaaaggcttgcctcctattaccaggtttccccttcaggtcagcacttctgtcttagccaggctgtggctaagggaccctgagtgtgtgggactgatcagccttgcagctgatggagagctcgccattggattccagcttctttttgggggtaccatgagccaaacagtaatccctggtccagcttagtactgggtttttttaccctaaactcccaccctcttgtcattcctggagctgggtgagtcacaaattttgtccctcatcccagttttggaagctagaacaaaatgtgaaaaaggttccagcacgcgagggaagcctgtgctggagcctctgaggctgtggagcagaggaagcactcacaaatcattccccagctaccagagagctgcatgggaaacgcccagagaagaaccttgaagactaatgtatgtagaactcttcagctggatctatcggcccagctcaaagaacgtcataataaccaggatgcaagagaagagtgttcagggcaagatggttgaactgagccctggagcttggtggtgggcaaggatgctttctgtgttgaccctgcaaataataaacatatctgaagtggttagtggaaaaactactcaacactaatgacaaagcttctcttttttgcttacccttgtgatcaactggggttttagatctccccatgatctcatcctctgtggcattcaagttctggatcaaaaagtatgtggtcattctccctttacctttcacttcaatttcacccctctcaatgattttaaacccttgatttttcaaggctctgcacagagaaaaaaagtgcatcagatatcaaagattgtgggtctgtaactcaagagttggctacaatgcaaagggctactcaagaggaaaagtccaggacacaggacacacaacagcaggggagggaagatcccagacatctgcctgctgaagcaggacagaggccgtggggaaagtgaggatgagatattctgaacaggatgccaaaggccaaaagagaacacagggacccatcaaaaccctcccaaccctgccaccaattttcctccctccagctcaaccctcatatgggcatctctcacgtttctacacaccatgctgtcagtgcccatgtggacaccacctttcatgtttctgccacgtaagactcttgggtatcaacactcttctttccatcttccccaagtgcaccatataccccatgcttgctactatgctcatcctaactacccaagctttctccaccacaatttctgtctgccaaggaactgaagaggaggactatagggaagggaccatgaaaagagacagagctatggggtaattacaaaacgtttccctgtttatttatttactagccaccaagtgatgttagagaaaagccaaagaaccactcagaccaatgaggattcaaattcatgaccacctgcctcggcactccatcgagccttcccttgcccttggccaggttggtagagagttcagaccttcaccacagtcctcatgggcctccatttggcatctgctcccctcactcatacgctggtggctgtgcctcctactttatgccctgattcatctacaaaattacattgattacaggtgagagcctgtgacttctcaccccatgaccacaccatcctgtcccccaatctccgaggatgaggtatatttcttgtccagggtctcctcaccctcacccccttcccaccacctctgggccttgctccattggccaccccacgcttatcttcatctcccattccatttgcctttctccttctgcttttcagtgtgcttatgtctcttccatcctaaacagaaacaaacaaaacagcctctcacctgctttaatctcatgcaaactttctcctctttttattcttcagcccaacgtctatcccaccattctactacaaccacttttgagaatgtccccaaaacctctagtgagtatttttcagtccttattactacatttgacatttttgttcaattcttccttcctaaagtcatccacaagagtgcttctcaccctcaactctcctggtcctttctgagtatttcttctcctgtctcttccctgggctcctcttccttctgtgccacttaaatattggttctgcacaggattccattcttttcccactgttctttgcacactgcatccttccctgggttgatctcatcaactctcatgactgttattaccacctatatgttgcttactccaagtctggatcttcaataactcaactccatccattttatggcacctctagctgaatgttccacagttcctttgaacccagcgtgtccaacctaaactcattgtctgcccctatgatctgggatacttctcatttgtcccattgcagatggccaggccaccattcaagccctagtcacccagaatggagacccgggctccccccttcttctcatcccccatttctaactactttagctggttttattttcccccatattcccaccactaatgttctgattcagaccaaactcctaacaggtctcatctgtctcattttctggttctcaaatatgccctttcagggtctctagagtggtcagtgtcaaataggaccctgaccctgtcactgtcttcaacctcacattcgttgggggcttttcctcacctacggcatagggctcttgcccttcagtaaggcatgtgcagctctcactgctcctgcctcatattttccaatacagaaaacctcgggtgtttatagttctctgcacctattctacatgtgagcctctacccactttttactcccaataccccaattttggctaaattttactctggaactccttgctcaagattcagctcaggaatctcctccatgaagcccttttttactgggtcaagcacccttgccctgggctctcatgacacccccggtgactaccttgaggataagagtgcagcagttaaaggggggacactgaactctgactccgtgggctgcatctgggctattctccttcctagcctacctggtcctgaggcaaatgattaacctttttgtgccttttctttcatgtaaataataataataatgtatcttcacagagctgttgcaactgtaaatgaattaacatataaaagaatttagaatagaatgtggcctattttaagtgctcaagaaactataagtattgttttatgcacatatttgtcattgtacttatctcactttaaaaataatcaactacaacttttcttttttcttctgctagaccaaaggtcagcacgctttttatataaataaagaccagatagtaaatattttagactttgtgtatcatatggtctttgttgcagtgattcaactctgcctttgtagcatgacatcagccatagactatatgtaaatgaaagtgcatggctgtgttccaataaaactttatttacaaaaatgagcagcagactagatttggtctgtggggttatactttgctgttccctgaactaaactatatgctccttgacagtaaaaactatgctacagttagaagctcaactaaatttattatctgccacaatatcttctgtaagccattgagacatggaaggaaaaacatgagtttcctgcactaccccaacccatggctgctaggcactctgtaagttctagaaagaggaagggacaaaggaaggcatgaataaatggaaggctacctgtaggctgtgggactgaggtgcactttgttgggaagcccatgactttccatcctagaagctgtgttcacagtgtcaccaaacaagcagtaccgtggcatcttgtctcctacaacatctgctaagactggtccagtatggatccccactctgagctgtacagagacagcatcactgaaaagagaccatctaatactcttgattttatttgtaagttgagatataatttacataaaataaaaaaagatattaaagtgtttggctccatgagttttgacaagtgcttatatccctgtaaccaccacccaaaataaaatgtaaactagttccattaccttgcaaaattatcttgtgccccttctagttaagctctctccccatcttcttcagcagagataactacattctcatttcttctttttttttttttttttttttttgagatggagtttcactcttgttgcccaggctggagtgcagtgtgatctcagctcactgcaacctccgcctcctgggttcaagcgattctcctgcctcagcctccagagtagctgagattacaggtgcccccccgccaccacacccgactaatttttgtatttttattagagacagggtttcaccatgttggccagctggccaagctggtctcgaactccggaactcaggcgatccacctgcctcagcctcccaaagtgctgggataataggcatgagccactgcgcctggccttttttatttcttttaccaaagaatgatttgcctgttccagaacatcacatatgtacaatcttatagtatatactgttttatatctggtttcatttactcaacataatgtttttgagattcatctatattgtcttacatatcagtagttatttttatcactgaatagcattctattgttagaatacaccacattcattatccagtctccttttcatgaacatttagattatttttcagtttgaatctattaaaattaaggctgctataaacattcctgtacagatatttttgtagacatgttttcctttctcttaagtaaatacctagaagtggaatttctgagtcccaaggtagatacagatttaattttattttttaacaaaacaagccaaaaaactacccagcaattctccaaagttgttttactgttttacatttctatcagcgacgtgacactttcagttgttcccattttcaccatcatttggtcttctcgtgggtgtgaaatgatatctcactgtggttttaatttgcgttaaattggtgactaatgatgttaggcacactgtcacacacacattggccattcatatattttcttttgtaaaaaagtctgttcaattttttgcctgttttaaaaattgagctgtttgtcttttattgttaatgtgtatgaattgtacacatatttggatatgtaatatgtatgtattacaaatatttttatcagtctgtgggtttgtgtatttattttctttaataagcagaatgttttaattttgatgaatgtattcatctgcttaggctgccatagcaaaataccacaggctgtgtagcttaaacaatggaaattatttctcacaattctggagcctggaaggccaagatcaagctgtgggcagggttggtttctcctgaggcctctctgcttggcttgtagatgtccacctttttgctgtgtcctcacgtggtccttcctctgtgcacatgcattcttagtgtctctttacgtccaaatttcatatttttataaggacatcaggcacgttggatgagggcttactcttaaggtttcattttactcagtaaagcctctagctccaaagacagtcatgttctgaggtagtgagtactagagtttcaaaataagaattttgggcaagacacaattcagcctgtaacaatgaagtttatcatttttttcccttcatggtcagtgttttttgtgtcctatctaaaaaaaaaaaaatcattgttttccccaaagtcatgatgctattctttatttccatcaagaagctttgtgattctagattttatgtttcgatttgtgatatatatcaaatgattttttttgtatatggggtaaggtagaactgaggtacattttttctttccacatgatattcaatggtaacagaatcattttttaaaaagaggttgccttccccactcaattatttggtgccttggtcaaaaatcaatggactaaacatggagtctatgtctggacactctgtgctgctccagtggtctctttgtctattcttctcccaatctcactctgttttttttttactgttgctttagaataagtcttaaaattagttgtgtacatcctccaattttgttattttctaagagtgttcgggttagtctagattctttacatttccatataaattttaaaatcagcttgtgaatattttctaagaagcttgcagggattttgattggtattctacggaatctatacatcaatttggggaaaatggacagcttaaatatattgagttttccaaagaatacggtatatctctctatttaattaggtcctctttaatttccctaagcaataccttatagttttaagcatagaggtcatatgtatcttttgttagatttactcctagaaatttaattaagtttattttctttttatttcattttcaattttttgtccttaacatataaaaatttaattaattttcctgtatttatgctatgaccttgctaaactcatttattagatcttgtagtttcctgtagtttgtataagagtttctaggtgcaccattatttgttctgtgaataatgataattttatttcttcattcatttccaaacttaatgtcttatatttcttcttcttgccttagttcactgggtagagtttttggtatgctttaactagaagtggttgtctttgtatttattctgcttgggtttgctgagctctggatgtgtgcattgatatccttcatgttgaaaaattctcaactattatctcttcaaatatttcttcttacccattctcactctgttctcattctagcatttcagttacatatatgggagtccatttgatattgtcctacagatatagagtgtcttgttcccctttttaaccctgttttcttctttgcatttcagtttgggtgatttctatttctctgtcttcaaattccctgatttttttctctattgtgtctagtcttcgttgagcccataaaattaattctttatttctgatttctgatatcatagttttctgttagatatagatatagatgtaaatatagacagtatgtacgtatttcccatatcttcacacttgttttgccccttttcttatagaccctttaaaatatttatcacactaattttaaagatccaacatctaggctatttctggacctgcttctattgactattttctctattggctatccactatattactattttcttgttgcttcttgcatctcatatttttcattatctaattgaatgacccatattgtgtgtgaaaatacagtagagactgaagtagataatatttatccaccagaaaatgttacatccctacagaattaggctgctggaatgggcagtaagtaaatctaatccatatttgagttgggtcagggcttttccagaaatattggtagattccatgcaccactggtttcaaatattatgaaggctgaatcagaactttcagtacagcagagcttagaatctgagcaccagcaagactctgaggaccttgaatgctgtacagccaatccacagcttttggagttgtaggagatctcctcctgcattacagcccaacagtgagattttcagaagtctctttgctcttcagtcccaccctggctctctgcaccttgggaaaattttctctgccattcctccttgccctcatacttcaaaaggtcatcgtagtgtacttggtgaagacgaagagtacttcagttggatttctctcagttctcttactctaacattagcctttaatgggccactgctttgcatttgggaaaggccccaaacacctcagggactcgggagttctctcagctctcctctcctgtcctagtttttggctgactaatcccctgcacttggcctatgaggaagagttggtagatgggtacagactctgtggctgggactctttggcattctaacctgttgtttcagccctgtgaccattaaaagtccactaaaatttagacgggattatccctaccctcacctctggtggattacttcttctgctgccctgccaggattgaatgcaattatgggtgtcttctctttgaaaggtttgtcacttcctggaatttagtttattttgattcctttgctttctggtgggggaaaaaaaactgctagcatgggaacaacagtctcttacagctttctacatcctaatcagattgcttgttgtttttacttgctagattttcttctgcttgaaataaaattataatttctctaggaaaacaggattctctgaacccttcaaagcacctagtaatactgtctcatacatggatggatctcagtaaatgtatattaaagctatatgaataaaataatagaatatctcagtgcaaaataattgcacaattctgttaagagagaaagtgtttccagttctctcccctacatccttgaataaacccatatgatatgctgtttctggtggatatttaatgatgctcctaattatgtccatagtcttaccttggaattgctaacatcctttcctatttttttcttggtaaatccaccttgagagtttccaacaattcattgtctaatttcattcttattggtgtagcattattttcatctctggcgctatgcccctttcatacacacatgcacacacacacacacgcacacacacacacacgcacactatgctttccatttttatttttatttttcaccagtgacttacacaagcatcctttaactgaaacatttatctcttatctaaccttcttatatctcttccctcattgcctctcatcctgattttttatttattacattggatttttattccactgatgcacactgtgtttacaatgagtcattatggcagctatcttgttcttgtgactatctaaggccagcttttacttagaagactacagtggatgctgtagccatgatctgcactgtttctcagcttctaactcaccatggtcagagtgagtgcagcagattttcagaatctcctgtaaaaagttataatgtggaaaaatcatattccatcttataattggctttgtttattttgaattgactagtttattttaaatttctgactgatattagcagaggaaggacctagaaatcaaaggcagagagacgccactctcagccatcccaggagcattaggatctgctgagccagcggaggaggacattcatttttcacctccaaaactgttcaacttttagagtgtgaacaaacttccagacttggaagcgtacttttctgtgagaaaggcgagcagatgtctcgctagtggccacttggtggaaggaaagccattctgaatatcttacggcatcacggtgcctggcctgctgactgcaggcagcctcacacctcagcctgagttctgaacctgtcagatggcatgttggagacacaatttcctaagcaggaaaagttggctgctcattaaacctgaaccacttgttgaaatgcttgaacataaaagcaggaattataaatgagctggtgtttaagatggattgagccctgctaggtaaataggaagaactgctcagcactgtcctgaattaccaacaaaggaagcttgcagtcaatcgtaggaaaaccttgagcaccgcagcctcctctgaaatttgagaaaagttgagactataggagccttaggaatatctctattagggacatatgcaagagaagaaaagggctaggatacattacccattttaatgacagcaacttacccagtaatcacctaagcacataagcagaattctacttttgtgtgtgagatgtttggcattaagccaagtactcagttgctctctacctggatgggttctccagtaacaggattcgtcacttcctttgcagaaattctcatccccaaggcaaaattagccactctttgagcatggtttccaataggcactggtacacctcctaccaccatataagcatctcctattgtttctacctgtcagggaaaaaaaaataggtattcagagggattccttcatgcactaaacatgtcactacactttttttcattttccatatatagacaaagggactatactaaagctggtaattgattctttgctaagggtatgaggagcatgagggaggaggtgagaaagaaaaggactcaggaaacaaccatgagagagccaaaaggcctttctgcttttggtggaaacaaatcccagaaaagacgaagctcctggggtagtcatgtgatgctatatatgagataacacattgtttagattcgattttctgctgaatttaggagtaggagaactacactctatgaaaacacctgacatctaggtgcccctcaagggcaccagagtgccatcttagcactgagcattgtaaaaagaatttctaaaaactagaattcctaaaatacttccaattccctttcagcttttattctgaccccacactcatccacaccaaaccccagaccagtgcagacagaggcaaagggagacttagaatcaagcactcgccctgcgtgagcacaccgtgaaacaccccacactgcacagacacttactttatagactgcgtgcacactggttaatctgtcaaacttggagtacatggaattcagcacgttcactatttgtataggttcacaggcagtacagatgttagtaaatgtcactacatcgctgaaaagaatcgtgcagcttttaaattctcctacaacagaaaccaggtatcagtgagaaacaaggagatcgactaataagtccatgaattctggattaagaggccctgtgagaatcaaacctgccctgtgccttgtgggaaaagtagctggatgccattccccattcagcatcacccagcacacgtttactgagtgcccgctgcaagctagtcgtagtaggagaatcatatcacagggggcaagcagaccaggccctcgcccccaaggagcccccagtctaatgaaggagacataaaagtgaacaaatccttccagtaaaatgtgaccagtgctgtgggaggacagaaagggcccctagcaagtgggccaagcagagcctgagctacaggagacctggggacagggctgacagagactggtcactgtgaagtgatgggtccctgtctttgaatggcaggaaacctaccttgtcctgaacacttgctcctaaatcatgcccctgattccaccttggcccccattcatgctaacttccacatagcagccagatgccctgtttaagtcagatctcccattcttcaatctcaaatctttcatgacttccatcacacttagaatgcaacccaaagtcctgaccatggcttacagaggggaccccccacctctgtccctgccacctctctgaccccatgtccctccggctccctccactctggccacactggcctcatggggtttctccagcatgccaagtgcctcctgccttcaggcttctacacttaaaaaaagaggtgtttcctctgcctgacacttttctcaaatatctacagggcctgttactcacatttcaaatgtaaccaactcagtgagaactctcctgaccaccctgtataaaatagcccctagactggctatccttttagcttgattgccttccacccactccatacatttgacattatatgtatatacatatatatatatatatttttttttttttttttttttgagatagagtctcactctgtcacccaggctagagtgcagtggcatgatctcggctcactgcaacctccacctctttggttcaagcatttctcctgcctcagcctcccgagtagctgggactacaggcacacgccgccatgcctggctaattttttgtagttttagtagagacagggtttcaccgtgttgtccaggctggtctcgaactcctgagcagaggcaatctgcccacccagcctcccaaagtgctggtattacaggcgtaagccaccatgcccggcctgatattttgtatggaatggtttatttggttattgtctaccaccccattggaatacaaagctccatgagacgggagactgtcagtttagatctctgccatatcccaagcacctaaagcagggcctggcacatagtaaatgctcaataaatattgagtgagtgaatcaatgactccttgaatgcagccgggtgccttctttgttagttaagcctctgatggtaatttcccctttgtggaactttcccttctccttggcttctggcctatcatcctctcttcatattcctcctacctttctgatctccttgttttatatctttccttggcttctcaaccttcttaagcactagatgttccctaaagagtaatactccactctcttctcacttcctgtcctctaggtgatcttatccaccattcagagtctatgattaaccccgcccacattgcaataactcccagatgtatagctccatgccacaatgttcctatgagctctcactaagattcctaccactgatcatgctgtgtggagtatcccacagacatctccagctcaatggttctaaaatggaccttatcattctcccccaaccctgctcttctttctggccctgtcttaggataaagcatcccatttttccatgcgagaagcctcagacccatgcctgcctccgctgtcttaccttccccatctggtcagtgaggaaatcctgctgattcttcctcaggctgccctaattcaggcctctaccatcaatcagctgcgcccttatggtctttcagcaccccctcatgcattcattacactgcagccaaaatcggatttataaaactcatcctgtcacttccataataagagaagaaacttcaatgaattctcactgcctacaaaagacaatttccttttccctaatagtccaaattcatcactgcatcacctgaaccccaccctacccactcagcgtcaccagaccccacttttccacataccccacgctctgggaacatgccccatggtattcgtttgcacattgccttaactttgactcttactagcccattctccaaaaatgcctttttcctctttgcttgctgaaattcagcctcaaggcccaactcaagtgtcacacacttttgagaggtacctccacaactccaacccacccccctatctcttatctcctgacatctatttattattaatttccctgtccccatgttgccatagcaccttgtgtgatggaaagagtatggattttggagttagatggccttaacgcagttagtttccacctctttcatttatcagctgcgctgaatgtcaatttgctcagcaatatggtatggacaacacctccttcatagaaatgttgagaaaatttaatgaaactgcacatgtaaaatgtctaacatggatcctggcacaataattgctccttaatgcaaattagtttcttttcctttggtcatttccacccccattaatttattctgcatatatctatcaaactcatgaggctgtaaactcctctgtgtccccagatctggaacagcaccctggcacagagtaagttcaccaggcgtgtctggtgaatgaacacaatcccatgacaaacggaaagtgagttcagggtaaacacagcatccctgcctccataaatagtatactgtcccagaatggtcctcagaggaaccctatgatttaactagtgtgcgagtgtattatttctagttaaagttaagaaccctactcattgtcactgagtaatgaggccagtctcaggacatatccttaaattcttagagaatttaatgtgtgtgtagttgacaaccatttttatataattcatgtttcactcctgtattatttttattattattattattaatgtagagagaacaaagctgagaatatgcaggtggagtaattaccccaagatcatgccacttacaagtgacagagccagaattcaaaaccacttctgtctggcttcaaagcctgtggccctgaccactaagacataccacgctctgctcagaggacgctgtggaggagagggtgccttacctgcagccacctttttgccctccctcagctggttggccacgtgtttgggcagcatggcataaagtaaggtctctgttttcttcttttcaatggccaagtgcttggagaggacctgtagctcctccttcttcctttccagctggttggacagctctatctcagccagccgctgctggttcaggaggatgagatccctggtggtgtcgttgggggcgatgtcagaaagatgcatattgagttcttccagctcttgcaggctgcggagcttcggagagcacaggtacaccatgcaccacatggactccatccagatcatctggccttgccatcatggagagaaatgcaacagtagagtatgtcaccagtagggactgagacgagctcgctggacaaccaatcatctcccacactgtgtgcttctagttactgcacagtcacgctctttctcttttacccaaggtctgtgagaccttacttatctcccctctgtccctagcagctgtgtccattgcctacattgaagtggctcccatctatcaatggcctccatgctaccgatgccaacacaagttccttggccttttctttactcagcctttctgctgtttgatgatgttaaccagacccttcttcccgaaatctcacttcctaggacttctctgacactgctttctctctgagatgtcccctaattctttgaatttttacttacattattttaatctcattccttaaatgttagtgttcctgagggttttgtcttggtattctcatttagcatcacacaactgcatcctacaccacgctgactgcatctgaatttccagagaaaccttgcttcctgaactcaatatgtgtatttctttaaaaatagatatgtttgttatgttattgtaaaagcagtacacattcattgcagaaaacaaaaaaagtgaaagaaaatagtaaaaatcacccataatcataccacatggataattactgttaatattttgtagtatatctttgttttacaaaaaaacagggattacatggcatcttcttttcataatctgaatttttcacttaaaatatataacatattctttcatagtattaaatatagatattcatcttaatttttgctggttaccttgctcatactgtcttttattaaataataagctagtattgattatattttatctagcttatcattgtataaacaacattgtgatgaataagcttgaggcagtctttgtgtataatcatggctagttagtttgttaaaaagatatattcttagacacgggttacttagacaaagaatatcctcatttttaaggcttttgatacgtattgccaaaatacactctaggatgattctgacaattaatacctccaggaacagtgtttttttttcttctgttctccctattaggtatctgttcatggatatctgcactgaactcaacttcgatcccctccacaaatcttctctttctattagttctttcattacatatgtagttagtccctgcgatgagctaggcacactgttttaagcattgaggatacagcagtgactcaaactggcaaaaatccctgcctcaaggacattacattatgtctttttttcagttaattgcaccttcatcacccagttacccaatcaaggaagctaataattatcctaacgattctcttccaccccccacatccagtcaccaagtcctgccttaattatcttgtgagtctatcctccaattgccactccagtgccactgccagagtttagcactttagagtttctttcctggactccagaagcagcctctgtctggcctcccaggatccattttctctacactgtgacccatccttcacacacctccagagtgatcattctaaacatcaaatctgatcatggcagacacttcagcatgtttccagctgcatgatagagttcaagtcctcatcttgccagcctcctctcccatcactccactctacacctcactcgggttcccagaacatgtcattctccccttggacatcccccgagttctgcctgtgcttatccctggaataactaaacatccctctaatagaaagatagctcagaatgtgtgccctttcaaggcatatgcaaaaatttgctcaaaaggaatcaaagacctaaatgtaagagctaaaacataaactcttaaaagaaaacatagaagaaaagtttcacaacatcagatttggcaacaatttcttggatatggcaccaaaatcactggcaacaaaaaagaaaatagataaattggatttcatcaaaattaaaatcttttgtgcatgaaaggacacaaccaacagtgaaaaggtaacatacagaatatatttgcagattatatatctgataagaggttaatattcagaatgtacaagaaattcctacaactcaactgcaaaagcaaacaactcaattaaaaatggacagaagacttgaatagacatttttctgaagaataagtagaaatggccattaaccacatgaaaagatgctcaatatcactaatcattagagaaatacaaatcaaaaccacaatgagataccacttcacacccattaagatggctactattttttaaaaagcagataataagtgttcatgaggatggtggagaaattggaacacttgtccattgatgtccatgatgggaatgtaacatagagcagccactatgaaaatcagtatggaagttcctaattttaataaattaaaaatagaattaccatataatccagcaatgccacttctggatatatattccaaataaatgatggcagggactcaaagagatttgtacacccacatttgtagcagtattattcacaatagcaaagtggtggaagaaatccaactgtccattgatgggtgaatggatacagaaaatgttgtatattcatacagtggaatattattcagccttaaaaaggcaggaaattctgacacatgctacaatatggatgaactttaaagacattatgctaatcgaaataggccagtcacaaaaggacaggtactgtattattccacttatatgaggtatctagacttgtcaaattcataggaacagaaggtagaatgctggttactggggaattgaggaaggacaaatgaattattgtttaataggcagagtttcagttttgcacaatataaaaaagttctggaaatggatggtagtgaaggtacaacatacaacgtgtgaatgtgcttaataccaatgaactgtacatttaaaaattattaaaatggtaaattttgttatgtaaattttactacaattaaaaacaaaatgtgggccctactaatagtgagttagatgatcatgttgctacataaaatacagacattaatttaataccaatagcacctcatgcattctgaaaattttggtaacatatcagaattttataattacataatgtatatacttgtataattatgtatgtaactatattacatacatagtttacgtctaagccagagatggttgaggaaataaaatatattctttacagatcaagtcaagtggaaacgtcagaaaaaagaaaacgtgttctcaacgtagcccctaccctactttttaggaaattggaaaactgcctcttccctttcggatcaatctctcaaacaggtggggagcaacaggaaaggagtgagtgattaccttgaagtttgagtgtagtccgactttgccatgctacaggcatcatttctcttcgtgtcttcaggacaaattgactgttgataaatctgcggatgctgaaaatgttgaaggtaacttgaggatgaatgatggagaaatactcatccagttgaatattctgggtttggagtcctggtacgtacttctgaatgttcactctggcttgcttcacctgtagctatccacagaggacagatataagctgaggaatagaaagcaacctcccttcccataaacttccccttggaaataacattctagccatgttctgtggctcactatcgggaaagggggtcagtaatggaatcaacatcatggaagtaataaatttttttgaaacaatcaaatctgtgctaatgtctgaaagagaaaagaataatacgagagtgctcagaggcttatttccgactaaagagaaatgaggttacagctctctgttgggctaatagttcctccttgctctctgagacaactctctctctcactctctctatcatttactaatgaagaaactagcaaattctatagcattggatctatcacccaggcctgggtgaagaaatccatcaagggggtgggggaatacctttcactgctatctccagtgaacacacagaaggaagaagtaaaataggtgtcctttaaatgagttcctaatcaattcagttgacatatattttatccatagaaatggattaacaatcaaacttaaatagttatgctcacaactcttacagagcagtggcttgagttggcatgaccccttccccatgttcaagaggcagaatgtgaagctgggtgggatggagacatacatggtggtcacaaggatgggaagagttcatgggtagaattccaccctattgttgctactgactgtgttctgctgtctctttatgtagtgaattttagtgtcacttccttttccccttttttctaatggtaaactttcccatgcattcactagttcaaacctccctttctaccctatcaagaagatcctgcataatggattctggaggataccacaatatgaaaagcaaatcaatggtcctgccaggataaagcctagtctcccaagccctgggaatttctcagggacttgaaaatctccactgttcatgaaggactgtaaatcatgctcacttccctggcttagccccaattctaagctacagagggaagagtctcttactgattcatcgaatacaatgtggaaaggaaaagcgttgcagaatgtcttctcttcaatccagagtctctcaggataaattggctcaaaggtgttcatgagatgccctggacatagaaaaaggaagtgctgatgagaagcagctcccgcctccacccttgcacagagcagagctcgggatagggatagtatcttaagtgtttcacaagcaaagtgcaatctcacttcttttgcatggactccctcagcatctccagatggccacagcaattcttcttccaaattaaaacaaacagaaaacttgctaccaggttgagaagccctcctgccccctgccaagtttctgcctgccgctgaagagtttctgggccaattgagtatgtctcgccatgaacacagagtcggcattgaaatggtgacagccagacaatgagctagcagagcagagcgtgtgctccgggcccagcatcagggacatttgccatggagctttttagactgacagttttgggtggcacgtgaaaatttaaccaacagtcctatttggcagggggtagagattcgaaatggagcctttttgatatgaaaatctcctagacaaaggatgtcaattgcgtgtttgactcacttgccatggcttgaaggacgcaaaatgcagccctttgagccctgcagaccttctcccagatgcgtgtcacctggcccattgagtcgtgacgcagagcaccctaactcccttctcccaatggatcagagcccttattcagactcaggcgttaggtgctaatcgttagacgggctcagtgcccacaggggtaccttagcaagcctaatgcctgcattttgcaaatgagaagatggagactcttgtccagggtcacacagctccttaggcacagagccagaaacttgctttcttggctcttgatctagtgtcctttgcttgggcgactagggttgttatccacagatctccagtccagaaatgtgtccaaatggagaaggcctgactgcagaagacgagctgtggaaaattcattgttcctgatggcacatcagtgctcatcttccttctctccacccatcacctgttgggagtgattccaattgtgtctccaaaaactttttcttaggacaggggagatgatgtctccatgtcacccggcacaaataatgagaggcaatggaaggacaattagagcctgacattttaaagttaaaaaccatggtcaccaaatccaagctttgcagaaactagtgccaacacaatcacagagggcttggccctgtcagtgtacactggccactactcctgagaatcaagcaatctttctgatctcagagctgagcttgggagaatcactcacttaccttttccaaacatgactatgcttctcacaacatcccagtgggattttttcacaggacaagcagagacattcaaatatttctccttcatcttgaggaaagctgcctggagggcctgcaggtggcagggagacaggtacctggtcacatgactggagaagcacaaaccccatttgctgtgatggggtccacctttaaataaggaactgtatccatggccagaggaacagcatgagggcttacaagatcacttctaccaagactttagcgttcccggtattttttaatcaaattagtcctcatgctgtttctctatcaaagaaagcaataactttttagaaaatctcaagagggaactaggatgatatctggcaagaaaatcatgcacgaacatttcttcctgtggttgaagattctgcagtgaacagactctgagatggactttgaaaatactctaaggaatcagagactaatcctaatctgggtattttcacaagctatgtgcatggagagctgttcagctaacatacatggtaacttaagcaggtaatgatcaccctatcagttgcaactggggtggccaagtacagagtcttgagttgactcaggacctatgactggttccagctgcagaagtgggcactgaagactggaaagatcaatttatttgaggaggattgaaaaaaaaaagccatcaaattcaaatttcaaatccttcatatggttattgttataggtgaaaaattgtccaggctcaggtgcatcccagaatgcttcccagtatatatccacttaaccttaacccagcaattctcaactgggaatgattttatccattacccccactacgcagacacttggcaatgccaggagacatttctttttctttcttttttgtttggccacaaatgaggggatgaggttctactagtaggaaaagaccagggctgctgctaagcacactatgacgtgaaagacaccccatcaacaccaaagaattatctggttcaaaatgtcagcagtgccaaaactgagaaactctgccttaattccactattagaaggtccagttggtctcccatccaagcactaaccaggaccaaccctgcttaacttccgagatcagtcacgttcagggtggtatagccgcagacactcgtaagtgggaggtgaacagtgagaacacatggacacagggagaggagaatcacacgccggggcctgtcagggggcagggggcaaggagagggagagcattaggacaaatacctaatgcatgtggggcttaaaacctagttgataggtacagcaaaccaccatgacacatgcatacctatgtaacacacctacacattcaaaacatgtaacccagaacttaaaggaaaacgtaaaaaacaaaaacaaaaacaaaaaggtccagttgattctgttgtttgcatagatttttccaagactcgtagctctacttaagtgcaactgttctttctaaaggcacagcaaacccagtacctcttggtctctctccatgccctgactgtcttgtaacctttttggctttgtctttctcatcttcctgtgagccttctgtacaatcagaaacacaacatgctccttcttccctgtcctctccacttcttcattcatgtcaagaatgtccatgattacatcaatatcaaagaagtctttggccacagcctcaatgatacctgcagcagaaggacacctattgtcgagggatggccgaaggcaactttatcagcaaaaatcataaaataatcaaatggcaaaacttctgatgaatattctgaagttcaccaagcccaggccctgcttcaaatcagacatcagtgacagccaattaaataaaaatatgcagagactgaagttatacatgtttggataccaaatatatccatgccactttaatttctagtttggcatctattcatttgtttgttatttcaggtaggcatttaactcattaaacaaacaaataaacctagagataatgtaagcaaaattcagttgtaaaagcattaaggatcaagttcaaaaaagtgttcccctgggaatctatcccagggttatatacaaaatatagggaaagagccaggcacggtggctcatgcctgtaatcccagcactttgggaggctgaggcaggcagatcacaaggtcaggagatcgagacgatcctggctaacacagtgaaaccctgtctctactaaaaatacaaaaaattagtaaggtgtggtggtgggcacctgtagtcccagctacttgggaggctgaggcaggagaatggcatgaacccgggaggcagagcttgcagtgagccaagatcgcgccactgtactgcagcctgggcaatagagcgagactccatctcaaaaaaaaaaaagaaaaaaatatataaatggaaagcatgtatgaagatgttcatgatagcactgtttacaaaagcaaacgattagtatcaatggaaaatttaataataggggattagttaagataattacaatatggaatatcattcggccacttaatatgtggttttaaagattatgtggaaacatgctttttctacaatgctaaatgcaaataaaaagctgatacaaaataatatacgcagaattatcacaactatgtaaaagcctgtatgatttaaaatgttgaaagaaaagtacaaattactcatttttgtggaattttggaaacttattttaaaagctcaaggacattgggagcagtggtcaagatgatatgaagtcacacattctaagagttttaacttcttacccgtagccagttattagccatcctggagaatctatggggaaaccttcctcacttcagaagccccatagctctgcggccagctaagccatttccatacctggtacaatgtggcacagaccacttctatccgagtagtaatggagaaacattttcccatctgctcctctctccacacgaaacgatggtgcattcatctcctaattaaaagacacacatttttcccagtggacacaaattgtgtaaattatgcttttgacgctttgtgaaacaatagtatttacccattacatcatacagagctatatgccaaccctctctccaatcacatagaaactcccactgtttctgctcctgtatgtcaggaattttatactatacctactgtactttaaacaactctatatggcaagtactagttccatttgaagaggaagaaactgaggctcagggaaggcaaacctaggttaatggtagaacaacatttgattcccaaatgagcctttgcaccgtgccatgctgtttctacccatattccaaaagcagctgtctgctggtaacaggaagccttagtgagtttccgccgcgcttggcctgtgaccaagtgaccatgggcatcttcactttccaacacatcagggaatcagagaatttgcaagtagaattaatcaatgtcttgttctgaaaggataatgtcttctgtgatatcaatttgaacatttagaaagtagaaccttccaccgggcgtggtggctcgtgcctgtaatcccagcactctgggaggcgaggcgggcggatcacgaggtcagaagatagagaccatcctggctaacacggtgaaaccccgtctctactaaaaatacgaaaaaattagccgggcatagtggcacatgcctgtagtcccagctacttgggaggctgaggcaggagaatcgcttgaacccaggaggccgatgttgccataagccgagatggcgccactgcactccagactgggcgacagagcgatctcaaaaaaaaaaaaaaaagtagaaccttcaaggatacatcagaagagatcctcccctttctccagaaatgttgacattcaagtacctatcatttcacagtaaatgagatgtatactaggaaagaaggatagagattttgcctaggggagtctctagctagttagagggcaactcagcaccctggacacacagcttttggtccaagtgagggaataggtaaaggagatgggttccttccaagatctttgtcgtcttccatggtgaaatgttgttagttaaaatgggtttcttttttttccccaaatacttttttatttttattttttttaattttttatttatttttatttttttgagatagagtcatgctctgttgcccaggctggaatgcagtggcacggtaacggctcactgcagcctctgcctcctaggctcaaatgatcttcccacctcaggcttctgagtagctgggattacagtcacgccacctccatgcccagctacttttttttttttgtattgtttgtggaaatgtggctttgctgtgttgcccaggctggtctcaaactcccgggcataaatgatcttgtccacctcggcttccaaaagtgctaagattacaggcatgagccaccacgcccagccctcaaatactatttttttctaattccaaaagtatgtacctagagaaagtacatatatttatctgtatgtatgtgtgtttacatcttgacaaaatgtaaagagtagttgaggcagcacatataaaaagcataaataaaataggaaattaacagttaatttaaaaattatatccaaatcctacatagtgaaaataaagtaacagaatacagaggcctgaaagaaagtccacgtgatcctgcttcatgcccctcactccttaccccctgcccagagacacttccaaaagttcatgcttttagttcttctggtcaatgtcactaagtctctaaataatataattacacttttatttcttgcttcaaatagggctttttaaaagtggagaattagggcaaagaataacagaataaaaaaaatgcttttgcctaaagagacaatctataatactttgcccagaataaagcactatatagctgttaggtatcattacagaacagaatagaaagcccagaaataaggctgtacacctaaagccacgtgatctttgacaaagttcttattattccaaagaataatgagaacagcacagggcaggatctttggagacaggtgtgggtttgggtccagctcagccaccatgcctgggtgatttggggacagttacttgaactttctggacctcagttttctcatccgtataacaggaaaaataagactgcctactcttatggcatcaagaaggtaagtcaatgttgacacattacttagcccaacacctgcctcataattagcactcaatgaagtttggccaaagcataacaagattaaaggctcagttataaccagaaatgtataccttaaaggcactgccaaattactagatagacacaaaaaaagtgaacattatcttactttgttatttttgcctaaagagacaatctataatactttgcccagaataaagcactatatagctgttaggtatcattgcatgtattttcttccaacttgtatattataatatttaaatattttatttacctcattatgtgcaaaatgtcctcaaataccaccagataagttctattctattgcttctctagcatcacttataagtgagagctaaatattgaatacacatagacataaagatggcaacaacagacaccgggaactactagaggagggaggaagggatagggtcgagggttgaaaaactattgggtactatgctcactacctgggtgttagcgtcaatcataccccaaacctcagcatcatgcaatagacccatgtaaaaaacctgcatatgtaccctctgaatcttttttaaaaaattgaaattataaaaaagcaaaggaaaaagatcataggataaaaaatatatgtgttataaaaaaatattaaaagggcctaactctatttctttatatcctaattgttgtgctttagctaagaaattgaaaggaagttgtcatgcaaattatcgttaattcttaaactggccatattgaacagagagaaaagaaaggggaaggaatagagttattatttatttatggaaagctgatttttctgggctgattgcaatgctagacttttccatcttatctcttgtaatccacatattgctatgaggtaagttatcttttccctatttattcctttttgtctctgtttgtgtccaataccttaaaaagtacttgatacatagtatcactcaataaatattagttacccaataaatattattaaataaaataaattgagattcagagacggcaactaacttgtccaggatcgcacagctgttaagtggtagagccagtgggacagtctcatgggcccatctgaccccataagcagggctgtttccactccctctacccttgagtagttcacatgataacaataggacaggcccagctattcatgcccaactattcatgattcataattgaagtcagttaaggcttccaagcctctgattccttatatgaaaaatggagaaaataatacttttcccatttatcgtctatgggggggtgtaagggttgctgaggctttttaacatccacaatcccattttgtccccatgacaaccctgaaagggtggatatgaacaccaatatagaaatggtgaaggaagatctcggtgaaatatataaggccttaaaattaaactatgttctctaaagcaataaactattattatgatatgtataaatgctctttcaccttttcttgtctaaaaaataaaagagaatctaggcatttgaatttccagtgatctctacaaacaagaaacccaaggaaagaactccagaaggatatatcccagtagggaaattagtttcctaacacctcagtcagtcacccatgggttaatcagagttggatggtttccgattctggctcttagccctgtcaagtcttcccttctgatacatgaataacatgaatctggctgcatatgcaatttatcagctccatcctggccaggaaaccttaggagagcttttgcaaatgcactgaaacctgactgttttccagcctttgttccaattgtaatgagtctccaggatttaattccaaatcaacaccacaccctatctgaaaaggccatcccttcggtttttgtgagccagtttataaaagtggccagcaggtgtttctttttcattctcttccaaaaagaactcctgagcccaccaacaccaggtaccaaggattctgcagatgggagggttctcctgcaaccgtgcctctgttgggggaggcggggagctggcccaggactgccacagcatttgcttcctcttgggcagccaagaccagactcaagtggccttacctgataagagagtgccaggtaactgtggagggcatccaggttttcaataaactccatgagatttcctcccagtgtccgtagcatcctgtcatagccagacatcttcagaattgaaagtattctccaaagagtttcaggatggcttccatggagacacctgtagaaaccaaagcataccccctaaataaaatctcctggaggtgtgtgttgtcctttgtgtggtcttcatttatttccaaagggttcacatcctggctgtgtgacactatcgagctactctctaagccgtcacttgcctcctcggtaaaatgccaataaccacattgatgtcatgggcccttgggaggagccccgtgcagcctggcactgagtaggtgcttgtgaaacataagtctccttgacaaatacttcctcaaagtcgagaaggggatgcagagatgctgtacccgcttagctgctgaagccagtgcccagaacaagcttcactctgggtggggagggcgcgaccctccacgaacactgccaacacctcccacatctttaaatgtaacagtcagtctctaacaagaatacaaggatgcctctgagaaataactaatacacaatgaaaaaactatgccttcaaggctacaggatcctgatttaccaaaaagatgataccaaatacttgcagtgtctttccctttctctcctgacctccctgtgaggcccagtgttcctgttccattctccataaagatttctctgaattctctcttcctaagtgttgcatttttttttcttcctaattcatggtaattctggagagaagcaacccgatcctacacgttttctgtgctaaacacagcataggtgcctgatgaacacctggaggtagatttgcggcattagttggagctgctgcccacctccccgctccccagtctacactgttggaatagacagtaagcaagtgtccactttatgggaaagacagcaaacattttaaaagaatgttttatagttctgacaacacacattaattactgttctgttactcaatgtttgcccagctcttataaggtagctaaccttattatcatgtcctttttacagctgagcctgttggggctgagtcatctttgtgaattgactgcagtcacatagagttgcagaggccagatttgttgaagaggctccaactctaagtttagcactttttataccacatcccccagcctctgaagcagcaatgagagaagcaaggagtctccccaagggaagcgctgcttatgcgttggcatcattgacacaggagacagggcatccatccatgctgctggtctggagatcctgtgagaaacaccctcttatttacaatggggctgtgacacatgtaagtcctgggggctggggcaaatgtctgtaatgcccaggtttatggaaggcctgaagagctcaccatcaccagtatctgtggttgcatccttgaaaaactctgtgatgctctggctggatttggaattcacagcaagggacattccaggtctcatgagctatccagggctaaatcctacagaggacagacgaaggaggtctgggcactctccagcccctgcttgcttcctaggatggtctgaagagcagtttccctacagctcatagtccacagccagaccatggggcagataattgttctgtaatctgagcaggatagagtccccactgaattggtctagttttgtcagagatgagttgtacatattttccaagatgagttatacatattttccaaaaattgattagtcggatctcaatctagacgaagcttgggatggtagagaagccagtggtaatggcctgtgttaattgcctccgttggcttctttgcttgtgggtgcatcctggccggcctcaggcaggcttgtctatacactggtataaattcaaggaccacctgctaacccctaggggatctgagacaaattctaccaagttcctttccagtgcttgagtctctgggagggggactgctaaaaggtaaacagacagatgggaaattgtccttctgctctcctgcttccatccctctgttacctctgatctagcttattcagactaagaaaaaacagctgtgctgtgcatcctggaggctggagctctgagcaggtgcatcctgttacctgccaggaaaagcaggggtcccagcggccccccttctcccaagaacctctgccaggaggactgggctgcgtgtaagccaagcaaagttatattcaagtaagagtggcagctttgggtaaaagactgcctgtttgactttcaaatctttaaacttaaaaaatccatgaagctgtttgttccaggctctggttattttgtttgtggatgcccagctctgttaaaaggaaaggacatctggctgagagatgaactgtttcccaaacaaggatcttgggtttgagtgtggtgttttccacctgtaatgggtttggagcttcttctagaattcttagttgagaatgcttgtccagcagggaataaaggccgcttttttaaaaaaatcagcacctgttttagtcttttatacagtttcacatcagtgtatttaagattccaagaacccgctaagtcataggggatccaagatatacaggaaatggttagaaactgcaagaaagaactaaactaacttaggtgccttaaaatgtttttctgatagtgcaggggagactttatactatgcttagtattctttaatgtaagaaagaagggaaaacaaggaaataatcatctatctgcctacttgtgcaaaattaaacaccagaaggataaacctggatctattgagattggttacctacaggacattggtagggaatggggtggaaagattagaaaaattgtggagttggggaaaatgacatttttctgagcataactttttgaacagttctggtttggggagtcatgttaatgtttcatatgcttaaaataaataaaatataagatcaacaaggatagagaaaacccctaagatggagtacaaacagaaacaaattcacagaacagcatttcaacagaacagttttgaataacataatcacccaggaaaaaaattaacccagtaatatttgaacatagtatttacactactgtgtcttcaggccaaaaacaaaaagaactttaaacaaatattttactgtagttagtaggcttccttttcacagcagtgtgggttagcaattctgaaactatgttctgaacaagtaaatatattgtggatagtgggagccaggtttttccctatctgagaatgaagttacaattatggaaaggggaggaatagaatgaaccctgtgcctctggattagaaaatctaacataataagacaatgaaatctatcatggttttagatatatctatattttatatatctatatctatatctatattttatatatctatatctatatctatattttatatatctatatctatattttatatatctatatctatatatagatagatatatagatagatatagattatatctatatatattatattatatctatatattatatatagatatatattatatatatagatatatatatagagagagaaagatggatgtatgtgtgtgtatgtgtgtgtgtgtgtgtgtgtgtgtgtgtgtgtatatgacatgtattttccagcactgtccactaagagggcctaaaagcagtgatatcccagtagcagtggggttgcctaatgtctagatcttagtttttaaatgctcttctcctgtaaaaggaatcagggccttggagaaatggcagattccagggctggggcagggaaaggatgagatcagcctataacatcttgttatgcaagaaggtaaagaagtgatcaaagaatgatggggacatgtcaaaaggacacaggggccagtttagggtggctctcactggctaactcttgcacaatttgagcatcaaaataaataataaaaggaaaggattacagcctgtttttaaaaaataagaatcacaaatctacattgatataagtaaataaatacatgggggagagggggaaattcttccttacagaaactcaatgaataaatacaaaaggaataatattcttagaaaatcaccatttgacttccatcataagtatcaattcagacaagaatcacaaataaatactaaaactatgaaagagggagtttgagaaatgacaagatatttgcataatctgaaagtatctcctcacaaggtactaattacaaagggaaaatgtaactttacagtggagaaagctggcaaattctacgtaaatcaagtgatcaaagttagcctcactaataataggacagatcaatgaatggaatatgcctcctgatatgataaactgggaaggaaaaagatcacgtctgtgatcttcctgccaggaaagcataacctgaattatatcatgaggaatatcagataatcctcaattgagggacattttgcaaaatgtctgaccagaactttccaaaaataccaattttataaaacataaagagactcagaaactgttccaagccaaagaatactgaagagacacgataagtgacatgattcaggattttcttttgttctaaaggacatcactgggtcaactggaaaactctcaataaggtctatagattagataatagcactatatctatgttcatttcctgagtttgattgttgtactgtagttatttaagagaatttttaaggacaagaaggcatcacatttgcaatatactaacaatttcaagaaaaaaagtataaatctagatataaagagaaggatagacactatatggtaaaatgtcaacatttggggaatatggataaatactacatgggaattctttgtactattcttgtaagccttttgcaagtttgaaattatgtcaaagtaaaaaagattctgttgattgctctgaaaagaccatagggaatcttacataataagaccgtaaagaccatgtttatccatggccagctgaaatacagctgcagcccaggcctctgtaatgttatgaattttgttagttataatcagggcattatcagtacatttttaatgtctttatcttgttagagactaatactgaaatatttatggatgaaattgtgagaaacctggtaattgctttaaaacactccagaaaaaataaaactagaaaaagagtggaggaatcagatagatgaaataagactggcaaaatattgttaattagtgaagctgggtggagggtatgtgggcttctgtacacaattctctctacttttgcgtatgtattaaaacattttttttaaataaataaaggagttgagttttttttggttggttgtttttttttttgtttggttgggtttttttcgtttgtttttttgtttgtttgttcggttttttgagacagggtctcactctgttgcccaggctggagtgcagtggtgctatcacggctcacgcagcttcaacctccccaggctcaggtgatcctcctgcctcagcctcctaagtagctgggactacaggtgtgtgccatcacgcctggttaatttttgtattttttgtagagatgggggttttgccatgttgtccaggctggtcttaaactcctgggctcaagtgatccacccaccttgacctcccaaagtgctgggattacaacacccacccaagactttttttccaggaggaaaatgatggtcacaaagcttctatgcttgattccccaggtgtggagacctctaacaagcttttacattggagtgttgcatgaactcaaactttctgacttaacaagcatgggtcttctttgtcactgggaaacatttgcttcttgctgggtttcagctcaaggtactggaaagagtagagttgggctgtccagggctgggggacagagagcgcctgttgaagccccagtgaggctggcagggacaccatagccaccaaagcagagcctcctggacaaacagcccactcagggccagacttgcaagacccctgcccacctcccgtcacccaagtcacaggcaacaagagctattcctcatggcactcttcctgagtcacccagcaaaacatgtgctcttcaacaggaaagagaagtacatgctctacatttgacaaagttttccgttgaaaatgggtaatttttcccccaaagcgttggtatccaaaggattactcttcagatacctgaaaagagccagaatctcacatactctttttctccaatgatatcactaatgtcaggcatgagttagtttatggggaaatattttggagtaggagaaagagtagtctaagaaaaggaaagaaacatctgcccatgtccatgctgtagtttgcaaggaggaagaagactctaaattaggagggttgggtttcagaagtagtcgtaagtttatacaggcacagagaaaaaataaactggaagtcgattaaggcagctcaggaaggtggtgctctgcagggatgaagcaattccgctgaagcctggtagagaagaagcctcctggttcccgtcaaaccttggaacagagtagtcagccctaccagggccacagcagggggccaggggtctatctggtggcaagcaggggtgagggacagggcgaggtaccttgttgtgtacccactcggtgtcaggcattttgctcaccttatttgatttcttctgtaggacagatgaaaccccctgggttgttgtcctacagaagaaatcaaataaggtgagcaaaacgtcacaggtatcattgctgcattaccaggggaacatttaccccaggttacattatcaggagccggtgtagccagggggctcacccaggtccgtctgattccaaagcccttgctctagacattgtcgacttcccctccagtctgtgggattaagcatcagccttggaatcagcagacctgaattcaagtctccattcgtggctggttgcacagcctgggttacttgtcccatcctcagaggagaatagtgaagagcaaacgttataatgcctgatttcaagacgttgtcaattttgtgttgttcttatttttaaagatgtgagtgcagagaggcttgctggcatttgctgatagctaactgttgaaacacattttactgtgggtgtcttcgcaagcaaagtctagacggacacagctgtgccaaatggctgttgtgtgttgttttgaattttgtcgcttcagatcactaataacccacttacacactaagtaggcacttattcatatacagaacaattccttatgcaatgctcaacctgccatctggtcccctcctgaattatgctaattggaaagcacagagctatgcagtggcagagcggtctggaaaagtcccagcaattgcttcaaggtagggaaattgcattctgaagcccacatggaaagcaaagccctcactagtggtgactaagcacactttttcccttgtcaaagggaggattttcaactgaccagtatattttgttagacagtaaaatgtccttcctgtagcctttcctttggatgggtcttgctctctcagactcatgggagttggagacatacagaatcacgacgggcttcctggggctgtcctgattccacatctcatacatgtgttcactcgattttgcatcccaacttcttgtttgaaaaatgcattcaccatactcatttactctttcagatagatataggccaatagatgttatggaaataaactacaagaagaaaagattcctgacattcaaagctaggcagagagaaaccacagtgatgtacgttggctttcggtggaaaggtgatgtgggccagcccacacattggtctgtagactggctgctgcctctacacatgttggttgggttgggaatgtgacggcagtggggcaggtatgtgatggcatctcactgctggaggtactgccacaccgtttgatgtacatgagcacagacagccacaaaaatggactggggtgatatgatatatacagagtatttctttctggagatatacaagctgattcaagttcttatattagtccactagggccaccacgacaaaatgccatagatggggtggcttaaacaacagatatttattttctcagagttctggaggtcggaagtctgagatcaaggtgataacatgattacttgacttatagagggtcaccctctcaccatgttcccatgtgacagggagtgagagagccagtgctctggtatctctcctataagagctccaatcctatcaagagggccccaccctcatgagttcatctcaacctaattatttcccaaaggccccatttccaaatatgaatttggggcatgggggcacaattcagtccagagcagttcttaggttaaaagatatttttagaatcttgaaaaagatctgcatccacccttgagagcatgaaatgaccaacttttcctgtgaagggcagatagtaaataataaatgttttcggctttgtaggtcatatggtctctgcgcagctactcagccctgccactgtaacacaaaagcagccatggacgatgtataaacaaaggggcacggctgtgttccaataaaacgtgacttacacaaacaggcaagggcccagatctggcccataagctgtatgtagtttgctgaccactaatcagagagctcagaacataatttttttttttttgagacagagccttgctctgttgcccaggctggagtgcagtggcacgatcttggctcactgcagcctccgcctcccaggttcaagtgattctcctgcctaagcctcctaaatagctgggattacaggggcaggccaccacgcctggctaatttttttttttttttttttttttttttttttgcatttttagtagagatggggttttaccatgttgcccaggctggttttgaactcctgacctcaagtgatccacccacctcagtctcccaaagtgctgggattacaggcgtgagccaccgcacctggcccataatttattttattttattttattatttttaagttccaaggtacatgtgcaggatgtgcaggtttgttacatacataaatgtgtgtcatggtgctttgctgcacagatcaacccatcacctaggtattaagcccagcacgcgtgagctaattttcctaatgctctccttccccccgacccccacaacaggccccagtgtgtgttgttcccctccctgtgtacatgtggaacataattttttaccacagccatttgaagtgaacagcaaagcctgtcttcttataagggacagtatctagaggtacaaaacatagaaatacccccatccttccttcagattcaacatttggctgacatttaccaaacacccagtatgtgccatgcatgttgctaagtgccttacatttgttatttgatttaattcattccttcccacaaccctgtaaggtattattccttttgcaggagatcaactctcagtgaaattctagcccaaggtcacacagctggtgtgacggaaaagaatccaccctccattctcattctggaataacaacgagatgttctttcgcagagggctcagaccaaatcaagactacacgatacagccactacgtccttctgctgctgggatcccttggaataaaatcaagaaaagactaaaggtgggcttaatttcactacccattgtaagcttttttgccgttttatttcctaagctctgtcaaaactccagattttcagctcaaaagtagtcatctctcattacagaatttccacctaatgatttgtattcttcctgtggaaggaaggttactagatgctcctcttacttagctagaagaaaggaggtaattgcaaaccactggacttgctcgtggacctcctgccctcactaggatcacagatgtgcagaattgtcagccacaagggcagcacctaggctttgcctatgtggggtggacatattaggatcaagaggggatctgtctgtctggtttgcaaaagcatatttaacatcgtaatcgcatacttttaaaaaaaattaaagtgatgcttaagaaaacaaaacaggtaatctctttggcaggtgtgtcaagcataaaggctgacaggtgaccctctggggtggctgtgctgctgccacctgttgaacaaaaaggccatagctggggagcagagctgagtcgagaacccaggtctccaggcctgcagcccctgggagcagcacagtgctgtaaagaggacacatcccgctctcagactcgagcgcagaaagctcgatgctgtgtgctttttgataacccagccccacagaaacctcccctggtgttagctgctggagagacaaaagggcctgggagtccccccaagacaggctggacaggataggggtgaggtttgcaggtatcactgacacttcccagttcctgggccagctttggcctagaatctctctctgtaagcttctttggagagcggagctggttggtggattcggggagaggcccagccgtgattcttgggaagccacgtgagccctgtctgccagctgcctgtgtcctccctctaagtgctgccgtggtggcaggctgggaactggctttaggaagcatccgggaggtgttgctgctcttggcgcctgagttccaggagctgaaggagcaaatgactgtttcactccttgtgccttatttccagcctcagacacaaccttggttctatcaaaagatgcaggtgggaagtgaccaggggctaacatacatctggttggaagttgttttaacaaccagttgggacaccagattcctcctagctatgatcaccatcacctgccaggcctcgttggcaactctggcccctgcttgtctctgtggctccaagagagcaacatgatgagatgagacagcaggtggcccagagtggacaggggaagcaggtggcccagagtgggcaggggaagcaggtgaccacctgttaccagagaggactctgagcaccacacacatccagcttcctcagcctcaatgacttccccctcccagcttggcagagactttgggcctctcctggatatggatccctggaaggtcttctgcatccaggagatgaccaggaacatgagaagagatgtagatatcagtcacagcgccatgtgaaagccatgggaaaagccctctcatctgtcagatccagttgcctgcaagtaaagctggcactatctttttaatcatcagataatttttctgaaatccaaagggaagggaaataagctcaatacctcacacgacacgggcactttacacatcactgctgcgctctggagaagctgcctgtccctgcgggcttagcattagctagctgccctggtgtgttctcaggcacgcctgctgggctgatgactgtgatacctgctactggcttaaacctatatcatttcacaaattgttcctgagaatggcaagccaatttgctaggccctcagaggcaccatgaaaccaactcaaaaccatggcccctgctgccagaccctctgcaggctgcataagagccagcttgcacactcccagggactgggcctagcctgacacttccaacagggctatacccggtgccaggtgacaagcatgaggcctgatgcagcgtctgagtgagatcatccttaaatgccatctcacactctcacagtgacccaaggcagcaccgcctatgaggaatgggtgaaggaagttcaacgggaagggaaagaggaacctcatcaaagatcctgggtacagaggggggcttcggcttcctgcatagatccctggagcctgggacggtggaggctgcctgcccctccctcccctcaggcctgccctggctcattgtgtactcagtgctggtgagaaggaaggataaagaaagcgagggtgtattgggttgaatagtgtgcccccaaattcatgtccacccagaacctcagactgtgaccttatttgaaaagagagcagatgtagctagttaaaataaggtgaggacataagggattagggtgggccctaaatccaaaggctgctgtcaatatgagaaggccacgtgaacacacagggaagaaggcctgtggagatggggacagagattggggagatgtgtctacaggctaagcggtgccagcaactgccagaagttgggagagaagcaagagacaagttatccctagagcttccaggggaatgaacccagccaacaccttggctttagacttctggcctccagaactgggagagaattgatgtttgttgtttgaagccacctggttgttggtactttgttacagcagcccaggaaacacaaaggggagggaaggaagaaagaagaaaggaagggaaggagggagggagggagtgagggaaaggagggaatgagggaagaagggagggagggaatgttttttgaaagcctattatatgccagataccacatatgatattttcacatatattttctcatttaatcctccaaataactctgaagattagatcttgttcaaccaatgagaaaactgtgactatttaggtcatttgtcctcggtcattaaactagaaagaggcagagctaatttcttttttttttttcttgtttttttttttttttttttgtcctgtaccttgtcccctctgggcctggggagtgagcagattaacaagataaaaaaaatccagtgctaatacatccacaggaaaaaccatcctgggaggacacgtacattgtcagtgggaccatccacacatggtccccctcctatgaccctgtcaatggcattttcatgtccaggcagatgggaaaatatgcgatggagagcagatcggggaagggccctcagcacactgcagagcaccccacgtccatttccaggtaagcacgagtgtaggtggcataggcggattctcaatgttgttcctcctgacacccagagataatcatagcagaccattctaaaggtattgcaacacctgtaaagccaacatcgaagccaaacatgatggcagtggtgcagacggtgctgctcatcatttttgtctgtaagaagcctaaggccactcaaatggaaagggtcatacctgagccctgtactgggttagagtgccccttaaaattcatgtctaccaggaacttgtgaatgtgacattgtttggaaattgggtaatcaagttaaaatgatgtcatttaggatggaccctaaatccaatatgcttgatgtcctaatgagaagatggaaatttagacacagagacacaaatacagggagaagacagccacgtgaagacagaagcagaggctggagttatgccgccactagccaaggaaagcctggggccacccgaagttggaagagggaaagaatttttcctgagagccttcagagagagcacggccctgccagcaacctgattttggacttctggtcccctgaaccacagagaacgaatttctgtagttttaagccacccaggttgtgatacagtcggtcctcattatttgaggatttcatattcacaaatttggctacttatttatctgtaggcccgaaatcaatactcacagagctatcaaggtcattcacagacacagaatttccaccggccaacatgaatgcttctagccaaggtagaacaaggctgtgctctatgttcttattttagtttgaactataaccaagtgtccttcttgcagtctatttagtgtcatctttttcacatttttctgcttttctgttggtgattttgctgtttagaatgacccccaaatgtaggctgaagtgccatctagtgtccctaagcacaagaagactgtcacatccttccagagaacaggcagtgttagattagcctccttcaggcatgagttacagtacagttggccagcagttcaatgtgaatgaatcaactatgtatattaaatacgtatttttttcacagaagcacacatgaaacaaagttatgcattgattggttggcaaaaatcttgtgaccagagactttcaggaaactaaccctgtatttcccctaggaacaatggtgcagtattcactaattcaggattgcagcagctttatagactataaccaatgcaaataatgagaatcaactgggttttgttacagcagctctaagaaagcaaaacaagttctttcatacttacccagaatgttgcaggcctcttggatgagcttaatggtgatgacgtcatcatacattgtgtaggtcatgaaggcatcttgtacttctgcagaagttctggaggataaatcgaggtgcagtgaatgctcatcagctggagctttgccccaggaatatatccactgacccagcaagatataatgtaacaataatcttcttgatcataaggaatgtgagacactggagtgtttgggtgtcaactcctccaagaagccttccctggacctcagtttgagcccggagaccccttctcaagtacccaggataggctatgcatttcctcaacttatataaagattgttggtcttacccactagctggtctccttgaggatgagcattgtgacctgtttttatctttgaacccccagcaagtggcactgtactgagcacatgttcagaacttaatatatggtagtaaactggaactcaatggtcatagagtcttgttctctgaatggtagagcagctgcttgagtttctcactgttttgcagtgtagttggctatgttgcaggagttatggatggactttagtcttcaacagatagccaagcctgctgaaaagaggcttagcctgggagtctgagacttgcacccttggcttggcccttatgtgagtcatcaaactgtagttggcaactgagttaacaaatgggggaaggaggttggtcagggaatgcttctctaagaaagggagattttgctgagactgaaggatggaaaggcaaagaagagccttctggacagagagaacaggcttctaggcagcagagaacatgtttgaagaacagagaggggtcagagcattcaagcttatccagagcacaccatagaatcttgacactgcgagaagtatggaattttctacatatccaattttctaaatgtccaatttcttactgcacgctatttctgactgctggttttccagtttcttcttgaatgcttccagtgacaacaagctcattcctttgcaaggcagcacattccacttaccaactgctctctttgatggaaacgtctttcttatgttcaaatgaaacccccttctgggccctcataatacctcctatttattaagcatgtgcttttggcccaagagatgaccaatttattacttatcattcctcgtactgttgagaaggctgatgctcagagggattaaatgtcttgctatggtcaccggttgacaagagaaggatctgggctctgaacttcaaagcccacaccactcctgtactgtgctgctgggaatttactcactggccttagttctaccctttaggaaaatgcagactgggctggtccctcctctggatacctaaccttctaatgtttgaggatccttattcatcactaaatttaactatctctttatcatctttctggacttcatcttcctctctgtaaaatgtggcaattattattacctgcccttcctatctgccaggagtgttggtaaggataaaacaggataacaaatctgaaagagcttggggaaaatgagaaccaccatgcagatcctaggagagctgtgatgacaatgagaacaaaggggctgcgtagtgagtaggaggtgaccagggctggggtttaggagactttggttccaagcttataccttacacaaataagctctgagggaaaaccactttccccctctgggccttgatttctttatccgtaaaatagaggaggtactgggcaagatttgtgtttctccatcttttttaacctctctgctacacacacatccactggggattctcagacagccccagaaacgcttgtgcacgcagttgaggatctaggactctagcttctaggactagaagctgcttgaattctccttcacctgtaagagttcctgttttggcccatgcctatacagtgctttctaagcatcttcggaggcagctgttcagagaaaccggctgtaggcctgctcgggcgaggagtgctgtacaccaccactgctgcctaagtggggcactctccaccatgttggagttgcctcttactcgcccccaggggcccacaagtctctgtgaaaacatgtgccctccttctgcacctataagcaaaacagaaacacgtggacgtgaccccagtttaaacttgacacattgtcataatgtgttctgaagaccttagaaagggttaagtgacctccaggaccgtcagaaatgtaacaaactctgtggcgctccctggccctctgatgggaccacccattcaccaatctctggatctggcagcctgttctttcctgtaggctgaactgatcatattttagtgtcaaatatttatttgggtttgtatatatgttgcacgttgctgggatgccagacgtgcccagactgttatgattatacagggattttcagccttgtttattgatctccacgatcctgcatataacatttcccacagagccagtgcacacttgcatatgtagtcattcaagctgctttagtaaaacagtatgttcaccaagaattttttttaaataaataaaccaattgatatcttccaatgagatgacagagcctctcatatgcagaggagaaagagagaaaaatgactattggaaagcattttgaagagatcgagttggagatgcaagaaatgtgggaaatgaagtaagagttagatgtttccagctcacacaaagaggagtacctgtcatggaacatgaaaagtgtcagccacataggtgcttgtatgcatccatgtgcaggagactgaggaatcagtgtttaattggcaccagcaggcattcaatatatgttcctctttagttagttccaactagcgatacccaaaatatctgagcagaaaatcagggccaggctgcctatagcagagcaactcacagggcaaaataaatacacagattcctgagccccaggaggtagtgtctgaaaatccatatatttttaaccactcgcctcagacgactgtccaggtttgaaaaccactgcacagaaacactttttaggattcagtctggcaaggcaacaggttacaaatgatacattttacgtggttcaaccttactaaactgatgtaatggttattcagagtccagggtgagccataaagcccataggaaaaatgaacagcactttgtagcaagattcaggccaagagaatgggatcaatttaagccataggaactcattttttcaacagctctcttaatggtaggtggggaattcatataacaaacttgcctgtcactgtgtgactcaaggtgtacttggggaaagagaggcccagagaggcaaaagatttgtcctggtgtcacaaccatctggaatttagaaaaagcaccagactgtctttctagcctgtcctccagctagcctgtctggctccccacagctttcctaataaaatctagacttcttaggtggacatacccagcctccacgacccagcctctgcacccactcctcacctccagccatttatcccatacatccattcctccagctactcaaactcctctcttccctgccttcccacaggctctgctccactagaaaagctctcactttccctgatctggctaacttgattcttccttcccaactcagtgtcagaatcccgattctggacattctcagccacttgcagatccgggcgtccctgctctgagccccccgtgctctctgtatcacctgtcttcgtgctaactgcgagtggaattgatttgcccatctgcatgcttcctagactaccaagttgaaggatcatgacaatgtcatttgatttaatatcttcaatacctagccctgtacctggcacacaacaagtactcaataaataattgtaagataatttcggtgagagacctaacttgacagaggctcacagactctgtgtgtcaggaggagacctaggagttaaccctggctctaccaccatctagctggatgacttggagcaaatctcactgtgcctccatttcttcatttttacaaagatagtattcaactaggtcattgtcatgaagactgtcatgtctggtcctccccttctctccctcagccaccaatgatgtctccttccttgacctctgattcacttagaaggatgcttaaggcatttaagccagcagttctcaaagtatgacccatggaacccctgcgaatacctaaggtgtttttaggaatccatgaggccaaactattttcaaaaccaaattaagacattatttgccttttgtactgattcatatttgcactaatggcacataagcattggtgagtaaaatttggtgccttatagcatgaatcaagacagtggcacaaaactattatattctttttttaaatcttcagtatattatttatagtcatcatatccctcattgtcacatatgtgcagtaaaaaaaaatgccagttttactttaggttgttcattttgaggtagtaaaaattactaatgttatgaaatcttgaccctgagtatacatcttttgaatattttgtgtaacagaatgggaagtacgcactcaaataaagtacttctcctatatgcaggagtgtgaatggtcacttccaggaaaagtacttacacgattgagttatgagatgaattagccactttttttaatggaacatcatttccacttaaaaaaccactgacagacgaactatggttactcagacttggatatttggcacacattctcttaagaaaataacaaagttagcctgtcacttcaaggaaaataactggcagaatgtgttgccaatgacaaaactcaagtttggggaaaaaagttgcatcttatactgtaagcttattagcatcccaatccttagaggctaaggtgatgatgatattgacaaatgcaattttgatattgtatagtgaaacatgtcaacatttgtaagattagcacaagtcagtgagctaatagtttccaaataactcatgcaagctagtacaaaatgatgcgaaaaaatttctatccaagtgtaacacagatcaagagattttaatataacagagtacgaagaaggtcatcagtacagttacagattcaacattataactgacctttgagaaaatacgatttgtcaagcttttgtgaggtttaaaagaatagccacaattatctgagaagagtattaaattcttcttccttccatattttcttcacaagtttcaaccaaaatcatatcacagaatacatacattgcggaagatggaatcccacttccattacttccattaagtcagatattaaaagagatttccagaactgtaaagtaatgccatcttgtcattaatttatttgaataatatagttatcataaaaatgttacactaacatgtactattatgtattacagcataattatataacatataattattttagataaatttaaaaatgtttttttaatttgttttaatttctaataccataaatacccatagattaaacaaaagctctgtggggtcttcaataatttatgagagtataaaggcttctgaataccaaagtgtttaagaacttctgatttaaatcaagagtgcttcaggtttgctttggaagctaatgaagctgaggtttccaggacagggaggaagcagcctcacctggccccctctagcttgaagccatccccagcctgaggggtcaccttatatgccctggtagtggtcctggatgcctgtgggtggggctgcagaccacccagtcctcaggaccacttgcttctggtagactcaacacacatccagactctactctaacccccaaaaaggcatctgaaagagaggctgcgcattcccagtggggaccgcctggtccaagaggacttgcgtaaaagtaggggagatgggtggaacaggtcgagggagatcaaacgctggagttttcccaggacttgccaacatgaaagaagcacacttcagcaagaaactgctgagaaagttatggatgtgcataaagaaatttgtctaagctaacaatgaaaacaaaatacaataaatacaattttcagccagccatgctagaatattcattctatcctctttatagaaaatgacattataaaatcattgtccaatgaacagaaaaagcaaaatacagccaaagatgcaggaaagtattataaaagagggttagttaatttatgatactaacaataaaaacatgtttccagcttttgatgtttatgttatctgtcagctttaaagttttcttccttaattctaagaagagtacttatttttgtagctaaatttttattggtaattatattctttttaaaggaggcttcccaaattatataagcttcaggcctcgtgatatctgtttctactcctactaagtttatcttccaggccctgcgcagtggctcatgccagtaatcccagcactttgggaggccaaggtgggcagatcacttgaggtcaggggttcgagaccagcctggccaacatggtgaaaacttgtctccactaaaagtaagaaaattagccaggtgtggtggagtatgcctgtaatcccagctactcaggaggctgaggcaagagaatagcttgaaccctgggaggcagaggttgcagtgagccaagatcgcgtcacttcatttcagcctgggcaacagagcgagactccatctcaaaaaaaaaaaaaaggaagaagaaaatttatcttccatatagtcatactaaacaaaagtatttctcaagctttacctttgacagcttttgttagaaaaaaatacttctgctttgtatatttaatattataatattcactatatttttagaatttcccacagatattctcatatgatcttttggaggctgagtcctccaggtgaaatgctctgaccagattgatttctaagggcccttctggctctgaggggctgtggtttcaggcagctagatgaaccagcaaaaatgtttgtggccaggaaagggacagaagtggggagacaagcaacatttttggatcaaagttaaaaataaaaactctctgctttcagctacttttaaactagactttatttatgggaaaagtagataacatggagggccaggggttttcagtcttgaagagagggtgagaaatttggtgagtcaattggatggacgagggatagcagaaaagggaatgaatgaattctgactttttctggctcaattagctttgcgatatactgggctcgaaggaatgcttctcaggatgtcacaatgttaacagccttttttttttttttttttttgagatggagtctcacactgtcacccaggctggagtgcaatggagcgatctcggctcactgcaacctccgcctcccaggttcaagcgattctctggcctcagccacccaagtagctggtgttacaggtgctggaccacacctggctaatttttttatatttttagtagagacgggggtttcactatgttggcccggccagtctcgaactcctgtcctcatgatctgcccgcctcggcctcccaaagtgctgggattacaggcgcgagccactgtgcccggccagcatttcctatttagcaagaacaaaaatcccaaggattcataatcagggttccttgattttttttagattgtagagttcttagagattctgatgaaaactatgaaccctctccccagaaaatacatatagtcacatgtacacgacattttaatagatgacttcggagggttctcagaccttctcaagcctatccatgaacctttggttaagaacccatgacatagagagaagccatgtaatcccacccacctctctcctaaatgggttggttgggcttggtagtcatccatccacctctcattcatttattcatcttccattcatacacacatgaatcatccaatcattcattccgttttcatgtatttatttatacaatggagaatatacgtcagtcctgatggctctacccattacctcttcttagagaccccaccctccaaagtccatctgaatgggatacatatggactccagaccaaagaccatcaaaccctctttctcaggcatctgcaattgaggcactgagaaactgagccagtctgatgatggtgatctcttgaatccaaagggcatatagaaaagcttggaagaaacagaaattaagtccaatcatggtggcatatacctgtaatcccagcactttgagaggctgaggcaagaggatcacttaaagtcaggagtttgagaccagcctgggcaacaaagcaaaagcctgtctcaccaaaaaataaaataagataaccaggcacagtgccatgtgcctcttatcctagctactcaggaggctgaggcaggaggatcacttgagcccaggatttgaggctgcactgacctatgaacatgccactgcactccagcctgggtgacagaaaaaaaaaaaaggaacagaaatcaaaagactttcagagagaagagataaccaggaaaatagagtaaacgtgaagggagatgcagagttggaaacagacctgctgactttctgtttcctctgagatttatctgtacttcctgcaattgagttctgttagagtcttctgaatctttatagtaactcctttaaacattagcttacatagtggattgctgatccttggaagtaaaatcctggactaagttctgcaaacaaagtgccaaggggatgttagccacctcacctatgctcacaagtggatgaggtgagcaccatgattatctccattcacaagtgaccacaccaaagctcagaaacttcagtaacccattgtcattagaagaaaagttcagctccttctcatcttctacacatttatatgtcctgatccctaaaaccctctccaccttcatctcctatcagactcctcacatatgatattccaagcatgttagatttttttcttcactgagttcagtctgacctcaggacctttgcacttgccattttctctggaacacatataacttctctgtcttgaggctgactccttccttcctttcagttcaaacattacctttgccaagaggttttctctaaccagctcagggcaactggcatcttctctgcccagtcaccactaaatactctaaatttagctctttgcacaacctgagatttatttgtttatttgcctgtttactgtcctccccattggaatacattcccagggaacacagcacttgcctattccttttgcctctattcccagtgcctgaaactttgttcagcacattctagaagctaaatacttgttgaataaatacatttgcccaagtcaaacagcaagtaagtgatccaggcaaaatgtaaaggtttatctgattccaaaggccttactcttcctaatccattagttccttctcattgttaaatttcaataaaggttttaaccaaaagattataaacaagcaatttaggccaggcacggtggttcacacctgtaatcccagcactttgggaggctgaggcaggaggatctcttgaggccaggagttcacaaacagactgggcaacatagagagattttgtctctaaaaaaaaaaattttttttttaaattagctggacatggtggtgcattcctgtagtcccagctactctggtggctgaggtggaaggatcacttaagctcaagggtttgagactgcagtgagctatgatcgtaccactgtactccagcctgagtgacagagtgagaccctgtctcttaaaaaaaaaaaaaaaaagagtgatttataattagaaatctacaaatctagactataagagaggaaaatactgcaagcaaaggaggagaaacatctgtttcctatttcatgttaagataaaatttatgtcataaggtctggaaacatgcttcattttacctaatcatttcttcttaaaatttctgtaggaattgatgggttttttctttctcagctgaaattctactctaaaagcattagggaatttgttatttaaatgtggcctaagcaaatccttttgcacagccaataatctcaccttaatttctcctttaaaagctgagttttctgcactagtttttttttcttttttctttttagtaaattctaatatgatgcaattttcatagctggtggacttcttagattggctttatttttggcttaaagatgcatttccaatgcaatcgtatagatgtctagtgctctgtatacaaacatcctgagacccagttaagcagataattgaaacttcaagatgaaagagataaaacctaatgacacaagcgcaggatgtaccctgctgggttctctattcccagacatatttctctggttcccttgcattcttgtaccctcattcaaatgtcctttatccccctggaggtcatgtggattcctgtttgtttgggaatgctatgagaactgctcttctaaaggaagaaagagatgacattccagcctttcagagaggtcgcaccaaggatccaaaaaggaaaaagtctcttccatccacttacacatggaaagctggagattttttcccccttgatttggaaagatatgctgaatatctcaaccaatgaaggttccagcagctggccatgctatctgtgttcagtcatacccggagggtgagagtccctccttaaacaacacatctcagctgcctgtcgtaggcagagctgaacatgtcattttacctctgctcatgtctaagtgctctggctatttctggctattttcaatgatttccagagccctggcctttctcctaggcaggacaggttcttctaagcagcagctgagctgaggctaaatgtcctaaccaggaaatcacatggtagaaaattcgtaagtcaaaaatcaatcaacaaaaatccatctctccccttcacggcctggtccctagcatttatgagggttcctcaaggcagggctagacagtggcccacactaggcgtcagggagatcagactgaaatgaggagtggagataaagccattcagcaaatcacactaactttaggaggcaaggtctcctctgggcaaagagaaagcctttgaggaatatctgcttcttcaagatggaaagcatcattatctgaccagcagcaaagtggttctaataatgtcaagtataatgtaatcttaatgtagcacctatatctcagagaggaggaaggatgcttactgagtttctactaggcacttctgtgtagattgcaccactcaattctctccttaaccctagaagataggtacattattccccctttatcaatgaggaaacagagcttcagagaggtgaagcaacccgctcaagatcacacagctctgagcagcagagcccagatgcaaatccagtccagtgggacgcacgccactgccccccacctctcccccaacccacgtgaggacgagcatcttgaaaataagccaataccaagcactgaagcagccattatgcaacagcagcttgcatttgttgagtgctcatcctgggccactcattttttctaagtgcctggtttgtatcatcaatctcagttaacacttgcaataaccccatgaggttagctgcttttattatttttcttttcagatgaaatacctgagtcgcagagtggttaagtgccatgccagggtcatacagactgtaggccttgcttctgggctttgagttcagcattgtagccccagagcccccgctgaatccaacgactgcttcctaaggacttgcaacaatgccgtgtttctgagaatatgagtatcctatttcccaagttggttccccaccccaccatgcagtgtccacccaacagcttggctgagcctgccatctctccttcctcctcctaagacgccttgccctctgcataggagcagctgatcctctggaaggcccaggtgtgcatggctggagctgacctgcccctgtcaagtttgtagcagaggaaacgatcccagtttcccatctgacatggcccttcagcaccctagttcctgtgttccaggcatacctgtaatgtttccacagattctaaagccatccaggccaaaaggcttatttgcttcttcaatcctccagtgtttttcatagtaccaggcctactatgggagctcagtaaacacatgtttaaagacacacctctcttatttcacccagagcccctgaaaatgaattcccacgtggtggcgggtgcctatagtcccagctgctggggaggctgaggcagaacaatcatttgaacctgggaggcggaggttgcagtgagccgagatcacgctactgcactccagcctgggtgacagagtgagactccgtctcaccaaaaaagaaaaaaaaaaaagaaaatgaattcccgttgccagttgctcttcctttccccaggtagaatggcctaatagaaaggagtctttgcagttaccgacctggatttgtgtccccaccccagcccccttatgcactgtgcagtcttcagcatcatcctctccgggactgtttcctctttggtgaagcagggcaataccttgccttgcagtgttcttgttgggctttcaaaagaccattatataagaggcatggccgaaagtaagtgcttaaaataagaagactgctctttcctgtcctctattcttactgagtttagcctttacaacgcaatggctgttacaaaaaataaaaaaatgaaaaagtcttcagatgcttctcttcccacggccgcatagggggctgaaaaggagcactttaaggttctgacagcgcatcctggccctgttgctcccttgctgtgcagtcttggccaagtcacttaacctttctaggcctcagtttcctcacctgtcaactgtgaagatctgggctaaataatctctcaagggtccacgagtccaaggtttccctgatcatagttactcagtgctcctacttaaaatatttggaaatgaatattcttcgcctctatgaggccagagctcctttttcccatctaaacttgtggagctgtaagcaatttaccccagagatgctgatttacccctgggctgccttcccgagaataagatggttgatggtgtcctgtgtgtgagcagtgggctgcagtgaccaggcctgtgcagggccatgggtctgggcaggacctacctgtggcaagtcactgtgctctcagctcgatttattttatttttaaaatgggggtaggaggaagaggagggaaagtttgcattaagcattttaagttgtttttacattacaaaagcaataaaaacatagcaaatttgggaaatagatgttaggaaaaaaaatcatccagcattttatctaattcagtcactattagttattattttggtctttctcttaaccctttttcatttgtgtaatttacctagtagatatgtaacttgtgtcttttttggtttttttcttattttttttaacagtattgtcataaaaatttgcaagttgcttcatgatctttgcaatcactatatcatgatgcatatttcttttgtcattctatgtgtttgttggtttgtttttaactactaaagacaatttttattttattatttatcaatataaagctacattatatctttttgcatatatatgcatatatgtgtgcacaaaggtgtgcatttctaagagaatagattctcgggaatggacttactgcttcaaaggatttgatcatttgcacagcttttggtacatgttgtcagattgctttccaaaggggctgcactgatttactatgccatcagcgattacccattttgctgcatcttaaccagaactggttattatcatttaaattttttggagatttaataggcaaagcagtgcctaattgttttaatttgcatggcattgatgaactgaggaagccaatcatttttccatatttttgttttcctctcccttcctaggatcaagtgatttctgaggcactttcatccccagcttctaacactttaggtctgggagcctctagggaagcagacagatagcacaagattgcaagagtcagacaggagactatatggagatataaatgatgacattaaggggttactggacagaggcagaggagaaaaactaagaattaaccaaagaacacctaagaagtgattctggtcaaacttaaaaggtatctcccctcttctgtttggcagctcccttgatgtgcaatggaaataatgcagttgctctctcttctgtgattagaaagagaaaatgagaattcattcatgagataaaagttaaaataatgttggtattatttacagtgagatcccatttaaggctgattttggtaatcaagactgataccttcatcgaagacagataaggtgtaccaggtgtttcctgtatctaattcatatgtttacggtacgggaattggtctccctagtaaatgaatctctttgagaaccagctgtatcttttatgatgggttcattcaactaactggcttaatcaaaaggtcagtaaaaagctgtaacctttaaaacactggaggcttaccagttgctccagagatacttcatcttccctttcacatacttacttcaatttttcccatgtttcttcaccaaatttctctatcacaagagattgcagacaggtgttgataaatccatactagaatacaaaaccagaagaaaaatatatattatgaggcatgaaatccccagtcatacacatcttcatgtcttttaggaaatgtgcaatggcatcctcttggagaaactaattataccttttccttgtttctcgtgatttaatttaatagctctgctcattcccaacttaggaaaaacctggcaccccaccgcttgggttatttctatatagaaaacatatgaactacatttgaaatcaaattgtaattagagaaagttaaagaaagtatttactgtcaattataatcctctccgaaataaggaactggtttgttagaacaaagaattcaaaaacacaccagtggcatggaggtgtttagacctggcagaaaggaagggcacacacttcatgtcgattccaaaaaggcagtgacaggatgattttttttttctttataaaaatgaatctatacctgggtgtgtgtgtggagaatataacgagtgcaggaaaacagaggaggaaactccaataagaaagacagcaccaggttaacagaaagaactgtcttctgggtttgctcattaatctgtgctctttcttcttcctccatcagagaaaaaaaaaaggaggacccatgaacacttctgcttagtgagggatagtgtgccccaggcaggccacctgccttccgcaactcggggctcctaacacaagcagggtgattgagttatgtttgaaagcactgtgtgagctcagctttcaaaatatttcttcctgaagggaagaattcttttgtcacacaaatatcaggctccagatttattttataagtttggattttcatatatataggaatttcttaaagtgaaagagcccagtgccaacaggaaggcgagtgtctaaactctggtagttattttccagaaatggaaatatttgtcctactgggctatatttccagttccccaccaccaatgtcatccttactccttactccatcttgtcccgcctctacgctccccaatatgtgcccgcaccctagcctggcattcagagcactctctagaactgtcttaatttgtttcattttatcacctactcctgctgccttaggctcatccaaaatgcctaccacccttccccaaacagagatgtcatttcttcaatggatagagtttcctcctttctcacccagtcagcccagggcaaggccaggctctgaggctactgggatactgcctggtctgcagaaccatttcctctccctctgccagacccagccatcattccctgtcaggctcactgctggatgcctctgtgtcctcaacaccacagagatggtgtgttaactatcacatgcacacgctcgggttttgtatctgtcaacacacacatatatatatacacacaggcatgtatgtatgggtgtgcatgtatttgtatatacttatatatattatgtatgtttatatgtggccatgtacacatataaatgcatatgtgtgtatgtatatatatatttttttcctgtcctttgttaaattgcaagctcctcagggtcaggaagtaagtgtcatttatctatattttgactaaagtgccaagacactgtctgctacacaggaggtatttaacaaacacttatcgagcaaggaagtactgaaatgaagcctcaagtctcatgaaaatctttaaataacccgttattcaacatcaatccaatgtaaacaaagatagcaattgttcaacttagcaatctttgcaaaagtatgcccaatcaaataaaacatcatgcccactgcccgagcactagagacaaacttctagtgtgtaacaagggaaactgaggcagtggggaatttgaagtctgctgctagttgataaccacatcacctacttctaggtcatgaccaccccgatagtgtgcctctgtttgatgaatttagggccattgagtcatgtggtccagcatttgtctttggtgttcagcagttccccaagctggtaccagagttaatcatttagagaccttgagcttatagatcagagagtggccccctcaccctctactgattataaacatgtccctttcctgtccactgaaatcaggtgactttctctgcccctggagagagcaaaagaggcaatgtatcccacacgatgtgtcgagcatatgcggggaccttggtgtttgctgcccacacccaggtggagggggatacttggtaggacacactccctacacatttgagggcctcactgaaataagtaagaatggcaagccagcaccaaagttctctaaccatctggaactagtgctgctcaaccagtgagatcagcaagcaggcagggactctcatttgctggtgacacccaaatctttcagaggctacttgggccatggctgcagcacccccaaaaacatctgcgttccaaagaagcaattaaaatgtctgaaaatgttaaggtttagccaaatctttctcctgtaaagatgttttcacattccatatccagtcctactcaccgtgcctgccaggcattggctggggaatgtggcttcaaaataaaatgcagtctcagtaagcccagagagggagtacagcttaggagaaagggtttgggctctggagccagaagggtttctgtttctgtgacttgtagctgtgcagctttgggtaaattgcctaacctctctgagcccagtctgctcatgagctaaagtggacataataccgtttgctgtgttggaggatggttgttggggttatagagtaacggttctgaagttagaccatgagggctcattgctgaccccaagtcttatttgctgtttgactcaagccagatcttactcaccctcagttgtctcatttggaaaatgggggtgagaatggtcccttcctcatagggttttagtaagcattaaatgaggtaatacgtgtgaggtacttggcacatagtaagcgctcaggaaactgtagcctcttagataacaggcattttgaacaataggtgctcaacaaacagaagcggaaggaaagtcagggccaagggtgctgagagctgctcaccatgttcctgccgcagctgctcctggggccacagggattgagatgcagcaccaagcgcccgcccttcctgccagcccctagtcactcaggagagaatccacagcgtctccagaagcctgtcttgtagaaatctgggcagtccacagtgaaattaggagctcatcactagcctccaagcaaggagcacactgttgggtcctcagtcacctgcggggtaaagcataaggccgccccctctggtgagcaagtgggacctgctgcctggcaccccaagtcgtgcacaccccagatgctaagctctcaggagttcagcctgaaacctgaagcttctccccgaggtgccaacggcacagaacgcctttctgcaagcacagaaaagcatacacccctaagctcctgtaggaagactgccttgtagatgaggctgtctattgagtgatctttttagtgtatctttaattaaaccacgttggatgccatccaagaacggcctgccttgaccaacacttggccctacagtgtcataatgggaagtcccctggtgccttgagccttatcctccatccccatcactgttccgtttcaggctctggtgggctgtttgccagaggtctatttcctgagtattacttgtggtcagaggtgagaaatccagccactaaccaggtccaacaaatgtcgcctgtagctgttccaacacacatgctagctttggtgtaaaaacagagaacaaataaatacatttagtaaaatcaaaggctggggtaagccctccaggcagtgtggaggtgtggggcactagagggatgtgactcatggttaagacagtctgtcgaggaccacaacgccacagactggggccgtccactgaaacgaacgtccaggcatcgcacgccctcctggaagacttcagcatctttcccttggcatccgaagtttgctgaaagattcttcccttctcagtaggcactccttcactctccgctgttggcctccctctcctatcctgcctgcccttctttctgtcactctccttagaaagacttcctggtcctccttccactcagcctttctggctcctttgcttttactctccctgcttaactcacgccagctcctccatagaaggacttgacacctggagagactggtttcagccccctcttctttctgaaatggggactttacttattctcaaaagctggactctatgtgctgctcctctgtggaaggaacatgtggtcaggaggagaaaaaaaaaaggctcaggaatagatgatttccataattacgcttcgcaaacccttgcctccattcagctgacactctttctttctgccctgccaagcgggcttgctctggcgctctctcacaaaccccctccccacccccaacccgctttttcaaacacatacaccagcaccctcacatttcacaataagtaaatggtttaaaaaaaaaaaatctccattttctttttcatgcggcagatggcagttctcaggaacttggtggaaattaggctttctgattttctgataaatttcaacatctcacacaaaaagcacaagctcattttgattctgatgttaagtaccatatggcatatcacccgtggaacgtggcagcttcataaccagggtaacaaggaagggagggtctttcctgtaacaacgaggctgagtgggaatgaaccaattggattcctgggtgaataccatttgataataatattgtatatgacagtggagtaattatccctcttttatggtatgtgttaattttcactgccagtttccctaattacaactgccacccaacggactactttttgtaaatactctgtaaacatttgaaaagacatagacagtgcttgtaccaaaaaaaaaaaaaaaaagtccctagattttgaaactgtctggaaaattggctgacgttttatatgtttttcaattgcatagacagccagggaggaaatttcactatatggaaattccccttctctcctccatgacataatggacctccctgccgatactgtgactgttgttttgagggatatttttcgctgttacctttttctatattaagtgcgcagtttcatgatctttgacaaatgtacactattgtgtagctcacaccctaataaagatatggaacatctctgtggtcatggaaatttccccggtaccccttctcaatcagtcctaccaccctcagctgcccctattccgattactatcatattatcgccacagactagttttgcttgctcttgaacttcacgtgaatacagtctgttctctgttgtgcctggcttaacttgttaactcacttttggtgcattgaagagttcaaacaccattccccaaattagtaacatgtatgtaaacacagtctcgcttgatgcgtgtcctgtgataagtgatgagatccaataagccacatctcatctcccgtgatctatgtatgatgtgcgatgagaaacacaaatcttttatttttcatggacttgcagggagggcgggataccattgggaggtcgctggagtaaacctctatcatttaaggaaagaaactagagggagaatgcaaggtaagagtgtctgagaggaagataggaccctgatctggtttttggtggtttgtttgtgcatttctgggaacgcagctgcctcattcctggtaggaagcctttcctgtggttgatttgttgcccccagtctacctcagactgcctggcttctgagccgctgctggctttctttccaaggcctacatcagcagaggaaggtgtccccggacacaagacagggtgtggctgaagctgggctcccagaggcccgtctgttaaaaaatacgcccccaccccccaccccccaggcctgccaggtctctgaaattctcattccttttagctacaacttgggaaacttctgacagaataaaaatatattcctttggctgaacagattagctagtattcacctaagaaggaaaaggacatagaacagttcaactttgatgtgtgtgcttcagagggactgagaggatcaatttccacatcagtccaaggcatagagtgctctctgagaggcaggctctgcagagggaggtctccatcacctagggaccgcagaggcacagaatgaaagagttcagctttactcgtgtggcaggtggtactgggatggccttgagttttctcccttggtaggattaatatctcattgaaagatgtcttgaggctgggataacctggctaaaggtggagctatgataaacagccagatctcttttggcatatttgcgtattagaaactttagtatgcagcaacaactgagtcagctatcagtaagaatcttcaggaaaaaaataaccagaagacagggcggtttgttttcctaaatgttcatagtaagtgcttgtactcttttcatgccagctgtaataataatcactcactttcaccaagcctcacaatatgcctggcacaaagcactttccatgttttagaatgagccacatgaaattgccattttttacaggtcaaagactttagaattgaacgaactgaaccacttgcatttcgttctacttaatattaattcagccttaccacaatcctatagtgtaggtcctattatcataaacacccttgactgatgggagcattgaggtgaagagacatgaagtagcttccttgaggctccaaaactagttagtgtcagagctggtattcacaaccaggcctatgtcctatatcaccttcaagagaagaataaaactagctgctgttaacccctctcttttttctggaagaggtttaggcctgtcttggagtcagacaatatcttcagaaaaaaaatctctttttccaggaatgtcaaaactctggcttatgtgagcccattttatttcatcagccacactggaaagtgaggtttgattcacacatgtggttgagtacaatgttgtgaaaaacacctgaaaatgggctctgaatgtggaattctgaatcctttgatttcagacaagaggtcctttgatttccccttaggatggatgaaaccagcaagaactgaggcatttcctacagggtggtaaccagctagtgaacccagctcacctcctcaattgctaacggccccatactcgttgacaatgatatctgtgtattctaagaactagagggcagggctctttccttttcagtttgattttcaaatcttcagcgatgcattaagaggaccagcgggattgctgagcgtaaagcgccaccgtgtggccaaagccccacatgccaacaggacgctgtgtaagtcattcccgcaggaagggaggcaggaggtgtgtggctctgaagactcacaaatcctgaccaggtgcaggatcatggctcagaggactgggctcaagtctgagtcttcaccctgcaactggtacttgaggtctggagtaatcatgaaaaagtcctctgtctttcccaagtgatagtgcccctcagtgtaaaatgaggctacaaccttctccaggtgcagtggtcccagaactgcaaagagaatatacatctgactttgtacattatgtacagaacccaggcaagaatggaggtgaggtctcgcaacactggcactcgaggtaagggctcctcaagaccaaagtcaacaatcttcaaatctaacctaatctatacttccatttgataaaggaaaagttgcaaataaaccaggtgatctggggactatatataaggaggcatgacaaaaaaggattgttacattgtaaccaactgaatgtaacttgcagatttatgtattttgagagccctaataataataataatatgaactgaatatttattgtgcttactctgccagacaccaggccaagggctttatgtgcattatgctatcaggtgctcatgagggtcccatgagcccaatcttaaccacaagtcggtgcagtgctgtcttcttcaaaacagctttctcaggagactgtacttcctccaattgaaacattttgagaatttctcttttacagctactttcagagtgtgtggcacaatttttgaatatcctaagtgatagcaaatcaacattctttcattatgacaatagttaacagttactatctaccaggcactttaacaggtgtaaattcatttaaccttcaccatgacactatatgttaggaaatgttattatcgtgcccaattcccatttgagaaaaataaggcgtagagggcctaaatcatctgcccacttttacacagccagggcctcaggcctgcagcttggatgagaccgtgtgagacagggtgaggctgggtagttttttctttgcatgagggggtactcgggatccagagtccatccgcactcccacccagtgcaggccagagaccactcagtgaaaggagcacctaagtcatgaatgacacttcagctgcccgtgggcttctgctacaggcaactgtctctcagcagggcttgagttttagaaacagtcagaaggagtgcagagctgggtctcatgagacaggttagtgagctttcagctgtggacagtccgattttgaataaaaattgagactgtttttctcacctggctgtgaagcctgctccaccaaccctgccggtctcccatgccgcttcccctctcgccctctgggctcagtccgcacccttggagcacttcctgctcattggcccactctttctcgaaccttgcttgctcctcctctgcttagcttctgcatgctggggtactccaggcctcaggtgtcagcttcctccctcttacatctccactcagcacctaggtgacctcacctccctgtggcttcaaattccacctctgcgaggatggccccgggattacaccctagaccaagccattcccctgagctctacacaaagatacctaatttcccatttgacatctctacttggaggtctacggaaagctctaagtaaacatacctaaaatagatctcttgatttccctcgccaccaaatacccctgcccatcagcccatccctcattcaactcaataaagggaacctctatcacgatcccatgtctccatatcgaattcacagcaaacctaaatactggaaggttctccttcagagttgatcctaaatccaatcatctttggttacttccctatccccaccctgatcaagctactccctcaggaccctacagagctgctcaacagctgtccccaccccacccccatccccagtcaaaacctcacccaacagccagaatcatcttttaaaaacgtgatcagattgtgttattcccttgctcagaaccctcgagcactcctgggcaccttccttccttctcctcaagatcccttgatgccgtttcacatggagccttcctttgcctgggcagttctcctcctggtctcctcctggtcctttgcctgggcagttctccttctggtctccattaatcccccatttcattccattaaagtgtcaccacctctgagaggcctccactgactgaactccccaccttccgcctctctacactctgtgcctttctccaccagacttcacagcatttcacccccggccctttattctacgtaaatatatatgcatgtcatagatgactacttattgcctatacacctctgcccccaaatttaaaatctctgaaggaagggatctggtcctattctgccttcagggcctagaagagtgcttggcaaatacgggtgctcagtaatgcactacagatcagtcagggccatcttggagctgcctcgcatgagccataatccctctagcacagatgccttgcatggtattccctcggcctgagtctctctccatggcccatggctcttgacttttttttttttttttgtactttaagttctagggtacatgtgcacaatgtgtaggtttgttacataggtatacatgtgtcatggtggtttgccgcacccatcagctcatcatttacgttaggaatttctcataacgctatccctccccaagcttcccaccccgcaatgggccctggtgtgtgatgttcccctccctgtgtccatgtgttctcattgttcaactcccacttatgagtgagaacatgcagtgtttggttttctgtccttgtgatattttgctaagaatgatggtttccagcttcatctttgtccctgcaaaggacatgaactcatcattttttatgactgcatggtattccatggtgtatatgtgccatattttctttatccagtctattattgatggacatttgggttggttacaagtctttgctgttgtgaatagtgccacaacaaacatatgtgtgcatgtgtctctatagtagcatgatttaaaatcctttgggtatatacccagtaatgggattgctggatctaatggtatttctagttctagatccttcaggaatcgccacactgtcttccacaatgggtgaactaatttacactcccaccaacagtgtaagagcattcctatttctccacatcctctccagcatctgttgtttgtgactttttagtgataaccattctaactggcgtgagatggtatctcattatggttttgatttgcatttctctaatgaccagtgatgatgagcattttttcatatgtctgttggctccataaatgtcttcttttgagaagcatctgttaatatcctttgcccgctttttaatggggttgttttttcttgtaaatttaagttctttgtagattctggatattagccagttgtcagatggatagattgcaaaaattttctcccaatctgtaggttgcctgttcactctgatgatagtttcttttgctgtgcagaagctctttagtttaattagatcccatttgtcaattttggctttcattgccattgcttttggtgttttagtcatgaagtccttgcccatgcctatgtcctgaatggtattgcctaagttttcttctagggtttttatggttttaggtcttacatttaagtctttaatccatcttgagttaattttgtattatgtgtaaggaagggatccagtttcagctttctacatatggctagccagttttcccagcaccatttattaaatagggaatcctttccccatcgcttgtttttgtcaggcttgtcaaagatcaggtggctgtagatgtgtggtgttatctctgaggcccctgttctattccatttgtctatatctctgttttgtaccagtaccatgctgttttggttactgtagacttgtagtatagtttgaagtcaggtagcgtgatgcctccagctttgttctttttgcttaggattgtcttggctatgcgggctcttttttggttccatatgaaatttaatgtagtttcttccaattatgtgaagaaagtcagtggtagcttgacggggatagcattgaatctataaattaccttgggcagtatggccattttcacgatattgattcttcccatccatgagtatagaattttcttccatttgtttgtgtcctcttttattttggtgagcagtggtttgtagttctccttgaagaggtccttcacatcccttgtaagttggattcctaggtattttattctctttatagtaactgtgaatgggagttcactcatgatttggctctctgtctgttgttgtataggaatgcttgtgatttttgcacactgattttgtatccggagactttgctgaagttgcttatccacttaaggagactttgggctgagacaatggggttttctaaatatacagtaatgtcatctgcaaacagagacaatttgactgaatgtagacagtcagagacaatttaactgaataccctttatttctttctcttgcctgattgccctggccagaacttccaatactatgttgaataggagtggtgagagagggcatccttgtttgtgccagttttcaaagggaatgcttccagtttttgcccattcagtatactattggctatgggtttgccataaatagctcttattattttgaaatacgttccatcaatacctagttcattgagagtttttagcatgaaaggctgttgacttttgttcaaggccttttctgcatctattgagataattatgtggtttttgtcgttggttctgtttatatgctggattacgtttattgatttgcgtatgttgaaccagccttgcgtcccagggatgaagccaacttgatcgtggtggataagctttttgatgtgctgctggattcagtttgccagtattttattgaggattttcacatcgatgttcatcagggttattgacctaaaattctcttttttgttgttgtgtctctgccaggctttggtatcaggatgatgctggcctcataaaatgagttagggaggatttcctctttttctattggttggaatagtttcagagggaatgacaccagctcctctttgtacctctggtagaattcggctgtgaatccgtctggtcctggactttttttggttggtaggctattaattattgtctcaatttcagaacctgttattggtctactcagagatttaacttcttcctggtttattcttgggagggtgttgtgtgtccaggaatttatccatttcttctaaattttctagtttatttgcgtagaggtgtttatagtattctctgacagtagtttgtatttctgtgggatctgtggtgatatcccctttatcattttttatgccacttatttgattcttctctcttttcttctttattagtcttgctagcagtctatctattttgttgatcatttcaaaaaaccagctcctggattcattgattttttgaagggctttttgtgtctctatctccttcagttctgctctgatcttagttatttcttttctgtgctagcttttgaatttgtttgctcttgcttctctagttcttttaattgtgatgttagggtgtcaattttagatctttcctgctttctcttgtgggcatctagtgctataaattcctctctacaaactgctttaaatgtgt

SEQ ID NO: 284 - DNA, 428485 bp, Homo sapiens
agtgctattattattcattattattatactatgtataagatttatattatgtgatatgtaataataattattaatagactattattattcttatttttagagatgagaaactgaggcacattaggtaaagtaacctaactgaagtcccactgctaatacctggcacagctgggattccagcccatgcagcttggctccagggtccgagggcagcccccaacacatgccactctgactggcatctccttgtgcgtgagacagaacccgacctcaccctctttctgctgggtggtctctacattcaggcccaaggaagttgagggctgggtgcaccagcctcttacctcacagacggggaaactgaggaaactgtgtctgtactggtatagtgcctgggccttcaaaggtactcccggtgcccaagcaagcgctgactttgtctgttcctcacttgctatgggagttgagacaagtgcttgcccagttcccagggagagcaggtaggaaggaagtcctgagaggaggcggggcaggcctggcagcgggcactgcgtgggcaggccagtgaaggcgaggctgggccagggctgaagtcaaggctctggagccggttttcccaggctgtatctgagtaatcctgtgtctatatttatctcctcctttcctgggtgagcaaacagagcctgatgccagccaggcccgccaacgccccccccccatgccagcacgtttccttcacctgtagggtggccctggagaacaccgcagtcttggccctcagttcagcttggcctatgtaggacacacaaaagggtgcttgaacccagtggcttctgtgaagaatctaattgtcagaggtggccagggattatccagtctgggttgctgcagacatgggcagtcatagcctgggcagtgtcggtgcattggaggcctgggaagcaccctctactctcagcactcaggaacaaagggtcctcttatctcagatgtgtcagacatgcctttcattcccgcattcacacgttgctctagatgttggtcccatttccctccaggatggtaaattccaagagaaggtctgcgtgcccagaggtctagaacacaggctctagagtcagactgctctgaagctggatcctggcaccctgaccttaagctaataacctcttcatgactctatttccctgcttgttaaatgggacccaatacttcctaccttccagggatcatatgagtgttaagttagaggcattatgcgctgacagattggatgggctgtgctggggaggggctgtctgtccccacctgcaggccacaggggacatacacacatggctctcacaacaggcacacactaatggatacccctacttttgagaggaacatgcggcctgaacccagggtggattaagtgggttggagcttgatccctgggaagaccccagaagttgcagaagccggatactaactttgctgagagcctcttcagaggtggaggaggcaggctaggtggccattgtcaagagatgatgcagcgtggaccaggcctaggtgtcatcaccctggaccctcgccaggatcaccatggctagctaagcccctgccctgactctggcctctgccctggtggtgccacctccctgaccttggagcggcctgggtctggtgcacgtgcacggcaggcccatctgctcccaggctggattaggcagagtccgaggacgtgccgggctggcaggctcaggggcggggcgggcgctggtgctggggctgccctatgccagctcaggcctgggctgtggcaaagccttttatggctctggcggagagctcagccggcagcacccattggctggactggcactcccagctggggctgcccagccccaaaccacgggtaactagagacgccgggagcaggtggattagcatgcccgcccgcccgcctgcccgcccgccccagggctgttcttttcctttcctaaaaaggcagagctgggcaggagagacggacagttgaactcaggcctggggtagaggagggatgggtggggtggtgcaggtggctttgttgagggatcgggaatcacagccctgaccttgggccaagcacttcccagctctggatgtcagttttctcatctggaagggaagcagtaggcagcggggtccccctgaagtaggtgatgcctggaaaggaccgaggaatatgcatgttggggtcccccagccccaacccaggttccagggctgcttagtagcaaagaggcccagattctctttccataggaagctaaccacttcccaaatatcgggacctggtttcaactcctggccctgacacttaccatgatgtccttgggaaagcagtgtcaccactctggcaccctgaacctgggcaaataacttcactgtgactcaatttccttgcgtgttaaatgacgctgatacttcctaccttcccactctagaatagataatgaggttataaggcatctcctcccagggtctcctgagcagtgcccataatgaatcccaagaagcacagccccatctgcaccctcttcacctgctctctgtcctccaccagctcttccttcttctctgcactcctgcccatctcaggctggcccatcctatctacagtggcccacaccccaccggagtctccaggacagagtgtggcctccaggttctgagcccagagaggacccaggcctaagggtgagtgtaggatccccgagtcctgcatccccagcccagacttggacttggacccagacaaagcttggtgaaggcctcagcagcagccagcagtggccaccaccctctgaggctggggtcagggggacaggtgagtggtcctgccacttgccagggtgtgatcttgggctctccccttcatctgcaaatgggagtgtgcaccctgtcctagtccactccaaatgggaaagtgcttcatgaacctcagagagcagcctgggaggcctgctggccagcgatgtgtgaatgattggtgggccttgggcctgttggcagccagtggaggaaagaattcacaggcacttttcacgctctcagttactggaatctaggccctggtgtcggctggtcattccttgcacctgtggcctcaggcacagggacctaaaatggctaccagatggccatactgacaagtcaggaggctgctggagagaagccccagctggaccctgagtggtcacagctggacagtctgagattccgggctcccctggagcccgagtgtgagatgggaggaggagggaggacctcagtttccctgaaggactacatgggagccacacaagggttttctagtcctcatactgcccctacctagctgtgcaccttcggctcctgggggccctttggagcttctgttttcctctctaaaaatggggacagtaactctcatcttgctggttgttgtagggactacaaatcaaatttgtaaaatgctggacactgggcctagcacatactatgctattcttcttctccttctggggctgatgcggggggtctacttccccactggcctagactgagacatgccccccgcatgacccaaggacgtgctccccaggcacctgctccaacgatggctcttcgtcctatgattctaaagccagctgccacgtttgctcccagggcctcttctgaactgtatttttttcactcactcactgtaaaaatccagcacctttgaggctaacactgtcaggccctcctccctcccatcgctgacatctgctcatctcctcttccaattctgagaagtcctagccttgtatgattatcattacggctgtttccaattattctcattctccttcattaggcatgaccacgtgacttgctttagccagcaaaatatgcatggaagggatagttgtagtttccacgtaaaagcatttacttgccagtaggaggccacgagtactgtatttgcctcagcccctggggtcatggaagcacagggaaggagcctctatcagtttaggtttctgactaggataagcataattcccctgctgacccacagtgaacatatagtgagggaaagaaatacacttccctttgcattcagccactgagtgtctgggttgctggtttctgctgcgtaacagaacccatcctgactgttaggccttggctcacagcccggatctccacttaagccctgcaatcctcagtgatggcctcatctgccacctgcacagcccactcagcaccctggactctcacttcctgatctctttcatcgcacctcagccacacctgtggctgacacggtcttcatccaacgagttaagacaactcacaacattttcctgttttcatccaagtggtcacttgaccactggcctttctccttatcaaccaggcctctttgttcccttctcagcgtgtgggctcagtggctggtggcttcaacctcttcactcgccagtgactcacctccagtaactcattgtccttgtgtcccatggcctggctaaccctgggccaccttccccatgcctacagccagcggctgaggactgctggaaaaaccacaccgctgagcagacagagggcagccggcccgtgatgctatgcaggtgccttccctgtttccctggcggcttcctctggctcccctcaaaggtcattcactcctactcaggtgtctttgatcttctcacccagcagcttcctcaggtgacttcactctatttcccacatacaatccattcttaagagtgtcctcaacttcccgtcaccaaatagacacactgacttcatctgcacttcctccctcccctccttttaggccactgtgggagaggagtctacatctgctcttcatcaagccaggctgaattctcatctcctcaccagccaatcacacactcagcttcctttccctgcactccacgcgccccccaacaactgccccagctctcccctgtctctagcctaggcccctagaaggtgtctgtgtctgctacctccacttccccaccttgccctcactcctcaaccaccaccatccacagccaccatttattcactcaacactcagcagcatctatgaagggcccactgtgcgccaggaactgtactagtccagctttcccaaaagccggcaacaattcatcctctgattgctttgaacgaacagaccctcttaggctcttagcactaaacttctggacggcgtttaccctgagaatcccccttgatcgtccattaatatctccttctcatggctcccttcgtcctcccgacccttaggacttttccaaggaaaagtcccctgggtgatgcagactcactctggattagcactgtcattctcttccaccacagcagtgatggccgctgtgattgagtaactgatgatggcctcccctgctacaatgtgagctcctcgtggtggatctgtgtctgtcttgctcgctgttgtatcaatgactgcctctcgttggcactcggcaaatcattgctgaatacagaaggtgaggactccctatcttttccgcccgtgtaaccccagaaccctgtgcaaagcctgctcggaaacaaattgttgaaggcttactatgttccaggctgtgttagccaccctgtatatgccatctcatttaatccccacgccagcccttatagatgtggatcatgaccctccactttacagattaggaaacagaggcacagagaggttaggtgagttgcccaaggtctcacaggcagtaagcgctgtgcctcccccactgccaacactcaagaaccaattcactactcatcttgaagtgaggtgaatgggggtccccccgaaagttaagtttatgtcctaaagcctggaatctgtgaaagtggccttgtggaggcagggtctggagtgatgagtgtataaaccagggaaggccaagcattgcctgcagccaccagaagctaggaggggcatagaattgattctccttcagagcctccgggaggaatcaactttgccaacaccttgactttggagttcaggcttccagaactgtgagagaataaatttctgttgtttaaagccacctagttcgtggtgatttgtcacagcagactagggaacaaatacaggccccaaaccacatggtgctatatctggtgcttcctcgcgaggcctttccagggtctgcaagagtgtcctgggctgtgtgaccgcagcctagtcacctccgctctcttggcctgactgctctgaagcaaaatgagcacttgggatgccaagtatccttccaactctgacattgtggaaccctctagaaaaaccatgagccaggcaagcagggctatgttgggattttcaaatttattccaacatgctaattcttttttttttaaaaaatatcctcaggctgaacactcagccagagctgtaataaaggcaattattatacttgtaaaaacttctcattcacagtacagatgtaatttacaacaaaggtcacacacatcaatactgagcatttttccttttgtacgtcagactctgtgctttagacctgcgtggatttttgttttttttttttgtttgtttctgttttgttttttcttttgcactgatatataccataccaacattgcaagatgcaagtgtggaaactggagtttaaataaaattacaggcaaaactaccccatcccagtgcggttgctgtacatatctacagtacaatttttggaatgtattgccatttaagaacatagaaactttctacagacaatttcacatacagaatacgtacaccttttagaaaaaaaggcaaatatttatcttacagagagcattgtattttacatttgcctgcacgtttcttttttctgtttcttttctttctttctttttttacatactagatttattaaagtgaccataagtgccgaagcggttttctaatggaaagcagactggattcacaacacagaagcagaattggtggaacaggctttcgggaactttcttcccctggtcacacggcagatcggtccccaaggacaggtgctcagccaggacttttgctttaagaaggatttgtctggagaaaggactagagagaaatccagctcagatgtattgctcattcctcttcagaaggactgggtgggaatggagcaggggctagaggaatctggaagctaattcttttaggctttttccaacagagggaagcagagggacttctgggtctggaagttggagcttacggaggcgacagtgcaggcagctggctgctgtcgggctcctggagggttgcaggggttgagcccagagtgagagccacaggtgcgggcgggagcagagaggagtggggttactacccaggatggccctgagattgccaagggtgaaaggcatcgtggagcgcaggcctggggggcaaggactcaccaaccaaaggcaaggtttggctctgaaacctcgaccagttggttcctcccccactgcccacacccaaggaccaggactagtctgtaccgaggaatggccaccccgcgcatttcaacagagcacgtagcaggcatctgtgccaagtcagccactgcctcctctgctgcttccctcaacaggcacaataacatcacaggcaaacaggaagcttggaagtgactgggagcagggcagaaggcccagaggagggcgtgcatggggcgagcgtctttctccaaatcatgaaggtgtacctgtgggctgggggctctgtgcgcagaggagcgggactagagtccggaggagggggttagagctgtgcccagtgacatatacccaggctggtggcattggttctgtccctctgggcacggcatcaatgtggaggcagccctttggtgagattctatttgtgcatttacccccatcatttagaaatagtctccagtgactcctggcccctgtggcttctctgcctgagcctgacgggcccggtgactgccgggcctctgccctgccggctgcactgttcattgctaggctgcccagggaggaaaccttgggtgggtaggctgtttgagtacagggagaaaaatgcccaggagagctggaaggcagggtggggtggagtggtgtggggccccccaccaatgtcaggggctagtccaccagagcccccggtctgctgctttgtaggtctggggcaggaagagcttgcccaggcagatttctaacctgggctgaagcaatgccctttatgcagctcccagacctcagcccttgaagtctccaatccgtgggcagtcccatgggttagggctgaaaggcaaggatgagaaaagccctggcctcctgggacttggaggagtcactttctgtcaggccactgtccagcaatatggacagtgtggtccaggctgggcttgctgcttctcttggggaggatgagagccctagtctctgagggaagcagccaggagctgctggctaaccctgattccccagaaccctggagcacagtggactcccagggagccctgccttctgtctcatttttgtcttagctctgaggcaaaggagaatgagtgaacaaggtggtctggctgcaggctggactgtggctggtttgtctgtctagtagggaccaagcagggaaaggccacgaattggaagaggcaagtacagccccgcacagggaactcacagaagggtcttaaccctccccacctactgtgtcctgtacccaagcagcttcaatagctcaagagccctggggcaggcacttgattcacacagcctggctgaggactggggattagccagagaggtccctgctctgtatagggtggcatcaaacccagccttcacgggcctcaaccgtagtccctgtgctgccctcccttgtagaaagtaaagaaaatcagttctgaaacactgggaaaaagctcacctctcccagttggggcgaacacgctagagttcaagttccatagttcaatttgggatttaaatttctggtcctattatttttcttacaaagtagagttttgccccaggaaatgcagggcagcttcttgaaagtagagatgtgggtaaggaagaggcactggctcacactgattgctttggagaattccaacgagttaggacaattcaaaaatcctctaggtcaaaagaatctgtggtggctgggtgaagtatcaaacaccatcctctctctttttaaaaaagaggtgtaagacagcaaacaggtccaggccgtatccaccagccacagttgtgggtatttccttggggtagtggagacaggggcagggacggggggaaacggtcctgtggcaaagtggtcctgaaacagttccccgcaaacctctgctgtggagaactggaaaaacccagccatgaggggaacaggctcccttgtaccccagggaccaagatgaaacaaaacccaaaacccagtctcaggaacggccgctagggctcgggccctgccacttctgcctttgtgggtggtttggtggttttagaacagaggaggcaacaggagagtgaggcctcggtcaggggcttgggagccagggacggacagtcagggctccttccccagcccagggggccagggtggggtgcagaagggaggtgtctggagtgggggtgcgtgggtggggtggcctgcccacctgtggagtgccaggatgggcccatgactcagactaccagagtatccaggagcccttggggagccagccctcctccttctacctgcacctattattttgtgttgaaatcctaggaaaagtatcattttattttcttgcaaaaaaaaaaaaaaaaaaaaaaaaggaaaagattagtttttctgggcctgcctgctggggcctgggtgggggtcacctgcctgtgtttgtgcccctctgcctggggacactggcctttctgctggcagagaggggtggctacgagctgggcaggggggtgaagtggcaataaacaggaaccttgatcgcatctgtacacaggagtgcttccttttacatttaattctatattgtttgaagtttccttttcctttctccctcagtgtacccctttccctctgccagcctctggggtgggtggctgccaaccacagcggggagggtcaggaggcttcaccatcagcctttccccaaaaccataaactattcacagcctcagactcctcgtgggttgttgttttttttttaaatgtatgtatgtgatttgttttgtttctttttaagcaacaaaaggtgtagaaaaaggcacaggtaactgcatacatgggaaggtacaacagatggggccgtgagagctcctggacggagggacagatggggctgaggaagtgggatgattcgaggaaagtggctggaaacgtctgttgctggacactggaagccagatgctgaagcagttggagagaggctaagcgttggggggaaccctgtcctcaggctgatgtggatgtgccctgggctccccacttcctgagggcttgggggagtcctgcctggtcctgggttccccggagaggttcctcgtccgggctgggaagcgggcagaggcctctgccaggcagcccacagagctgctgcggtccagcggcggggtggcagaaggctcggggttggtcggtgcacgcggggactccaagcgggggctccaggactgcgctgcccggcgtccctggggcggccggggcaaggtgtcgggtggggtgcaggggctgtgcgtgggtgtgggctctgcaggtgccccggtcccatggggtgtccagtcaggaggcctgcccgggcctccgccggtcctctccctctccttggggtagtccccgccctccagctctgaggagagtgtgaatttggagaccttagccacaggcgacacggaggctgacgagctctcagtgggactccagcggcctcgctcctgggcctcccgggcccctgtcaggtcgctgccacccccggagaagccactgacccaggctgcggtgggccctggcagcagggtggggtgggctcctggccgggcctgcaccatctggatcccaccgatgggaatcaagggacatggggcacgggtcaagtgctgggagtgcagaggcaggtggctgaagatgttctcctctgtccgggccaggatgtggccgtggaagtcatggagggcggagaagggtcgggaggagagaggatgagcagggccgggtgagcaggagggacttcgggactcggccttctgctggggtcagaaaacaagacaaggtaaggtgaaggttacatgctgggcacatggggagccgaggcctggaagtgggagggggactcgcccaagatcacagagcgagtccagggtcccggctgagctgagcccagaaccaagttcctgactccctgcccacagatgctgagccagctgccatctctggaatgggccatctccagctcgacagtgaccatgagtatgctcaggccccatggtctccatgcctctagccagcatatctgtcttcaaaggaggggatacttgagcgacgtggggccctgttgtcacccatgagcctggcctctatgtgggtctgctgcctgtcctgttcctaaaatggtcttcacccagcttcactcttggacatgagttcccacctgaggctctttgcccttctgctacctccaggaatttgaatgtgaacccaaaattaaaaatcaaggaaagattcctagatcagtgttcctccaggagtgacagggctgggtcatggcaacacggggacagagaaggtgtcggaagggggtcagctgacaatgatggtgctatcggtggaggggtcatggcagctgaggggacagggatggtgactgtgctcatggggtggcagcagtggtgtgttggtgcaatggtgacagtggtggtgctggccatggggatagtgctgatggttgacaaggatgatattggttgtggtgtctctgagagcactggtgacagtgatattggagatggtgatggttttggttaagttgtgccatctgctcaaagaacacaggcagatggggatggggtgggggatggggaattgcacgagtatttacaacctcatccaaggccacaccccttgcaagtgatatgatatcgtttggatatttgtccccgcccaaatctcgtgttgaattgtaaaccccagtgttagaggtgggcctggtgggaggtgtttgggtcatggggacggatccctcagggcctgatactgtcctccagatagtgatttctcatgagatctggcattttgagcgtgtggcacctttcccccaactctctctcttgcttccactctgccatgtgagatgcctgttcccgctttgccttctgccatgagtaaaagctgcttgaggcctccccagaagccgagcagatgctggcaccacgcttcctgtacagcctgaagaactgtgagcctattcaacctcttttcattataaattacccagtctcaggaatttgtttatagcaatacaagaacggactaatacgtggtagaacccatttcccatgaactccagagtccatgctctgtgcttctgaggctaaaataaagtttaataagccagctgatttagggcagccagcatggtgcatggcacagtaggtgcctaataaatgtttgcgaaattattaataactactgagctggcagagctgtttagttccaggtgtgatacccaggagggtgtgaacttgcaacccctgcacccacaggggagaagcggcccagccaccaggggcaggaactcacccacggggaggcgcaggtctctgggcttctgctgaggagcttgtgaggtagaggcgcgggcgggaagagaacccgtgggtccagccccaagcctgggccatgctcccccgctgaggggctgcccggcccagccaaggcccacttccctggcggcgctgaccgtggtggtgactcggcctgacctggagaccatctcctggtgggcgagtatctggggaggcctgggtcggtggtaccctcgagtttggagagcacatgtgctcgaggggccagttctcttcccagggggcagagggtgagaggagacagctgaagtcttggagacccacaagggagagcgcccatgccccttcctgggtccacgtgcaggccaggtgggcttggggctgaggcctgtggttctcgggccggggagcatcgctggggagatgagtcgtttttggttagcgagtgtttgcgggctagtggtggacggctgcctgcttctttgcttggggaccacggtcttcttggggacacaggcttgtagctcaaggctgagcctgtgtctttctccacagagcccagaggggccggtcccagccaggggaggcccggcatgctctggctggacatggagcagctgctggctgtcaggcgctcagcttccgagaccgagctgcctcgtgtagcctccgtgccagaggcgggggcatctgggggctgagggcccaggatgggtgaggagtctgcccgcagtgcatgtggtgggccaggcgggggcgcctctgaggatggtctggacagctcatcctggctctcctcctcatcctcatcctcgtcttcgtccaggtctgagtctgagtccgagtcctccaggtccgaaaactggtgctcctccacagcctctgaaccctctcgtccttccgagtcctggaacaggtcgtcactggttcctgagggcaaacacagaagacccaaggtcacagttgggccttggccccactgcccacacggctgctcctctctgagccccagtttccttgcctgctgactgggcaaaatagccatcgcaagggcacaagattgttgggacaaccaagaaacgtaacagatatgggagcgctttgtaaataataatgaacaataattcccttatgcctagaatgtgcaatgttcagttctgagagctttaggtatatttattcatttagacctcagagaatcctgtgaagctggtactgttctcatcctcatgttacagatgaggaaactgaggtaagagaaagtaagtaacttgcccatggaagacagcagtagggctgggattgagccatagcaaagaagacagtctttgtttgtttgtttgtttgtttgtttgtttcactagcatctcagtgctggcttcaccatgggcaacttaccaccttgctctgcttggtctccccctttgtcgaatgaatgtgatggtctcacctcaccaggttttctaggaggactaaaatgaaggcctggcacatattgagggcttaaaaataattatagctaccatattaatacattaatgatgaaatctgttattccaggacagggcagtcacactggctggtccagcagcacagagccatccgtggtcagtgtacacacacatctgccacggtgaccaggctcccggtggctggcacaatggcatctggcaggtggcggactctggcctctgtgggcggcttgactaagctggcctcaggctgcagagcaggtccccatcccagccacgctcttatctgaggagccactgcccttttgaagtccaggctgcctctagcctcggggccctcccattgcctgccagccccagctccaccccatagttttcgacctacatgtggctgaatgcccacttttgtccactttggacatctgactgctgcatgttgagtgacttggaagcaattgttcacaagagtaaacaaaaaacaaaattgtgatacttgtttcagatattgttggacatttaggtcacttgcactccttaaacagactataagaataatgacagagttattgaatagagtctaaaagtgggggttagggctctggaatactagcctcctggtctgattcctctgggatgaccccaaccagtcgggtcacctctaacatgtcaggagtctagtttgggcatctctgaaatggacagcaatccggatgctggggagagctccgctaacatctggcctgttcgctggcccatcactagaccattggaacctgtttctggtctgcagagtgaggttgctgacaggtgggttgagctggccagccagccccatcgctcacacatatcagtactgcacccacctgaccaggagggctggcacagaaactgactcaggccgctggggcagctaggctttggctctcaaccatgcccagctgccccggggccagaaagcccggaactagcacttccaagtcactcaatatgcagcagtcagatgtccaaagtggacaaaagtgggcattcagccggatgtaggtcaaaagctatggggtggagctggggctggcaggcaaaaggaggcccctgaggctagaggcagggtgatgagaccagaggaggaatgaaggattaggatgagagcagggctggggatgggggtgaactttgtagttatgccccaggcatttacctcccttgcctaggactttgggaggggcctaattcaacacctgttcacctggccctgcccctcatttacatacagcaaaatccaggcacagatgacccagtgagagctggtggctgagtcagaactaaggtttacagcccttgcattattacgctgacagtttaaaaatgatgtgctgcactaagaagcagggaatggtcgggtttgaatctcagcactaccacttccttgctgtgtgacgttggatactttactttctgtgtgtctggtttcctcatctgtaaactgggtagcaataaaagcactctaggaagctgttcagaggactgtgagggtctggcacacagtaagtacccaataaacttcagctcctgtcatcccatgataccctgtccccccagtctcagcaggcaggtagctggggtgggattgtcagcattttgcagatgaaggtcacaggggtagtgttaggagtgaaggagagtcaggaccagcgtctcctgatgtccagcagggagggctcctaaagatcctctttactaatgtggaagttgagacccagtgggggtaatggcccgtcctgggcactcagtgcatgaatgctggaagccaagagtcccctgcccagctcggggctggccggggcctccacatctgcgttcctgcagggcgctgagggaatgcccctggctgggcggccccgcccctgctgggatccaggccaacgctccacaaatgagagagcttgagcgcgcggcgggcgccgctgggagaggccacacggtggcgctagcgcccagcctggccagcaccatgggcagggccggggcgcctggctccttccaggcagttctcccacgcgccacctcgcgtcccacagacacgaactcctgccgctccccccggcatctgtctcgtcgcgggaagtggaaactccatccttcagtctcttgggccgtaatccttggagtcctccatggctccttttcgttcttccccctctcttctgccccatatggggtcatctgagcctgtgggctctccctccggaacctccccagaatcccgccgcttttccacctcctgagcacacccgtgctccccgcgcccacggcacaggccagaggacgccctgcctctctcctccgctccagggcacccccccatgcccttcagccctcaggctctagctctctctgaaccggctgcccccgcgtccagcgggctccagcacgcgggccaagcgccgtggcccccggggaccccacacctgctgctccctctgcaggagagctcctccctgaccccacgtggctcctgaccccggttcctccgggtgggttctctgctcacaccgccctgtctagcacagcggccctccccacgggccccagccctcacttggctcttctgctttctctttggcttcacaggcagggcccctgctctactccaccatcgttccttgcccagctcccctgccatgccgactgcctgagggcaggagctgttttatttattgcggaacccccagcacccagaacagagccaggcacagagactgtgcccagtaattacttctggaatgaatgcatggatttcgtcctccgaaaagtggctctgagcatcctcgtttgctccactgggaaaatgaggctggggcagggcagggacctcaggggagggctctggcttaggttcaggctcccctggtccagcccaccaggcagtggactggcatgcagccagggtttttgtgtgaccttgggctatttttacctgtctgagctttgacttccctgacttaacatgagtgacacaagtttctgccacctgttttgaggactcaatgagacaacatgtgcatatggcccagtgtatccttgacaagcatagtgaaccccattctagctttgggggggaacagccccaagttcactgtgttctcctctataaaaatgacttattccacctaaaaggaaatatgacttaactcttttttgtaagaccacaaatacatccccaaattggaaaaacaaaaacagaacaagacacacagtgcgtgcatacacactcctctctgtcacactctaagtcctggggctgatttcagggaatcagtatgcttcctgctttgcttggtgctggcgagatggctccagcctccttctgttggagggactgccgtccaccaccaaagcccctctggccacctgcctgactgctgaggctgggcagtgctcagccagacccactggcttcgactcctctgccctgtcttctcagagactgactctaagatgcctcctggggattgaccaccatggccggggtgtgtacggggatggggctgggaggtgacaagcggctgtcaggtctggtttgggcttttttgaaactctcctagctccaaaaggcccatgtgtcaggcccatgccagagtgtgtaggcaggagtgtgggtgtggagcttcggagagtatgtgtcccacagtgtcactatgaggggttggctgggataattcagggcatgcatttagaacccgcctgacacatagtgggcactcaatcaacgttggctgtaagttctcttgtgtgcatttattcagtaaacattcactgagcacccatgggtgccaggcgctccacctgcatggcagatggtaatgcatgatagctagggctgcagagcatatcctatcagcatgtggggaggtggctcgatcattcagggaatttaacctttgtctgatacttgggagaactgaaggtgaagctattggagggagagaggggaggagggggaatggggcaaagcagacagaaaggaagcagggaaggcaagcaggaaaggtggaggaggatagggaaagcggacaaggggaaaggggacggagaaggttggcaattgttaccttcttcggcttccagctcctccagcacccctgtctcttggcactttttgctgtgggccttcgacttcatgtgcttagtcagattccctagaaagaaacgagaatacttaggctctgctatggggcaggaggccagggcggacccagggctcatggaggtagcacctggccggcaggccatggtttctcaggccagtcaaggccctgccagctgcagggctgggcaggagctggggtatccctctgccccggtgctcaggcccagaagtgtagccacagctgctgttcagggcagtgcacagcagctaggtggggtgggcgagggctgtgaggggacagacagtataatgaggaagtgagatgctggttaaaaaacaaacaaaaaagaaattaaaagacaactcaagtgcaataggtttttttttttttttttgcttctgatttaagtctggccctagtagctggtgacactcatcaggcaggactattggccatctcaagtgtgggatgacgtgggaggctcccattgaccggcatgacgggtgaggactgagcatgcccttctggctgaggacacctctagggcagctcacagggcagaattctaaagtgtaggtagagaaaccagggcaaatttaatattaggcatggcgagagggcagaaggtgagagtagggaagtctactagccagggactcaggagccacaaggctgggggcccaagcttggtttccatagagaagtcccatttctgggccttcagtttccccaggccaatctacagtgcagacacaggaccagggtggttcagggaaggcctgggcaaggcctctgtcctgctccatgcctacaaagccctcagaggggaggctgactttgccccaagttgtaggtccagcccacaagctgaagagtggaggcagcagctctgtggaatcagggaacagtagcaacagcttcagttccccaacaggtgcacaacatttcacaggccacacagctctgtggacaggagcgttctaggaaggacaggcagagcatcccagcctgccccagaagaacacaggccagatgcctcaggatattcctttgggcccagcagctactcccaaaccgtgatgtgctcactgttgccctggggatggctatatttccatatggtcattaacatcataagtcataagttccctgagtcaggtgctctgtcccattagtctaatgaattggtaagtttgaatggatggatggaggagagaagaatggaaagagctaagcctcctggagtggatgaatagagcgattggtgcgtggatagataaagtggataaaggaaatataaagagaatgaagaacaggaagaggatagacagaaggatggaacgctagatgagcagataaggagatgaataggcagacggaggataggtgagtagatgaaaacaaatggaaggatagatggagaatgggtcaataaacagatgagatgatggagagctggatgggaggacagagacgtggatgaatggaagaatggaagaatggctggttggatggatgaatggatacatgcactattacatgcatgagagtacagacagaaggatgaaagaatgggaagttggatgggtgggaggacaaatgggagaatggtaggaacagataggatgagcagataaatgaacaggaaaacaattagatgagatggatggataggtgaccagggagagggcccatggatgaactgaagggtgcttcttaatcattcctagaattagaagaaatatttagggttttgctaagaggttaatgggggacccttaagctgggattccctgaggtgtccaagtcaagggcagcagggatgggaggggagctgtttcctttcctctttcttcaccttggtcctagttcatgactctatccttcccaatttgggttttcctcctacaaccggaaataaatctggatgtcctactcctggccatagtgggagcaaagccataaatttcagagtcatcttgtagccagagggtcctcagaggtccctatccaaccttgtggacttcggccctcattgtcatgagaaggcaaagccagagtaggacagtcaagaggtgggaaaaggcagctggggtcttccgcggatcagagatacccactgtcctaaggtcgtggagccaggcccaccctaccctgactaccccaggccacagggcactgtggacactgctcattctggctattacctcacttgttgcacctgttctgcctggaaggtttaggtctctaatgaaccaagctagacgctgggcacacaatgggtgtacaatagccatgtatgggaaatgcccttgtcatcgcaggaggaaaatgttggaaggagcttcaaagtccatgtaattcaacccccgccaggctgaggttctccctgcttctgatctgactctgggcccaggtgctgatggcaccattagacaagatcactggctgtcttggatgctggcagggctgcttgaaccaacacagtgaatcaagtggtccacagtcacagtgctggttggtgccgagttccatctagacccaggtctcaagactcggggggcctttcccactccatgtggaggcagaatggaacctagatggaacctggcagccttgggtttgactgtgggctctgccacttgccagctgtgggctcttgggcaagttcctcaaccttctgagccctggtttctgcaaccgtgaagtaatacctacctcgtggggatgcgggaggacttgatgaggtgacacaagtagagtggcagcagagtgtgcctggcagagaacagacccctgtccccatgtgagtcactctattgagcagcccaggggctctgccacgcaccatgctgggtgtggaggaagagatgctaagatgatgcttttggtgaaatggttttacctttctcaggagaaggcaccagggagccccccataggcctccctctcctctgcccccgccacgggggtgcagggaggagtcaggatcggaggtgactttgcgggtccaggagtggacactggatgggcagccctgagtgctgtccgggtccctctgtgacttcccctctccaggcctgtctcctcctctgtgaaaggggaaggtggggcacacggctgcaggcacagcctgaacaccacttccctgttgagggccagggcctcagcttgtcaggcagagccacagcttctcacagtcatcccagaccccaccaaagcctgacaggcctggaatgaagaggaaaggcaagtgagaggtaaagtgatgggtgtcgggaagaggcggaacctccgataaaagggcatccaccaacaaccctgcctgcctcatttggctttgatcaaccgctctgtccctgcccctgccgctggcagacctgaggccatctctgtcccctgaggcgatcggtgcaagggcctggacatggcacagccatccgctggcctctgggaaccatctgagaagaggaaatgggacccccagccaccacagggccacccacaggcctccccagccccacctactgacgcattccttagccagtttccagaggcctgagctgctgccacgacgtctgacacaagagacgagacacacacggcagacagagacagacaggaaggcaggaggggctccccaggccctggtgtagccgggtggtagggtcgggagggctgcctggggcaggcctggaggtggcccaatggggaggcacacagccccggagacaaggggcctgtgttgtctgagctgatggctgacggggcccagcactccacaaagacacctggccccagaaacagacaggagctccagcgccctgctctcccttcacccccatactgcagagagagttaacagggagacttccctgcttccattgccaccatcccaacctggccttccctctattagtcaaacagtttcagattccaccatttcccatctgctcccttcgttggttctggaaggttctagtcttctagaagcccctgtgaacagttgaggaagagctcagggcactgcttgatcactggttgagagcacggcctcacagccctggccttcaggacagcaggggcagccttacctcgggggatgctctacacccctggaaatggggagggcctacagcccctctgttcagattacgccctctggaccctccaaagccctccagggccctggctctgtgctggctcagagagacccaggaagggactgcagacaggctcagtgtggcttccaatgaaggcatctcctagaaagtacgggctcctgctagggacccaaggcaaagggaattgagtgggccccctgtgggaaactgcttgggctggaaacttccagtctcacgcggcagagtgatggtttcctgaggcgatgggcagcccaggctgcgtgtggggcacaggtgtgctctgcatggccctgggctggcagtgtggtcccctggacacaggccactccaagtgcagctttttgccacccactccagggaagggagggaactaactgctcacagaaaggaagatgatggggtgatgccctggagctcggggcccgtgttctagttacagctccagcattaacagttattctgttttctgggatcactttcttcaccttcaaggggacttgggtgataagttttccacttttagagttgacgaccgtccattgaattgtcagtcagttatccccgtcttgctcttccataaaatctcgactggctgcagaaggccagaggaagtgcggttggagggcgtgtcagggacagcccatgtccagggcgacgcatgctgggcagggctgcagggatggaagacaccttcgaagcacccatggggtgggtggggagtcctgggccaatgtgccctctctgggcaacctttgggacattgtttatgagacaccaagagagaagaggatgggggaaaggcagtgggagggcaggcacctctgtttaaaccaaaaccttgacaggaaaatttgagctcaacttgcagatgatggcgaggggacagaggagggcaggggttcagttaatggggtgaggagaccagaaatgggaacacagtcagagaagaggccactctcccaggggatgtgataaactggcccctgacctggtatagagagaacggaaggggccaagcagcaagagcacggaggaagtgaagaagggtagggaccctgctgggccccctccagagcagctgcccagcctcgcttgctgggagcaactttgccaacagaagaaaggtcaacaggtggcacagctgaaggatgcccttgagtttcaccccctgagaaaccgtggggctcccagaagcccccaacttgctcaaaggagaagacaggaccctgatgtccaaaccctgacccaggaatctatcaagctccagaggctgaagacactggggtgccgagagccctgggtctccctccaaggcgcttcagtctgcagtgagcaagctgccaggaccttccctgcctatcctgcagtaggagagtgcaatccaagaatctcatggactcagctcctttgtccacaccaggggcctggcctgggtggctgtggcaggccaggccatgcccatcacccatcacagctctctgggatgcatgcctttcacagcaggcccctcctttcaccagtgactgccagagcctatcctgaccctgatgtggggtgtggctggggcaggggtgacagggctgtcagtctgggagtggggggctggccctgtgctgagaggtgcagagaagctgggtggagcaggggcatggtgggagtggagaggtgggtggaggtcggcgcgctctggcaggagaagagagcatgcgagtgtgttaagcagctgggagtggaatggatttccaaatgcaagagtggcagtgacgagcatggatgctggagtgtctcagatcagtggataaacggctcaggagacatgcagaagggaggggagatgagagaagatgcaaaaccatgaacggtgagcaagagtgccgcaccaggctgggcaggccagggccgggtggccacaggtgcaggggctgtgtgtgtgttccaggaggatggctgggggcagccatggggagccacaggccagtctggagccagctgctctgccactgggcaccaagctgggtgggaacccaggaaatggggctgctccaggccccctgcaaagaggtctgggcacctgaactctgtgctgggactcccagaggggagctccctgcagcgggcaggggcagtgccccagctgactctctcttacctttggttttaaaagcaaagtgacagtgcttgcacacatagggccggacgtcagtgtgggtgcggatgtgtttcttcagcatgctgggcttcttgcagcgaattccacactcctcacaaacatatttccctcggccgcggcctcgcacatatacatactcttcgtttgatttgtacctatgagcaacaggcgtcatagtaaagggaaaaaaaaggagaagaggcaggttcccacctcagaagacgcacgcgcttcctagattcatccagcccgttacagacgcaaggaatggaggccacggaaccagagaggaccacgagagtgggaggaactgagtcaccctggtgatccactgcggacccctgcgcccctccccctcagacggggggttgcactattcttcctcctccagagcagcagacactggcgcttcccactgaggggatgtggagctgcagggtgccagacagcctccttggcacagccagcccagctacagcttcgcccacaaagaacagccaccgcaggccaccagagtcccagagagggaatgatgataataaaacagcagcagcagctcgggcagccgccattcaccaagtgctcactctgccaggcactttacccaaatcaaagcacaaccacctcaccatggagagcctgtgagaccccgagatttagagacagtgagagacttgtccaagatcccatagccagaaggggccagaatcaggctttgaacctgcctgccccaaagcctgtccagtctgccaggaagccgccttgatattcatgggaggagaaggaacagggaccaccattgcttccctggcttcagagtttggaatgaggagtcctgagctctccccctcacctgcacgtcagcctgcaagctctgcaggatgcagggtcccagccacctgccacatcgcttggggttctatctggaagtgccaccagctttcagaagctgcgcctgaagcacgaatcagaatgctcttatttccacttagaaggaaacccacgagtcccacatgcgcaacaggatcacgatgaagctgtcttgttggtctaatgctatacatgtgcaagtctcagatgcggtggggagggtggcagggggcgcgccaggagaggggaccctggcataattccaggagaagagccttctgactcctgaagcctgagaggccactggcacggcacgtggaggaggcgtggcttctcaacctgtggggcgcaccttccaacgccagccagagttgccctcacatactcacgccgcaccacctgcccctgcctggttccagcacagaggggcaggaggtggctgggaggaggtgagcaagggacagcgtgtcggggcgggggggctccaccctgctccaatggggccatcagcttacagctgaaaggacttgggaaggaagggcttggaagaggggacttgagggagagagcccgctggcagcaacagaaccaccaccaccacacccccaccctcacactcgccctcacacatgctcacacccacacactcaccctcacacgctcaccctcacacacactcaccctcacacgctcaccctcatactaaaacatgctcacaccccacactcaccctcacactcaccctcacacgctcgccctcacactcacacatgcccacacccccacactcaccctcacactcaccctcatacgctcaccctcacacacatgctcacacccccacactcaccttcacactcaccttcacactccacacccctgccgtcacacttgccctcacacatgcttacacccccacactcaccctcaccctcacacaccctcacacatacacccccacactcacacccttacacctgctcccacccccaccttcaccctcacacacaccctcacacccccacactcacactccccctcatacctgctcgcacccccacactcaccctcacgcacactcaccctcacacacaccctcacacactcaccctaaaacgtgctcacatccccacactcaccctcacactcaccctaacacacaccctcacacgctcaccctcacacatacacccccccacactccctcacacccgttcacacactcaccctaacacgctcacacacagcctcacaagctcactctcacactaaaacatgctcatatctccacacacaccctcacatgctcaccctcacacatgctcacaccccactcatcctcacactcaccttcacactccacacccctgcactcacactcgcttacacccccacactcaccccccaccctcacacaccctcttcctcacacacaccctcacatgctcatcctcacacacacccacacacccacactcaccctcacacaccctcttcctcacacacaccctcacacaccctcacatgctcatcctctcacacacccacacacccactcaccttcactcccactcccacacatgctcaccctcacacactcaccctcacacactcacctcacacacacacaccctcacatgctcaccctcacacaccctcacatacaccctcacaccctcacacttcacacccctgcactcacacacacatcccaccttcacactcaccttcacactccacacccctgcactcacactcgcactcacactccacaccctgccctcacactcaccttcactcacactccacaccccaccctcaccctcacacccctgtcctcacactcaccttcatactcacacaccaccctcacacacactcacacacccccgccctcacatgctcaccctcacgtatacacccccacaccctcacactctttcacactccacactcaagcactcacactcattcgcatactctactccccaccctcacactcgcactccacatccccaccctcacacacccgttctcacacattcacacatcccaccctcatgctcaccctcacacacccccaccctcacatgctcaccctcacacatgcaccctacaccctcgcattcaccttcacactccacactcctgcactcacactcgttctcacactctacaccctaccctcccactcaacttcacattcacaatccacttccccaccctcaccctcacacccctgtcgtcacacattcacactcacaccccaccctcatgctcaccctcacacacacacccctgccctcacatggtcaccctcacacatgcaccccacacccttgcattcaccttcacactccacactcccgcactcacactccacaccccgccctcacactcaccttcacattcacactccacacccccctcacttaccttcacactcatacccttgccctcacaccttcacactcacaccccaccctcacacccttaccctcaccttcatactccacacccctacactcacacttgccctcacactccacatccccaccctcaccttcacacacccctgccctcacaccttcacactccaccctcacaccctcacacactcaccctcacacccctccaccctcacacaccctcacatacacccccacactcaccctcacactcaccttcacactccacacccccacactcacactcgccctcacactccacaccccgcccttacactcaccttcacacagtccacacgcccaccctcaccttcacacacccttgccctcacaccctcagactcacatcccaccctcacacacaccccaccctcaccttcacacactccacacccccaccctcactcaccttcacactcacacccctgccctcacattcaccctgactcacaccccaccctcacacaccccaccctcacacaccccaccctcacacaccccaccctcacacaccctcacactcacaccccaccctcacactcaccttcacacactccacacccccatcctcaccttcacactcacacccctgccctcacgttcaccctcagactcacagcccaccctcacactcatcctcacacaccctcacatactccatcctcacactcaccttcacacactccacacccccaccctcacactcaccttcacactccacaccttgccttcacactttcacacacccctgcccttacactcaccttcacacactccacacttccaccctcacaccttcactccacaccccgccctcacaccttcgcacacccccgccctcacactcaccttcatgctcacattccacacccccaccctcacactcaccttcacacttcacatccctgccctcacactcacaccactgacctcacactctccctcacacatgctcacacccccaccctcaccctcacactcacacacatcctcaccccacaccctcacacatgctcacacccccacacgccctcacacaactcaccctcacacacaccctcaccctcacacatgctcacaccccaccctcacactcacatgcttacacccatacactcacaccctcaccctcacacatgctcacacccccactcacacttaccttcacactcacacatgctcacaccccccactgacacaccctcaccatcacacatgctcacacctccccacaccctcacattcacacatgctgacacccccacactcacacgctcaccctcacatgctcaccctccacacacatgctcataccccacaccctcacacacaccctcacacatgctcacaccccacaccctcacactccccccaaactcacaccccatactcacatactccacaccccatcctcacacttatgctgacacccctaccctcacacacccgactctcctccccccacaccccaccctcacacatacgtccccaccttcatacacatacatacactcacatcactcaccccacaccccccacaccctcacacaccccacactcacgcccctacacactcccacaaccacacttgcatctccacttgaatactcatataccccatatttacacatacacacgccaccctcacaaccatccacacacacccccagactcacttccacatccccacacactcatacatacacataaccccacaatcacacaccccacacacccccacattcacagtcacccccacagtcacacttacatcctcacactcccactgatgcatactcccacaatcaaacccacacaccaacaccccccaccacacggacatgcaccccccaccctaacacgctcacagtcacacacgctcacacccatgcacacacaccacacacttagactcatttgcacactcagaccacactcacgctcatacactctcctggcacactcaccctcacctcacacatggactgctgtccaccagtacaggtggaccctgtttttttgtcacctcagatttggccaactgatgccgccaaggagtctaaaactgccccttctccaccatggctgccctgaccagccagttttggccgtgtccccagtgggggtcacctttccacgggatccaggacacgcgccaccttgcgtccgagaggacgaactgaaggccgtggcggcggtacgcagaaatgactcggttctcttaggaagggcactctgtggccaagcacgaggcatctgcctcgatgtgacagcggctcaccctcacgtagcagatctccaagaccaaaaccagttgctcacacctggatcttaattcccatgtccctccatgcccctgggacctggtggccagggaagatggctgagatggggccccctttcccagctagaagaagacagagtgaggacagcttggtctcccctttgcactggaagccccgcaacctcctggacactagccttcacctggccttgcttgtcgggtccatggcacttgctcccctcccgccaccacctgcaatggtgtccttcagcctaatggtgtccttcagcctagccttcaccctgctgatccccacacaggcccacagccactctgacgtctactgggcctgtgtgccagccaacctagaagcaggtgccagggtccatctgccccagctgctctccgaccccttcatttcctcctccacatcaagcttaaatggtacatggtctttccaaatggagagagagagataggaaggggagggagagagaggactctgagccttcaaggttggtgccttgacttggggcggggtgtacacaaccacgtgcagcaccttgtcacatcagggagggagtgtagcctgctggggaacacgagggaggagcctgggttgggtgaggccagggatgacaggagagatggaggacaggagagatggagaatgggagagaagggaggacaggagcgaagggaggacaggagagatggaggatgggagagaagggaggacaggagcaaagggaggacaggagagatggaggacaggagagaagggaggacaggagcgaagggaggacaggagagatggaggactggagagatagaggacaggagagaagggagaacaggagagatggaggacaggggagatggaggacaggagagatggaggacaggggagatggaggacaggagagatggaggacaggggagattgaggacatgagacatagaggacaggggagatggaggacaggagagatggaagacaggggcgatagaggacaggggagatggaggacaggagagatggaggacaggggagatggaagacaggggagatggaggacatgagagatagaggacaggggagatggaggacaggagagatggaagacaggggcgatagaggacaggagagatggaggacaggggagatggaggacaggagagatggaagacaggggagatggaggacaggagagatggaggacaggggagatggaggacaggagagatggaagacgggagatggaggacaggagagatggaggacaggggagacggaggacatgagagatagaggacaggggagatggaggacaggagagatggaagacaggggcgatagaggacaggagagatggaggacaggggagatggaggacaggagagatggaagacaggggagacggaggacaggagagatggaggacaggggagatggaggacaggagagatggaagacgggagatggaggacaggagagatggaggacaggggagatggaggacaggggagatggaggacatgagaggtagaggacaggggagatggaggacaggagaaatggaagacaggggcgatagaggacaggagagatggaggacaggggagatggaggacaggagagatggaagacaggggagatagaggacaggagagatggaggacaggggagatggaggacaggagagatggaagacgggagagagaggacaggagagatggaggacaggggagatggaggcaggagagatggaagacatgagagatagaggacaggggagatggaggacaagagagatgaaggacggggagatggaggacaggagagatggaggacaggggagatggaggacaggagagaagggaggacaggggagatagaggacaggagagatggagcacaggagagaagggaggacagaagagatggaggacaggagagaagggaggacttgggtaggcaccccccggagcaacggcagagtgttgagagcctggagtatttggttgcagagaggagatgaggctggaggaaaggcaggctggatcaccattggccttgaacaccatgctaagtttgggattgataaaagccttaaagagaaatataaagtctctaagagaggatattccctggccatgggaatggcctggaggaggagagaatgaatccaggcccaggctcatgttctagaacagcgatttgagatgccttctgggcataggctccacaggcctcagtggccatttggatggggcaggggtcagaacgaaggagaaaccaagatccagaagtttcaacttggctctagtggcaccacccccgagcttggggggaagtgatggaggactctagtctttaagcattgagtatgagatgcccatgaggaagacatgaagaaacgtccttgtgtcagaaatcagtgggactgagaaggggatatgtagatttgggaggaggatgaccccacaagacagaagagggtagtgccgacggcagagacctgggtggcacccaaattcaagggtgggcagaacaaatggcaccccaaaccctgccctcaaaaagagaaaggtcagagaagcaggaaactgggagagaactgtggcttagccaagaggagagggtttagaggaggaggggcccatggctggacatcccagagagcttgaggaagacggctgctgaggacccaggacttgaaagagggcagtcctggttcaacgacctggaacctgtggctcctctgctcgttgaaggccaggaccgaggcttgtccagctttgaggttcccagagggtccagccagggacaggcctatggcagctgtctatcagtgtggacctccccaagcctgaggtagacctgccgggctctgggtccagctcctcctgcggtgccagagcccaccccacccactgtcctctcccacagcttcccagcagtgtcattgcctccctctcctagccccttccaccaccacagacacaagcccagctctcttcccatcacaaatcaaccagccccaagcctccctgggcccaaatcccgggccagctctgctgtccctctttcctgcacagcccggatctggagagggctgtccacacctcctccccactctatgcttttgagccgctgcagcccagctctgatgaccaactgttcttgccaaggtcacagcttgctccattgaaagtccatttgcctcatcctgtccgccctcttgctggccttctggaggcacctcattccctcctgcttgtgtctcctttgcaagctccttttttgcccaccctttcccatgccgacatggcccctgccagcctccgacctgcactcttctcaccacacaccttccccaggtgaccctccacctgggtgctgatggcccccagccacttctctctcgagttccgatgcctttgctatacatctaactgccttagtatcacctctggtggttttcaggcacctcataccttgcgtgcccagaaccagccttccaagtccctctacctgcagtgtctgctcctgggtccccgttctctctcagcaagcagcacctgcactcgtgtggctggccagcccacaggctgggcttcatccttgatggctccatttccttcatgctccataatcaatccaccaccacaaccatcaatgctacatgcaatgcatgctccaagggtgccacctctctgtccccaccagccctggccaccaccctctctcctataccactgcctcctttcttcacaaaacagccagtaggagctgtccccaaatccatccaggcttaccactccttccagcctagaggtcccacttcatgcttctcccactaccatcggagcgaagccctgcattccttggcaggaaaggcccagggcaccatctgcccttgccacctccccagctcatctccctccaattcccactgatccccccatttcctgctgcactccccctccagccatgccaaaggtcacctggagccttgcatccctgccccagcaccaccccctctcctgtaagaccagctcctccactctaccagaaatttgcaccaaggtcctgtccttcggaggcctgtcccacacccctcctctggacctggggatctcacccacttctgctccagggcacttgtcagactgtgtgtactgcaatggccttttcacaagcacagcccccatcatccctgcgcgggtgaggaccacatctacctcatttgtcaggacatccccagcaggtgcccaatacatattcattagctgcacatcagagagaccagcgaggccttctttcctggggcctgtgatcctcagattctagccttgactttcccactccaggagttcctgagcacaagtttaactcaatgctgggctcccaaaggaggcgggacacaggcagtgcctcagaaccttgatgggcgcatacgctgcccaccttctgagaggagtgactctgctcagagcgggagaggtgggcaggacacttgggtcttggttctgctcttgttggaactcgccaggtgaccttgggcaagtcactttctttccttcggaaatagtcctcataacctgagacacggcagagcacggtcacatggcgggcatcactcgatcctcccatcaaccattttaccatcgtccccattgtatagaaaagggaaccaaggcccagtgggttcattgacatggccaagaccacccagccagcaattttaccacgcagcaccctgttcccgcacatcatctaaacacttttagatgatgccgaccaaggttttgttagcatcttccctctcccagggacctgttacactgcagacaaataagaatggcatcactccccgcccagcccttccagccagcgctggggtggaaccccaggtgttgacagctgtagagaaatgccggggaagagccagggtgggaaaccggaacaccatgatgggggtccctggggatatagtcctgcttgcctggtctgctggcctcttccctcctccacccaaggcagccctttggaggcctacgccacaggctgccctttatcaggggagcaagtgaccaacttccctgcctgttctgaggctgcaagacggtccactgctggtgggtctggcagggctgacttatggagtaatttctcccagtgtctggaagcagctttctgcccatgcctggggtcagggcaggacagaggctatggggaggggtatggcgagaccagggtcttcatggatggatcttttcattcttatgctgtggctctaagactcatggactcaaaggaaaagaaaaagatccttaaacaaccccttgatcaggagggtcttacaatcttcactgaatacagaaggaagcagaaacagagaggttgagtgtcttgcccaaagtcacaaggcagctcaaaagtggtgacgcaaggactggaccccagatctgacttgtgtgccctgaagagcagcacagtatgatctagtgtgatgtcctctcctgcccccggcaacttctcctgcaatccccatggctggtgatactgagctgcctgtgaaccatcagcacatgatatcttgggttgtagcagacccacagcttctgctaagcacaaaggaactcggcacagagcccccaaaggacgtgacacgttcctctgctcaagatgtcaaagaggggttgtggtggaaattgcatggcatttcaggcaaggtgatggaggaggttgttgttcccggactctgaatataacaaaagatggaaagaagctgctctgccatgcagtgggctccccgtcactagcactgtccacctagagaccagatgaataggctatgaggtcttctagtagtaggtagtaggtagaatagcattattctactactcctagctagtgggagggaattcatgacgtctacgtgctcaggacacgtccagcacaccgacagagcggctttgggtggattagcttgtgtatgagtgtcataacattgtaaagtggatatatttagttcacttggatatatttagtttagcatatttgttccagtaaatataagtggctatatttactcctaagaccaagtggaggctcagggcactagagggggatgggctggcaacatgatcaagcaaagcaggggaggcgtaggaggggacgcggtggggactgtggtgacctgggaggcagggcatatccctctctgaaggggcagtggctattcctgtcctgccaaatgtcacatgaagttgttacatcttccagttttttcaatgaaaccacagattcagatttttaaaaaaaaactaaaaatattagcaaactcttacactgggtgccaagcacgattttaaatgctttacatgcattacctcattaaatcacatgacagccctatgtgatggggctgtcatgattcccatttacacaggagaaaacagtcccagagaggttaaataacctgcccaaggtcacacagccagttaatggagtcagaatttgaactcaggtcacctggctacaaggttcatgtgcttaactgctgtgcaattctgttttttaaaaaacactgtgtaagtcaaataaaatacaagaggcggatccagcctggagctaaacttctggctcaaagtaatttccccaaggtcatatagctagtcaataggggcatgtctgaccttcaagcccgtgacttttcactccaccaagctgcattattttctgaaatgaagggatgaactcaatggcctccaagttaccttcttaatctgagattctatgtattaagctattctgcatttatattatgacttttccacctattattcatatttaattagaaaactcttgcatctcttccaagtctggatattttaaaggtttgctgcatttctgattttattatgatctggttgccaaatatgctttcctcccagggggcacacttcttgggtgtagtcagtcatgcaaagcaagaggaagatgtgacgagcaatgcacacactgttgctctgagacccactttggcgggcagcctgtgtccgtgaagtgaggctcagggccagttcccagaggtctggtaccctgggaggtccagccatggtgagctggctggcttgtccgcagtgacacgctgctcttcgagtgaaactcacagaagaatggatgtctgtggaaagagaggaaagtgccaggtggtacagcctgctgagctgtgtctctcttaaaaatattcagtggccaagaggtagtagacacatcccctggtggaaagtaaactggggaggccatgtgggtcatggggaaagttcacactggtttctgggtacaccccagattctccttttgttggggttctgcagaaactacatcatgtcataacgctcaggctgggggccattaggtgcaccctcagggacaggccactgtgccaggaattccacggcacgcaggcacagagcccaccagcacagtctctgttctaaacagcgacgtgagctgcaagcatgtgaatttactcaacagtatttcctaaggtctggtctgagcctggcgctgggccagggccagaaatataaagctaaataaaaccctgaccttggtctcaagtgtgactaacaggcacttaaaagatcgtaaagcaaagagatggaaacagtaatacagacaatgagcaaagtgctacggatgatgagaggaggaaccagtgggggtgggtgtcaggtggcttctgcagaagaaacacctttgtctgagactttttgggtgcacagggtcagacctgagactcctgttttatgagtctccgcctgagtgcagtgtggaggatggtgtgggtggggaggtctggaggccaggagaggctattgtgactgtagagagcccagctggacagaggcgagggcaagaggaaagaggacctagatatgagacagttcagcagtggcccgacagaaataagaggggagagtgggtcaaggatgccttcttatacaccttccagaaggattcttgctgatgaggcaagctcttgtcattttgcaggcttgctacctacagtggcattttcaccatttcctgggttttactattgtgatttttttaatactaggaaaacatcagctcccagtggcagcagctgggaagatggcagcagctcaggggtctaatgcccagcacagctctaagaatagcaaacgcctttattctacagaattggatatgataggtggaggtcctgtggagtgacttctgggtgacgaagagcagaggcctaagagccagcaagcaggcaccaagcctgggctgaagccagcttgggtctgtcaaacacagccgataccccatttctgaccagatagtggggttagggaggcaggcaggaatgggttgaaatgaaatgaaactgtcagaggagtggatgccttcactgcgaacattaggtggagttgctccagccatgagcagccctggcctgcagggttctagaacagtgacttccaatctgtgctccggattcatggggcatgggggtggggaagccgagcagtggggccctgggtcctcctcccccacccacagcagctctggattgcgttggttttcagagtgagtatgtatgtaaactgaactttgtaaaaaggagttatgtgaatgtaaaaacaatttgaaaattactgttagagaacattcatgcttggaagttccttaaaacctctgatgcagagaagcctgctgcatccttggattaggccattttcaggtggatcccgtccacaccctcccacaggtgcatattcctccggcaccaggggactcacagtttcccagcagctcctgcgacttctgggcagctctctcactattaagctgaagttgtcaacctgtgctcacacccatgctctgagctctgggcagtccagctcctccttcacacaagtctccaaaagccatgatgctgctcgagacttctttcctccagtctcagcatttccatgtcctcaaacaattccacatgtgagaaattctccccaaactgtccatcttctcccagaatggcccagagcacagaagccctcaggtggggctggacctagcccaggccgatgcaggaccatggtctcctctttccactattccagcctcactcccttatgtcccagacccagaatggggaagtcactaactagaccctgaagaggcgggagcctgtctggtgctccacaccacacaaatggccagagctgggagggctgaggcctccccagaccacctgacctcacagtgaccaggccctcgctatgtgccacacgctttccgtaggatatctcctttcttcttggttaacatttatgaacacttcttcttctcattattatttttgctaaaaaccgctaaaaaaagtcaaccagggtcataggtgaaacctttcatcacataaaaataaacagctacaatttgttaagtgctgactctgtagtaggcactttttacagaaattatatcgtagaaaccttggtacaattctatgatgacagtgctgagtacgaatagcaggtattgaggcagaaaggccagttggagactggcttagaaaagcctcagtgcccggctctaaaattcagccagcgtcttacaggtggtgaaggagaggaaaggaaaggtgtactgtcagaggtgggacctgcggagctgcagctggaagccccccattggggctgtgcggggcagcagccagagaggacactgaccaaggctctctctagtagcagctgacactatgcgtacaccaggtgcctggccaacgctgggctactacaacctgagacctcggtgttcctggctgcacagaaacacacatatgctgaggtacacattaggtaagaaaaggctgtgaacagttttaaatcctgcaatgagctcaaggtgtcagcaccatgaaggccgtgaaacagtttttgatctatctgaatggggcaaggtagccagggctcatgaaggcagttggttggcatctcttgcagctgtccttacagattaaacctgaagaacactgggttggggcgtgggggaggatacatgctcagaccccagagttactccaatctggaaaggagacggatagagaaggcattctaatttctgcatgacaacaggcaccttcttaccccataccccaagcagatctgttccccaccagttaagattacaggagaaacagggaccaaggaaaacctgtctttggacacctcaggtcatatctgtgaccactgtctcagcctcctgggaggtagctcagccaaaaggcagaaccaggcatggaggaagatccgggctccctttaagaaagagttttctgaccccagggctacaaacttggaaaaaagcaagcctgaatggtagtgagctccccaacaggtctagtattcaagcccagattaaatgacaatgtaagtctggggcaaaatagattctaatggtaggagctgggctggactccaggtccagcgggtttagctggactctaaatggacactgcaaccacactggtgctccagacataaacagccagtaggtgagtgggtgggaaaacaggaaggaagggagggtgtggtcacggctcagaggactgaggtggcctgtctgattaggacgctgcgagtgcagtggttaggcatggggtgttgatgcatcagactgccgagttcaaatcctgcctcctccgaccagctgtgtgatcctgagcaagcacccgcccatggagggtgtgctgatgctgcccagaggagaccagctatggctgtggctgtgggatggttttactattacacctcccagctgttattctcagactgagccacctcttccaatgaaagccctatttctctaatccactctatggaaatgtgactttcccaactcaaagtgggttttccttgcagcgagctatttagggatgcctgttgtgagtccttttgtggaaggaagaatccctttgtgagccccatggctgccctccagtgactggtgagtctgtgtgttgtggccgtgacaggctgtccacatcgcctccctcctgaatccccacagcagatctgcaggcctctcagcagatcaccctgcctggaatgctctccttccctctttctgatgaagctccagttctcccctgagctcagatccaaccccagcttctcagaagcttcccctgaccctgagatgggtcatgctctccaggtccaccttttctatgggcagtagaaaacagagctgggcttaccagacagaactcctgaggcggaaaccagcctctgtcccttattagctgtgtgaccttgggcaggttacttaacctctctgtgcctcagtttcttcatctgtaaaatagggataatgtcctatttcttgacctgtgggtaactgggcacaattccataggtatgttcactctgtaataactcatggttgtatacttatgacttggattgttttttgtatgtatgatctgtttcaattagaaaattactacaaaataatagcatatgctccaagaggtgttgcacattttacttagttaatataggttatgtgcttggaagagtgcctagcaccgagtggggctcaatcagtatttgctgtatctggcactctgccttgatagcactcattacagtcagattcattcttcaatagtggaaggaaaaccaagtgccccagatttcaataggttcagaagcctggagatgtctccctcacccacctcaaaagcgaagctaatggtttcgtgctaagaggctggctcaactgtctagccctggcaatattgggaccagttgatggagtaagaagtcacgatggagtctctctaccatctcctccttctctccagccatggccaggtttgcggaggaatccataacatgctgatggggatacagaagcccttggaagctctccaagatcacagccaaggggaccatgaacttcccaggacccccccgctggaggatgatggaaatgaccacactcatgccaggatggggtccgaggcgcaggaagctcctcacagagaagattcctttgtgcccatctctcctgatgagagtcttgtccccaggaaggtcaatattccgatgaagtagaagaggagcagcatgaggaagaggaagatgatgaaggtgacgaggatgtagaggaaagagaggatgcagacagaaacatcgtcacagagccacagtatcctgcagaggcagaggcagtgcaaggggatgatggcagggaacaaattccagggatgaagacagagccgccaacatggaatgtgaagcatttcagcttccaaactttgacactgaatacagtgctgaagagcaggcttcagttcctcctatgacacatgatccgtatgacacggagcttgaaccactcttccacttttaaaatggctatcagtgggatgcaggatcatggtccagattaacaatacgcagggggcaataaaagcctcaggaaagttaacctaactgttaggtttctatcgggataacggaggcgcaaaatgggtgacatgtttagaagaaactccaagatgaagaataaaggggtttgcttatctgcacttgacaaacatgaagcaggaatcccttggtgagatggtaggctggaccatgcgcactatagatctgtaagtagcccctcacctacccgctgccttaaatgtctgaccactcaaagtgggggccaaattagtgtcctcaccagcagaaagtggggtcgaggagtcaaggcacagccacgagctggcgtgattcagctcctgctcctgcctgctgatcctgtctcatcttcccttcagttcaaagtacttaatggtttgggcagttcttagcatgacagatggacagatggttttcacggaggtaggcagggtgaaaaatgtggttctgaaaagcttccagagcttgtatgtaaagatcagactgtgagagttgtcactgctggcccggctatccctcaggaaagccatttctatgaaaacttgtcagagattaaaggaggtggtaaccagttagcagagaacactttgtctcttcccagtcacatgtgggtaactggctgtgtaacctaggcccaggcccttgccctctctggtctccagccacctcactgactctacaaggcctcatagctccagggggtgagcatagacccctcaacacctgggggctccttatttaggtccttcctggtgtatccatattgagactggggctagaccctcttgagagctgcacagtgaacctgaccacaacccagatgctggaaacgagaaagcaagatcagaatagggaaatgaggtggaggctgctatagacgtggctctttggtctcctccaatgtaagcgcaggggaagtggagatgcttcttcgccgtgttgaaagtttttcgttgactgggatcagcacctcctacaatggtccaatctcctgctcagtctttgtcatgctgttctcctcaggccttcatatcttggagctggtggccttgctgttgttcattccagtcataagggctcctcctggtgctgcaagccataaaggattttacaggtcctgacacagccaccaaagggtcgtctttatcttctgttggagtaggaagcaacacctttattgatcagagcaccatgccacctttatgatcaagatgaagaggaacgtctctccagccccaaggtatgcctgtacctcgtggctaactggaccccacactgctcagccattttctgcatgggatagacagcagcagccgcaagaacacaaacgaacatctgtgatcctctagcactacagtgcattctcctcactccaggacctcctcatccttactagaaaccagtgaggggggttatgtcagtcctctttttcaagtgaggaaatggaggttcagagaggtaaagtcacttgcctgaggtcacacaaccagtgggcaggaaaagaagggcaccaatcccccctctttgaattgattaaacaccctctggctctcatggttgaagatgttgctagtgagagaactattctctagggcatggaataactggacagggagggggatgtctctccacagcaaaccctcaccataggccccagtgaagcaccacgaccacctctaccaccatcactaccatcaccaccaccatcaccgccaccactatcatcgctactaccatcaccaccaccactaccaccactactaccaccaccaccacctctaccaccactgctaccatcaccaccaccactaccacctgtaccaccaccgctaccatcaccaccactaccaccaccatcaccaccactaccactacctctacctccactgctaccatcaccaccaccactaccacctctaccaccaccatcaccaccaccactaccaccaccaccaccaccaccaccaccaccactaccacctctaccaccaccatcaccaccaccactaccacctctaccaccaccatcaccaccaccaccactaccacctctaccatcaccaccaccaccactatcaccgccaccaccatcgctaccatcaccaccaccaccactaccaccaccaccaccaccaataccactaccaccaccatcactaccaccaccaccaacatcaccacctctaccatcgctaccatcaccaccaccaccactaccatcatcaccactaccaccatcaccaccaacaccacctctaccaccatcgctaccattaccaccatcaccaacaccaccaccaccactatcgccaccaccaccatcgctaccatcaccaccaccaccaataccactaccaccactaccaccaccatcactaccaccaccaccatcaccacctctaccaccatcgctaccatcgccaccatcaccactatcaccaccaccatcatcgccaccatcaccaccaccaccactaccaccaccaccaataccactaccaccaataccaccatcgctacaatcaccaccaccaccacctctaccaccattgctaccatcaccaccaccaacaccactaccaccagcatcaccaccactaccaccatcgctaccatcaccaccactaccatcaccaccaccaccatcaccatcactaccatcaccaccaccaccaccaccatcaccatcaccaccaccaccaccatcaccaccactaccatcaccaccaccatcaccaccatcaccaccactaccacccctgccacagccaccaccaccaccatcaccaccatcaccaccaccaccaccaccaccaccaataccactaccatcaccaccatcaccactgccaccaccaccactaccatcaccaccaccaccaccaccaccatcaccaccatcaccaccaccaccaccaccactaccatcctcagcattcactggacattccagtcctggccctagtcacagagaggaacagtaacagggtctcaccagagccttgccatgcagaaagctgacagttggaaaatgcagaaagtagggctcccagttaatggcagtgaggtgtgaaggaaaggacacaggctttgaagccaaacacggctgagtgtgaatcccagctctgctccttacaacctgagtgaccatggcccctctgagtttagtgcttacttctgtgcctggagcatgtaagtccttcagtcaacagtgactgcagatggggtggagggtgggcagcagggcgggtgactacagctggaacaggctcagtccctggggaccacgtgctgcacctcaaccagtggtccccagaggtgaagttgttcgaggtccctcctgagtgtgcaaagtgaggactgtagtggagaaggcggggggctcaagtctcccaggagctgcctctctctaccccaatctgtgctcgaatcagctcccttcatggcctgagagtgggaaattcagggcacagaaaagcaaggagtgctcttctcagcaggctcagagctgacagagaagggttcccgagacagaacagatgcagctgtccagaggacctggcatcattctcagaacagacatgccaggaagtttctaagtgaggagcccccaggtgtggagggacctgtgctcatctcctgaagctgtgaggccttgtagagtcagcaaattggctgatgaccagagcagacaaaggccttgcccaaggtcacacagccattggcagcagagccaagactacaaacctagacttctgcttcttgaagcagggctgatgtaactgggtgtggccttgctacagatgaccactcactccttacatgcctccctgcatcaggcctggtgcccagtaaagaaatggatcaatgcattgtctccagaaagcttgtaggcagctctccagcagcactggcccggcctggatgcagtgtcacttgcaaatactacttaaagcacgtgtagtgcctttcagagaagccatcagccaggaggcagccctgtgactagaatcaagcccagatgcagtcattccaaatgacagaaagagaacagcacttgctcacactgactgcagatctacgcagtgctcatcgggagtggtgggaggtgctgaagtgtcctctagtctcctggcttttcatgacagccctgtgaggtagagagagctgtccctattctgcagatgtggacactgagctaagagaggcacagtgacttgccctcagccacacagctagtaggaggtgacaccatatcacactgaagatcatcctgcccaggcttgcggatttaaacttccatgttttaaagcatctacggattttattaactgtaccttccctgcctgtgggctcaaaagatggccagcagaagaagcatagtttgcctgaagcaaacagaaaatagtaaaagtcaagctaagggaaaataatcagtcggtcttggggtttggaaggatagctgttgacaagcaggcagtggcagggttggggagggccagggaggctccagggaatgggggtgcctggcctgggctttgaagatgaagaaggggaaatggccctgcaggtggaggggatggcaggagcaaaggcacagaggcagggatgcttgggatccaccgagggaatggcttggctggtagagcgaggagcccgaggaggtggcctggggccaaggcagcctccggcactctggagggacctggggaccagcacagactcctgctgggccaggcgttagggccaaccatgtggcagagttatagcaataccaggctttggggatttatttaaaaaagcccacagagcatttataatttacaataattgacaataattttcatgtattcattgccactctcccctcacaaaagtgagatgagtgatgtggcctcttccatttgatggaaaagaagcagatatcctttcctccacactccacggacaccttccacctgaccatgggctcccaggcccctcccaggctgcccactgcttcccctcctctctggccatcccccactccagcctccctagcacccctttcctgcacggtgctaatgctctgtccagcctccgacctttgaccctgccagttcctccagatggaacaatcctccctccccttccatccccatgcctttgttaactgccccaatcctcagacctcagctcgaatgccaggtcctcagaggtgctttctgagccttctgtgaccctcccaatcaatggcctcatgtgcaaagcagtccaggaggtgccagaactgggctgcaggactcagacaagctaatgtgtgtatgtgtgtgttgagcattgacatgtcccaagcaccatgcagtccttagaatgacacatgctgtggtagcgatcactctccccaccctgcagatgagaaagggattcacaggggcattaagtaacttgcccatgaccacatgcctgcgctcttggctcccagccactcctgccttcatcctgtcctgccagcttcctccaggtgctctgcaacctcagctttgtgtgtctgtctgggctccaagctgctcatactgcacttttttaagcaactctttttaaaattgtggtaacaaatacacaacctaaaatgtaccacttgaaccattttgggtttgtttttttttttgagaccgagttttgctcttgttgcccaggctggagtatagtggcccgatatcggctcattgcaacctccacctcccaggttcaagtgattctcctgcctcagcctcctgggtagctggtattacaggtgtgtgccaccatgctggccaattttttgtatttttagtaaagacggggttttaccatgttggccaggctggtctcgaactcctgacctcaggtgatccaccccacctcagcctcccaaagtgctgggattacaggagtgcaccactgcgcccagcccttgaaactttttattttccaactcattattttattttattttattttattatactttaagttctagggtacatgtacactaagtgcaggtttgttacataagtatacatgtgccatgctggtttgctgcacccattaactagtcatttacataaggtaatgctatccctaatgctatccctccccctgccccccaccccccaacaggccccggggtgtgatgttccccatcctgtgtccaatgtgttcattgttcaattcccacctatgagtgagaacatgcggtatttcgttctctgtccttgtgatagtttgctcagaatgatggtttccagctgcatccatgtccccacaaaggacatgaactcatccttttctatgggtacatagtattccatggtgtatatgtgccacattttcttaatccagtctatcattgatgggcatttgagttggttccaagtctttgctattgtgaataatgccacaataaacatatgtgtgcatgtgtctttatagtagcatgatttataatcctttgggtatatacccagtaatgggattcctggatcaaatggtatttctaattctagatctttgaggaattaccacactctcttccacaatggttgaactagtttacacccccaccaacagtgtaaaagtgttcctatttctccacatcctctccagcatctgttgtttcctcactttttaatgatagccattctaactggtgtgagatggtatctcattgtggttttgatttgcatttctctgatgaccagtgatgatgagcattttctcatgtgtctgttggctgcataaatgtcttcttttgagaagtgtctgttcatattgtttgcccactttttgatggggttgtttgtttttttcttgtaaatttgtttaagttctttgtagattctggatgttagccctttgtcagattggtagattgtaaaaattttctccaattttgtaggttgcctgttcactctgatggtagtttcttttgccgtgcagaagctctttagtttaattagatcccatttgtctattttggcttttgttgccattgcttttggtgttttagacatgaagtccttgcccatgcctatgtcctgaatggtattgcctaggttttcttctagggtttttatggttttaagtctaacatttaagtctttaatccatcttgaattaatttttgtataaggtgtaaggaagggatccagtttcagctttctacatagggctagccagttttcccagcaccatttattaaaaaagggaatcctttccccatttcttgtttttgtcatgtttgtcaaagatcagatggttgtagatgtgtggtgttatttctgaggcttctgttctgctccattggtctatatttctgttttagtactagtaccatgctgttttggttaccgtagccttgtagtatactttgaagtcaggtagtgtgatgcctccagctttgttctttttgcttaggattgacttggcagtgcgggcttttttttggttctatatgaactttagttttttccaattctgtgaagaaagtcattggtagcttgatggggatggcattgaatctataaattaccttgggcagtatggccattttcacaatattgattcttcctatccatgagcatgaaatggtcttccatttgtttgtgtcctgttttatttcattgagcagtggtttctttgtaggtctccttgaagaggtccttcacatcccttgtaggttggattcctaggtattttattctctttgtagcaattgtgaatgggagttcactcatgatttggctctctgtttgtctgttattggtgtataggaatgcttgtgatttttgcacattgatgttgtatcctgagactttgctgaagttgcttatcagcttaaggagattttgggctgagatgatggggttttctaaatatacaaccatgtcatctgcaaacagggacaatttgacttcctctttttctaattgaataccctttatttctttctcttgcctgattgccctggccagaacttccaacactatgttgaataggagtggtgagagagggcatccctgtcttgtgccagttttcaaagggaatgcttccagtttttgcctattctgtatgatattggctgtgggtttgtcataaatagctcttattattttgagatatgttccatcaatacctagtttattgagagtttttagcatgaagtgctgttgaattttgttgaaggccttttctgcatctattgagataatcatgtggtttttgtcgatggttctgtttatgtgatggattatatttattgatttgtgtatgttgaaccatccttgcgtcccagggatgaagccacgttgatcgtggtggataagctttttgatgtgctgctggattcagtttgccagtattttattgaggatttttacatcgatgttcatcagggatattggtctaaaattctctttttttttgttgtgtctcttccaggctttggtatcaggatgatgttggtctcatagaatgagttagggaggattccttctttttctattgcttggaatcgtttaagaagcagtggttccagctcctctttgtacctctggtagaattgggctgtgaatccatctggtcctggactgtttttggttggtaggctattaattattgcctcaatttcagagcctgttattggtctcttcagagattcagtttcttcctggtttagtcttgggagggtgtatgtgtccaggaatttatccatttcttctagattttctagtttatttgcatagagatgtttatagtattctctgatggtagtttgtttttctgtgggatcagtggtgatatcccctttatcattttttattgcgtctatttgattcttctcttttttcttctttaggagtcttgctaatggtctatcaattttgttgatcttttaaaaacaccaggtcctggattcattgattttttctgaagagtttttgtgtgtctctatctctttcagttctgctctgatcttagctatttcttgccttctgctagcttttgaatttgtttgctcttgcttctctagttcttttaattgtgatgttagggtgtcgattttagatcttttctgctttctcttgtaggcatttagtgctataaatttccctctacacactgctttaaatgtgtcccagaggtcctggtacattgtgtctttgttctcattggtttcaaataacatctttatttctgccttcatttcgttatttatgcagtagtcattcaggagcaggttgttcaatttccatgtagttgtgcggttttgaatgagtttatttatttatttattttttcattattactatactttaagttttagggtacatgtgcacaacgtgcaggttacttacatatgtatacatgtgccatgctggtgcgttgcacccactaactcgtcatctagcattaggtatatctcccaatgctatccctcccccctccccccaccccacaacagtccccagagtgtgatgttccctttcctgtgtccatgtattctcattgttcaattcccacctatgagtgagaatatgcggtgtttggttttttgttcttgcaatagtttactgagaatgatgatttccaatttcatccatgtccctacaaaggacatgaactcatcattttttatggctgcatagtattccatagtgtatatgtgccacattttcttaatccagtctatcattgttggacatttgggttggttccaagtctttgctattgtgaataatgctacaataaacatacgtgtgcatgtgtctttatagcagcatgatttatagtcctttgggtatatacccagtaatgggatggctgggtcaaatggtatttctagttctagatccctgaactcacaccagttagaatggcaatcattgagtgagtttcttaatgctgagttctaatttgattgcactgtggtctgagaggcagtttgttgtgatttctgttcttttacatttgctgaggagtgctttacttccaactatgtggtcaattttggaataagtgctatgtggtgctgagaagaatgtatatgctgttgatttgggatggagagttctgtagatgtctattaggtccgcttggtgcagacctgagttcacgtcctggatatccttgttaaccttctgtattgttgatctgtctagtattgacagtggggagttaaagtctctcattattattgtgagggagtctaagtctctttgtaggtctctaaggacttgctttatgaatctggttgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcttttttttcgctttccatttacttggtagatcttccttcatccctttattttgagcctatgtgtgtctctgcacatgagattggtctcctgaatacagcacactgatgggtcttgactctttatccaaattgacagtctgtgtcttttaattggggcatttagcccatttacatttaaggttaatattgttatgtgtgaatttgatcctgtcattatgatattagctggttattttgcctgttagttgatgcagtttcttcctagcatcgatggtctttacaatctggcatgtttttgcagtggctggtactggttgttcctttccatgtttagtgcttccttcaggagctcttgtaaggcagtcctggtggtgaaaaaatctctcagcatttgcttgtctgtaaaggattttatttctccttcacttatgaagtttggtttggatatgaaattctgggttgaaaattcttttctttaagaatgttgaatattggcccccactctcttctggcttgtagggtttctgccgagagatccactgttagtctgataggcttccctttgcgggtaacctgacctttctctctggctgcccttaatattttttccttcatttcaagcttggtgaattatcaaattgtgtgtcttggggttgctcttttcaaggagtatctttgtggtgttctctgtatttcctgaatttgaatgttggccctgccttgctaggttggggaagttctcctggataatatcctgaagagtgttttccaacttgtttccattctccctgtcactttcaagtacaccaatcaaatgtagatttggtcttttcacatagtcccatattttttggaggctttgttcatttctttttactcttttttctctaaactgctcttctcacttttttcattaatttgatcttcaatcactgataccctttcttccattggctattgaagcttgtgcatgcgtcacgtagttcttgtgccatggttttcagctccaacaggtcatttaaggtcttctctacactgtttatcctagttagccattcgtctaatcttttttcaaggtttttagcttccttgcgatgggttcgaacattctcctttagctcagagaagtttgttattaccgaccttctgaagcttacttctgtcagcttgtcaaagttattctccatccagcttttttcctttgctggcaaggagctgcgatcctttggaggagaagaggcactctgatctttagaattttcagcttttctactctggcttttccccatctttgttgttttatctacctttggtctttgatgatggtgatgtacagatggggttgtggtgttgatgtcctttttgttgatgttgatgctattcctttctgtttgttagttttccttctaacagtcaggtccctcagctgcaggtctgttggagtttgctggaggtccactccagaccctgtctgcctgggtattaccagcagaggctgcagaacagcaaatattgctgcctgatcctacctctggaagcttcatcccagagggacacccgcctgtatgaggtgatagtcggcccctactgggaggtgtctcccagttaggctacacgggggtcaagaacccacttgaggaggcagtctgtctgttctcggagctcaaacaccatgctgggagaaccactgctctcttcagagctgtcagacagggacgcttaagtctgcagaagtttctgctgccttttgttcagctatgccctgcccccagaggtggaatctacagaggcaacaggccttgctgaactgttgtggactccacccagtttgagcttccccagttgctttgtttacctactcaagcctcagcaatggtggatgcccctccccctgccaggctgctgccttgcaggttgatctcagactgctgcattagcagtgagcaaggctctgtgggcatgggacctgctgagccaggcgcagaatataatgtcctggtgtgccgtttgctaagaccattggaaaagcacaatatttgggcggcagtgttccgattttccacgtacagtctgtcatggcttcccttggctaggaaagggaaatcccctgaccccttgcacttcccgggtgaggcgatgccctgccctgcttcagctcgccctccatgggctgcacccactctccaaccagtcccaatgagatgaaccaggtacctcagttggaaatgcagaaatcacccgtcttctgcgtcgatcacgctgggagctgcagaccacagctgttcctatttggccatcttggaactgccctgaaccatttttaagtgtgcagttcagtggtattaagtacattcacattgttgtgcaaccattaccaccatccagctccacgactgtccagctccagaaaaatttccattttccaaacggaaactttgtatctgttaaacactcactccccatctcctccttcctccaagacctggcatccaccactctcctttctatctatggatacgactagtctatgtaccccatatcagtgaaatcatacagtatctgtcctttttcgtgactggcttagttcacgcagcatggtgtcctcaaggttcatccacgtgtggcaggtatcagaatgtccttccatgttaaggttgagtggtatttcattgcatgactagaacgtattttgtttatctgtttatccatcagtggacactggggttgcttccagcttttgactattgtgaataatgctgctgaacacaggtgtacaaatatctgagttcctgatttcggtattggtggtatgtacttggatgtggaattgctagatcatatggtaattctatgtttgtgatttttgaagaactaccataccgtttttcacagcggctgcaccatttcacgctcccaccagcagcgtacaaaggttccaatttctccacatccttctcaacacttattttccatgtttttgataatagccctcctagagggtgtgaagtagtatctcattgtagtttggacttttatttccctcatgattagtgaggttgaatgtcttttcatgtgatgattggccatttgtatatcttgtttggagaaatgtccattcatgctttttggctatttttaaaattgggtttttggattgaggttgttgttgttgagttgtaggagttctttacatattctggatatcaagcccttatcaaatatatgatttgcaaatattttctcccattcccagggttgccttttcattctgttgatagtgtcctttaatgaataaaagttttaaattttgatgaagtccaaacttatctattttttcttttgttgcctatgcttggtgttgtatccaagaaatcattgccaaatccaatttcatgaagttcttcccttatgttttctcctaagagttttattatagttttagctctcacctttaggtctttgatccattttgagttcatttctgtatatggtgtaaggtatgagtccaacttcaccttttgcatgtggatattctgcttttgcatcattccttggaaagactttctttccccattgaatagccttggcaaccttgctgaaaatcatttgaccatatttgctagggtttatttctgggctctctgttgtattccactgaactatatttctgtcttgtgtcagtaccacactgtttcaattactgtatttttgtagtaagttttgaaatcaggaagtgtgagagctgcaacattgtcctcttgcaagattgttttggtggttcaaggtcccttgctcttcatctgcttgttcactgttatacccccaacacctacaacagttggcacccaattaatatttgatgaatgaaaagtaaactatctatggcatctgtgtcatgtgctaggtattagggaccaagaccaatccgctctggtccctgcctttaaggagtgacaccctgggaggaggtggctggataaactgctggctgaacaaaacagcagtgtgtttgatgacagaatgcacaagttcagagggacacagaggtgggcaggttgactctgatggaggggtgggtatgggtgcggagggagatgagggcagtttcccagagggtgaaaacactgcactgggctttgaagagtttactaggtagaaaatggggtaggggcacctgcacagagggatagagtgtgcaaaggcattggggaatgaaggcgcaggctctggaaggaagcaaccagcctggagtcacctttggggggatggcagggagtggggtggtgaggttgaggagtgatgggcagggaacccaacctgtggggcccagagcctcgtctctctccaggggtggggggcagaggggcagccccagagggcttgacttctcccatctattacagagggtgtgccgggcacccaggtcagctgacccagtggttttggggaagaaagagaataaaggacaaagagtaagatcttgtttcaacggtgaccccagggtttggctttgccactggggagagattcacagccagcgcttggtgaggcatggcgagaacccccacccagcgagggctcctcacttgcactgagaaaacaagccctgcaagcctcacagtggcctcacagtagtgaggtaggcgctgttctctcccagcttacagacgaacaaatggagctacacggaggtggaggaatgtgcccagcgaacagtaagcggcagagctgggattgaactgggcactctggcaactgaggcacctatttctttcctgggcccccatttcctcctaagtgaaaggggagggagtggcctctcaggtgccccacctcctccctgtgagtcctcaggagagggatgatgccccccggcccaggcagcattgggaacattggagcatgccctatgctggacggccagtcctatctgcagagcctgttggagcccagccacctcctcactcctggaccttcctgctctggacctagaacttgattcccatccaggtgtctcatggttagactagcgtaagctacaaccctcaggaaaatcacagagcttagagcctggtcctgagctcgccagctacacagccccagaaacttctgaggggagccctggggagatgaggatttggggaagcctagatgctagatctgctgacattctgaaagtttgtaggagcttgactcctcctctttgtgacagggtagctcctcttccttttgtgtcagcctgcacccctcctggcctgctcttgggggaacatggcccctgaagactccaccctgggattcaggctgaataatgctcacattgcagaggagcttccctcggcctccaggcccttgtcagctgcctccattccttgtcactttccctggggatgcaggggaggtgcccagcctacccttggctctagtctctaaaaactttgtccagccccctggctggccacatttggcccagtctgccaactgcacctgccagctggtcacaaggcctaacccatagcctggcttctccctggctgccgtaggctctttttggctctcatgtgcagccctgtcagctgtcaccacattcttgggagcctgcctgcccagtaagcctgtcccactccatgctgccccactccaagactgctctgtcttctgctggctgctgggccccagcacacacctcccttgactctcttgacagctgggcctgtccatcttgggcctgccagccactcatgtcaacagatgaccccatccatagcacagatccaaaattccgcttggagctttggccccgctgcctcctttggtccaaggcctttcaccacctctcctggcctcagcagactccacttgtccagaagtctgcctggctggctcccaatgccctctgtctcttttaaagtcttccctcaattcctggcttccctggtcccccttcttctgagtcgtgctgtattatcatttaaggtttttatttagaaacatcacaaacatacaggaacatttttatcctgaaccatctgagagcaagttgcaacccaacgtccatttcccctgaattcatcagtgtgtatttcctatagccgaggccaccccaggcctccctggcaggacactttcctcctttgctcaggatctgtctccacggagggatgcccctctcaacctgcttggaatcctctggggctgaatatccctctgcaagggagccgaaggcacattaggtttccaacctgatcccaccaccacaccatctccttgccatcaagacagccatggaaggatggcacatgcttttgtgtacacttatcacatgttgcctcctacttccttcctcctgttggcatatactaagcgggggtcaagatgctggcttccatcattaacatgccatgttaatgcctccctgggctacagtttccttactggcaaatgaggaattacgattaagtgatttctgaggattcttttctaataataacagctgagttttatgaagcacttactatgtgccacgtaccgtgagtacttcataggtagcatcttggttaattctcataccaaccctctaagatataatcacagtactgttatctccatcttacagactgggaaaccaaggcacagagcagttacataacttatgctcaggcagccactcagagattctagattttcatgcaggtggtccagttcagagtttatactctgctgaaaagtaatgggggcagggggtggcactatccggaatttattatttgcctgaagaggcaatcagagaagtaaatattgataattcagaaaaagaggtcaactttctacatgccaagtacattacacacaaatgccatttcacttaatctgcaacaactttgagacacagcactatgattattctcattttctagatgagaagactgagccagagaggttaaacaacttttgtgtgaggcgcagggccaggatttgaacccaggtgtgctgttgtcacctagtgctaaactgggacacatgccgtgctcagagggcaggtcttcaaggatgcaggtcattggctgtgactggcaacggggttgggggcagagtaccaggccctgggcaactgtttcatgcatctgatttcattttatactcccagcactcccgagaagcacctccacccacagagcagggaaagacactcagccacactaagcagggaagatgtggctggagcttcatgcacccttgggatgcggccaggctggaaaacctctggcaccgactcacagaggacctcattgcctcccggggccaggacttcaccccgtggactgcaaggaactgctgaagctgctgggttgggtctcctttcttcatacaccacagcggaggcccctcctccaagagactccaggctgtgggtagagaggtgctttctctctcatccaggcctctgaggccagagcaccctctggagacttggcatctcctttgtgctcctcacctcacctgcaggtgttccagcaagctgatacccagctctgggctctggaaggaaagaattcccagcagatgcctcacctcaaaccagggtacacggccacggtcctgcccaataagaagcatcctgcagcaagctcagatgaggtcctttgaccttcaaggaagatcagcttcctccttatggagacaaggcttgaaggagcctgcatagctccctcacccaggccttttcggtagactctctctgagcagcagctcccaggatttagtgccaagctctgctgtttccagagctggaaagaccctgcacattcacatctggacaagccagagatagttcatccaaaccacatggcaatcattcatttcatggaagagaaactcacaaagagcaattgcagagctagtaatggcagctgggactcaaaccccagtcctccagactctacagcccaagcctcattcttacatcttccaattgcaaatgagaaaactgtgacccagaaagggtcacacaaagtctccagctccacggctcacaccacatgacctccctccctgcagaagacctcatttcaaacaatgcccgaagatggaaaaggtaaaatgttcttgtgatttgcagctaagaaaattcaggtggacccacactgaaccccattctcagacactccatctgtccaacaatccatatgtcactttttttttttttgagacagggtatcactgtcacccaggctggagtgcagtgatgtgatcatggcttactgcaaccttgacctcctgggctcaagcaattctcctgcctcagcctcctgagtagctgggactataggcacacactaccatgcccagctaattttttttttttttttgtagagacaaggctttaccacgttgcccaggctggtctcaaactcctgccatgatctcccaaagtgctgggattacaggtgtgaggcaccatgcctgacccatattcactttgcattttagttttcattgttactgtgcatgggtcaatgcatttacagagttggtgcagacttttctctcttctatgatgtgccgtccacacatggccaccaaagacacacaaagacagcatctctctcctccttgggcagaaagaccaccttagcctgaagaaaatcagaatcacgctagtggaggcaaggaagaaagaagagggaaggaaggaaagaactatgaaggaggaaggaagactccctttgctgaacacttgtatactttctgtatgctggacctgggataaacaagcccatgttatcttactattagttctcaaaaggaccctggaaacgggtgtcattatctctatttagatgaagaaactaaggttcaaagagcaaaggaactggccagtaattactggaagtgaggctagaatttgactctgaatcagttcaaagcccaaagactttctacaacactgtcaggttcccacctgtgcctccaagtcctagaagttcagggaagtgccaataggctcctggggtctgggggtggggctgagagggtgacctttcttgaagagttctttggaagaatgggctgcatggctaaaaaatatttgaataccaccttacaggcagtctttaattaaagatagtgggaaaaactttcttccttttcttttccctttccttcccttccttccttcctctctttctccttcctcccttcccttcccttccttccttccttccttccttctttccttctttccttcttttccttccttccttccttcctttctttctctctctctctctctctctctctctctctccctctctctctctttctttctttctttcttttcttttgggtataataaacctacaaggaagaggggaatgggataggagactaacagtaaacttttggaagctggaaagagatgaatgactggaagagacagaatcccaagcctgcagcagggaaatctgggaaccaatctgatttacatcccaggatccctcaaagcctctgcaggttggggtggagggaaccaaggtaaggacgattggtggaaagtcttgttagaagctgtcagactcccatccccgccccaactccagcagctcaggagactctccccccacccaccccagagaaagcctggaggtttcttctctgcacaagttgaaactgagcccttttgaggggggatgtcaggcacaatgagggcatggcaggggtgccataaagaaatagtgggggtcgggcgcatggcttatgcttgtaatcccagcacttcgggaggctgaagtgagcggatcacttgaagtcaggagtttaagaccagcctggccaacatggcgaaatcccatctctactaaaaatacaaaaattagctgggcatggtggcaggcacctgtaatcccagctactcaggaggctgaggcaggagaatttcttgaacccaggaggcggaggtggcagtgagctgtgatcatgccactgcactccagcctgggcgatagagagactccatctcaaaaaaaataaatagataaaaattaaaaaaaaaaatagtggggaggaagtgaatgcaatgcatacagactggctgcagagacccctccttcttcccctcctccctgactttttcctgcggcttccagaacatgggaagcagaccctttaaccaagagggagactgagtcttcatagggattgattctgctcaagaagaaaggcaccactgttgaagactccccgacgaaacagccccggcagtcagctatggggaactcgccgtcaaagagcctcactcatcacttccaatcatctttgagcccctccactcttaaacatgagaagacaccaaaggctatcagatgtctgagaaacgagaccaaataaacacacaataaaggggcacttgagagaaacagaaaccacgcaggaaaaaaacctaaaaacagaacaagaacaaagccaaaaacaccaagtaacattaataacaactaacgttaatagccttagagagataagatagtagagtctatcaaacaagaacaggatgccattaaagggacattcaagaaaaaaaaattcttgaaaactgaaaatgtgacagtagaaatcaaaaactccaccttgggaggctgaagagggcagatcatgaggtctggagatcgaaaccagcctagctaacatggtgaaaccctgtctctactcaaaatacaaaaaattagcagggcatggtggcgggctcctgtagtcccagctactcgggaggctgaggcaggagaattgcttgaatctaggaggtggaggctgcagtgagccgagatcgtgccactgcactccagcttggcaacagagcaagactccatctcaaacaacaacaacaacaacaacaagaaaaaactcaatagaatggatggagacaaaaatggagggacgtactcagagaatccagcaaaaaggcaaagcaatggaaaatgtgacagagggtatgaaaatcagagaaaacagataggagggccaaggcctgaataacagcagttccagagagagagaagaaacagaggagaggagataatcaaagaactcaagacattttcttaaagcagaagtcccagggtcaccagactgaaagagccactgagtgagaaaactgacccacaccaagacccatcactgtgagacgtcatgttctagggttgtagagaagatcctaagacaggaccctaaagaaggcaacaggactgagaatggacttggagcttttaagagcaacccaggaagttagatggcaatggagcaatgtcttgacaatactgaaggaaaatgatttccaccccagaattctatgatagatttcaatctactgcaaaatagaataaagacatttccagcattttcagatatgtgaaggatcaaagtatttccctctcatgcatcttctctgaagaagaccacactgaaggatggtctctgtaagatgaggatgaaaaccaaggaaaaggaagacccaaggttctggaaagagaagacccaacacaggaggcagagaggacctccgggagtgggtggagggagctcgctggatgagagtgcaccaccatggagaggggagccccggggcagtcaggagccaccagacaactcagcggagcccctgcctcagcaagacaagatgcacagagcgtcaggtgctgctgaacatctccaatgtcttgaggggaaatttgggtgaggcgtgaatctggggttgaattagtaacaaatgtatagaaaacaaagtgcagttaagcacacatacatacaatgattatacacagtgaaaacaggaaaggaaagtaatcatggtttactttatggcttggctgtgaattatttatgatacaacactaatgagaggatagggaggtggccggaggtggaatgcgaatggcaaaggctttggagcctgcagataatgctgaagctgagaagccaagtcatgggcaacccaagcacattatgtagagatatggcaaaccaagacaatctgccaaaagagatgaaaggtactgcttctgggagtggtgaccggtgggtgggtgggggttgggcagagagaaaatgtggggcaaagagaaagagtactgctgtttcccacaacaaaatctatggaaatatttgactctttaaactccagacatgtgtaactttgataaaaactgaaagacacacacacacacacacacacacacacagagagagagagagggcaagcgagcacatatgcctctgttctctaagaagctgctttacccacaggagagagacagagagaagccagcttcctcctgggagcccagcctgattccccaggacagaaacagaggccaggatccaggcagacagtgtccaggaccagaggatgctacatcctcgttgtagctctcaggggactaccaggggctgcccgagacccccctacccaggaacctaaggctgtacccgcttgaaaaaaagtctccttttaaattttaatacgaggcaaagagatcttccctgacagggctcagagctctggaaggctctgggtccagcatactcagacactcagtctgcccaatgatcaatatgtcttttttctttccacttcgcttttcacatttttttttaaccatccatgacttgggtttcacagcacatcatcagttgtctctgatgaccggagtgagtgttccctgggaagtcctttgagtcctcagaggaaatccagaaggccagcacagtcaccctaactagaccaacacaggagatttttcttgaaggatcatctttatggagtaacaacttttccaagagtctaagtgattttctgggtacagaaattttccactctggtttcaaaatagtcattcacaaatgcatggtgggtgaagacctcaagcccataggtggcctggaatagtgaaaagaggcctggaatggggctgagagaatcctccccactgcccacccccaaaccagcatcctctcttcctcctatcatgaccagggaagtgtcttcttctcatcaatgcccctgcaggtccccagggctttgctcctgccccctgccccttctctccttggcatcatcacctgccccttgctagaaggcattccttgcagcaaacacacatgaggacttctcagttcaaacacctgtctgctccagctcacactccctccaggcactgcttccctgatttgtgctgctttcctccacagccagtctcttaggacaacgcttacacaggcacctccactcctcattttggcccataccatcagggttccatcactatggaaacagcgcccatcagtcaccagtcacctgcacagggccctgttgaatgggcacgtgccacatgcctgtcctcaccgggctgagcctccttcctccttgaacattctcttctcttggcatccaggattcacacttggctgggtctcttcctgcttctctggcgattcctcctcaatctcttctgcagcagtgtgtctgtctgccctagaaatgctggtatcctgggatcagtcctggatgcctttttcttttctttcttctccatctcccccaagatggcccatcttggcccatagcactaaattgcatctatacactgacaactctgaagagtgtattcagcctcaggcctctcctctgagggccaggctcatctatccaattgccaaatgtctccctgaacatctccacttggcctggcatctcaaaagtcacatgtccaacaagttttgatctccctgtccccagacctatttttcacttccctcctccatcccttctcaccccataaagggcaccaccatctactcagtggttactacaagaaatacggtagtcagtctcaagtggaggcttctctctcagcctccatagtcatcagaagtcctatagctcctctttccatcttcactgccatgttcctggtctaaaccattgatgtctcacctgggctttcaggatcctgctcttcgtgctgccctgacaaccactactccttcccaaagtctgggttatattccccaggagagagggggcaacaggatttggaggtataaagaaaaagaggaaatagcccagtgtgggctcatgtgatgggggctggacacttcactccccagcccattgggccatgctcagagctgcacatctacatttctggggagaagcctgagaattaaagagagagcaaggtgctgggcctcagggataaggcagggccctgatagcctagacccaccccagaagaagagcagcccctcacccagagctgagaacgtaggacccattttctcggcttctagaacacaaagggctctgctcagagaaggccctggcctgggagctggcccacgagccatccctttctggcattatgtatttcatttttaccttgaacacctgcagagcagaatggtctgcaaggaagagtccttggctcccaaccccagagcctgccccataacagaggccatctgacttcaccttccccagaccaagcctgccttcaggctgatggatgggttctcactggcctggtttcgccttcgttgtgtccttgatccttcctgagacccagagtctcaattctgttcccagattctaagagctgcagagttcagggacctgccctctcacccaaggtctcagtcaatcctgagcacattggaggaagattccttcatttaatagatattccccagcactgcctatgtgccaggcactattctcagcactggggacacagcaatgaacaaaacatagttcctgccctctcacagagcttacagtctggtggaggaaacagaagcacactagtaaatacctggagaaaaataaagcaggaaaggaagaggataagaagtgccatggagtgtgcaaattcatcgtgggtagtgtgggaaggcttcactgaagggtgatggagagaagtgagggggccatgagagtctctggaaaaagagctccaggcagagagcacagcaagtgcaaaggccctggggcagaagcttgtcttacaaagagcagagcttggccaaagcccagggagcagggcgagagccataggcagaggtcagggaggagctggagccggcacatgcaggcccgtgagggcttcgggggacacggcgtaggagcggcagggtgtgtggaccttaacaggatcactcttgttgggctgagaacggaccacagtggggaaggtgggagcaggtgactgtaggacactgtgatcacccaggtgtgagctaccagtggcctgacccagaggttgggaaaaatgggcagattctagatacggtttcagggccaagctgccaggatttgctaatgatgtaagacagagtggctttcggtccaagcatctagaaaaatgaaactgcctatgcagaatgtccatcttgcttaactgaatgagtgactttgccgctctccttcagaagatgcctttccccactgatatggtttggatctgtgtccctgcccaaatctcatgtcaaattgtaatccccagtaatggagatggggcctggtgggaggtgactggatcatgggggcagtgtcttatggtttaacaccatcccctcttcatactgtcgtcactatagtgagttctgagatctggttgtttaaaacttgtgtgacacatccctcccgctcttgctcctgctccagccatgtaagaagcacctgcttccccttcacctcctgccatgattgaaagtttcctgaggcctccccagaagccgagcagatgccaggagcatgcttcctgtatagcctgcagaaccatgagccaattaaacctcttttctttataaatttcccagtcttcagtatttctttatagcaatgcaagaactgactactatacccatctttgaccacttaaaagactttaaagagatataaagcaagtgtgggtaatgggcacagtttgtctacctatgttatacatttcccaacctccacgccaccaaccctcctgtggtatgtggttttgctactgtttaggttcttagagtggcttactgactttattttttacacacctatccaaaaggctccaacttattaccacttatttaattcatagtttaatcaatttgttccccaataaatacacagaggtaacacatattcccaaagacataattctaaatctggagttcacagcaaaatgggactaggcacagcagatgattaggctgaaaatcatgctacacttctgggtttcaaagtccaagaagaaatggatttgtaaaaaaactattagaaaagaaaataatctttagattttttaaaactaacactattctctccaagctactatttcatgaaacacacaggtatgtgtgcacatacacaggcacacacacacacacttcaaaatgtacaaatgcactgtcacaaaaacgtgctgcgtacactgcatgaactcttaagacttggataaaaattaattcagctatagaaatagatgagatagaaaagtacactcgttaaaaatgtaaccccttcaactggaacagtaatgaattaaataaacttttaaaataatttctttaaggaatgtcaaagaggcctgagacacagttctgcagtatgcgctgtgctgtggacaaagggtgggttcactgatgtgcaggtggaccgcctcccagatacgaagttggatgcatgacccggagttcagaggagaagtccttggagatagggatctgagtgtcatcaacctgtagatggtgtatagatcacgttgggactgagtttagaggaagagcacggagcctggggctgggccatgtggagccctaatgttcagagatcaggcgatgatgggactcactgaagatggtgagaaagtgtaaccagtcaaggaagaggaggatcaagaaagaaggtgatagggtttgtctgtgtccccacccaaaatctcatttgaattgtaatccctataatccccatgtgtcaagggagagaccaggtggaggaattgaatcatgggggcagtttcccctataccattctggtgacagtgcatgagttctcatgaaacctgatggtttcataagcgtttggtagttcctcctgcatgcatttttccttcctgccaccttgcgaagaaggtgccttgcttccccttcaccttccaccatgattgtaagtttcctgaggtctccccagccatgtgaatgagtcaattaaacctcttttctttataaattacccagtcttgggcagttctttatagcagtgtgaaaacagactaatacaggcagtgtccaggaaaccaagaggacaaagtcctgcatggacgagcgaaggattgactgtgtcaaatgctgccgatggctcaggaaagaatagaagtgagaactgactactgacttctgcaaggtgagggtcatcattgacttggataagagcagcttctgaggtgtgaggagcccaaaggcccaccttgaataggtctgagagaagccaggaggaaagatacggaggtgagcaacacagtcaccttcttctggagtttttctttaaaggaaacagagaaatctggcaatatggcccttcagccaaagtatttttaaggtggaaaccttaagtctgggtatgcttaaggagcactctcctggcccaggagagtggcaatggctggagtgaggtactggggtaggtgaggtgggatgggagccaatgccctcccataggaggtgcagcagctgagtcctgcagcacgcagggtctggcatggactcctgggatctcaccatctgaacttatcattcccttcggacataagccccaataacacaccacccaactgggcttggtcagccaggtggttcctatcaattccagtctcttcctcttccgtgtaagcccactgggctgaattcccagctttccttgcaataagtgaacttgagttaagacaatatagtcattactctcaaggaacaacataactttgtgtgtgtgaaaacaacactgcttaacaaaaagccattctaaacaaccaaggcaaatgcacaggtgctgggtgagagagccatcacatccctgatgggcactcccaggggctgcctggaaaatgcgggctttgttcaggtgtggaagtgatggggaatgcagagggggccatgtgccaggaaactagtgcaataaacagagactgatgcattgtgtgtgcaaagcattaccccaggacccaagtcaagaagggacttgggaggagacagaaatggatcttagcaccagtgttatgacagaagtaacacaaagaactacagagtgtggagggatttgggaggctcgttagaggagcagggctgagtattggcttttgaaggctgggtaggatttggcaatggcagggcccagcaggcagcaaaaggtgaagggcgacaggaacaggtcagattctgaggccagcactcacaggctgagtttaaactggatcctgtaggtgaggcagccacagacggctctggagaaaagcatgacacaggcagaatcatgtttagtgatgctcagtggcaccaactttggagttctagagatagggtggccagagcagtggcagagggagtaaagagaccacactgagtcactgactacttcatgcagacaccaggattggggtctaactggaaagggggagaaggcgtccaagacaatgttaaggttctgagtgtgaagggctgggtgtgtcatctgagatctggatgtggaaggagatgctgttggtgggaagtggaaggcttggtttgcacatgctaagtgtgaggtgtgaatttcccaggcaaaaatgctcaggaggcatcaaaaccagtgtctgcagttcaggggtgaggtcctggctggagacccagatgtagcaatgtcggcacagagatgaggcctggggctaaggagatgggtgacactaccaagggagaatgctcaaggcaagaggaagtgagtctcactgatcaggtatgggagctgccatcacacctgtagcaggtagactgctgggcagcgtacccttcctctccacttgtctgggtctcgcccaccctctgggcccggccccacccactccgggaagccctctctagctattccatcccccaggcatccttcctttgctgtgagcttctcagctctggccatccccaccttagcagtgggtcttgtgttgccaccttggtgtagtccccaagcaccttgagggcaggatgacagttaacccccatgggacactgcattttctgacacagagcacccaaaaggcactgattaagtagatcctcctccctgatgaattaataaattgatcagtcactgaaatggaggtcaagaaagaaattaaggcaagtttaattagagattaaaagactcatatagcatctactcttttgtgtctggcttactgattcatgatgaactaggtctacatgtatcaacatggatgcacgtcaaaaacactgttgagtaaacataacaagttacagatgtatgttaaaccaatttgaatagtcatgagcactatatctaccaaatatttcaggttctcccaagcacacggtaggaatgcacttctctactcccatggagctaggtgaggccatgtgacttgctttggccatttaaatgtgagcagaagcttctgggtggaaccattgttttcttcttcctctctcagcctctactggcctggatctaaggaacagagctccatagcagatccttctcaaatgtgtacaggagtgaaatacatatgtttgttgtattaaaaaagaaagaaaaaaaaggaagaactgagtctaaggcaaaactgtgggattgcagaggagtgtgcccagtgattctgggtgtgggcactcttggcaatttgggggaacaagaggttgtaaggctggtggaatggaaggtcagcatctctggcctcgtccctgaaatgccagttatgtggcaaccaaaatgccctccccctccttcaccatttccaaacactctgcggggtgatgccagccccaagagaaccatgaatgtagaagaatcaccagaagtgagagtgggaggcatggtcccagcttgagatagccaggctgggggaggaaaggatctgacactataatcagttccatacgtgctcaaattgcatgtgacaagttgaaagggagaggataccttccatatctgacagaacagatgggactgtcccagacagagattgacaaaatggatatactagtagtaaaatgcaccaatgtccattttttgagcagctatgaattatagccttcatatggggtctcacaaggtcctctgaaaatcccacatgttattttcccccttttacaaatgttattctcccccttttacagataaagaaactgagggcgggagagctggggggctagtctcaggcagaacagaggtaagtggggcagagatgacagaactcaaccgagaggattctgaagcagagcaggtgggactaagtgaagacctggaaggaggtggagagggagtaggacccataccagctggaggaagagaagaggacttgtgggtgatgttccccctccttcagccattgcagaccgtgtaggtagagacatccagcagggagctgggcacggagtggctcctgccagctgcctttctggaggctcaggcttcctgaggtctcagagcacctgcctctcagggaagatgcgaacctccccgggcacacacagactgctgctggggcaagctcctgggacaccaggaaacactcagcagccctcagagaccacagagaacctctgaagcaagaaggaagagggccagtcgctgtgagcaggcgcttcatcaatcctgcctctgtgtggcctctaagggatccagtggcatgagaacacagagacacacgagggcgctctaaccaaacagcaggaggacccgcgtccctccccacacggaaagagggttggcattttcaaagacctttggttcagtgttttttcaacgcagctgctattggtattttaggcagtaggtttcaggggcatttgctacccctggcccccttcccatcattgactaccctgctgcccacatttccaagcaccctctctcctgagagcccctgctggtcagtgccaccagaagatgccaactggtggccctggggagggtggcagtctctgttgtcccccaaccttatggaggactcccgtgcctcccacgctgaccctgtgagttaggcgcttgcaggtgctagaggatcagaggcccccagtgacagccatgttggccccagctcatggggactgtcctgcacaggaagcgcattttcctctacgttgttgtccttcagggctgtgcaggaccaggccaccctgatcacaccagggacacagacacaggaccctgagacagaacgccatgggacctgctcacagacacccaaatcccaggaagcaaacatgtggccacacaaaacacagctggcacaaaacttccacaaagcacgtctgaaacacggcacccttccagagcccagacagtccctgaagctgtgagctctgaaacgtttagaccattcgtttcccaaagtcaagcatcaaaggtgaataactatgaatgagattcaaaatattcaccaaccattgagccctgggccccagccagtcaggatagggaccagtggaaacacctggtgcatacagtgtgcagtcagccctgcaaacagcctagtcggctgagcccaagtgccccatgggaaaccagacatgccaagatggccattgggcagtacagagatgacttttggagaatacatgtcaagagagacagaagtctggacatttgctgggatactgggatggcaactccaatgcaggaactagaaacctggccaggatctgagaaaatgaggggctggagaaagacccagacctctccagatcctcaacaaatacccagcatcacccatccccaccaagaagccccacggcattcttaaacagaggggcctgagagtcccaggaaggtgatgtctgctgaaaggcatcgctgggaccacagggcacctgtgggcagagcccttgccaactgagccactgctgcccgtgaacaccaatgggcaccagctcttattccacggaagcagacgatggaaaccaaacatgagtcttaccctccttcgaagattttgatcctcgccggctcccctctctgggaggcaggagcatcctcctccggctcccctctcctctcttcttccttctccactctagctagatctttctggccttccggggaaaccagtgaagggaggtgaacctggcccaccgcaggaatgacaaaatcattgctggttaaaagtgcatcctcagtcacgaatgcaatgctaataatcatgccttacacagtactgcacaagtacacatatgcaatcttcacactcccccatgaagaggtgctattagctccactttacagaattaaggaaactgatccccagagagaattcccttatccaaggccatgccattagttggtgttacagctggaaccctgtctctttcatgttaacctcccataagacctgtgtttgttctctgtcttttacactagtctgggaactcctggggacaggtcctcatcttggtctccttgggcaccccagaaccccatacagggcctgtctcagagaagaggcttaaataatgttgaacacatgaacaaggctccactctgcctttggagatgaactggtccagttcttgtttatagatcagaaagctaaggtcacccagcgagttaagggcagagctgggagcagagcacaggtctcttgcttccaggatcttggccctcctgagctagtaccaaaggccaggagctgggctgaggaccctgaccagcaggacgtccccaattccaccatagagacaggcacagagaggctgtgcaggctctgggctgttagtcctgcaggacccacgctctttacagagccacacctcagtgatgagagctagcttaaggggagagctggcattggctttgtgcttcctggacatcttccactatcccaagaacacgtcctgtaaacactgcagtgttgtcaggggtgggtgcacttttgcctagggagcagaaatgctgtgcttaggggctgggagtgagaatttcctcctacttcatgccactgtcattaaggtcatgaaaaaccatgctgtttccatccagtgaatgaagcaaccacatttcctgatgctggggcaatctaagaacggcagtcccctttgccagccaccacacctgcccccacaaggacagcatggggctaggtagaaaggtgactggctgggaatcagggagtctgagttccagcaccagataggccatggcacactgggctgccgtttggtggatgacttcacctctctgggcctcagagtctgaggggatttagaccatcttgaagatcaattccagggcaacttctgtgactcagtgaccaccaaataatctcttcagatttggaggaggggagtggaaaccgagcaagaatctggactgctgctttggcagaaggcagctagttttctgcaatacccttgggtttccagagcctaccatttccactgcaccccggcctgagatctagactgtccatgtaatgaccaaggtgcctcccacaggcaaacagactacttctccctcacagcctgccgtgatatctgggccacactggaggaggctggtttgggtggcagtgtaccactttcccaggaaacacagtgttggaactgagcagggaccagggatccattttagcttttgatgacaacaatatgaataagtatagttaaaaatacttactgagtgccagtgtggcatacactgttctaagcacactccgcatgtcttaactcatttaattatctccacagtcctatgcgctaagtgttattattatccctattttacagaggatgaaactaaggctcagagaggtgaagttattggcccaaggtcacatagccagtaggtaaggtagtgggattcaaacctgggcaacttggtacctgagtccttgttcttaatcactttgtgacagtgctgtgttgttgtcaaaatgattcccaaggaggaaaaaggaaagaatgtggctacaaagtggactctgaacaagctggggtttctccagggtttatacgtggaagaaaagatctatgaccaaacaaaaacatcatggggtgtcctagacctgcatgaagatggtttggaagagcttcaaaatgctaagatagacctaaggactttttcagaactactaacagagaatggaagccgcaagctgacaaatgtcagctcagtacagtaaagaaccttcttagagcactgtccaaagatgaattggactgcatcatgagatggtgagttcctcttgctggaagtatgcaagcagagaccagagagaggtgtagttgtataaaaggccttaagccatagaccatgtggttatactaatgtaccagattggtgcaattctggaaggaaacatgccagtgaaccaaacagaatattccaagaaaaagttcgcaggttttaggagcactataaataaataattgccgaatccaaattaacacttcctttctcttaaatggcctgtaacattttcagtcattagaaactagaggcagcttagataattcaaaagggcattggagtaaaatctagttttgatctaggctctgccatttactgtgtggccttgtgaaagttacttaacctctcttgtgttttggtctcctcatctatgaaatggtgatattgcaccctaactttcaagttggttgtgaggagaaaagtaacatttagcatagtacttggtacataataggtatccaaaaagttagcagtatgaataattataacagcatcttgggagtggccacagctagtaagagacgctgaagaggaaattagcaggacattaacacaaaagtggaaatcttggtcagggatgtctgtagactgacaaagacatctagggaataaatttggaaaacagttctgtgaagaacatccagtcaagctaaggacaaattcaatgcacaaagttcactgaatgacaaaaggggaagatatgagagcacaggaaattatagaacacagttgtgctcacttatctacaatatgaatttggtttagggaatttagacctaatttggtcagagcttctggtctgaagacacactaataaacattttttaatttgcagtcaacttttaagattttctctcctcaaataattaaaagaagaaaaatagactctttggagtcagataggtctgggttcaaattctgggtttgttcaacatttgccagattatcttgacctttctcagactctgaccctcagttccctaagctatagaagggagatggttatgttacttcagaggtggaggtgagcagtgaccagattcaagggcccagcacagtgtctggcaccatgaggctgctcagtaaacaagaccagctgttattccacaaatgccaagtcagcacaatccaaatccctaggctggccttgtcagggtatggtggtggcttttgtctgacatttgaaattattgaatttcaaacttgctgagctttcaggggacgagttcattttatagctcctgatgtagcctcagatcaaaggcaatgaaagcgtaaacattagcgtttcttgaccacgtagcacaaataggtcaaactgtgagtggcattgccatccactggtaaggagggatactgcagctcagctccatttgctgtcttactcccagaaaaggaagaaggaatatttcaggagttgtttgtgccaaattctagaatcttggaaatgggaagatttaaagtggtactagagaatggaaacagcagatgtaagaattaagaaaagcaggaaaagactaacaagacaagggatatccatataatgaaggagaggtaaaaagttctaaaattgctacaggcattcctgttagccaagttttccaactcagtcttttggaaaatttcttttttttcttactgagactgtatctttgatttcacaacagaaattcatggcagagcaggatcactttatggctaactttattgaagtgtatctattccaatgatatgagggatacagtgacaaagaaactcaataaacatgtttccttgtaaggtgaccagtctcagctttcagagaggaaatctgactactagtctggctctagttctgcaactggaacctgaggatactgtggctttaaaagctcgccaagtgcttttgcaaatcagtgatgagaagaaaaacaaggctgaacttacctctgtcatgcggggcttgcgggagctggatggcacaagccttcctgcctcaggatgcggagctgtggccatggtgtatgtctctttgctcactttctgcttagacctcaggagggacaaagcagctttagtggaaacccccggaaggttggggttgtacaaacttatgcaccaaccagcgtaaacagaggacctcctatctgcatgctggatgtgatttggcttaatgtagtttaaatagcaccaactgacattagtggttgtgtggaggctggggaactgcagtaccttctttgagtccgtaccttcttgtgacttggctggtctggaggacgtttctgacagaggcagagagctcggaggtgccaaggaggggagatcaggttgttccttggaatcttctttcttcacgctcagtggggtcaaccctcttcggtgaggtttgccagatggctggggatattccttcaaagcttctgagcctggggctgtcccatgggacaatgcagggtgagggaggggaggaatttcctttgtgtcagatggatctgaggacaggctggacagcatttctagctccctcctgccttggccctggttgcctaagtgggatttctctggcctcttcccatcctcggtgctggtaaggaccacactgcatggttttaccagctcaagtttttcatctgccttggaagcctcctcctccttcactcttttttgctgctgggtttccatggtaagttcaaggctgccagctggtgaaaggacacgtttgcttccccctgctgttgatgaactcccctccaggctcaagatactctctgatgacagggaagtgccttttctttcaggtaatgtcacaggcactctcaggtatggagttgggaaagctctgctttgctcttcacttaacccagaagggccgggcccaacctcatgcacatctgcaccacatacagtcgtcccctttgatgggggttcctcaaacttgggaagtgccacagttgctgagctgccttgggactgggtgaccaagatctgggaaagggtggtgtacattgcgctcccataggacggcatattggtctgaacacggacaggcacaaccagggacaccatggtgtctggacaggcaggcagggccagtggaggagctgatgtaggtgctgaggagctggctgggggagccacagggggtagccggatgtcactgctgtactctgtgctgggggagaggccagcacttcctgttgccagtggggccaggctggttttgatctggggcagatggctttccacatcaccagggagctgaagtgcaaactgggattgcagaggcaggaaaaacccagaagacagtgctgaggaggtcgggtatggcatggggaggaaggaagggggctgcctgaaggggatgttggctgggtgaggcatgagctgggggagatggagttggcctgggtgcagaacagtaggctggagaggaagcggtggggcttgaaataaggagggaggaagtgggggcatggagtatggtgaggacaggaggctggacatggcctgggtggagaagaattctggagactgtcctggctcatgctgcacgagatgctggaaggagaaaagggagactggtgggggcaggtatggcttctcatgcaggggtgtctgggcaacggggtggtggaacacttgcagtgcttctgtgtagggcacagtgggccccaatgggggcctgtcctgccctgggcccttgcctcccgggggtccaccatgtgaggtggccgcagaggaaatctgggacaatgagcttttggcagagggtttactggatgagggctgtggttcttcgctctcctgtcttcccttgggggcaacctccaactcagattctggaggcctgctcagagaggcctgtctcaccaagaagcattttcttctctctggcggggccacccgcgctggtggagccactggggctggagcagaagggcctgtcaaggacaagctgccatagtcaaaggatttgctgcgtgtctcggtcatgtgggcagaatgggaaacgttggggctctgctctgaggctgacctccgcatctctcgggcatgtgggtggtggctggggacagtcaacatgtgggtgcccaggggtttggggcgcatgtcagatgagggactgggggcctcggctttcccatggtcatccctctcaaacgaggctgagcggctggacccactcaaagagacattgctttcctggctcgggctgcgagacagaggcacagaggactcgaagctggactcccctgatgattgggccatctctgccaggcgcaacctcttctttttgggtggcagcttctcagctgggagctgggcaagtgtctggctgcgctggggccattggaactcctcagtcttctcaggttccttagggggcggctctggctctgtgtccggccggtcaggctcctcagttactaggatctcaggaacctgaatgttgggctggcggaccaacttaggctgcagggagtgagcagagcgtccgtgtggggcaggtgggggtgatgggaactgggccagaggtttgtcttccccttccaagccactcggctgctcgagagaatcagatttctcaaaggagctggtgtgctggatgacagaaatttctttggacgttgttctcctctccttccctgattctgaaccggaccctggcttgggagtccttggctggaagcccgtgggtccctccaaggagggcactgatttacttggttctgctggtgacttggtggactccaggggaaggttccgagcagcatcagatggcccggggctgccaaactgactttttgtggactcaaaggcaggtggctcttcctcgtccccaaggctcttctctttcctcctcttcctcagtggagtgagttccagggtggttcccagtttgtaatgcatcatttgggaccacggctcatgctcaatctgactcttttcagcttctggagatgtgtgggtgcctgcagagatgggctttgcgatctgaagctctgagcagtagtattttttgtgggcttcgtagttatcccttttcttgtaccgagcaccacatatgttacattcgtagatcaccccttttgttttcaaacccttcttggtctttttggtaagctcgctttccttgggttccacttcgtccgagggcttggaggctgtgtctttgctgcttgggccaggctcctcagaactgtattcccctcccaaaggtaattcgattgccggctggcgcttcagcatccgggggtgggaggtaaacacgtgactgctgtggctcagggcttcggagtcggtgatatggtcatcgaaggagtagctacctcggaaggggtggtggggggtgctgatagtgcaggcggcagaaggcattgagtggcttctcaggagaggcacagggggggcggtactgggcgggtgctggaggctcagcagtgattgttcaggcttggttttctcactgtgggatgacaggggctcccggtagaggctggattttggggactccatgctgctgcgcctggacagtgagctccgccttggcttcacgctgtcgatctcgctggtgtccaccacggcctcgttgatggtgatgagcttcgtgatgtgctcgatcacctgcgtccggggtacagacaaaggcaccaggctgggcttgtcttcggtggacaggggcaggaggggctgggtggaggtggctgtcagcatggcggtccgctgtcctattcgcccacacttgccaaagatgatctcagcgtaggacttggcgttggtgtttggggggctgacctgctgctctgcactctcggagcgagagaaatacccagactcagtactccctttgctgcctgggctcagaaacgcctgctcatcgatcaccttcttcctctcgcttaagcggagggccagcttctgcttaatcgtgtgggtgtcttcaggtttatggctcagggggtgctcagatgagggttccacaaatggaggggggtcttcgagtgactgggctgtgctggactgggacagggaacagcgttcgtggctggaactgtggctcccagagctgtatagcccgctggagagaaggggctgcttgggtcttggggagagctctgcagggtgaccagaggtggcactagtctcctcttcagaatctgtgctttctccctcagtgggctcctcaaactcttccccagggatccgctccatctccagcccatgtgggtacatctcgccacccatgcctgaggccaggcctgctttgatgcggtgggcatgggacttcctgtgcttgtagagattactcttggtcttgaaggagaagccacaggggccgcaggggtagggcctctcacctgtgtgtgagcgaatgtgcttctggagcacgctgggcttggcacagggccggctgcagtactggcagatgtacttgcctggcttctggggcttcctctccttcttgtgtgcctcttctgtgggcttcaaggagacctgggaaggacgaggcacgaagactttggggactccaggaaggtcctcggggggaatgatggaagcgtgggaaggaaggagctggctctgaggatggagcccaggggccacgaaggagccagagggtccaggtctcatggggtcaaccagttgccatgtggacccctccaggagatgctcaggtttgccaggcgacatgaatgctggtgtcagagggtgctgcggaagctgtgagatgtggacggatgcttcgatggggggccttttggggggcttctgctgctggcccgttttctcctgagagccttccctaagaactgatgaggggcccgggaagggctgcggggctaagagctcttgggcggggctctcttgggtggcagctgtgccgctgcctgggtatgggacgctggaagaaacactggtctgaatggcctctcctttggtcagccgcttccggggacttccctcagccttcttggtgcccttgacactttgttcaggatccatgaccttcacaaagacttcagatgctattcagggagagtcagggcgggctgcatttatgaataatcccagtgtcccaaggaggtgtccagctttggccacattggtcaagagctgtgggagccaaacccaagacggctttgggagttttttgcaagtgtcactggctgtgagtggactcggagcaggtcatcagggcccacgctattctattggtgaggcatggccctctactttgcagacagaaaacgcaccagcactttctgcctgaatgtctgtcgggaaaacgtcatgaaggatgtcagtattgccattgtattgtttcagctggcagtggcaggtggcccccacgagtcccccgtgtgctatgcaaacggttgaaggttggagacatctgtgtccatggcccagtcatccctggtcctggcacaagagatgccacgctggatgctgggggtggctcttctcccctttagttctgggttggagatcaacggccttggaggagaaatcacgctcttcttctgtgtgatagatgtacacacacacagaaatacacacacacaaaagagaagacagagttactgggactcatgcacagcctgggcagcccagactcggtgccacacctggctgagacccctcaaaagttaaccagggaaactcaagcagaaccacaggctccggctccacatgtccaagccctgcaattctttcctcccccgctcccatgtcagtgttgggtgacctgaatgccagtgtgtttctgaggactgtggccatgtgggatgctgagaacagaaggcaaagtgggctctgggaactgcagggtggttagggacagaggcctgggctctcatctctgttttgtgatccactctgagtgggtctaagctctctaagcctcagttgcctaatcggtaaaacagataacaaatcctgcctcgactgtgcctcggagctgcagtgggcccaatgacattggagatgcagatgctgctgggtgaactctggatggggccatggctggtgcaggagggaagtgcctgtggtttattcaggggtgagttttccaaggggtagattattctcaggttagtatttctctctggccctgggttctgaaagtgtccacaagggacatcattcactgctttttaccccattgctaacccgcaccccagcccatgtttgaagacaaaactgcaaactactgccacagcctgtgagaacttacaatctgacacagctgtgaccatttgcttgatccaagcaattgccaggaggatcattctggaaggttcctctggctttgcagcctttccttgtccagtcagtgccctggggatgccatggaaatatggggatcattgccctcaagtggaggagcaaagttggtctgcatatagccccaagtgtgtgcctcctcctagggccagctgcaagcagggcagtctcagcttcctgggctcaggtgcatcctcagggccctcctccccaggaacagggtcggaatcccaaggctggagtcaccatggactccatctcacccaaccacctgactttggacatcatgaagatggcttactgaaggtcccgtgttgctaacaggcagtgttgccacctggacccaggcctcccatggccagagtttgttccccagccccttctcaggtgtccatcccctggcatcccttggcgaggccctgggtgagtgatgagcatctctgtgcttgctttttctcctgtgagcatgccctacccccggcatcctgccctcaggctcccctcatgctcacactcttcgtttcactaggtgtgtgatgatacagacttgaaaatgccacttactacatttttgcaggtgctcagaagacgaacaagtctttaagactcaaataattgtctcttaaagggcagggccctcggacactgtgatatgctttggaggagcaggtgatttgatcttttagctaaaaagcatatcctctaagttcactccttttgtgtgccttttctacttggtgctacaaagaattcaaagtaactataacaaaaccatatttatagaagaatgacaaactataaatatgagaaaatcataaataagaataacaaatcagaacaaagaaaatggaaataaggcaaaaagtcaggattggtgggataaaaagagtactgctataccaataataaggacttatggtgtttctataattcagctatatatttatatatgagcttcctggcagccaaggagaaaagggagatttggtccattatggagtcttatagccagacaggatggaacatctaagtttcttgcaaaactttttcatgtagcacttcagtcaggagcagtgaatgatgcaggagatcatttatgtcttcaatgacacccctctggtcattgaatacagtgacggattcaatgacatccctctagtcattggatatggtgcaaatacagtgattgatatttgtcaatgaaagactgtgtatcagcagagattctcctatgagcagtcaaaggcctcctgtgacttgtaccaaagcaggctgagtgtggggaagacagacaaatctcatttcattagattacatctcagtcaacagggtggccatataagataccatccaaactgggacacttggagaatgaaatgggaactactaacagtcatcgaggaacaacaggaataaacaaagacagtcccaggcaaaccaggacaaaatggttacccttacaattaatatttgccttacggccaaaactaggcataagtgccaactgtctctgggtgtctcatacatacttttgatctcttctatggagactaaagttacaccgtgatcttctgatagattcttagagactgactgtctagtccattcctctcacttgacagaagagactgaaggctagaaaggtgatatgattttccctgaaaatcacacgggaatggtggcaggactggaccatcctgtgcctcttgaccccccagccaggactgtctcccacctcaattaatagaagttctctgtggcttctgtggcatgatgcgcactgcagtctatggcccctagtcctatggaagcaccggcatggccccaggggacatcgctgtatccacggcaagagggagtaaggaattgtctagcatctgaacaatagagttgccctttcaacctatgtcctaaccacactgcagctgctggacagaagaaaggggagcccagcaaaggtcggggaactcgtcctggcagccttaccccaggtcttgcttacctaagctaaggcgggcagaagtgctgagccttctaaaaatcagacatggtagacatggtttgcagcacagagagaactgctctttgggctgggctgggcctcctcagcctggctgcactgtgatggagaggcctttgggtgctatgtgtggataatcaagggttggctatacttactattcttattgatcctttcatgcaaggatctgagagcagccccaaaacaccagctagtggtaagctttgcttcttccgatggatggatgggaccctgcagcatgactgggtggtgaaatgatcaatctgagtgggggtcagctggccaggcaggactctacattgcttagtcctgccttctcccctcactgagccacaaggctctccttggcaggtggtggagcgcccagcagctggggtttggtgcaattcccagggccaggtgggaggggcagggtagatgaaggagacagtcagatgactgctgcatcatcagatgactacagggccagcactgcctgcccagggtcagtgtccagcctgcacctgtgggctggacatggtgtttctccaagcagaggcctcctacccacacttctgagtggggagcaaaaaggccacaggagcaccgttggctgccagggcgcagagtgagcgaggcctgtgagctggaggggccaccctgtcattctgcacaacaggcatctgagccatggtggagggtggctagcccaagccacactggggcttggacttctggactagtgctctctgccagcctgctctaccacaccatgacaggtctgaagtgcttaagaggaggggcagggggagaagggcagccaggaccacaggtgcagatgtaggggaacctgcaggacctaaggagacttctgtcttggaatggattccaaatgtggtgcggcataaaccgaaggaccgttctaatgactgtgaccaacagacactaagaaaatggttcttttctaccttctgtggttctgagggtatgtgtgaaattttaacacaaacttgaagtgataaagaaaagagccacttttccagggaattggtgagagcacctgtaaaagtcaccagagaaatgggcccaggagctgggccaacagaggcctgaaccccagaccagaagaggatggacagcctctactgatggtcacagaatgggccatgaggccagtgagagctctcgctcagagaccagcttataaccctgaggggaacctgagcttcagcagccaactggttagctcccacttcaagaagcttcctttggtctagctgtgggagcagcccaataggaaggagatcgggacttgctggggttggagccacaaaagcctcaggggagtgggaagtaatggaggagcccggggccaaggcagggaggcctgaagctctggaaccaaactggaaagcaccttctgtatcgaaggcgtcaggacaacatgaccatggcccagggtggacaccccagaggacatttccagagggcaggtgggagatgggctctctcaggtagacaattccaccagtcctggcaggaggccagcttgaatctgccttgggctctagactgaggagctggggtccccggtcaaagttagataaggctggggcaagataggggcaggggcctgatgtccaaggagctgttaggctaagctggccccaggctggtggggcttaatacagctctttgcttgtaatttacttacacacacacacccccacatatcccaacatgccaaaatctggtcaaaaattttactggcagtaataaaacatactgatgtcaaaaatataagaaaactttcctattaactttaatacctgggaacccagggcacaaggccacaggctgaagaggaggcactcagtaaatattcttatttaatgacctagcaacaaagccagtgccccttctaaaaatctctgtgtacaacactctgtgtgtgtgcatgtatgcatgtgtgtgtttaagctggagcagaattcttcacttgcaaaaaaatactaaaagtggctgtgggctcaggtggtggcaaaacaagccagatataagcatatgggtctggagactaacagggattggtagtcaaagagtcacagaaggatgtctgggcaaagagagaggccaaggtcaaggcggagctctggctgggaacagggattgtggcagagactgaatatttcttccattagccagttctctttcttgtagtaatcaaaggcccccaagctgggtctatggccaccagctagaggctgcctttcccagcctctcttgcagctagttctggccaatgatgtatgcaacttctaggccacagccagaaggaaaagtgcttgccctccacctctccattttgtcaggaaggaacatggatgtggtgggggtgagccaactgtgaccacatggacaagaacatcaccccaaggaacagtgggacaagaagacaagaagacagtgtgaagcaaagccacctgcccctgagagagacatacatctttgagcttgttacttggtcccttttggagcagttgaacaaatacactaactcatccaggggattggagtgtgatgttggtgtctgggaggctgaaaagggtttgccagaacccaggtctaggtaagtggggacacagggagaggtagcaacacagatcagggtttagttctaaagcacaagacaggcacctgtagcaaggtaagcatccagccactaaacccatgcatgcggcaacacagcacagcgactcccaaggtagctttgagactcaggcagcctgcagctgaaccctggctcctccacctcctaactgatggtcccctaatctggacacccctctaagccttagtctccccatctgtaaaaagggacagtaaaactgtcatgtgtggtttaaattgagttgactcatataaatctcttggcatggcacctgacatatagtaagcattcaataaataataatcatcattgctattggagaaagcatttctgtggaggggctgtcatggctgtgtggaaagatctctagactagattccagtcctggctctgctgcttttaggctgacaggctgtcataagactgactggggttaccatgtatgtaaagtcccgggcacacagctggtgctcaagaaatgagaaccaaggttgaattcggaggtcaaagcagggcccccacagaaaccagtgtcacactgacccaccaggatattgggagagacctgagttcccctaaacaggggaagcattggttcttgagttgggcagagccttggcctgcatgctggagccaagtggtcctagcagtggggataagaacacaggcaggcgatcaggtggtgaaaggtctgatggatctgactttatgggatacttttcagattgaaggcttcataccaacccagggcacaagctagaactgataatcatggatgaaaatcatcacgatcctggcacacagctttccaggccaccagatccatcttcctgactccatggaagccacactagatggttctcctactgagattgagactttgcagcctccaatgtacttcttggtcactggattttcatgagataatgaccattcagtgaggaccatggcagagcggctctgtcttgtcagtgtcctgaattctagcctcgattactgccaaatagaagagtcacatgagcacattcctgtcctcaaactcacaacacttgcatccctcttattgccatttgattctgggagacactgactcccagagaagaggcatgaccgacccaacgagagcgggctgggaagtcttcaagccaaactaaagacatttctgagtcctccgatctgctgtttgaggtcaattcctcctgaagagcaggtgctgcctgacgctgacttgacctgcttgggagctctacaggggcagagaggtctgggctgcaggtgggacagtgagtagcacacctggtgagagccagggggctgagcacctgggtctcctcaccacaggcagccggctgcctccctggcttgctttcttcaactttctctgggggttggtctgtgggtttcttccagcaagggcagatcaggaggcctggagtcaccttggctgccatgggtccggtaacctgtggcaggaagccctggaacacacaggtctactgtgtgaccctaggtaaggcactttcctctctgggcctcagttttcccttctgcaacatgaaattgggctgaatgatctcaagatcacttcctttctgacaattttggattttgaaatctaagaccaggtgacagtgtggccaactgaaaaatactggccacatttcctagtttgctcaggctggctgcaatattgaccttaagctgaggagaattccacatggtaacttatgcctcaaattcctgttagaccttggtcaaagtgagcatccatctagtgatacctgctaatctttgtaaaaggcaaccctccccgtgggactgactgagaggtggactggcaaggtcaggcccacctactggcccaccatcctcttggcttctctgggggaagggctggggaaggatcctgtgctggcctgagctatagttgctgacaccaggcaacctgcaattgttggtggaagccctgccttttctgcagatgcttggctcacctataacattctaacctcactcaggtcagggtatcccacagcattgacctaccagcaatcagggggttctgtgcagagaaaactacccctgcccagggatccgcatgtatcccagcaagcagcccaggcctcctggacaccggcttctgccagtctaggccctggccaggtcctgacctgctgaccctctcttgggctgtcaccacctccacccctgtccccagccatgtcatcaatccccaaatctggttgtttctgtcccctgcctctcctttgggcttgggttcctacccctagttttgtcgagaccagaagttccaaagaccaacgacagaacagaaatgctggggaactttctccttcttttaaacgaaaattcttaaatgaaaaattacttgaaaaattttaaaccactgcagaattgtaccatccttggctctttcccctgaatctccctgtccccacatgcccctccccagagaagctacagttaatttaatatatgttcttcccgacgtcctaatgtatttatattgatctgcgacttgttttttttctttttttaaatctatgtatggatatctaggtttacctctttctttttgcgggcagcagcactgtattccatttttggctgtactcaaactcagccagtcccttactgatagatatgaaggttgtttccagctgtttctattccaagaaatgctacatagaatatcttctgcatacttgtatgagtatatcacaggctaacctcctagaagggagaatacttgattaaaggggatacaccttgaagcttttcatggggactggcaaatagctcttcaaaaagcagaaatttacacttccgccaatggcgggtgagcactatttccctaacctcctgcctatctggaatataaactgtctctttaacattagctaataagaaaggcaaaatggttgtatttggttcccattgctgctgtaagaaattaccacaaatttagtggcttaatgcaaaatttactatcttatagttcgagtggtcagacgtctgaaataggtctcactcggctaaaagcaaggtgtcagcagggccacttttctttctgggggccctagaggagaatccctttccttgcctttcccaacttctagagggtacctgaattccttggctcatggaaggctccccttccacctgcaaagctggtaacagccagccgcatctttctcataacaaatcattctaatattgactcctctctccctctcctaaggactcttgtgattacattgagtccacctggataatctctccacctcaagatccttaattaaatcacatctacaaattatcttttgccataatgggcaacatattcagtttccagggtttagaatgtggatagtttgggggtccattattttgcctaccacaaagatatcttacgtttcagttataattattttattattattttttgaaatggagtctcgctctgttgcccaggatggagtgcagtgacttgatctcagctcattccaacctctgcctcctgggttcatgcaattctcctgcctcagcctcctgagtagctgggattacaggcgtgcaccaccacacccagataattttcgtatttttagtagagatggggtttcaccatggcggccagactggtcttgaactcctgacctcaagtgatcccctgcctcagcctcccgaagtgctgggattacaggtgtgagccaccccgcctggccgatatcttatgttttaaaacctgtttcttgatctctagagaggcttagcatttttgcataaacatattcagttatttcatttgggagactatttttctggtttacataaactcttttgatattgaagctattgatcctttacatataggttgcagatatcttctctttatcattagtcttagctgtacagaatttttttttgtttccatgtggttaaatgtaccattaatttttccctttatgacttttaggtttcacatccaatattactttttagaatgtcacccaaattttcttctagttccattatgatttattttttccctcctttcctctcttctttcctttccattgtcaccttggctccatctggcacttatttgtgtgtaaggagtgaggtaaagataaagcttaagtttttttactccctagctagccagttgtcccaacagcattattgaatagtccacctccccacctctgaaatgtctgtggtgtctgataaaagcacaggttctagccctattccaaatccactgaaatagaatttgtgggaaagggacccagaatctatatttttgctaattccccatgtgaatattgtaaatctggcatatacttttctactggcatttggggaagctgatgaaattcctccaactgcctcctaatcaccttgcttccaggtttctagccttctcccagtccaccccactccactattcattgtggaaagagaaatctcttcagttgccaagctcaccagacctctccccttgtcagtaattctcagtagctccccaatgcagagagattcagccattggcgtttcagtcctgtcaaaatagggcccacccagtcttcctggcctcctctctctccatcctgctcttacactttgaactctctgcctttacacattgttgttcctggtgggacatgccgagaaaggagtctggagactaattccacagaggagtcagcatacccttgtttgagctgggttttgaactatgggaagatgttgatggtgagatttgcaagaaagagactctaggtgggaggcttgtgatgattaatatcgaatgtcaacttgattggattgaaggatgaagagggtgttgccaaaggagattaacatttgagtcagtggactgggaaaggcagacccaccctcaatctgggtgggcaccatctaatcagctgccagtgtgtccaggataaaagcaggtagaagaacatgaaaagactagactggcttagcctcctggcctacatctttctcctgcactggatgcttcctgccctcaaacattggacgccaagttcttcagctttgggactcagactggcttccttgcttgcagacggcctattgtgggacctcaccttgtgattgtgtgagtcaatactcctcaataaactcccctttatgtatacatctatcctagtagttctgtccctctagagaaccctgactaatacaaggttcaatgtacgcaaagcacagggggctggaatgtggccacaggaaatgtttcagggctccaggcaggagccccacgatgtgctgggatggcttctggacactgggaggtgtttccacacgtcccctcctaggccccagaatgacgagataaagtcccaaactgtgaagcctcattatgtcaagcagatcttctaacagagctgtggtcagtgactgccctctgaaagcaggtggaaggcacaactgggtccccatggggtgggcaagggcgcactgctgctgctgggctgggccatgcttccagggtgaccagcccctcataccctctgacctggattcattcatggaaaacaggcacaacctagagtccatagatagcctgtgttggaaggaagaggttttttgctaatccaatgggtcaaacagtgctgttcccccaagaagcctgggatgtctgccttgagccaggcctgtggcttaaccagttcatcagtgtcttccaggtgaacctgcctccccctggcctgggcaggaactaggctccattcagatttgcatttccagtgcctgatacagaactccacactcagtaaaatattaaaaatatttaaaaacacttaactgaccacctaccatgcccaaacaaaacaaacatattgattcttacacatcccctttttatagatgggggcagggctgaggctaattgcttcagatcagacacaaaaaggcaaaggcaggatttgaaccctgagtgctggccaacatccaggaaacccccaagggccctgatcttggtcagaatgaccgagtggatcctaccttccttccctgtatctgagatcctccaggaagtcttccctggttaactgcagccacctacatacacttgcatcaaagtcctccctgcatgcaagtcactctgcatgaccatgttaaccttagggctgagtttcttgttaactgctttttccctcaataatgaatggtggatttttcactgtctgggaggctcttaaatcatttcccttggatgactggtctctgtgttcctacttttccttctcctcctccctcccaactccaagacctaaacagggcttggaatttctgcacactggtcaaaaagcaaattctatcgaaagcaaacagaagcctaggcaatcctagacgagttagacccggctggtatttgtcttcctgttagagagctcagggatccaggtgaaactgatatcaccaaggagaatgaagtctcctgtgacatccccatagaaagcaaaaacacatttcacagtcaagatcaagcaatgatgtagcaaaaactctactctgccagacttgcagaggcccagatttcccctgattgtctgtgggcataataattcagaggaagatcatctaaaccaatgtcctgtgcctagacggagcaaatgaactctgactatgtgccagggctgttcttagtatgttacgcaaattcactcatttattcctcacaatgacccttcaggcgggtactattatcattcccattttacaggtgaggaaactgaggcccaaaatcacaaaactgataagtagcagagacagaacctgaacttggaccatcaggtgactcctgcagtggtgaccctcaaggcagccaggccacaccagcctcacagagaggacacagatttgaatcacagtcctgacactgcaggtaaccaaacactgtttttagcagccttcctttccttcataagggctaagcttgttaacctttttttacctttctcctggaaaagtatcgacagtgtttaagccttgcttccattgagaccaaaaatgaactgacattagctgctacagccttacctcacctacacacatctacaaacaaggcccagatgcttgtagctaattcacctactaagttatctaatgtaatgtacatagctagctatccacctacctatctcattgtttatttatatccgatttttcccatgaggattaaaagaggcatctggacacccatgagaactcagtgggcatctatgaacttaactcaacctgtttatcttaaatggtccaggaagtgcttgtgggtgaaagagcttagggaagaacaaagcctgaaatgagagttgcgcaggcccagcaggcttgtcttctggccatttgtgtccagccagtctctcatcaacaccgcctaagagagacccaaattccacatttgctgcagtggcctgatctcttgtcagtttctggcaggtctctagtggttcctttgatggcattttgtttctatacacgtgactgtggcacaaaaggcacacctacctacaagcttcctaggtagttaaggttcttgtgtctactatggagagcaatacatagaatacacaataatatatacacacacacactataagatgaaccacagaagaaaaaatgactgggagactgggtgacatacagagtgtagtccaacagaagaggtggcgactgcctgtggcttctgtcattcttgcccacatggcaggatagatataactgtatagtaatgataaagcagttataacgatcactctactgcaactcatttcttcatttctccactcagtctgcaagtactacgtgggccttctcaatgccaggccagtaagatgaaaacagacataaatcataggccttactataagctacagtaatcaagacagtatagtatcgatacaaagagacacaagaagatcaatggaaacagagtagggtaaggaaacatactcccacacatacagtcacatgatgttatttatttatttatttatttatttagggacaggatctcattctgttgcccaaactggagtgtaatggcacaatttcagctcactgcaacctccacctcctgggctcaggtgattctcccacctcagcctcccaagcagctgggactacagacacgtgccaccatgctcggctaatttttatatctttttttagagatggggtttcaccatgttggccaagctggtcttgaactcctgggctcaagtgatccacccaccttggcctcccaaagtgttagaattacaagtgtgagccaccacacccagtctcagtcacctgatttacaagaaaaatgcatctgatagagaaagtaatggtcttttcaataaatggcgctaaagctattggatatccatattaaaaaatgaaccttgacccccgatatcataccatacacagaaaacgaatgtgaaatgaataaatgataggcctgaatacaaaagattaaacaataaagcttgtagaagaaaacaagaaaatatcttcacggaacttggggtaggcaaagatttcttactcgattgacaaacgcgtaatcacataatcataaaggagagaagctaaattgtgcttcattaaaatttaaaacttctgttcaacaaagactctaataatagagtagaaagacaaaccatgggttgggagaggatatttgcaacacatgtttgaaaacaaattcctaaaaatgagtaagaaaaaggcagtcaacgcacctgaaaatggcaaaagttaactcaaaatgaatcaaagacctaaactcagagataaaactatagaactcttagaaaacataaggaagaagcttcatcacattggatttggcagtaacttcttagatgtggcaccaaaagcatacacaacaaaagtacaaatagataaattgcctacatcaaaatttaaaatcttctatgcgtgaaaggacaacatcaacagagtaaaaagacaagaatgagagaaaacgcttgcaaatcatatatctgataagggattaacatgcagaactccaaaactcaacaacaaaaagccaagcaaaacgatttttaaaaaaatgagcaaaggacttgaagagacgtttctccaaagaagatctacaaatggccaagaagcacgtgaaaagatgctcaccattaccaattactagggaaatgaaaaatcaaaaccacgaagataccacctcacacacattaaaatggctacaacaaaaaaaagaaaaagaagtatttgcaaggatgtagagaaagtgagtggaactgttgcactctgctggtaggaatgtaaaacggtgcagcctctatggaaaacactgtggtagttcctcaaaaaataaaaaatagaattaccatctaatccagcaattccccttctgggtatatactcaaaagaattgaaatcagagtctcaaagagatatgtgtacatctatgttcatagcggcatgatttacaacagccaaaggtggaagcaatccaaatgtccattgatgaatgaatggataaaaaattcattcatgttgtagcatgtgtcagaatttccttctttaagacggaataatattccattgtgtgtatgaaacttgatgacattatgctaagtaagataagccagccacaaatgaacaaatactgcataatttcacttatatgaagtacttagagtaatcaaattcatagagacagaaagtcaactggtggttgccagaggctgtgggaatggggggctgttgttttatgggtatacagtttcagcttttcagaatgaaaagtaatctagagattggttgcgcagcaatgtgactgcttaacactactgaatttaaaatagtaaagttggtcaatgttatgtctattttaccacaatttttaaaatagcaaaagattttaacaggcactacaagcaagaggttatctaaatggtcaataagaatatgtcatgaagttttcccctatgttttcttctagaagttttatgtcataaagttttctcctatgttttcttctaggagttttacagtcttaggttttacatccaagtctttaatccattttgagttgatctttatgtacggtgatttttatgtatggttaatttttatgtaagataagaatccaatttcattcttttgcatatgaatatccagttttcccagcaccatttattgaagagactacccttcctccattgtgttttcttggcacccgtgttgaagatcagtcagcatatatactggatttatttcgggttctctgttctgtttcattggtctacatgtctgtctttatgtcagtaccatactgttttgattagtgtaattttttatgctttgaaattaggaaatgtgaggcttccagctttgttcttgtgtcagaggattgatttggctatttgtgttttttgtggttccatataaatcacagaattgttttttctatttaggcaaagtaatgtaattgagatttttatgggggtttcattgactctgtagattgttttgggtagtatggacatgttaacaatattaattcttccaatccatgaacacaggatgtctttctctttgtttgtgtcttctttaatttctttattaaatgttttgtagtttccagtacacaagtctttcatttccttagctaagttcattcctaagtattgttttaggtgttattataagtgacattatttttctaattttcttttcagctagtttgttgttagtgtatagaaatgccactgatttttgtaaatgattttgtatcctgcaactttactaaatttgttaattagttctaatactttttaatggcatctttaggattttatattattttgtctgcaaacaggaacaattttacttcttcctttctgatttaaatgtctttaattttttttcttgcctaattgctctggctaggacttccagtactgtcttgaatagaaatggcaagcaagggcattcttgcccttagcttcttcctgattttagagaaaaaacttttccgtttttcaccactgagtatagtattagctgtaagcttgttatatatggcttttattatgttgaagtactttccctctagtcttagttttttgagaactttgatcaaaaagggtgtgttgaattttgtcaaatgccttttctgcatctgttgagatgctcatgtgattttaagtctttattctgataatgtgatgtataacattaattaacttttgtatattgaaccatctttgtatcccagggataaatcccacttggtcatggtgtatgatccctttaatgcactatttggtttgatgtgctagtattttgttgaggatttttgcatctatattcattaagaatattagcctgtagttttcttttcttgtggtgtctttgtttagcttttgtatcagagtaatgctagcctcataaaatgagtttggaggtgttccctcctcttcaattttttttggaagattttcagaaggatcaatgttaaatctttaaaaaatattttggtagaattcaccagtgaagctatctggtcctgggcttttccttgttgggagttttttgattactgactcaatcttcatattagttataggtctgtttagactttatatttcttcataatttagtcttgtatttttctgggaacatatccatttcttttaagttatccagcttgttggcatagaattgttcatagtagtctcttatcctttttatttctgtggcatcagttgtgatgtctcttctttaatttataattttatttatttgagtctcctctctttttttctagcatagctaatgatttgtcaatttaaaaaatcttttcaaaaaaccaactcttagtttcattgatttttttcctattgtttttgtattgtttatttcttctgtaatccttatatctttccttctgttaaccttggccttaatttctttttctaggtctttgaggtataaagttaggttgcttatttgagatccttcttctattttaatgtaggcatttatcacaacgaactctctgagtacaggttttgctgaatcctataagttttggtatgttgtgtttttgttttcatttctcttgaggtattttctaatttcttttttgatttcttctttgacccaatggttgtttacagtgtgtcatttaatttccacatatttttgaattttcaatttccttctgctgttgatttccatttctatttatttatttatttttattttttattttttgagactgagtctcgccctgtcacccaggctgcagtgtagcggcgcgatctctgctcactgcaacctccacctcccgggttcaagcaattctcctgccccagcctcctgaatagctgggattacaggcacgcactgtcatgctcagctacttttttgtatctttagtagcgatgtggtttcaccatgttggccaggctggtctcgaactgctgacctcaggtgatccacccacctcggcctcccaaagcgctgggattacagtcgtgagccaccgtgcctggcctatttatttttttagatggagtctcactgtcacccaggctggagagcagtggtgtgatctcagctcactgcaacctctgcctaccaggttcaagcgattctcctgcctcagcctcctcagcagctgggattacaggcacctgccaccatgcccatctaatttttgtatttttagtggaaacggggtttcaccatgttggccaagctggtcttgaactcctgacctcaagtgatccatccaccttggcctcccaaagtgctgggattacaggtgtgagccactgtgcctggcctgctattgatttctagtttcatcccattgtgatcagaatatatatttggtatgctttcaatcttaaatttgttaagacttgtgttgtaacttaacatggagaaaaatccatgtgtgcttgaaaagaatgtgtattctgctgctatttggtggaattttttggcatttatttgttaggtccatttggtctatagtgttgttcgagtcatttgcttctctgttgatcttctgtgttgatattctatccgttattaaaagtgaggtattgaagcatataaaacaatgctcaatacaattttgtcattagggaaatgttaattaaatctacaacacattcaccataacagctaacatgaagcaaacaaaatgacgccaagtgttggcaaggatgtggtacaactggaactcttcttgtgcattgttagtgggaaggtaaatagacacatttggacaattgattggcaaagactaatgccacacacctaccctcagacccagaaattccactcctaagactatatcctatagaaatgcctatgtatgtcctccaaaaaacacaaagaagaattttcatagcagatctattcatgatagccaaaaaaactggaaacagctcaaatgccagcaacaaatagaatggataaataaattgtggtatattcatataacaattatacatagtaataaaaaagaacaaagtactgctacagacaaaaatatatatcttacagatataataataagtaaaggaattcagacacaatagactatatgccgtgtgatgatgtgaatgtggaaactccacaattcaggtattgtcaacgtgatagtattaagaggtgattaggctgtgaagattcctccctagtgaatgggattaggtgtctcataaaagtgcttgctgaggagacttcatctcacttgccctggtacctctcaccatgtaagaatgcagcaagaaggccctcaccagacaccatatgtcagcaccctgatcttagacttcccaggctccagaactgtgagaaataaatttctttactttatagattacccagctttagtattctgtactagcagcctaagacatactatatgattccacttaattaaagttaaaggataggcgaaaaaccaatcttatggtattagaaaataggatagcccaggcacagtggctcatgcctataatctcagcattttgggaggccgaggtgagtgaactgcttgagcccaggaattcgagaccagcttgggcaatgtagggagacctcatctctacaaaaaataaataaaattagctgagtgtggtggtgcacacctgtggtcctagctacttgggaggtggaggtgggaggatcgcttgatcccaggaggtagaggctgtagtgagctgagatcacgccacagcactccagtctgggtgacagaatgagactctgtctccaataaaaaaaaaaaaaaagagaaagggaagggaagggaagggaagcggaggggtggagaggggaggggaggggaggggagggaagggaagggaagggaggaaaggaaggaaaggaaggaagaaagaaaagaaatcaggatagtggtttctgatttctaatggggcaggtgggtatttactccgaaggggcatgaagcagttttctgggtgtacaattgttccacatcttgatgtggttacatagatattacatacacacacgcacacgcgcacacacacacacacacacacacacacacacatacatatgttaaaaagaaaactattccagtacagcggtacacttctggtttgtgtacataactgtatgtatgttatacctcaatttttgaaaagacatgggctttacacctgaaaaatacaaagcttatagggaaagagaaaaaagaaccaaaaagataataaggggtggtagatgccatgatagaaacaggttcccagtacaggttgggagaggctgactcctgggggtggggagggacggctcaccagcgtaggctttagagatacacacactgggctctgaaggatgaacaggatctcaccgagcagaaaaggggatgagtgggagaaagacagaaagatgctggggaaaccctaattgtgtgagaaggtccagtgtggttagagtgttgggtgtgcagagcatagtagtggggggtggggctgagggcatgaatcaaatcagctttcagatttgtttatttaaataaattccccataaacattttttgagtgaacaaatgaaccttctcacggtcatgatacatctgatgtctggaatggtaggacagatgtgttaggatggcagcaagtactgaatgaagagatgtagtactggtgtggttacaaagtccatttcttctcaaattattaatctctctaaaatctgatgtcttctaggccccagaatgccaaaccgtcctcacttggttatggtactgactctctgctgtgaaactgcagagtttttcgcattcaacctctctctcccaatttccttccaccccatctcacaatttttggtggttaccaatttttggtggttctggcagttgcttttagcatcttcaagtaatatacttaaattgcgattttctgatctatcaactttagacagtgtctattcacttcctactatgagcaataaaatttgtccacattctctactttccacttccttccctcctgcccaccttcagatttttgttatatgttattgcttttgcataacaattacattctcatcgacagtataattaagtctactctataggataattctaaaaagtgaagctagttaacaacatcattatgaagatatcattgcctgcgaagccactcagtatgaatggacccatgagaaaggcaagtggttccacgttactgaaacttggtcacaagaagaaaaatggatagcttccttcacttcttcttgaacctcatttaataattattttgggttccttttttgattgatgaaataactccaggaggttttattttcttccagaaaatataggtgactgagtgacaaactttctgaatcttacacatttaaaaaactatttttttcaaagtttgacaggatgactcttagtttatcctccagaattgtgaaagtactccactgtactggagcatcttgcatgactggtgagaaattctgaggtaatttttgagtctctctggaagttttttgttttttatccttgatgttctgaaatttcaccaagatgggtctgcatgctcattttactaattcctgccctaaagtcagtatgatctttctagtttaaaatctgtgtgtgtttcttttttttttatttttatttttaaattgaaatggggtctcaccatattgctcagtgtggtcttgaactcctgggcttaggcaatcctcccacctcagcctctcaaagtgctggattataggtgtgagccaccaagcctggccgtgtgtatttctcaactgagaggaaatttctttggctatatctttcactatttctacccaccccctgactgtctgtggcttctagttctagatctcctagttgatggatactgaacctctggatctatcctccatgggtcttaatgttttcttcttgagactttgctctgctttctgggaggttttcttggttttaacattgaaatgaccaatctggtcttcatgcatatccattgtgttattcagtttttccactgaagttttttccataatgatattttacaatttcagcaagtatttcctttcctccaattgtgctatcttcatagcaacctgctcctctgatattataggttatttcacttacagaggtgaatgaaagaacctcttacttactgttaaggatactactgataatttagttttgggctttcttatattcaaactgtttcctttgaaataagctcttccttttttttttcttttttccattttaggccttctctttcattctattggtttgcttccaatgtttggtgattttggttatccaatatatttatgaatgagggattatgttgtaaagttaggatatgtattaggatacaggttctagctcctataacaaggacctaactgcaggagtggcttagacgagacagtttatttctgtcttatgtgcaatctgagtttaagtggccatggctgatatggtggcttcaccgtgtggacatctttgatcttggtcttctgatatccacagcacatgacttccatctcccaccatcacatccacaccctactcagtgggaacgataaaggggagggcagagctgggagttgcacttgtcatttcagctcacacgagcccatggccactcctagctgctaggagggtgaggcagtgtagtgtttagctgagtggctgtgtgccctgctaaaatttccatcactacagaagaagagaaaaaagatataagtggaatactaactacatagggcttcccgtgaggtgtctcgtctatttctctgaccagttcagtcttgaatgtgagggtggcagtcatggaaaggttccctgcaggagggtgaagcagtgtggcaagtctcctagtaataaccgtggacaggaagtggccagggaactcccacaattgccaaaagaaggacttttctccatggtgggcataatgctatacttcaccctgagacggagctgccaatccttcttctggctccctgccccacatccagtctgctagagaggtctggaatgcccttgctcagctgctgtctcagactttccttagagagcatttgttggggaatttggcggccactggctgcctgcctctttgtgaagaaggcggggaggggtccaactgtacttgctcttctgaagggctctcaggggagaacactgctaacccattccttttctgtgctttgttggctctcagcttgaactatgcttggctcttctgagacaaaaatcactgagacttctggaatcctgggctgcaatgttttctgctctgattgctctgtctgtgcaatctcatgggctttctatcttcctaagatttaggaatgtttccgtcccacggatgacttcctatcttgttttctaatgctgttatgatgtcatcctttcaaaaatggctttcagctgggcacggtggctcacacctgtaatcccagcactttgggaggccaaggcgggtggatcacttgaggtcaggagtttgggaccagcctgaccacatggtgaaaccctgtctctactaaaaataccaaaaaaaaaaaaaaaaaatagccaggtgtggtggtgcatgcctgtaatcccagttacttggaaggttgaggcaggagaatcccttgaacctaggaggtggaggttgcagtgagcctgggcaacaagagtgaaactccgtctcaataaaaaaaaaaaacggttttcactgtcatcataccaattcctagggaagaggtggaggtgggcacttgtgctccaggacttaggaaatcaatgcattcatgactcattggctgaggccaatgtcccttccaggatgtggacaccggaaaggaagatgaacccttcccatgcagggcatcatctcagaactccatggtgtctgcccttagggggaacacttctgatgttcctgaacctgggcccccaccgatgcacaatgcccacctagttccactgagggtaggaacagccagccctgtttgcctgggcagcctagtagttcatggacaccagtcaatgacccgactgcctaagggcgtgcaagcctccgtgtaggcacctggcaggctgtgtttgcctttggaggtggataatcagcaaagtccctgtacactgtcagctaccacagctgagattcagcgagctatctacactaagtgtaccaggagaaagggttccaccccatcctctaaggttgctcaaaggctgtctccaatccataatgacacccctttttaagacccttcagcctccccactagtttaggccccacggcatggctctggaggcctcacctctctcattccctccatctgtgtgttccagccacatggagctggagaattctcagaacacacgccgttcccaatggctgaaatgccctttccctcctagacatgtggcaaactcctcaatgtcctttaaacccaccagtgatggttaattttgtgtcaagttggctatgccataggccaagacgcttggtcaaacattattctagatgtttctgtgaaggcattttttagacaagattaacatttgaattggtaaactctgagtaaagcagaccgctttccacaatatgagtgagcctcatccactcggttgaacgccttaacagaaaaagagtgccctccccagaggacaggggaatgatgtctgcagactacctttagccttggctcctccttcctggatctccagcctgctggcccatcctgcagattttggacttgaaaagcctccacaactgcatgagccaattccttaaaatctctctctctgtatacacacacacaccacacacatacacaattggttctgtttctctggagaaccctaatacacaacttcagacatcaaatccttcagcgagctttctatggcccccttacactcagccagtcacctctgtaccttagacactttgctgctatcacatgtcttacaccttgtggtaatgtatttgtttacaagcttttctcctcctacaggacagggttcttttaggccaaggagccagtctcattcaccattacatccctaggtgggtgaatttgtgagaacaagagagtactgaggctgatggcctaggggaatcctactggatggtgggaggggcattcccattgagcctcttgaaaggcatctggtaagacaggccagagagggacggttcctgcaaagcaggctaacagcactgctcctgaatatcagtcactggtggggcagtggcccacagccttcttcagctctggtgaggagaggaccccacaggccatggtaccacctgtccagcttctccagctccacccagggagcccggtttaattcaataaatacttactgaattccgagcgcaatttcttgtgaggcattcgcactctaggtcctgatctgacctccagatcttccttttttgacaacatctgagctctcaaaagcactcagggaatgtactgtttgtgtgcctgaggggagcagtcatcatcctcagccttcttaaacttgccctgagaccccccaagctcccactctgtgctccctgaacaagacgatgttgtcaagtatgatttcgtggggctgcatttccaaaaaataagctcttgcagttcatacaggctttcttccattcaaccaggtgaactctgaaaatcccacactgtgagaaagaaggccgtaggctcagggtgtgggggcagaagggtgaccctttgagaaaattactagtgtatgttacactcctgttctaaacaaaggtcacgggttgtccagggaattatgagcaaatgaatgagtgaatggatgaataaacaaacgctaagttgaatggatgataacgtaacccaggctcaagtcaagagcatttaattgaggaaacaggagaagagccagaagataagctatacacgggcaaagggacttccttaaaccaaaggtggtttaaggaaggcaaattccatctcgtaacaaagacacaaactgtggagcaactgggataatcaatcataagaaatgctgatggggacagagcgccatgtgccaggctctctgccgagaacctgacatgtcctcagtcctcagaacgagcctatcaggccggcaatgtttttacatccatctcacagatgaggacacaaaggcaccgaaggttccatcatgcgcccaggggcacacattcaacaaagagtgagactgcaagccaaggcaggcagggggtctgcagtgtgtgtctcaaccacttccccatttcacctccacatgtggctctagcagcctttaatcaaggaagcaagggaaaactcgaatgttgttcaggcctggggatctagagacccacctggctttctcccactgtcctgggcaaccaggcaagtcctctgtgagattgtgctgcctgattccatatcggaaaaatatggtattcactagagttgggtttcggggacctttcccgccctgacattctggatgcttctccctagcctgggaactccggttgcctgaggtcggctcaccccagagcacctgattctggccccagatgaacctcctgactaggtctgtgaagatataaactcgcccttcttgatggcccaggctttttctacaggacccaacctcacctcaccttcctgcctggcagtctggctattccaccctgtgatcccacctccactcctcccgcctccccaccttcctcctcccactcccacccacctgtgccccagctcctctcaccctttctgcctcctgccagggttcaagcccctcccttggcctgctgcccggtcccccatcttcccttctttgttcagccaaatccttcttgtcaccactgccagtttctccctgggacctctttccatctcagacagaacccattctgccttcccctggccggtgtttacacccctgtttcagatggatcataatcccaacaatgccgccttacgttagtgcagtgactacagctcaccaaaggcccctgtagccactgtctcatttaatttcacccaagttcctccttgcagacctcctgttcatggctccaactgccccctaagactgcaaacacaatgtctaacatacttcataactaagaatttcctcaaaacagccctctgggaaggggcttatcacttcgttttgcagatgaggaaacagaggttcagagaggtggaaagtggctgggctggatccacagctcaggactctgattctccgtcccatggttctcaaggattcatggtgttccctgagtcctgcctaggatcagactcatttctgtattcctgagctatcctttgcttggacaaatacggtatcctgaactcaggggaccaggagggtttgctggcttaaaaaatgaattcatcagggcctagaatcatcaccgtcctaagtgcctccttcagggtaccacagtgccagcccctgtcccctcccttcatctttgcatggaagagatgggcagagctgggccctttagggtctgaggtacaactgaagcctcagaagaaccgataaaccatgtttcttgtttgccacacagaaatggggcagtctctgcctctcattgtcccaacctggccctggcagggtgaatgcagcacctccttccaggaagcgcccaaggaagctccaagggacctggacagggcagaggattccctgggcagggagcagtggaggacagccaggagcactgggcgcggagtcagccgctaggggctcactgcctgcagggacactccctccattcccaagagctccaaacccttctgacaagctgcgtcctctccaaatgggtttcccaataggctttggcctgagtgaatgatttctttccagaacaggaacacacccctgccttccagcccaggccactcacagctcccctctccagaggcaatgacagttgtcaattcttgactgcttactttggaacgcgtggggcgggtctcgtgacattttatattgtattccctcactgtactaatcttttcacatgcccatctccccagctacacattttggagagcaggggctgtattttaaacaccttcatgttctctgtgcctgccacatagtaggcactcatgggtatttgtgagtgaataaataaataaatgaatgaacaaagttaaaattgtggaaagcttcagttaatagtttgcagaagtcactttaattccttctgaaaaaaggggtgtattaatttgctaatgagtagaattgtgtaaactttgagtatctttctcataaacataactctttaaatgctgtctagtcatttgattattcaaatattgagatacaattcacataccataaaattcacagggttgtgcaaccatcccaatgatgtaattccagaacacatgtatcactctgaaaagaaatcctgtacccattagcaatcactccacattcccttccctccagcccctggcagccactaattcatctagtttccatctctataaatttgccttatctggacatttcataaaaatggaatcacccgccatatgtccttttgtgtctggcttctttcacttagcataacgtttttcatcatttgcactaaaaatatcagtgtttcctggtgtttctcacagcaccctgacgcccaggccacaatgcctgtgagatcacgcaggttggagctggccgctctgagccatcagggcagtgtggcgtccggcagcagatgtctgtgactgggcagtgcagggactcagatgggagaggtagccacaacatgggcagtctgaggtcagcagcagaatcagaatggtcagaaacagatagcacatgggacggcactcaatattcctccccaaggaacagctgcctgaaaatataattatctggtggtgagagaggcgtgtcaagggccaccagccctgagtctaaaggctctgagtctgcagggagagtaccatttctgagatgatctcaaagctcaacagagggtgcaagtcccaagggcttagatggttccattctaggggtggaaaacaggcagtggccatcccaactgctttgccaccctttctgcctaaggcaagcctcctttctgcagggcttcagttcctcgtaggaagtcccaacaggctgagcagagccaagcatgctttggtcatgtacagtttgtgcacagatagattaactcattagttaatcccctttttgtctttttgcaattttaacttgatttattccacagtagatttgaggtaatttacaaaaacaaaataggaacacaaatttaaaatgaaaaatcaacccaggggaaatgaaagaccagaagggatggaagaagatgggtaagtcacttagaaggccccacatggtagctctcttggggccatggatttagtatacagcagtcagaggaagaagggcaacacagttagctgcacagtctccgtgttctgatgatacgctggccagttcctcagaaaaaacaaagctcttcttggcactaagatctgaaggaaatttcttccatgctgttttaagtagggagccctccatgaagtcatcctcccaatacttccggggctctgacatccagctctgagctaggcaattggctctcccagcatctcagaaggccaggtgggccccaccctttaagtcattagctcctgtttgggaaacgttgtgccatttggtgaccaccgttacaagttttctcagaaataatgccatcgtattgtattgctatttatgtaatagtttaatttactttgacttgaattggacttgtttaaaggttacttcttcctaagcaatagggaccacaggagaaactgccaactagtattttttactgaattaaataaataattttaccagtcaattaaagaacttccagcatgttctcccaaaatcagctcatcttctactcatggtttatgtcctgaacttgggaaatcggcccgtccctcaccttgggatgcactggggctgccccccatctcctccacctggagaaccctcagcctggcttccccatcacaccacgcaagcttagagctagagggcacttaagtggggtctaaagtccacgtttgacaggtgaagatgctgggcccaaggaagagaagggattcgcgcaagaccacaaggccagtgacaggacaggcaccaagactgcccagaaacagtggcagggccggtggacatttagatgtaaccaaaggctgaaactcaccaaaagagtctaacaggaaaagactgtgggcagagaggcacagggcctcacccaactcagggcaagcccggtgggggcagggtaaacccagaaaacaatcatgggatggtaatcccgagttcaggatgacggtcactcctgggagcacaggagaaagggacccacattgtggaagcgatgcagggcttccactgtatttgacaagtcttttttttttttttttttttttttttttttagcagggtggtgagttcactagtgttatattatcatgcataatattgctgcttggatgaaatattttgaaaatattttatatttgttaaatatattaataactccaagactcctttaacaagtgtgttttctctctgctaagatgacactctctaccgcatctcaagtggtttaaccaaaggggagaagaaatgactgatttccacaagagacatgccccaggtggggagcttctgtcacctctccctccactcccaaagcctgtgacatgtggtgggtggatctgagcatcattgtacctgaccaaggtggagtccatttcagacaggtcatggtgtcatggttggcatggctcatacaaacccatgggtctaggaggaaacttagagcaccccaagtggaaccatgtgggctccactgatgaatgccacagcagggcaatgggcagtgctgtagaattaagcccccagccaacatctttgttccccacctgcacaaaggacgtgtcttggcatgtatatttttgcaaacagcagactatcccgttcagttaaaggcagggtaggatgtactttgagatttctaagagggacgcacagagtctcagagtctccgggttgaagggactgccaaggacactgacccaagctcccatttgagactccagccttccttagaggctgctctcaggaggccactcactgcctgaggcaatagcaattactttttttttttttttcaaacagggtataggaagtggggaagatggggagccttttttttttttttttgagatggagtctcactatgttgcccaggctggtctcaaattcctggcctcaaatgatcctcccgccttagcatcttgagtatctcagattacaggcttgtgctactgcacctgctcaatttttgtttttctaaaaatggtatcatcctatgtacattcctcagcactcggccttcctcatggacagtctttctaggctacaggccaataggttgtgagcagttatcctgtaccaggcacagttataagcacctcacataattaactcagttactgctcctaacaagcttaaaggacaggcactattgcaatccctactttaccaaagaggagtgtgaatggccagagggtcaagcaacacagtttgtaagtggtgggatccggatttgaaccctggctgtctgtcttcagaccctgtgctcctaaccactctaccgtactgcctttccaaacagagacaggatctgtctcaatcttgttacagctgaatgatggaccatggtttggatggaatacctttaaatttactgttaagtttgtatattttttgtaagttttcctactagaattttgccataaacatcctttatacacatatctttacagactgatgcattcattgttccataggccggatttccagaagtggaaacatggatcaatgtgtgtgtttttggttaaaatacctatggggcctattgtttgggccatcgtcctaataatgagccatgtcattttcactcactggttttgattctgtcccgaggaccacacagaacatctctgaccctttttctccagacaacccctggggtggttgaggacagcaagtctgtctctcaagtattctgttacccagtttcttcaaaagttcctctgacaagggctgcatgctcctgagggctggtccagatacctcttaaagtgcggcaccgcctggggtgatctggcttatgccccttgctccccattcaaagacacacagagagggacattgacagtgcacaggagatatcaacagtgtttcctgacatccatgatgcacgggagagaaccaagtaggtaggattcagacttctcatcttcacctctcccaaatcacacacatgccttcctgagaaagagaccctttgtgagatattaaagaccagccaaattctactcccacatcataagaaactggagttcactctttaattagagaagatgccaatggctttggaactggacaggcttctaagcatcttttagttcagtgtcttcttttacaaaagagccctggagggcaatgaccgcaccaggctcacatgtcattgggtgtgtggcagcatttccctaagctgagaccagggtcactggtgggtgcatttccccagctctctctgcctgctggttcctaggaaccatcttactagaaaggcgtagtgtaaatattttgctaagcagccaagagaggaaacttacccaggctgagctgccctgtgctgggtgctggccatggacacaatgctcaatgagggccattatctgggaagggagggctgtttgttccgctgcgggatggtgccagagcccggagccaccaggcttgccactctggctgccacacagaagagtctccttgcgctcagcagactctgcggttatgcaatgccgggccaggaggttaactctccccaggccaggagccaagccttgttccttcctgcctaagcatgtccatctgaaaatgctgaaaattgagggcctcagtgtttgcaaaatgtgctcgggccctgaacctgctggtttattccaaagggcgtagtgttgaggagctggtgtgcccatccttgtggctcctggcagcctcctaccgaggcccagtgctctgacagcagcgtctgcctgccatcctcgggcaccactcataggccttgcaaccctttgcctgggtgcccctgtcccgttctttccctttcggtggtgtctggtctaagtcctttcttaagcccgagttctactcacttgttcaaagccttccctgaccaccccaggccccagtgacctgagctcaaggatgagtttcccaagacaaaagggaccttggaagttatctatccacctggcccattttccagatgaggaaactgaggcttgaagaagttgactagtctgagagaagactgaacagatgtgtcagcctggctcccctctcagaactctttctcttatacctcacgtcccatctgtcagcaaatcatgttggcttgacctcaaaatggagctggaatcagaccccttcccatggcccccgcagttgccaccctggtgtgtgactctatcacctcctgatctgtcacatcactgcctcctagctggcctcgggctgctgcccccgccccctccagggcagcctccacagcctccttcggcaggacagcccactcctctgctcaggcctcccagggcttctggatgttgtgcctgcctctcccttccagcctcctctgctcctgtgcccccacccccactcctccagccacaccagcttccttgctgttcccagcaggctgatcttgcctccgcctggaatactcttttctgatacccccagcacttgctcctcgcctccctcaggtctttactctccacccgtcctgactgcctgatttcaaaaccttgacaacctgccagccccgtgccccctattcctttcctgactgccaccttgtcacatactatgtatgttacttaagaagataatatatttacatttattttacatacacttatgtttttaagatctcacaaaatatacagtctatagagagtgtgcatgtgtgtgtagtgacgatatgtttgtctatttccctaccagaatgtaactccaagaggcaggtgttttgtgctttgtcacccagaatggtgcttggccccttatgtctaagtagggccgaaggtaaggatgacctacctctttgaggatggatgaggatggtgatggtggctggggtgtcacctgactggtatgggtgttaggagtgggggaagggatgagtttggtggcatatgtaggctcagcagagggagagccagggctccagggaggtcagctgggaggctgtccgaatgctatatttttggagccatatggaataaacacccagacacctgggcctcagtcccccaaccccaaccagccccggtagagcagctccaaaataggaaattcgcagaggtagccccagagaggctgctcagattaggctgcagtgagcacctaggcatggctggccactccctgcttttaggcatcctgaatttgcacgtctaggaatctccatctccatgtttcaagctctctagtgggtgactcacaggctctgcaggggtttgggggctgcagctgagttcctttgaatatctgttgaatgaataaaagaaatggaaggaaagggggaaaggtgctaaggcagacacaggagaagaggacaaaggcttgggagcactgaaacgaccccagggaggcatgccaaacagagcccgaacagaggcaagacagcagggcttgtcctgacaggtggcacaggtgggtccagtttccactcgctttcccacacctgcagctacgctggccaggagcacaaacctcaagcaaacagaaattttttctcgtgatttcagttttagtttgattgacatttttatttacccatgacatagtttcttttaggatagctggctttattctaaagagcagcccaaactaagtggcctaggtgatttggctgttcaaatctcccttttctgatcctcctgtcctgccctacctctcctctcacctgtctgagcacttctctgactcttccatccaagctttttcttcctagatgcctgtactcagtcctcaagctttggtctctaatcccctgcttttctctctctgcactgctcaccttgacttggtagcagcttccacagctgcacacatcacctgccccacccagcacgccccaatcctgcatttccagcagctctcacattcaatatgcttagtgccccactcatcttttcacccctctgtctctggtaaaccttcaggcttgcgacactagtgctacctctaaactccactctcctttgtcctcatagcacccattcacccagtcactcaccctccactcctaccctttccttcaagcaaacagaaaccctgattggttcaacaattactgatcaaccactactgtgcaccaggcagtgctgggtaccggaggcatttgccttggcctgttcttcttccacctgcggcacctcgaggaccacccgaggccctgagattgggagaggaagcctgttccataactggtcagccccacacctgcaagtaattgacagtgtgaccctgggcaagtcacttgccacgtttgagcttgggtgttcccaattgccctttgggaggattattcattcccgcctcacctgtccccagtccagctgggaaaggcatcacccggcttcctacaggtgacaccagtctgaataatacttgtggtgcacccatagccatggtgcagcctcttcctcccacagaccacggccttgacccccttcagcctcctggcccccagtatgggacagagccctggaatctgcattttaaagaaactcaaggtaattctgttatgggagggtatgtggacacacatggagaaattctggctcacaggataaagtctaagcttcctcaccacccccaactcattgatgaaaacttcgccctgctttccagcattggccccctctgtctcccaagggagggcctgcagccgtggccagactgctctgtccactccccaccctgagctcagcaatgagcctgctcttcttcttcttttgttttgttttgtttttcgagacagggtcttgctgtgtccctcaggctgcagtgcagtggtataatcacagctcactgcagcctccgtctcctgggctcaagccatccacccgcttcagtctcaatatttaggactacaggagtatgaccaccacatctggctaaattttttatttttctagtttttgagatgaggtctcactaccttgcccattctagtctcaaactctccggctcaggtgatcctcctgcctcagcctcccaagtagctgggattacaggcctaagcccccaggcctggtcagccctgctcttctcttatgacttccccaacttggaaagacttcctgacctccctatctctgcaagtctctttcccaccctgcaacatccaactcaaatgccttcaccttcctctatcaagctcagaatctccacttgacatcagttagggccaaacacacagaccatcatcatttcctgcctggattgctggctggcttttgactggctcatatcctagctttctaagctgactgtgagctccctgaggccaaccatccatcttgcagatccttgggttcaataacaaatgcttactgagcacctgcagaaacctatacagcagcaccctgctgggtgtacagaagaggaaggccgaatccctgcctagaggggagcccctctcatggagagacagatggaacttgcatatatgaccagggtagaaataaagacagggtaccacagaatcccagagtaaaggtcctaatgccatggggaaggggcactcagggggcagggaaggaaaactcagaaagagggagcagcacacgcaaaggattaaagtgtgacatgttctgcacaagagcaggggtgggggaggaagaaggatggagataacgggaacaggctgaactgggaatgctgagctaagggtctggattcatcctgtaggtcaagggttggcaaatccagccggctgcctgttttcgtacataaaattttactggaacacaaccacgcccattttttacatattatctgtggttgcttccaggctgcaatgacaaagtcaagagagactatatgcccggcaaagcttcaaatactatctggccattcagagcaaaagaatgctcattcctgccatagacgctggaagctatgggtggattttaagcagcagatagcagggtcagatttgtgtttcacgtttctatcactctcggatcatgctgggatgtgctggagcaggcaagccaggggaaagggaaggtggctgggaggctggtacagttttccaggtaggggatggagatcaacaacaacattgctgttttttattaagagattcattaagagttgctatgtgcccacactgggctgtgccctttacacatattcatttaatctgcagagtaactgctggatatagctagagttgttatctccatcctactgatgaggcacagagaagtgaagtcatttgcccaaggtcacgcagccagtatgagacagagcccggatgcaaacccagtggtccaaacctgagctggggccctcagtgccaagctccagggcttcagtgtcaagcatgtttttggcaacagatcccttcgagcctccctgggaatacacagaacacaaatcctctaaaggagaaaatctaccccagccgagtcaggcaggaagtgggaggcagcagtgtggctattttggagaagcgacacgagaaaccacgaaacttcctacctgtcccgttttgctcccatctgtcctcagaaacaaggctgcccctctccaagataaaaaggtgtttctccccacacagtggctctgccactggtggtgggagagagagcactaagcttagcacacacttgctatttttaaagggctatataaacaaacagggctatgtaaataagaaaaaaatgaggtcatccttttaaaacctaaaaatgtcccttttctatggggtgagcagcacaacctcagaaagcacaggggtttttctatccccttgaggcttctctagcccatggcctccaaaaaccaccaggcctggctctcttccttgcacccactgagtgaagggcaggtggcctgggagtcaggactcctgggtttcattcctgggtctgtgggctttgcctcaaatgcctaaggccaatgtgcaatcccagccaccaccatccagggaacctgacatccaaccccacgccggtctctcacaaacacggcccatgctccaggccctcctcctcctgtgccagccctggtttggcaagctgattctcctggcccctcgggtatcctttttcctccccactgcctcacaccttgacctgttgaatggccacagaggctctctgcatgccgatcagagtgacgtgtatgctccccacccccacttctctgcacacatgtttaccttgctccacgctcttctgcaccttttcttcaaaggcgcgggccagaggtcattaaagcagccccaggagctgagtttgctcatcaacaactgctaggagacttcccaagcctcagcagaagctcacatggcctccctgggttgcgaagagtactatttccactactgactgcactctccacagcatcacctcaacttctcccctccccatctctcctccttcctcctctgcctccaactctcagcatccgtggcccctccattatcctccagtacaaaaatgagaaccaccaatatttgctgaaggggtagtctccaaattgtgttccatgaaagtgtttcagaggctctccaaatgttccacgagcatgttattctaaaagtacagtttgactcctattctaacagaaaacgagcacgtacacacattcaaacatgctctatagcacatgggaacacactgaatatagccaacaagtgctgccggtttaatttggtttgtgcagacctcagatgaaggtctgggtagatcttgaccttcaccgttgaaatgtatcttcagttaggaagagtggagctcttcactgggtatctttgtgttgtcattttttaaattcaggactctatatgcgtacacaaaaccatacaagcaagtacactctgaagctttcaatgacaagacaatgtattatgtggattatcatgaaaatatcataaatgattgtggggcttcctgtctgacttatgtgtgtaataggaaggaattcaagcagttgttggatattgtcactgatgcaaaccagaattcccttctactcctccccaaatgcccagataatgttgaactgaagaccattctgtggctttaaggcaagctgttaacaatctgtcaccattcacatcatgttatggatgttgatttagaattccttggccaggcgcggtggctcacgcctgtaatcccagcactttgggaggccgaggtggatggatcacaaggtcaggagtttgagaccagcctggctgacatggtgaaaccccatctctaataaaaatacaaaaattagctggtgtggtggcatgcgcctgtaagcccagctatttgggaggctgaggcaggaaaatagcttgaacctgggaggcagagattgcagtgagccaagatcatgccattgcactccagcctggctgacagagcgagattccaactcaaaaaaaaaaaaaaaaaaaaaaaaaaaaaagaattccttaatactttgcagtcaagccaaacgaaacaagaaagaaaaaggaatattagatattgcagctgataaagcaagcaatacaatgatgatctagggcagaggtcagcaaacttcttctgtaaagggccaaatagtaagaactttagattttgtgaaacagacagtctcaagcagccatagataatgcatttaaaaaacggtgtggctatgttccaataaaactttaccgaatcaggcagcagcctggattaggcccacaggcaagtttgccaattcctgatctagaacctcagatttcaatgtgtttgtgcatcaaaacagaggtgtcgctaataacataataaatataacgttcataataaataataaataaatgtcaaaaactagacagccaggtgtggtggtccatgcctgtactcctagctactcaggaagctgagataggaggatcccttgagcccaggagtttgaggctgcagtgagctatgatcacaccactatactctagcctgggcaacagagcaagacagtatatatcaaaaataaataaataaagtcttttgcatctgacttaaattagactaagtctaaatggcaataatttggagataagaaataagaataaaaatgagaatttttaaacaatgttaaaaatttgaacttaaaaaataatgtattcataaaccatcattttaacctgttttatatattgacattccatgcaagatttggcttttaaaaatagcttctaagactataaaagtttgaaaactgctcaagtttctcattgctgagaaattgcttccatatccattttcaaatgagatctgtcctctagcttctcattcagaaagcacatttattctggagaaagccccacttcaggccccttctgaagagtggctgtgactccatgtttccctgccctcagtaattccacacatagctgtgcccaagcctctgatggtgctgatgggccaccccgccctccccagcaccggggcgtttgcagcactgcacacctctgtcttgttcggatgccatatatcccagctcctccctggtggctgggagggccgtgccagcagtggccgtgatcacctggactccagcagcaccaagtcagcacctcattaatcacaggcactttcttccccagggagaacacaggcagaggcaggagccaggtttctcgctggaactgacagctcatttccctctgggcaagtcccatactctacagattcttccaagcagctggctgagcccacacggacaaacaaagagtctgggcacgaagcggggggaggggagggaaatgccaagtctgcagaggaccccccatctgtactccctggacagttcccccatgtatctggcttgcatctctcagagggctctgcttctggactagttcaagtatctgttgtacacctcatggaatgaacccagatcctgtcctgagactgctcatgagacccctaaatggctgtgataggcacagaaggaaacaagtgctaagttgaggtaccaggaagtgccccaggatgccgagccaggggcatgctggggcattacagcatgatcgattcctatgaacatgtggacattcctggggaaggggtcatccttggagctgtcattgctcttcttcaggaagcatcttggtggagaaaaaagtgctgggtcttttgtaaccagaggctctgccccttaccatctgtgtagctgtctttaaactactgaacctctctgtgctcagtttccttatgtgcacaacaggggcaacaggaccagactcactgaggtttgggaaggactcgaacctgtctgtaaagtaccaaccatgtgggcagcagcatcggtccccgtgcttcagcctgacctcagggacacagcactggggccagagggcagggcatgcagatggcacagggctgcaactgggagagcagggtggtggcccaactgcccacacacgccagaagggtgactcacgtttgggaggtccttgttaacgtggctggcaacattctaggggccttccccagcaaccctgcgaggcaggtatcactaccagcctcattttgcaagtgagaaggatgaggcagagttggagcaatttgcctcttaaaccagtaagtgcctcacacaaccactaagagtcggggctgggatttgaactcagggtgggtctacactgttaagtaccacaacaaacatcccctcttaaaatgaggctccaatgcccagttcttccttggaatccagggaacgattcctttacctcctcaggagaaccctggtctaggcctagggctggtaggcccaagctgtcatactgtgggcagagacacaggctctagccaccccgaagtccaggcagcaacagcgatgccatctctgagggctgcctgtggccccatccccttctctatacagtgaggaaacttcagctttcagagaagcgaaagagtcactgctcctggcatgccaggctgggaaatgttgccttggaaatctcagctgggcccacagacccaaacacaggcccccagaaggaggccctggagtccccaagccttggctgcatcagaatcaatgtagattcctgggtccccaacccccaagagtctgatgcagagggcacaggtaggccagagaactccctccctccgtccatccctccctccctcccttccttccttcctttgtcataccaggcaccctctttctaatccccagctctctgggtgattctggctctccacaccagagaaaacatccaaggacttgttcttgacccaacaagcttctaacactgcacacctaacctgtactgaagcctgaacatctagccagaaaccacagcacatacctgaagatctaaatgcatatataaacataagctgataccaggcctctccccaggctcatttgatcactatttcgggagctggggccctgctattgaaattgctgaaattccaagaatcattgccccaaccctgacatcttttcaattcttcacaacttgggggcaggtggggtgagaaaggggactgaagacctgctgctatgtctctaactcccgtggtgctcctctgactaggcattgggtgggcagtggtggtcttcagcaagaaccattatgtaggagaagagggtagacctctggctatcaggagcacacagttggactggcttgtggaggctgtggcccctggagagggggctgtggccctttgagaggagctgttgtgtcctttgccaggacagaatggaaactgaggtactgggagggggcggactgcatttcatgggagacagcatgggaagcagtagccagttgctggcactcaaggtctctactcctgaccaaggaaggttgaggactttcacaacaactttcacagaggcaccagaaaggcaacgataacactaataataacaataatacatttttcagaggaagaactaagcaagctcatgcaagacagaccaacatggcgcctggcaagcatattcagcaacagcccccatttcctacctgtgctgaaggcaccacttccgatgaccaaaactgaaacgctgttctctctgaaagccagcattcatgtccactcctacggcagccaccctccacctaggcgccgctcttcccaccagaggggcgggcttgcttggccaggaccccgcgaggctcctccatgaactaggttgaggctgctgggtttgtgcctcgaatcctgcaggagatgattgagaaacatggtcaaagaactttcttggtcaacttttttagacacagaacaatccctgcctggtccctggaggacacaccccccaactactcccaagcagctttacttggtacagggcctgatccccacatccccctactttgcatccaacacttaacttctctgagcctctatttcttcactagtgtggtaggcagaattctaagatggccctcaagatttccggttcccctggtgcacagaccctgcaaagcccccaggactgtgaataggatggatggttgggttatgttacagggcacaactgaccttaagagagggggattatcaagacctggcctggtatgaaagccctttaaaaacagaatttgcaggaaatgccattctggtcaccagccttgggaaaagtatttatggctaagtgctcaaaagcaattgcaacaaaaacaaaaattggcaagtaggcctaattaaactaaagagcgtctgcacagcaaaagaaactatcaatagagtaaatagacaacctacagaatgggagaaaatgtctacaaactgtgcatccaacgaagatctaatattcagaatctataaggaacttaaacaattcaacaagcaaaaaccaaataatcccattaaaaagtaggcaaaggacacgaatagacacttctcaaaacaagacatacaagtggccaccaaacatgaaaaaaatgctcaacgtcactaatcatcagagaaatgcaaatcaaaaccacaatgaaatgccatctcacaccagtcagaatgtctattactaaaaaggcaaaaaaacaacagatgctggcgagaccgtggagagaagggaatgcttatacgcggttggcaggaatgtaaggtagctcagccactgtggaaagcagtttggaaatttctcaaagaacttcaaacagaacgaccattcgacccagaaattccattactgagtatataaccaaaggaaaataagttattctgccaaaaagacacacgcatttgtatgttcactccagcactattcacaatagcaaagacatggaatcaacctacatgcccatgagtggtggatgaggtaaagaaaatgtgatgcatatacaccatggaatattatgtagtcataaaaaagaacaaaatcatgtccttgacagcatcatggatgcacctggaggccattatcctaagagaattaacacaggcacagaaaatcaaatgccatgtgttttcacctataagcaggagctaaacattgggtacacatggacataaagatgggaacgacagacactagtaactactgggtgggggagagagagggagggacaagggctgaaaaactacctagtgcgtactatgctcactacctgggtgacaggatcattctactccaaacctcagcatcacataatatacccaaacctgcacatgtaccccaaatctaatagaaaagttgaaattatttttaaaaagcagagttttctctggctaatcacaggagaggaagtcagagagattagggtctggagaaagcttcatcataccctcaccgccttgaagatggagggttgtatggaaaggattggcccgcagcttccaggagctgacagcaaccccggctgatgaccagcaaaaaacaggacctcagtcctaccattgtagggaactgagtcttgtcaacaccttgaatgagcttggaaagcagaatgttccccagagcttccagatgagaacccagcccaccaacaccttgattcagccctgagcagagaatccagccactctgtaccagacttctgccctacagacccgtgagctaacaaatgggtgttattctaagtcactaaattggaggagatttgttatgcagcaagagaaaactaatacagcctggaaaactgactcatattcaggcatgggtggcaatgaaatacagtaatagacataaaagcatattgtattccccaaatcacaaaataaaacaggccaagagaggcctgtttcagggcaggagctcaacagtgattcctgaatgaatacacaaatgagtattggtttttaataactgacttgccaggctgttgtaaggatcaaataaggaaatatagaggaagatgctttgtaaactagaaagccgaagttgtttcagtcagtggtggcgtggcgtgtcatatccacgccgtgctctttggaggatgctctggtttgcccgctgcaggcagtgtcgtgggatggatgagaatgtggcttccagggccaggtatacctggttcaaatctagcccttccacttctgacgtctgcaacttgagaaagttgcattgccttgctgtgcctggcaagtggggctaagaatggtgagtgccttccagggcccgtactttaatgagtccgtacatggaaaaaggttggaacaatgcctggcacggcccacgtaactgctctgaatattatctcagagtggaacccaataatctgggtctggagtaacccgcacacaggcctggggcactgttacctttctcctcttgggcaccctgctttttattcacacagcctcagaatcacgtttggcaaccatatcgcactgctgattcctacagagcatacaggtcaccgatgcccccctgctgtccccttcccaatgtacctgctgctatgaaacccagccagccccctcctacccccagggcagcatcgcagcaccacacagtggagaggcttgctctgtggctctatcaatcagttcctgattctgccgtccgaaccagcccaatttctcactactctgtgggtttctatcctccctgatctgacctcatgccctccaatagattgcagttattaatcaaaatggccgtgctctcttcctcccagtgtagaaacactcacttctcagaacacgctattctacaaacacaatctacagtttcctacctctgagccttggctcaggcagcctcttctgcatgggatgctactcacctccctctgcaatcgtgcccaccttgctgaatcctgcccatcttccctcaggaggttcagctagctcccataaaactggacctaagttctgcctctccagaataccccaagcacatttgctgtgctcctcctaaggtaaataacagcatccactgtgctcagccacggcttaaagcccttctagattgcatacaactcaggcagggtcattctgactcactccctcaccccgagtatggcctgtcacacacagtcagtgtggaacaattctctttagcgcccaagttggttgtttattcatttaacagatgtccactcagtgcctattttgggtagagccgggttgtaggtgccagcgttaatagatggcaaagatttaatctctatcttcaaggggagcacggagtaggggtagtcaattttgatggtgtctgaatgtgtaagagagagaaaaaagaaagaggatatttaaaacaaagggagtcatgtaagaaaagacagatctcttgacctcgtgatccacctgtcaaggcctcccaaagtgctgggattacaggcatgagccaccacgcctggcggatcacgggttcaagagatcgagaccatcctggccaacatggtgaaaccctgtctctactgaaaatacaaaaattagccaggcgtggtggcacatgcctgcagtctcaggtacttgggagggtaaggcaggagaattgcttgaacccaagagacagaggttgcagtgagccaagattgtgccactgcactccagcctgggtgacacagcaagactccaactcaaagaaaaaaaaaagaataaaaaaaagataaaaagaaaggacagaggacccccaaatggccagaatgttcaagaaaattgcatggtgtccacatggctggaggtgaggggcagcgacagtgggaggtgctgtgtaggggccgggacatgacggtttgacagatgaagtggcctggatgtggtggtgctgtgaagtgaggtcattttcatcagtgaggtcctgcagccagggtgaggggtgtggcttgaggagaaaggatcaggtggaaggagagagacttcttctggctgcggtcgtgaggctggtgtcactgactgtccccagtctccccctccgtggcaggtcagagggctgcccaccacacccgtgtccaggtcaccagaaaaggtcacacacacctgagggcctagatggcaaaccgagcccatttatctccctcttctcccccccgcaacacccctcaaataaaaggagaaatgtgcaaataagaacagatctgcagtagcatcagctggccagaaagtccgagggaaaacagacgagagggagtgacaggaaatctaatcagagcgaagctagcctcacccagccgggcagtgagggcccacctgccaggcaccccaggacttgctcagagctcctccatggcagggcgggctggagtggggtcctgaaatcccccccaaaaagagtggatcctctcagtttccaaaatgaccaaagtgagagttgggcagggaggtactgggagcagaaagtacctccccacacacctttctgccttcaactgcatgactttattatcccaggagcctctctccctggcaaatggcttcactgttcatcacagaaacctcctgaaggacccatctactcttcaatcaacagctggtgccctacgattctctgaatcccttgcctggcctcaaaatccctcacctcatggcttccaccagtcctggactactgtgttccttacacaaccctaaccaagcccccacattgacacacccaccttaaagagaactgctaggcttcagaaaacccaaccttgcctccttcctcccagacaggccaaagccctctggaatcagcaccctcccttcggcaagtgagtaataaactcagctttgccttaccaacaagtttgtagatgatatctggggagctggcatttgacagtctctacaaaaatgcttggaatcaaattgacattcaatttggtatctgcatcatttacaacagggcagacctccgagcttggaggaaaaagggttaaaacccttagatccgttactcagccaagtctcaaagccagagagaagtataaaatagtgtgacacccaccacccacgcatcttttcttaaaaaaaaaaaaaattactcgaggaatcactcaaaggaaataagaattgtaccagaataagtaattcaaaaaaggacaatataggatatccaagaaacagggagaaataataaaagcagaaaaaggtgaagtgaagtctaaacaaatgttgataatcatgatcctatcttgttgggaattagatactatttaattcttgacatcaatagagaaatctgtgtaaaaactaaccatttctagaagaaaagcaagatgcaaaccttttaaaccactgtgtggggagaggggaagggagaaacaaagaaaactctattaatttagccaagagtgggaaaagaaaaattaaacaggaaagaaaaagtgtaataaacaaaagacataaaataagatgacaaaagacacaataatatgaataaattaaattactttaagttaagagaccaggctggataaaaggaaaaaaaaatccagctatatgctgtttggaaataacacacttaaaacaaactgacaaaaaagatggaaatcaaataaatggaaaaaagcaaatggtaacgaaaataatgcgagaaagccaatattaatatcagacaaaatgcaaaaatgttaattaaatacactaaactggggccttttatattgccgaagagtctatttctccaaggagatacaaaaatcacgaacttttactctcatcataaacacagaaccacaaaatgtataaaataagacattcttggaatcacaaggaggaggtaaagaaagaacaggaaatgtcttgagcattattatttgaaatttggtggtataagtaacctccaaagaagaatacaaagggtttgaagatgtagttagtaagtttaacttcatatacattcaagaaatagagaaaacacctttttctcaaatgtccctgtactagactgcaagaaaatctcaaattccaaaatgcacgaattgtacggaccacagcctcagttcttgatgaaataaaattagacattaacaaatagcaaaaaataaaaatacataaacaaatgatgcacatgacaatttaaaaatgcttttctaaaaaaactcttgaatcaaagaggacagcaacgctatcgtaggataattataaatgtacaacattgagaaccctacttttcaaaatctgagtagtgcaatcaaagctgcatctagaagaaaatacaaagcttagatgttttcatgataaattaagaaaggttgaaactaaatgagttaagcacataacccaagaaactaaaaaagaatgaaataaaccaaagtaatctagaagaaatgaataaagttgaaaataaaacgagtgagaaaatgacagcaaccacaactatatatatatatacacacacatatatacatatatagctgcatatatacatatatgcacgtatatgtatgtatatatacatacatatacatacgtatgtatatatacatacatatacatacgtatgtatatatacatacatatacatacgtatgtatatatacatacatatacatacgtatgtatatatacatacatagctgcaagctaagctttctgagaagaccaacaaaatggacaaatcggtggcaaatctgactagcagtaataggcaaagtcgcaaataatcattaagaaaggtgatgtaaacatatacgtgaacattttgaaaaatcaaagagaatttgatacataactgtgtcaatgaatttacaagttggtgattttctagaaaagtataaattgtaaaactgaagaagagggagaaaacctaggtagactctaataactatagaagaaactatagaagagaaggctgtcgaagatggaattccagattagcagagaaagaatggattatttaaataaaagcactaggacaactggctggctgtttattcattcaacaaatatttattaagaacctactatgtgctgggcattgttctgggcactgggaattcagcagtgaacaaaacagaaaaggtctatgcccttatggagctgagagtctggtgaggggagatgagtaacaaacaaatccgcaggtaaaacaaaccacatggcaaatagtggcaggtgttacaatgaaaattaagcagcaaaatgggtacagaatgaggaagggtggagaatgccattttaaatagaatacacgcaccatagacacacagaaatgtatatggattagagatataaacatcctataaaagcaagttcatgaaaataccagaactattaaaatatttctatactttagtgttggaaaataactttcaaagcccgaattggacctcagtgctcttaatggaaaagattaataaatctaactacataaaaatattaagcattacataaaacaaaaaaccccagttaatcaacagttaaaaagcaaatgacagattggataaaaatatttgcaacatatatgaaaaagtgtcaatatccataatatgtaataagcatccacaaaacagtaagacatatagccaataaaatggagaaagaaaatgaacagatcattgcttaagaaataaaaatgtctaataaatatatgcaaaatgctggcctcgttaataaagaatatatttaaaaatgtggatcacttgaggtcaggagttcaaaaccagcctgtccaacatggtgaaaccccgtctctactaaaaatacaaaaattagcccagcatggtggcacatgcctgtaatcccagctacttgggaggctgaggcaggagaatcgcttgaaaccgggaggcagaggttgcagtgagccgagattgtgccattgcactccagcctgggcaacaagagcgaaactccatctcaaaaaaaaaaaaaaaaaaaatcggtatcaccttttcccatttggttagcaaagaggaaagtgattgctaccatcaagtggtggagggaggagtcgtcatcaaatacttctcaaatactgctagtaggtatagatgaggagaatcttttaaccgtgtctaccaaaatgtatgttgactcggcagctttgcagtgtgcacacacatcatcatacacaaacatacacacacatgcacacatagggatgaccactgtagcactattttaacagtgaggatggatgcagccttaatgaccatcagcaggaaattggtttaataagtaaatgatgataaatacacacaatggaatagtcatgggaacataacttttcttaaagataaacatatactcctaccaataacagagattcattgtggctttgtctatgtatcaagctttgtctatgtgacgtacaagcttcagcgcttctcacaggtagtctccctgcccccctccctcaacagtctgccgggtggaaggtgccacttctgcccccattttccatctgaggcctacagaggctaaggcctgaccaagcggtgaaccttggtctgttagactctggagactgcactctcagctgtgacacacacttcctctcaacgggatggtgaaaagcaaaatcacagacacacatctatctgtgtagctgtgacggatggaaaggacctgggggatgcaatcttgtcctggagggcactgcagaatgggtggggcttgaaacatgcgttcttgtttctacatttccatactgttctttttttaagcactaagcatgtatcacttttgtaatttgaaaatgatataaaagtatagagacagaaggtagaataggggttgtccggaactggggcagagcagaatggggggtcagtgtttaataagcacagaacttcagttttacaagatgaaaacagttaagaggccaatatcttaagtgaaacaactaagaaacagaaaatcaaatactgcatattctcacttataagtggaatctaaataatgtgtacacatggacacgaagtgtggaataatagacgctggaggctctgaagttgggagagtgggaagggtaagggatgagaaatcacttactgcatacaatgtacattatttgggtgacggttgtactaaaaacccacacttcaccgctatgtaatatatccatgtaacaaaattgcatttgtaccccttaagtttatacaaagaaagaagagaaagaaagaaagagagagacagagaaataaagaaagagagagaaagaaagaaagaaagaaagaaagaggaaggaaggaaggagagagaaagaaaggaaaaggaaagaaagaaagaaagggagagagagagaaagaaagaaaaaggaaagaaagaaagggagagagagagaaagaaagaaaagaaagaaaggaaggaagtaaggaagaaaaggaagaaagaaagaaagagaaaagaagagatggatggtggtgatgggtgcataactttttgaatgtatttaataacactaaactgtacatttaaaaatgattaagatggtaaattatgttatgtgtattttaccataataaaaattgagaaactgatataaaagtgtcttctttttagaaaacagttgaacagggagggggctactaggggtagaggggcccatctgcaaggtggcacccacccagggcaggaaggaccagggccagctcctctgctggccccacccaaaatcatgaggagggagggcccttgctctccactctccaccaacacatcaaagcaaggcctttgccagcagctggtaggggccgcatccggtctgggcactgggggttggcatcactgcagctgacaaagggttaaagaaaaatcctggatgcctggcaggggccagcctcactgggtcataacagctgttttccaagggctggcagggaggcaggggggctttggactctggcactgggcctcacacactgatcctaaagaaagtggagaagaaggctggccctgaggcccctgccaccctcctgacaccctcctgacacgtggcccttccctccactctgaacggaacgtctgcagaaggggccggcacatggaaagtcaaatttgatctgtgtggggcagggaattgtgggatgaatctttctattttcagttttatttgttattgtggtctgtgatcaataagaaaacatgaaaatctaagacatgggtcacacatggcagaatcatatggaataatcctggtggttcatgctgggatactggcaaaggggtggatgggaggggaagagagagaattactggcatgcctcatttacccagcaccacagaagtagcatggtatagcatagcgagttggccttaacatcatcagaaagacatgggttcagaccctggtttcatccattactagctcactttcctcatgagtcagaagtgaagactctcaccccctccctgggtttgccacgtggatcagatgcgacaaagtgtatgtgaaatgagtatgaacccagtatacaaaaggcactcaataaatgcctgtgcccttcttcagttatggtgggacaccttccaagtctctctccctctgtcaatctctcctccttctggcttctgttttggggtttggggttggctctgtgacccacctccctctctgtggtcagccttccggctctcactttcctgaggggctcacctttgtttcagcggagtgcgctctagtctgagaatgctgtgacatgcagctgacagcctggaggctgccttgggaaccttcccggtccccagctgtgttctccagacaagaggcttctctctcacatggtagctgactcacggatgagtgaggcgtccccaacaaggagagtgggcagagagacaggcaatggagtccagtcattgatagcgacaagacctgctttgaggatacccagaaatgttttccaggaaagacagggcatttaaaaatagagaatggtgatactttccattgtatgaaggagcaaaaaagaagaacttcaagtacaagataacatattccatttagtggcaggtaggaatatactgtctcataaactctacactgggatttggcagaagaaaagttcatggttttcaggcactgcagggacaaggaagggaggtgttgctggtgtatatggggagcacccagcccaggagtcgaggagaataccggagtggcgggaggaggaacagacgagactggaggagctgcacttggagatgaaggttctgagagctgctggggcgggggttggggggcgggggaaggtaggtgtgggaggagcagtgaggtcgcttcctgctatatcaggccacacctcgcagccctctgtcacagaaagccccctggaactaggcactctacacaggggagcagagaagacaccgtgttccctctctgggtgcaatagaaatcccatgaggcagccccacatttgaggtccagctgcacccagctaagtgaccttggacaagacactctccatcactgggctagaccccagggtgcaaaggtgaagaagaccttgtccatgtctcaggctgtgatggatctagcagggaagatagataagaaaatcagtggttctggccctttctcccagggagcccaaaacctgagctgcttccccgcaagaaggcttctaaatctccccgggttgtagacacagaagccagaggtagaggaagaacccaacatttgttgagtgtcttccacgtgcaaaggctgtccctgcattttttcacagtcatactaatgctacggtcaggctccatcatcaccatctgacaactgaggaaactgaggctttgaaaacagagagatgtggacagccttgcactgcaggagggcccaaggctctggcattaaataaaactggacattactggtcttagacactgtgtggccttcttcgagtccttgaccacctgtgagtctgtttcctcacctctgaaacaagagcaagagtgcacgccctgggctggggtaagaacaaaatggtacggttggcttcccagaaaaatccaccttctccctcttcctcttctggttacttctgatcttttagctttacttatgtttatgattatttcatcttctaaaataagaagataccagatcccataacaagattgctgcaacttattcacagcaaagcaggtggaggcctcgggagatcccggggactacagaacctccaccactggcccacagtaggacaggggcagggagtaattcatgcctactaggaagactgtgataacaggtgtgtgtttttggaggcagaattgctttctgcccacacgacagctgcccccttagctaagaggggaagcctggtgacccagggtcctccggggacccagccaggcttctggtctagatctcaacctgccccactcctgcccagtgctaccccatcttccaccccatccccacctccaccagttcagagattcagccagacagaaaggctgtgccaaaggaaattgtgtgccacagggcccacttggtctgctgtggtgttcttcctttttttggactttgtggctgtttgagtgggtacctttttccatagaaagtttccattgcatcagttatttacattgtcaccacctatatgtgggctctggtttcgagtcggtgaaccagagcaggccctgtggggcccaacactgcttacagggggtgacaggagccagttgctacggcaagaggacctgcagctctgggtcaaccctcagagccacccccaaccctggcaggtccactcttagtgtgctcagtccctttgggatgccatttttagggtgagatttaagagaatttaagagcacaggctactaggtttgcatcccgcctcctccacctcctagctatgctctgagttattgacatgacatctccgggcctccgtgaactatcatttgtaaagtgggaatgacagtggcgcctacctggctggactttgagaaggactcaatcaggtagtgcacataaagtgcttagaacagggcctggcccaaagcctcaatccatgttaatgaatggacaaggatttcctgcccccaccctggctcagaccctactgcccatcctctcttgtgtgaaccaacagcaacagcgtctgcactgtcctgcccagcccaccgatccatagacccagacagactgtcctgatagccagctctcaccaagtcactcctcgccccaaatcccaaatccttcagtggttctccttagagagtaatgtctgcactttacaaatatgccaggctgcctcggcatcaacactcccctgcaaagccccgctcttgccaactgccatgctccacattcatgcctctttgcagttgtctctgtctggaatatttctctccattttaacgtggctaaatccaacccacaccagcctgggtgagcccacctcataggcctcctcctccacaaagccctccatgactctactctctctctggccaggaatgatctttcatttaaggatttgatctctttgtcgtggtgtttaccttctctaccttgtatgggtgcaatataatacatacaaatgtgtgtgggcatcacagacaaaccatctgatctctgaggacaggactgggatgtgtgtgatgcatccgtgtcactcacagagccttgaacataattggtgactgtgagtgaataaatactgaattctctcaatttactaaccccgtcgacagggaaagctatttgggtgtgtgttggtgaagatcaatctgcagcccatcagtgtccacatgatcctctcggttcttcttgagggacccggcagactggggtgtcagccaggggccaggacccctaggggctcacagctactcagactctgagtctcagcatgggaccttgcatctgaggcatgtgtggaagtccaggaaccatcactgacttcttctccctcttcctcagcctccaccttccatatgtcaccaggttctcagtgaatcagctccctaagttcctacgcccatgagcccctctccaccctaccgccaccgtcttggcctaggcttcagcatccttgcctcctccctggtctccccatgtgactcccatccttttctgggtcttctctccatgctgctgccccaagcggtacttctgcatcacagctctgattaggccacaatgcttcttgccacttctgatgcctgctgactgccatcagaaacccagatcccctaggaaggtgctggagtgtctctcttctctaacgcttctaaccctcatccagagctttggtgtaacatcaatcacactgtccagcgacatttattcccctgcacacgggtcttcctcgcagacagggagtgccttcagggcaagaacatgtcccgtctgtacccccagtgcttggcatgcagtcagcctgctgtgaaagcatgctgaacagacgagtgcatgaataacaatgaattaaacacaccaccactgccctgccttccagtgttgccctgacaccaccatattcaggacctcatttttgggaccaagcaacaggtgaagttactaaagtgacagatacacagtctgcctggaccaaaggttgccccagggcacttgacatccctctgtctgtgctgcagctcccagaacccctgatggcctaatgtcagcagggcagatgcttgccctggtgttagctacatggcctaggaacctggagacggacagaggtcttagggtgtttccagaaggaggggaaggaaagtgaagggcgttccacctctggtcgctctgtaccaagaccttccatgttgttaccttcccctctgcccacccccctcaccccctccccaaattgtgtctgccttcccatcctcttttttttttttttttgacagggtctggctctgttgcctaggctggagtacaacagcacaatcttggctcactgcaacctctgcctcctgggctcaagccattctcccatctcagtctccagagtagctcggactacaggtgcgtgccaccacacccagctaatttttttatttttgtggagatgaggtctcactatgttgcccaggctggtctcaaactcctgagctcaagtgatccacccaccttggcctctcaaagtgctgggattacaggtgtgagccaccgtgcctggcaaaccttcctatcctcttattcctcaccagggtcacctccctgtttccctgtcaggctgtggccacctattgtgcctgaagtagctaaactcatggacctatgggacagtacgtgtggtgaggaggtgggtgaacaggacctgggatctgaccacacccctaccattaactggccacgtgaccaagaacaaatcacattctcttctaggcctcagtttcccctcctctcaaaccaaaaacctgaacaagtctgtctctaaggaccccttctgtttaactccctgtcaggaggttgatttctttaccagccagaataattctttctaattaaaggaaacaaacagagagaacgatgtgtctttctctgctgctcctgaaagccaggatggcctctaactctcagaatataagtcagatccccttttgattactgaaggaatgtctccatttggtggcaatcttcatgcccatataacccagggatttaaagcacacttgcatatctgttcttttttttttttttttttttttttggatgttaacaattgggtaagctaggcctttatcattctcattttgcagagtgaggctcagggaggtgaggattatccaaagtcccccagcaagcaagagggagaagaggaactggctcccaggatattataccacagctggcccaggtcgttggcctaggagctggcctcacccaacaggcaggcaagatactttaataaaacaatagcacacatctccctgtatttttatacaagctttcttcatgcatgcagaaacactctgacgcatgggtacccaaagcttcacagtgagctggtgggatgcctaattcctagaagccaggctccacccagacccaacattccagagaacaggcaatactgagaaccatgctttgtccaggcagagaatccttggttttgaacactccagcccctgctgctatcccaggcctccaagcccttgaatcgaatccaggccagcagaagctctgctgcacaagacagggcaatgccttgttcctcttggacccccaggccctgctggctgcagggctccttctctgagactcccaagggagggctgactgcatgtgatctgaccgccacacagggagggagagaagatgagggcctagggccctagaagagaaggaagtagggttgcaattctaggcccttcttccaacctggctctccctcttattgctcatggtcttgtactgttactttaagaacatattgatcctgccttccatattttactgggaactccttaacagagtctccacagtaggtcctccacatgcacctgtgcagtgcacagcctgcacaaccattcacaacctatggcttctggccatcccctgcatagtatgtatcaccactgtaattaaaaaactaattgcataattacttattctgccttcacagaatataaatcctcaggggagcaccaggccctgtttgtcttgttcccaagctgtagcccagcctccagcacggtgttaacagagaataggtgctcagtaaatacatgctgggctaatgaacccaaccaaccattcgttcatgcattcagtttgaaagagagtgaacctgccctgcaactgaaggtgacaggcctctgttgtggccccagctctaccaatgtgtgtccctgagcaaggcatttccctttctaggtctgttccctcatctataaaatagtgtggggtttactctccatgccacatttgcacgaccccgaggaaaagcacctccttaaattttgcaccccgggcaccttgctcacctcacccatcatgacctgaccctggttttctacattttcctggttttgtccagacctgggcttatgggagatgctcggtgaagtcaggagaagggggcttccaggcagcattcaggggatgccaaggttgggagaggagtttttactcctgggctgtatctctgggagagaaaaataacagacagcagtacttccccaggagagcagtgtcttcaaaggccttcttcatcagccttgtttaacctccagcctatggagaaggaaggagggaagggttggctcaagatccaagttaccaagtgtcagggccaggggcaaaccccaggcaccctgtgttcagatccagacccttcagcatgcggacacagcctggctcccatgagtgcggggcacaaccagtttcagccggcagaggcacacacagtagcagaggaaggagatgttccttgcaggagatgggacgggagccttgagaaacaggagggcttatggagaaggatggggtggcattcctggcagaagagatgatgtctgcacagtgtgcctgcaggagaccatgttcaagggtctatgaccactttcttacttgcagagtggtctggccaacggggacccatgagggtgaggcacaaggcaaagctcagatggagataaaacagaagagcacgactacagagtcctctgcctccagggcactccaaggacctcttccccatcatggcctcagcctccctgttgtactgcatactttagttttgtaaggcttctgtaacaaattatcaccaatttaagccaaacttaatggcttaaaacaacacaaacttattatctgagaggtctggaggtcacacatccaaaatgggtctcactgggctaaaatccaggtgttaacagggctgcattgctttctggaggctccagggaagaatctgtttcctccttttccagcttctagaagctgtactccttctttggctcatggcctcctcaaagacatcaatggccaggtcaagtctttctcacactgcaacctcctggcactgactcttctgcctctgtttaccacacttaaaggcccttgagattccactgggaccttgtgggtaatccaggacaatcaccctactctaaagccagctgattggcaatcttaattccatctgctaccttccctcccctttgccctggaacccaccatactcatagacttcgagaattaggatgcacacacctttgagtggggcattattctgcctttcacactgtgtgaggcacatctcctccaaatggggttttggaaggaaggtggcccaggatgagagagatggggtggatggtgtgggcaggagagggaggcaggcagacacacactcaccctcctggctgcctgcttagcacacatcaccattgaaaactttgtcatgtttccatgctgaaccgggcacaagctgtttccacagtgactgcaagagcagaagcagagccagaaataaccccactgacatggaaagcctccccttcccttggtactttgctctctccttctccactctccccatcatagtatgggaggttccagtgggttctaagttggaggcccttccagggcacgctgaggccttggggaacactcctcctgcagcctggctccagcagggggaacatagggatctgactgtggggctgggcctggtcacctcatttccacaccactgtagtgagcttggagtctcctctcctcagcctcactgcctctgagccacaagtccctacaaagtcccaatcgctccttcttggatctcttgccaccaaacactgggatccgcagaacactcttggtctcttgggccagaagcccatgggatgttctgatctggccccctccttgggcctctgggaggcccctgactggtgaggccctgcctggtgggcctgggacccactctcacaagccctgccagcccccagcccagtccttgctactggtgagccttgccagcctgctcagtctccctgcaccaggagccctatctgggaagctgggctcaaaccctaccttctccaaaagcccctctttctacaggttttttccttagaacaagatctcacccactgcaggggctgaaacatttgctgaaatatatagaccaacgaatgcccgggcctcaccatccataccactccctcatatggcattgtgtctctatggccctgggaaatgtcctccacgactgtttaatttctcatgtctttcatcctagtccgacaaaggaaaatggagttaatgcacctcctacctgctgggcactgagcaaagtattaaacgagcatgcatcggcacatttcatccctcacctccactcaaccatcatcaccaccatcttacagagacgcaactgacttgcccaaggtcacatagccagaaggtggcagggcccagactggacctctgtgtgccagactccaaagcctgaggctgcagccaccatgtcccactaggggggccaggggaggagacacagagatgatcaatagcaaatgctaaacgaaatgtgtccaatttgcctcctagaaagccctgagcagctcaaggtgtctccaatttttgtctctttgtatgtattgggatttggcctaagattttatttgggttttcaaaaagttgggaggatatggaggggggttacatgaatttaaaagttcggaggacatggactgtaggccaaccccatccttgtaccaatggcaagaccaaggcatggaagtggaagtgacttgcccaaagtcatggcctctgccactgaagccagtgaactccacttgtttctcccacccattccttgatggagaggacatcgtatgctccacttagcccttggcactgcttggcacagaatttagagtccaatgtggtatgggtcctggatcctgctttaacagtgctgcatagttgatggcttggtagctcaagtgctcagagcctctgcgtccttgtctgcacagcagagcctgtgtggatttattcgagaaggcatagacctgctttggatcatataatattaggatcacgggtaacagagctgggccctgagccacttctacgggaagatggaaagagctctatatttagactcaaaagcctcaagtagagtcccagttctgatgctcatcactttgtggccggagcctcccacttgacttcattgagtcttactctgggagacaaaaatgtctcccataaggggttggtatgaattgaaatgaggtaacacatgtggaaacactggaggcataagaatcctctgggttgcagaatcccaggctccaccttctcccactgtctgattctacagctgcggggcagggcccaggaatctgtatttccccaatcccctcattccccaccatgattctgttgcagttagtcaacaggccacactgcaagaaatccctctaaaaagggctcaatatgtgtttgttaaatacacgaatccttgaacatctgttgagctgcatatggctgctaggagacatgggccgaaggaaataagtaattttccccaaatacatttcctatgaaatctaaatgatgggaattgggttggggcttcgaagactaggagatgatgcaataatagcttccttctccaaagagctcctccccttagatggggagagacctggctggagggtcatgcccagtggctcaggatcaaatgcggggaggggtgctctggagacggagtcccctggggatgagttccagaccctgttctcttcagcatcttcatgaagacaggaaagaaataactgaaaatatgctcattaaatctgcatctggcacccaatttggcagggttgccaaaattctgtaagactagaattaaattagcaaattgcaagtaaaatgattttaagcaggcatgatggaattcatcagggccaggtggaagctcatgggggaagggagtcaggaaagcccacatccccgggggtgggaaagcctggccgggaacggaaacggaaaagaaacaaaccggcaagcagaaatgacccaaatccttaagattcacccttggaatgtggtggtgacagaggcagccccacactgcaaggtggctagaggctccttctgggagccaggaggtgtggctgggcagcacccggttaaggatggcagctcttcaaaagagggtcaagaagaaaggacccgagggactgctggggaatgggaggggtgggtcctttagactggcggccccacaagggcagacacgtgggcggtgacagagcagtggcatgtgttgacactgctgaagcaccattgcgtgcttactgatctcacagtcagggaaaaacactggcatgggcatggcgggggcaggggaggtacagactctgaggaaggaagaagaggctagaagcatttcctgggcgcttgctaagtgtcaggcactgtgttaaatatttgtcaagtattataatctcatctaatcatcacaataatcctgtaatgtaaagagtcttcttttctctttattttcttgggttttcttttttgttttctgggtttttttttttttttaatgaagagatatttaaagtaagaagtagacaagtcctgcttcatcctctcaaagcctatttcccagatgaaaccaccaagcatagttcactgggcttgttcccaggctgtttctctgagcgcagaaacatttctacatgtgcatacacagacttaactgtttaacttttcctgtataaaaatgagattgtcctaaacatattacacagaaacctttttccagttaagaatacattctgaatatcctcccacgttaagacctgaaggatcatttctttcttttgaaatggccacaaagtattctctggcacaaatgcaccataaattttttaagcattgtctctgctggacactgaggtcatttccaatttctctctatttcaaacaatgctacaagggagtacctttgtacacatatatttttgagtacatatttttctatagccagggaattgctggaccaaagtgggtacagtcagctctatctgtgggttccacatccatggattcaaccaatcgaggatcaaaaatagttggaacaaaaattccagctgggcgcagtagctcatacctgtaatcccagcactttgggaggccaaggcaggcagatctcttgagtttaggagttcgagaccagcctggccaacacggtgaagccccgtctctactaaaaatacaagaaattagctgggcatggtggcacacgcttgtaatcccagctacttgggaggctgaggcaggagaatcgcttgaacttgggaggtggaagttgcagtgacccgagatagcaccattgcactccggcctgggcaacaagagcgaaactccatctcaaaaaaaaaaaaaaaaaaaaaatccacaaagttccaaaaagccaaacttgaatttgttgtgtgccaaggactatgtgatccacataaatgaagtgatatgtaggcaatgtattaggtatcgtaaataatctagagatgacttacatatacaggaggatgtgtgtaggttatgtgcaaacactacaccattttatataaaggacttgagtagctgtggattttggaaccctcagggcatcctggaaccaattccccatggataccaagggatgactgaatatgcatttataattttcattgataccaatttagattctcaagaccctttggcccttgccagtactagatcttctctattttttaaaaatttttttacattttgccacctctaggcagtaacaatctcatttttaatttacaatctttggttttttagtggctagagcattagtcatatatttatgggccatttttatatctgtgtactatctgtttatcttttgcacatttttaaaaacttggctatgtttttagttagttgatagaacaataattttctaactaatagttctttaaataataactaatacatagctttctatgcacctggcactcttctgggttcctgacaaacttcacagcattgactcaaagccccgagaggtggtcacagcagtccatgtttatagccaaggaaagggaggctcagagatgtcaagtaacttgtttgaggtaacacaggtcagataagaacacgccagagtctgaaggactagctaagccaaccacttcatcacgagttagttctttctgaagccttcccatatgtcccttgccatctaatccacagagaaagaaaattcccccttaaaatttccctctctgttatttatcctttgcttcatttgcaaagcctttaaaagagtattattctcatatgccaggtaagaaactgaagtccagtttccaacgagaggcaatcatagcatggaattggcccctaaccctgatatgcctggggacgtgcctggaggagtgaggagaaggatttggcatggggcaggatttacacatggggccgaggatcagggaaagtggaggctgaggcagggcccaggatggcaagagttttaaagagcaggccaggcagtctacaggactcaccctacgagcaacgtggaggggtgaaaagctgggacaaggagtcaggtgaagatcggcctagtgagaaatcatcatcaaatcagagggtgtccccacctcaccggccatttccactgaccaggcacactgaccaataaagaagcctgccctgcggggtaacaaacacacctgtgtatatgcaggtgctggcaactctatgtgtgaaagctatacatgacaaaagggtttttggtctttagtggcattttaaaataaggttcttttttagctcctaaacaccaatgtcacatgtgggtttctgggttacaaacccaccattgatttgtcacatgagcttggttaccctcgtctcaatgagcacacacaatacttctgcctcccatgagcaccgcacgtagggaagggaaaaggatcatttgcatgccatttttcttctgaggataaaagaaattaagctaacaaagtgggaaaaaatgtgagaaactgacatgctgaaactaacatgcagaaataagttttaagtcactgtttattcactttaatttttttagctttgacctcagataaccttagcatttccccaaatgtttttctgtggaactcttctccagctattctgtatgtgtctaaatgtgtgtgcgtgtgtgtgtgtgtgtatgtacataacatatatatataacatatatatatatttgttctctgatcaattaatcttaaaaagctgcacacagtacccacctctacacacacactcacattcacaaccctcacacacacatactattttgcagatacccaatgcacttctgcatattaaagactgagaactcctgcaggataagggtctttaaagtttcccaaatgtacttggccattggactttcattttctccctgtaacacatctttacaccccatggcacttgtggtctacaaacacaccatgggaaaagctggacttctttatttcataagatcagagcttgcttaaaataaagagcccagatatcctacccttttaaaaaacagatgggttctaatcaacccatgatgatgatggtttcctgcccacctgggcatctggtgcctctcctagatttcagggcgacaccaaatgttcgcatgccaaggcaagaaaccgttaggaggccaggtgtcctgcacaggctaagctgtgtggctcagcagttgaagggtgggtctggatcaatcccttgctcagtggctttcagcccaagggtccccagagactcacctaagccaactcacttgttctgtgaatggagaatgaggcactaagcctcaaaatcccctggcccctgttctctttcatccactccatgagacacctctccctgggcctaaatattttctactgcaaaaaaaaaaaaaaaaaaaaaaaaaaaaaccagattacctttaaaggcctttccagccctctgactcttctgactctgttctccttgcacctactccttcccagctatcgtcactgcaattcattatatagatatatagtcacttgatatagctctacaagtaaaactatgtttctgtctgttatagcatcaagtgaaattgagttggtgaactttcactgaatacaaagggcatacttggcctaggttaaaatgtaagttatacggtatacatgaaattcacgtgggggcagtccctggggaaggaatctccaatagaaaattcctctgccagtgttgttacaggcactggtttataattttgctccttctcacacaggcaactcaggatagttgcttaggatgaccagtaacagagatttaattacttaatgactctttatggctttcctaagcaacccttaggaggacagctagtggaagtgtatatggattcattcatttatttttaaataaaatgttcatttttggaatagttttagattgacagaaaagttgcaaagatagaacagagaccccatatagcttctactcagtttccttccatgtgaacatcttacataacaaggtatatttgtcagaactaagacattaacattggtacattactagtaactatttcaccagtttttccactaatgtcctttttctgttccagaatccattccagtatacaacatggtattaagttgtcatgcctccttcatctgtggatttattattgttttcaagaaatagacaccattctctactgcacgcagggaggtatgctgggtactacagtggatcccagctgccctgcagggagaaacacagtgtccagtggagagcaagtctgggtttgagtgtccattctgcccctcatttctgacacagtcctgggcttgtcaccccacatctatagttctcaggttcctcaactgcggtctggagataataccttctagcttgtgagagagctgaatgagacagtctacatggaaagacattttgaaggcttaaagccctgtcccatgcagctattattattattaaagttgctgtaacgattatcattaagcatatttgatacactgtttccaaagcaggacagcccagagtctgagctgtctgaccgagccgacccttccagcttcaaatgagatgtttccatagacctccacgtgccccatagagaaaggaaattttccttagtctgttcagttctacacttcctttatggctccattcatgggtcaccatatcagtgataccttctctgaccatcctacagcaaagagcctctgaggccgcgcgcggtggctcatgcccataatcccagcactttgggaggccgaggtgggcagattacttgaggtcagaagttcaagaccagcctggccaacatggggaaaccctgtctctactaaacgtacaaaaattagccaggtgtggtggcgggcacctgtaatcccagctacttgggacgctgaggtgacagaattgcttgaacccaggaggcgaaggttgtagtgagaagagattgtgccattgcactccagcctgagtgacagagtgacactccatctcaaaaaaaaaaaaaaaaaaaaaaaaagagagggagagagagagaaaagagcccctgaatccctccccacggcattctctaacttcccaccctgcttcatgcttctccatggcactgaacccatctgacacattccctattgccgtgttcctttgttcacgattggcctccctccactagtttatgagctccctgagagccccagttgtggtctgttttggtcagtgctgtaccccagtgcctagagcagccctgacatatagtgagggctcaacagatgtctgctaaatgaatgactatatgcttggttttactctgtaatctcttgcttccaccctggtaacttgaaaacaactctttacacccaaacatactgttgaattcaaatcagagcaaagctatttggtaagcaggtggctcagagccctttgggtcttctttaagaaaaaaaatagggtaatgcctttcttttaatttaattcaatgtcatgaacgtttctttgcctgcctcctctcccatgagtggctctgccaattagaaaccacagtctcttccttgtccagagcctgtctgctggcctcctcacataatcaattccaacagagtccaggctagaaaaagctggtaaaatccccacagccccacacgcagccagttcacttccttactgtattcactcagcacttgcacatcaaaggcccatggacttctcagagcaggaagaaacccaggggatccctcaggccagcctgcagctgaggacattgtggttcagacaggggagggaactggcaaatgacacacagtagttagtggcagttccaggaacagaacccaggactcccagctccataccctggccccaattcctttgtgggctggaaccatctccccatgcccgcctttcaccaaggaacacgtacgtgcttattacctggagctctaatctgattgtctgcccacccctgaccattcctgggtatttgaacttgggcactgatgggctgagatgactctccaaagcagcaatgcaccaggcagcagagttaagagccagacagaaaggaaacgggggttgcatttgttcagagccaggtactttacatgctcatctcaactaacactcacagtgccctgaaatgaaggcattataactacattttataaatgaagaaaatgaaacacagagaacttaaaaatgcagcaaattacacagtgagaaaagggcaggaccagcatcagagtcaagttcctcctggtaaggaagcccttgttctcctgcccgaccactccatcagaggcccaaaggcctagacagcactccagagcctgttgggctgggtccctaaaaacaacaaaatattcctctggggaagtaaccagaatgatcccattctagagatgaggaaactgagatctggagaggaaatacaacttgcacatggccacgtggcttgtgggtggtagatttgctcaactctgagcttcttggggatgcagactctctcctagtgcttagcccagagctgagcccccagaaggaccaatccactgttgaataaatgaataaatgacagcgtaaggtgagaagcacaacctcccgacactcccacaagccgggtgtttacaccccaattgacccacacggtggcctcaggagcaagagaccaggctgatgcaggtgagcacaagcctaaactcacactgatatccaaagctcacatcctcgtctctgagcccatcgatgtcagaggcatgggaagtgatgctggccctggtccccattcagccctcagctctccatggagcaatggttatgcaatgaagaggtttaggaagatggcggagctggtaattctttcacccaaagactgatgtttatggcatggaatgtaccttcctcccaaaggctggtgtttggggcaaattggtctattttgttgccccctttgggagcagctgattcattcacaaatactgcagtttttattattctcagtaatttttcatcctaacaactgaaactagttgttgtttatggttcacctactaagtgccaggcacaggtatctaatgagacatctgtcaccctgtaggtaagtgtgagcattcccacatcacagatcaggaagctgaggtttaggagaggcaaagcaaataggaaaggcacagggctagaaagcaggagatataaactccggtctgtgggacgccatcgctcatgctcctaccatgtggcctttgcaggtccgggacaagggggtcggagccacagccaaggacagatggaaatgggaggcagatggaaggcctgcctgacttcctgggcctcctgctggctgggcttctcatcccaggcagaacatctagcaccagggcacttctccacatgcccacatgctgtccccagactctctgatcagacaatcagggtggaacttggagctcttctgttcaaagccctcaggtgacagcacctggcacccctggttaagaaccactgctgtcaattctcagaccattttctcacaactacaccctcttctggaaggttcgaaaatgtttcttaagaaatctgttaattggtttacaaagaatatcacaactcaaaaccgctgagaccttccaattctaagattctcaaccaagcaacaataactcatccacaaatgcatgtgaaggtttgtctttgttaatggcaattattcccaaacagcgtgatgtttataaaaaggactttggagcccaaagtcctgggtttgagtcctagctcaaaccagttatttgaccacaggcaactcaactcaacctaatagttattaaaagcccactatggacccagagtcctgggctgggaagactagggacacagaagcagacaaaaaaaagtcatgatccctcttagctccgagttcctcatctgtaaaacaggaaccagcagttaccaagtgcctgctacacccccgggccttgaaagtgcatgttctcacttcaccccccccatgagcctcgggaggcaggttctcctgtgatcctgctctgcagcggaggaagcaggggctcaagggggtgaagtggcctgggtgagcctgcggcagtgtgtggcagtgtctgcactctttccatcccatcccccgcttggcagattagtccacagagtgaacaggataataagggagagtgctctgcagccgatcaggaaccgcacagatgtatgacatcatggttattaataatggaagcagcacaactaattcacaatccttccagatggaccacctgaattgtctcctaaaaacctcctgcaaacagagcatcgaattctataacggtagagctaagagggtccttagaagtctgaccttttcctcatttacaggggttggggatggacagatctagagggcagccccgccccacaaagcccaggatgcactgttgggctttagtgattgaaccaggaagataagtaggtctcagatcaaacaccagcagttaccccctccaaagggtgctggcaagaatatcagcagcgaactgcaagtatggcctcttcctggtccctagcccagctcctttctgctacagggcctttgtacctgctgttcttctatggcaaatattctttccccaaagctttgcaaggctgtcacttctttattactcagatctcaagataaatgtcagctcctcagagaactctctgggcccccacgtgtagcttctcccattcctccctggcattctccatcacacagctttgtttgagtttcttcagagtgtatatgacgacttagctttatctgatccattaatattcattatttctcttcccactggaatgcaaactccctgaaagaagggattaaacagttttcactgctgtagtccctagaatggtgcccagggcccagcaggcactcagcaaacatgttcatcaagtccccctggatgttggcctgggtcatggccatcctagcatctggcagacactcattcaataaatgctattgaccctctcctctatgccaggctctctgctagatgctgcggtccttgccctcacagtgctttgacattgattaaagcaaacagcacaggagacgccagagctgtggctgtcccatcacatgcaaccaagcaatagtcggccaatatccacaaatatggcagaaaatggaagaaactgggagacatggaggaaatgcggcgttgggttggccctgcaaagcactcccacatgctcagtactcatcttggggagctagtgccaggcaccccctcaccagctctggggacacggggacaaggggacatccccattgccacaactacctcatagctgcagcctagaacacaatgggatgaatgtgtgtgtgtgagagtgtgcgtaggagcagatgtgtgagtatgaacaagtatacaggatcgcataagtgagagtgcatgggagtgggtgtgtgtagaggagcagggttgtgtgtgcgaatgagtgaacaggatggcatgtgtgagtgagttggagtgggctgtgggtgtgtgcacgtgtaggaacaaacttgtgtgtacaagtgggtgtttgagtgtgtaagagtgcacacacgtgtgtatgtgtgcatgtgtgagagatgactgtggtaccattaccaagctcttcaccacaggctccacatgtggttgaactttacatgctaaagtcttcaaaatgaaaggcacagagttggtaactggtcatcacttaattcattcaacaataaatcatttgactctttatgttttttaaacacattctgcaaagtgtccatacaaagcagcaagactggttctagaggaaaattctcaacttctggatgtcattcagtgaggtgagagcactggatggggagtcatgttgcggtccgtgctttaccactaactactgggtgatcttgggccactgtttagctgtgtgacctcagatgagcctcttaactgttctgggcttctgcttactctccattaaaacagaccaattagaatttagctctcaaagtttggttgcaactgtacaacactacatcatctctatgggtagcccctgaagcactgtttccttggagagcaagcctactaacttgaaaagggcccgcaactagaaaaaaaatgctgggttggacaaagttaaagagtcttttattgcaggacttctcagagcctttcatttgccagtatggattgtaattggccaaaagggtaatagagagcttgcacaatttgccattcttactctaacagggaaacctttactggtggaacagctttcagaactaacaatccactgaacacactgggaaaatctgctactaggcacacaggacacttattaatgaccccttttttgcagatgatggaacagaaagggtgttctaagtcacagagcagagccatgacaactaccagcccagaaatcatccaaaccacagttactggcacgtgcacaaggctttacatctacaaaacattttttacttacgtgatctcaatctttcttaaaaacatacctctggggacactcattccatttttgataaaacatagcctgaaagagacgaacgagtctgcccagagtcactaagggatagacccataatttggctctatcagtttcccctatgtccttgatgaaacatcaatcaatacattatatttttatagataaacaactgtggccactatgcagagatccctgcaagatgccaaggctgatgctatctgcacctgttttgcagccaccaccacttctgtctgaagcccaagcaccctgctctgattaaggggggttggggagggtgctctcagaaatgcccctggagtagaagccgctctggaaacatccaggctgtgaagtgggagtagatctctcccagtcgccacaccctcctgaccatgccaggtacaacccgctaggatgtacccccagtgccagctgtcattatgccgggaggaggggctcctcggaggatccagagcaatgctagtttaactcactcccaatgagccccgaggagccccaggctggtgggctctgacagactgaaactgcatggccttgggggaagctagggctgccaaacccattcagcagctcccgccgggtgtgccgtgtcccacggtatgcgtgggtgcgaggggtgagcgccgcgccggggtgagagtctgcgctggacacaggaggctgtgcacgccaacggccgtgccaggcgcgagtgtgccagagaagtgtgtgaacgcgggaacgcttgtgtcgccctagggtggtgacagaagtagtgtctggaaaacgctggctgagagcgcgtgcatcaggccaccgcaggctgcgaagaagccggggcccctcactccaagggtcccgggagttggcaccgacgcactactgcaagcgcgcccgcgcccagccctctcccaccgacgcggctccctccggtccctctgccgcccgctcggcggtgcccggtccctgggctgccaggccgcggcgggggcgcggcgcgcggggcgctcgttgcttacctgcgggcggccgaggctccgctgctctgggctgggctgcgccgcgctggactgggctgcgctgggctgcgcgcccggcctccgcgcggctcggcagcgcccgcgcgctcggctccgcccggctcggctccgcccggcggtgccccaggcgctcgctggcggcccacgcggcgcggggtgggcgcggggcgggctggcgggcgggcgccggcggcgggcgcggctccgggccgccccgcggccgcttggaagctccttatttgggcagtgatgtcaggggaagtcgcaggggccggaccacccacttctttccattcactccccagagtttcctgtcgccgagcacggggaccccgccgccggcccggggcgcctctcccgtccgctcggcctcactgctggccaccccgggatgccttcgcggccggggtcgcagatgggcccgggcgcggctggcggctgccaggggagggtctcctcgcccggggaatccctggctgccggcggccgcggggagggtctgcgcgccggcctcctcggtgacaggccgtgtcactccgggcgccgcccctccctccgcgcccgccccggctccggcgctgtcttttcctcctgggccctctagggagggcagacagggaagcccctgtcgccgccgccggggccctgccactctgcgccacgccttggtcgcacccgggcccagcgggagtccatcgccgtccccaaagtgtgcgctccccgccttccccctgggtgccagccgggctccgggaagcccgcgcctccccaggcgggaatccgctttaatgagctctgggcggggcgggcctgccagggcctccctgggctcaggcctggggtgggggcgggggacaccccggggcttcccaatggcttgactttaccagaagctgctggatctcgggatttgggcctgagtcactctggtccttgctctggccaggatcaagcacacttgagccagttcccagccaggcctccacaggtctgcgggaaggccaggaccctgagatctctctccgtgatctgttatttcactgatgcccaccagaggttatttggcagaggtcaaccctctgccacagtggaaccagggctggccctgggtttggctgactccaggaacagcctcaggaggagacaatggagctgggggtcgggggtgtagagtggggttaagccaggactagagtgaggtaagttaagtgcctaggatgcagaatttaaccaagcactccctttcagggtcatgaaagtttgaggccccacaggggaactaagcactatgctgacccaagtttccagggggatccttggaggctccaggtttcctctggctccaaagtcatgccctcaacttctctaggcccaaagggcggattagtgaccttgggcatttgtgtgcctttatacaacagcctctgatagagctgccacccttcctccaaagccagatcagagcaaatagactcctcccagacccccagctttaatggagggaacccccaccttctaagaggcactacattcctaggggcagagaggaggaagctatggctccagggcttgcagagagtcaaggcaggtgtgattgcagctggacatgggtctgcacactcacgtacacgattgcaaacccactgaccagctgccaagctgcccagctgttctgtggatcaccaccaccccagtctctctcaacttccatcagctcccagggcccaatcccagctctaattgggtcatcctccttctgacaaagccccaaagggaaggaccacacttcctgatctggcatgcaaggccccacggaccagctgcatctcccagagctcagcccatcctgccatttgcccagccaccacccccaacacgcaccactttgcaccagtttccacttcttgaggtcttcatacaggctttccctttgaaatgtcttctccaccccctccagctgtccttcacaccctgaatccaagcctgcccttgatacaggtccttctcttgagcagggcaactggggtggggtgccccctgggacagattcctgctcctcactccactcctgccctgcccccactgtcctgcttcccgttttctgtctgaaagcaactccaggcagaggaggtgggtgccttgttataattcatatgccctgaggggtgactttctatcattcacacacacaggctcagatgacagccttgctcctgccccaagttgaatgacatcctcctcccctttgagaggtggcctggcctcaagggaccctcccaatggatttggtcaccttccatgatgccacaggcaactcaatagttcctgcctctacagacttgcccatcacctcacattgaagtcagttattgggggcctcctcttcctcagactgggagcttcagggaactttccatcttgatccctctcccctcccaggactgataagtttacaaatgtttgttaagtgaatgaatggtcctgaggggcaaatcctaagacaaactaaccagaggacgggggagaatttacccaacccagaacagtggctgatgtcctagggtccctggctgggggctgggatgaaaggcggggttctcagctagactggcttgaatgctcaggagactgggatggcttgggatttgtctcctcctttctcttgacaaactcctctgcagccatcagggagcctgggatatccccatgccaaccccccaaaacacggagtcctgagctggccctaatgaggtggaggggaaggatgaaggaaaatgcaatttgtcaagccctttcattgtaccagacacagtcagactggatgcccctgagccttccaagccatgcaggcctttccagcggtagtcattccccaggccaggagtgtcagctggggagccctcacctagctcctcccacaaccatctgtccccacttcaagactcagcccccacctcagttctggtgccaattctcactggaagccagaaggtcttcaggactccagcctcagagctcagagaaagaaggtgggggcagacagccctgcttcgaggctaccagcctgacctcgactctactctgtgagcccccacctgcagaccaggcctccaccagtctgcagaaaggcagagttgaggtgcaggacacctttcccaccatgtatctgaaaggcaggtggtaccaggtgccagttccttcctatcagccccatcccctgcaagtaactgggccaggtcttgagaaagtcccagtacttggccctgggggccttcccacattcctgcattcctcaaacatgaatcaggcaccatttctgtgttgggaacatgtaatacacaagcctgtgttcatggatggagactgacaggtaaacagatatcccattgctaaatgttacactgctgtttgacaaggttggagaggggtggagtaggggcatacaagatggaaagataagattcattctacttctggagctacaattcaagaaaactgtgatccaggtgtcccgggctagaatgctgaatgcttgtttccacggaaatgttatacacacacacacacacacacacacacacacacagtctggatctgctgtaaagccagcatcacactgtagagactttacaagctaaaagagattagagcagagggcaggtttggcatctgatctgccatctagaaagctatctctatggaattttgtttccagcttataacaacaaaattagacacaattttggaacccactgttgctcccaaggagctagggaccagcacagtgtgttgggagcacttttaaggtggggtggggctgagcaaccaggccctgtgggccttctgggttatttatgtttaggtcttacactgacttagcaaccatcccctctccatcctccatccccattgctgtgctttcctggactcagatgctttggttgttttcctgtttggggtgtgtgtgcgtgtgtgtgtgtgtgtgtgtatgtgtgtgtgtgtgcatgtgcacatgtatggtaggtgctctcttcatagacctgttgcacacatgaagcttctgtcctgggacagagactagagtttgcattttatggatatcaccttcctgaggtccagtcctccagactcagttcccatcctttctctccagcctgagaactgtgtttccagcttcctgacttaacttgatgctgtggataacagcatgggccttggagccacatagacctgggttcaggctccagccccacatttactgtgtcaccttgggcatgttacttgatgtcactgatcttgacgttctcatctccaagggctgctgggaagttttgacaagacactgcaatagaactcttcagtgtacaaaatagtaggtgctcaataaacagtagcattgattactgtcctcccatatggtgactcagaatcctcctcctctcatactgctcatcttcatggatgtgggcatcaatcttctcaagcccgaagccagaagcccttctccatgcctggtgcctcaattcaggccaccatcaccaacaagttccaacagccttctccctggcaccgtgcccagcttacccctgcaatccattctccacacaggtagaactctctaggacaccttcaagtgggtccctgttcagcgaaaccacccggtctattagggcctttaacaacagagcctcagtttaccagtccaaacctccctctctctgcactatccccatccaccctatgctcccaccatacagaatctctcactgtttctgagccttccaagcacattttgcacatgcagttccctatacttttcccctcacccatctgcttggccagctcccactcagccttccaggccagctcagaggccacttcccttgtgaaggcttccctggcccccagggagtgttggcgtttcctttgccatgagcctccagcacttgatacagactgtcctggcttgtgccccactatgagagtcatttcttcatgtgtctgctgcccccttagattctgcatctctgtgcatgaccaaatcttagctctaggaatgtcacagatattcagagcatgctgaactgttaacacacggctgctctgaccatcctgcctggtaaccagcaactacaggaggccagttggcctcaagctcatggaatagttttccccaaatgacaaaagcatcctcttttcctatacttcagactgagacctgggtctggcctaagctctgagactgcctcattctggcttttcaccagcattttgggggactcccacagggctcagcaggccccaggtggggaaggcggggccttcagttccaggaaatcagaagattagtcaagccacactcccctggcagctgtgagaacaggttttccccaagccaagggacttgcaagatcatcaataacaacaaatatttactctgcccatggctttgtgcccaccaagggaggtgcataagtacagcatcaacttccacagcttggattaagatggatgtgggtgcatgtcctggtcctgacacttactggctgcttaactcccctatacctcagttttcacagctgctaaattgggagaataacacatcccaggaaaaatttagaggaataaattagagcagataaaattaaaagagaaaatgcatttaaagtatcaataacagaagcaatatgtattagtcactcaataaagaagccccccccaagccccccaactcaagctctttgggggatactatgatgaacaagacctagtccttgccaatagctgatgaagtgagggaagggggacatgagaattaaatcagaccctataaacatgaacacaaggtaaacagcaacaggaatgacaaaaaagagttctgggagtagcagagggagagaagaattctgagatgcccttacattcttcttctctcctgagactttcatccaactgattgatataatccatgtggccagcccagggcgaagggctgggtagggcagtgggtgggcaggaaggaatcccgaggcaagacaaatgaggcctgaaggatcctgtgctcaggcagctcacagtctggttccggagaggccttgcacactacagaaaataactatgacaacagtggatgaaagcagtgaatgctgccgaagacatgggcgagagagatgaatacgggaggggtgaggcctggtgcaaaggctactttcaaaagcctgcatccacagcaaaggactgtggaagtggcctcaccccatccctgctcaggctctgctcccactgcagcccttctgacctctcaaggccagaggtgagaaccccaatccttcagccttgcaatcttcccacttgcagtcatgcccaggaagggagtggcctgggccagacagctcactagtccgtaaacataatgtgaatttggatactccacttttccccatgctgttccttctacctggcatgcccttcctcctcctatcccccatccacccttccctccagctcccctgtaaattctctttgcctatttagtgaactcgtcctataagctctccttcaaaagtcctgtttttcttattttttcctgacttccactctcagcagaattgaaagcacccttctcagtgatgttctggtaattagctttgtatataccatcaaaatatttctcacattatagtaaagtatttgtgtctggtgcccctactaggttaggagagctctggggtcaatgcttggtacctactaggtgctcaataaacagggcacctggaaggctttctcctgaggcttcccgcagctggggtggaatatggcagcctctgctactctgcctgggagtgcagaggaagcttccatgatccctcaggaactccagactcttagtccagtcagccatgtaccttccggcctgaaaacaagccctctgagagctgtcttccccaggattttctgctgatctcttgcaacttgctcctcaaacccaccctgaactctgactggattagaatcccagcaagggtcctgggcacctggctgtgtcctatttagaaagggctgagtcaggcgaacttataagcagaggcaatgtcccagagggtggcagggtggaagcgctgaggggagacctggggaggggaaggcaggcctgtgaatttggtgggtcttggtttgaaggtgaaagatcaatagcagtctgggggtgggaggagggtgtgatggttaattccatgtgccatctcgactgggccatggggtgcccagacatttggccaaacattgttccaggtatgtctgtgggggtgtttctgggtgagatgaacatttggatcagtagacttaaagcagattaccctccctaacatgggagagcttcatccaatctactgaagacctgaatagaatgaaaaggctgagtgggaggaaactcctcctgcctgactgcttgagctgggacattggtcttttcctgcctttgcaccagaatgaaacatcggctcttcttgggtctcaagcctacccacttgcagaatggaacttataccattggctttcctgggcctcaggccttcagactcagactagaaatacacatgggctctcctggatctccagcttgctgacagcagatcataggacttctcagcccccataagcacatgagctaattatttacaataagtctcttcctatgtctatatctacatttatctctatgcctatcatattgattttggttctctagagaacccttatagatgtctaaatcaggacttccctcagataccaggaggaccccatattcctttttggggtctcacatctccaacaactctgaagtaagtgagcatttccttcttcctcatagctagcagaggcctcactccctgggagggcctctttgcagatgggcagaagccgtcagtcctctgtggactcctagcactcaatatgggtcctggcacccagtaggtgcacagtgatattgactgaacgaatgcatacctcacacttatttgggtagccctttatggtttggggcataatcacacccatgtcctcatgggtgtgatcccaaggctctgtgaggggcagggcagggaccatcagccccagttaatagatgagcaaacagaggcccagagaggacctagaagcagttccagcagaaggaccctatctccagggcattggctttctctggagcagccatggcccatgtttagcaaaaacaggatgctgccctgagcccaggtgcctccatcccccctgaattcatgcactctgtaacacatgttcagccactattggctgggccctgttctagggacttagagtgcatcagtgaacaaaatgaacaaaaatctctgccccatggaacttatgttctaggggaaagagacagacagtaaacaagaaacagaataagtaagtaaactatagagcatattagcaggaggtatggactatggcaacaaggcagaacagagtaagggaaccaggaatgcaggggtgggagatgagtcacaagtttaaatagggtggttagagtcagcctcattgagaaggtggcatttgagcagcaacttgaagcaggggaagaattaagccacgcagttactaggaaaggcctttataggcaaaggggcaaccagtgcaaaggccctgcgtcgggcatattacacagggcctggcaggccaccgtgagagctgtggctttcagagagataaaagaaggcccacacagaggcctccaacagattctacccttcctggagtgtggggcctgctcaggcagataataggagagccagaggatgcctgaatggaggtgggaacggtagacaaagaagaggtgggaagaaattttccctgattatcatccctttctgcttcaaccagacacccccaagcaaaggcagctcctgcgggtgggggacaggcccctccccaccctgcctctcctaagcctccctctcaggggacttgtgaggagttaatgaagttgagcccaggaaagcaccacaggtagactgtagaacgctgggcccccagctggctatcaccatcactgcccagcctcgacagggaggcaggggcttcgcctttcctctgctacacactggcagatgcaagaagcagatccgctccgaagcctagatgaagtcgcagttagcagcctaattttagactgagcatctgctcttccgtcccagagatgcagctctgtctgggatttgctccttctggaattgccggagaaacgaatcctgctctcgggggcaggcactggtggtgtccagatcagagctgaccaataggccctgccatggggaaggcctcaggagctgtgccaccctggccatcctgtgtcctcctagctgagctcccatctcacactgacatctacagagtcctatagcttccatcttggagtcccactctgccttctcagaaagccacaggtcaaatgaggctccgcctcacgcagaacaggggacctcctggacaggagtggcttttatccatccccacacccacagctcccagcgcagaccccgaagaattcatcccaggtgagtacggcccagtcagactaagactaggagagcacaaaggaaggaccagttgtttgcaaatcttcccaggaaagcttgtcagaggagatgagttttgagttggattttgaagagtgggtaggtatttatcagtggaaaagccaggaaaagctatggaggcaggggaaacagctgaaaagaatatgaaagttggagaatggcctgaagggagggagaagaaagtggggagaccctggtggggattgggcaggggctgggtgcagttgagttgggccacaactccaggctaagcagttggggttgtatctgcaggtgggagagtctatgggggcccttagcgcatgagtgtgctctgacagatggctgtggaagacttccaggtgggaagcccatgcccctctcacctgggagagccactttccctgttgacttcctccatggtttgccaggtcctttggggccctccccacctccctggcacatgtggggcaggccccatgtgcagagtacactgtggatactcactcccctcccagacccccacctgagctctgcccacacatctcctggcatcaggcccatcacctcccacccttctgaccgctgcagccactgcttggtccttgtctgaatccccagttcccatgggcagtgttcttttgcttctccggcctcagcttctctgccctggggctgttatctcaagattcctcaagaatgactctgcagtcccacgtgcctctccctacctttctgtttgtgggcggcaagccctgttctctgagctaaggactttctacacatcaccttgctttatcccccaacaatcctggaagatgtttattatttatccctttttacaggtgaagaaaagggtttgatgagcttaatttgtgattgatcacacagccaggaagtggtagagtggaggccgtctgcctctcagtcctctcccaccaggttcccccagccttgagggcagggcttgagcagtgatgcccaggccagaggcagtcaagacatctggccagttcaggtggggagtgaggagagtgaaagaggaggaagactcagccagggaccatgcctggattcccttgagaaagaatgagttaaacacttacgtaaagagatttgcaaatagattctacaaaacaacatttggatgatttaagtgttaaggaatcagaaccatatggattaaatgtccctgacgttacgtatggttttaaaaattagaaggaaatgtaccgggaatatacacatgtataaaatatgtaaagccaggccacatttttagctttgtggacatggagttatttgaaaaatacggcacagcttctcccaggctggcggtccccctgccccctccccaggccttgtcttctcccccaccaaatggggctcagctccctccctaggggcccagcctgagaaagagacttcctggaacagccggctagctgctctaaccacaggacagttggagccaaacagctgggtcaggaacgactggggtctcccagaggccagatgggtggtctcaggtgcaaagaggcagtgagagaatgcaagtttcccaggaggacctttaagtactttatagagaagatgttgagtagctcaggagaggcagacagcattttcagttcattattgcttttgaacctcactcagtttccccagcagccacaggaggaaaaggttattacccccatttcataggaggggaggctgaggctgaggagggctggctgctcggcttagcttacaggcagtgcaccagaccacgacctggatttcctggttacacacccagagcttctcctcactgtatctcactgcttgaaacaaaccaaaaccgcgagcctgagtccaatttcttgaactctaagcattttttttctttcaagattgtgttagcttctcaagcttgaaggtttatctggcagggtatttttgaggactccctaagtatgaataaatcaagtttggttgtgagtctaaattgcacatgctgttgagctagggaagaagggataaaatgttcagtttgggaaaaaccaaaccatcagaaatttcctggccaagtcctggtggtgaagagagaggatgagaacaaaaagccagttcgttaaaagcatcacgttaggtgccaggagtgtgggacctccctgaacccccaccccagcccgtgcagaaggtggggttgtctttcttctgcagaaaaggaaacaggcacagagagctttgatgatgcacagctgcgtttctaacccctgcctctctgacaccagggcggggcatttccctaaacccagctggctggggccgacctccccagaggggcttgtcagatgaagccagaagcaggtttgtcaggagaattgaatgtcacccagacataatccccgtgtcgggaaagctggccctgagtctgtctcatgccccgccaggtctccaatgcccagtccagtgcctgatgtttgttaaatgatcattaaacaaatcaatgggtgaagaggaaggaggcatcaaggaaccactacatcctccccttctctttcttccattccccacccatgccactgttttgtggacacaagggatggccttcccacgaatgtattcattctggcgatgcttcatcctgttcagtggcattcatgcttacagcctgtccagagctctcagggtgctgactggaacctggagtatttcaaggacgtgggattctcagggcaggaaccaggggaaaaggagaaagggcagaggaatgaggacagagaaggtgagagactcccagctctggaacttcctccctgccccgtacccaggacccctccgtagagtttgcagtagatctgcccgtcgatgggtttcctataatggcctattcacaggtgtcctttgtccagggttatcccagccccacccggctgccggccaccaggatggaatcctcacgctgagatcacatccagccgcctttccacacaagcacctctgaggagtccctttgtctgcagcctttcccatggtcaattacgttgggaaaacactgcctattccacagtcaccttggagctccccagtgtacacagcaatgcacaaagccctgagaggggcgggtaaagaaaacagctcatctttagtccacacttattggaacagaacagggactccccttttcccccacacaggtcccatcctctgcaccccattttcacagccatggaattcttaaaatgctggcacaggcagcctagaaagcccctcagaggccttctgctggcttctcatttatagaaccatcctcccatgggtgtccctgtccccccacaggtaccccaaatgtccttgactccaggctttaatccgtacccctgtgtgccccatgcctgtcctgcttaaatcctctcaatggcttccttctgctattaagacaaaggccaaattcttccacatggtgtccaaggcctgcttcagtgaccccacctgcccctcctgccacatctccccctcgatccacctggggcgtagggtcttctttcggtgccccctgcctcagggcctttgtacatgctgtgtctgtgcctgggacactctgctcgtacatcccttccacatccagcggactcctcttcaacctttccatttccccttgcatgtcacctcctcagggaagccctcccctgcccccaactaaaccaggccctgtgcacattccccagcaccaggcatctcctctccagagcctctcaagtagcagcatttgtaacttttatttatgtgtgcagtcttgtcagatgagagtgacatgtatgttttgctcaccatggaatctccagaaactgtcagagtagctgtgacccacatggattgtttctcaatgctgagccctgggatcagagaactgatcaccctgtgaggttagtactgaggtgctgtctccactcagagcctgctgagccctaggaagaccaggagagtttaccactcatcgtgaattccctgcacctggcatagaatatgattcaaactcagccctcaatatgggtgtagaggaaagtgtgcaggggtggtgggtgagcccatgggaaggagaaccaggccacaggctctgctgatgattgcggctccagggtgtgtccacacggcccagctcagacacataatgttatggagctgaggtgacataggatcttggggaccggggacaggacagctggggaactgccaatggccgggcaacatctaatgccacatcaccccgcttcccctcgaccagctctgccaaccaggtgtttcttttcttttctttctttttttttttgacggagtcttgctctgtccctcaggttggagtgcagtggcaccatctcggctcactgcaacctccgcctcccaggctcaactgattctcctgccttaacctccccagtagctgggattacaggaatgtgccaccatgccccactaatttttgtatttttagtagagacggggtttcaccatggtggccaggctggtcttgaactcctgacctcgtgatccatctgccttggcctctgaaagtgctgggattacaggcgtgagccaccgtgcccggcaactaggtgtttctcagcactccctgaggcctgggtgaggctggggatggcggggacagtttcctccccatgcaggagaaggtggaagaacaggggagtcagactccagcccaatgtctcagaaattcactgtgggagcatggcagggtcacacaatgcttccgagcctcagtttccctatctgtaagatttaagggataagccaatatagaatgatttacatattttgcctcacattattactgactcagcgctttcatccatctcagggtaatgcacgaccattccttttctttctctgttcagtatcctctctcccctttcttctggcaagaattcctcaggaaactgccccccaactccactctcaattcaggcagggcttcccttcacaggaggccaccatcctggccagggcagggaggggcaacctgtttggccaaacacaatcgcgcagtgacccaggagtagtcatgtggcccaagacgggccaatcacagcacctccctaggatttttcaccctgcaacagctgggaggaaagtccacttttcattctggagtcaccagctgggatggtgaaggctagggagccagcaggggccatggcccttctccaccctgcagagtcactgtgttatgccgtgtggaggatgacgcccaaaagcagcagatgagactgagatcaacacgaaaaggagtaaagatgaaaagaatggggaaaataagagtctggtgatctgatgacattatatcagctcctggatctagccatgcctgagctccaccacctactcatccctataaaatgagacaatgagacaaaactcagtttctctcttcccaccccaactctcacttttaaacaatctctgaaaaggcaggaggaatgaaaatgagcatgcactgagagccatgcactgctctaacacgcttcacacgtataatccggtctaatcctcatgacaagcctatgtcgtaagagagaaatacaatagtgtgacagaagacaatggatgctagaaaagggtgttaaagacctgagctctaatcttagctctgccgtgcaccagcggtgtgacattgagtcagttccttaacttctctgggcttatctttgcttcactataaaatggggtagtgatgcctacctcaaaggccatcaggagaatgatgagacaaaacaaatgaaagagcctagaatgttcttggctaggagaactttaatacgtgttagttgagcctgtgaagtccagaagccctacagctagtcttgtttctaagaattagtgttggccatggggaaaagaagagaggaatgtgtgacaagctcccagctaaagtccaatatctggttaatatccagcattggcctgtaactatcaaatctccgatgacgtgaggttggctgatgcgtctgcttccccgcacatcgggcggtcaggtgagtccgcaggaacaacagttctggtgagtggtgatgggtcaccaaggaaaggggcctgttaatagtttccagatgggcctaagctgcttccagtctcccctgcacagtgttgaaaagatgggctaggactctgaacaaagctgaacttgacctggaggccccagctaatgggttattggctctattgggttggggacagggcatgcctctctgtgctgggctgtctgagaggttggcccatttgtgtcaccttctggagagcaattctaaaaaaatgctgctctgaataaatattttggttccattttgcgacgtggctgttggggagatttccatcgagtgtggtttgcaaggcgattctcctctgttgtttactctcggcgatccccacagcctgttcctggcagcatctgcatctgctgcactcctgggccgctgggacctggatgctccgctccagagagaggctgagttggccggcccctccattgggagcctgattgcgacaatgcattaggcagctggccaccagacccacagggcctccccactcctcagcttaaccttgctctccttagccagctctggctaaggctggtgctcttttagaagtcccattcccaccaacaaggaggaggctgtaattagcccagctgctctaggccaggggcttggaattcctgtgggcctagagaagcagccttgtccatttcctcttcccaggggtggcctccggctcgcgctcctctccacccacacacctcttccccagaaccacaaccacacagcagcaggcactatccagtctgagcagtaccactgtctcccacccatcccccacacatcaaagcaacttggagagaaaccccagcccccttgggcctgagcccaccacacctcttggttacagtgactgtgacgactgccctacccgcttgaggccaggtccccagggctgccaaggctcagcatgcccagccctgctcagatgatgacagctctccagccaggaggccacacctcatctcaaagaggaagcagttagaggtgggagccttaagcacactttcaagccagctcatcttagactctgctccctatcaccatggccagatgtccagggagaagaaggattcatggggtcagggtctggcaatcaagacagagaaatggcacaaagtagggagggtgctttccaggcatagagtttggtgtcccagtacaggacccatggcccagggagaaggtgctccacaagggatacatctcaaggatcctgggtgggaggactcatatcacgactgggcatttggaatgttcaagacccttgccatggaggcagaggctggcacacactgttctttctccctcccttttcttctcacctccccaaagccactcccctactctttttgacatgcgtccaattctggtggctcaagttttcatgatgcaggccttctgggaccctattttgcagatgaggaagctgaaactcccagaggccaaggtccatgcccagggtcacagagcaagcaaggcagagccttgatttgggcccatttgtcagaatccaaatccagcactcattccatggcaccatggctgcctctgaacatagaaaggacagatcctatctccccagttgggtgcgtgggactcatttgcctatacctgcaatggaagctgctagtccctccctagcctcactcagtggtccagagaccagttgcatgcatttggggaggggactggtggcagggatggaggactgctttggtatggaggggagctgaccagcctacaaggtgctgctgcccagctgtggctctgctggcaccatgtagaccagcagtgtccctccttctcccaagctctgcttggctccagactctcagctcagtgcctgaaggctcagccctgcccatcactgaattcagcctgcccagacctgggaggatgtgggaaacccagttccatctagggctagaattaattttctcaccagaagccacatgccttgtggatgctctgggcttgcctctactcgcttgccacagtcttctcctagtgcccttgggaggcagggcatctatctggaggtctgacttgagctcaatcctgctgccttaatgagaacttcaggtccactttgctaagggtctttgcaggacacctgtctggctccacagccacccactccatgactataccctgtgcctcatccttttagcaaccaagttttggatcctgccctgaaggggagatgggccaggatggttgagcctccttctaagagacactggctctcacacctcaggcacacactggtccctgggatgaccatgtgggccagacagctaaggatgtgacatagtcatttctctacaggtcacgttggcaaccaggcctgacattgggccactcctctcaggccaagcagctgagacccctgggctccatcagtactgagcatgtccaaggtatctaagaggataccttagattctggccttgtcctcaaatgccaattatcttcttcctgtccaaactcttactctggcagggagtcactcagagtgctaaaacagtgggaaggattgggggcagtaagcttcaaccagaaagatcacttacaggttcttagcctcatcacagtgtccagctaggtggggatcagcctatagttccaaggccatagtcccacttgcttctttttgaaccagctgatagctgtctcagtcccactcagggcaggaacattgtcttttatgctggtgctggaaacacaaaccacacctctgcatggaaactgccctgtgctctgctctgtgattctcatgctggcatcccaaatcttttaaagcagaatgtggagttcctaatcaaccggcatcaagtttcagtgaagccagatgaagcagctctggcgatctgccgcacaatgttgtattaatacctgtcgtctacaacaacgtattgtacacttgaaattttgttaagagggtagacctcaagtgttcttgctaaaataaaataaaacggtatatggcatataaatcaaacaggacaaccccctctccgtggaagcttttatgaaaataatcacagctaccacttactgagtacttgctatgtgccatgatctgggctgaccatttcacatttatttaagcctcacaataataatccctggagggggtattaatactattcccaatttgcagatgagaaaactgaggctcaaagtccatcctattccaaagctcttatcattccccagaagctaagaactggtgtgtgtgtgtgtgtgtgtgtgtgtgtgtgtatagacagagactgtctgctggagtgcagtggcacaatcacagctcactgaaacctcaaactccttggttcaaggggttgtcctgcttcagcctcctgagtagctgggactacaggtgtgcatcgccatgcccagctaatttttatatcttctgtagagacagcatcttgctttgttacccaggctagtcttgaactcctgagctcaagtaatcctcccgtcttagcctcacaaagtgctgggattgcatccgtgcagcaccgtgctgagcctgatctgtgtgttttatcaatgggctttggagatggttcttgagggccaggggtgactcacagttgaactaaaatgagatgtgccctctccccggcagaacatactaaagtgctcagctggtgctcacgtggctgcaggcctcctgcctgtgtgatcccagggttagtttgtgagccacagaggacaaggcacccttgcaccacattctttcacaggcacagctctcggggcacacatcctctgggccagaatggtgcagcgctggcctggcccctctctccttgcttccccagagaccatcctaatgggatgggcaagtgatccagtgggctggtggcacctgagggaggaggggctgggagggaaaccttgtgttcagctacataagttccactgccacaaccttgtgactatgtcccctcctcctgatatggactggctgccccaacttggatgttctttctgactatgtgcaaattccgattcatttacaaatctgctcccagctcccctctgggaatggtgaagccctgctcaggcacatccctccttcctctaacgctatccctgatgacatttccctggctattacataatcaagggagctcagccaggactttaattggaaaagctcttccccaagggtctccgcggatatcacttgtgccagcccaagccctcttacctctcaactcctctctgtggtctctttctctctctctctctcatacgcacacagggacacgcagctgaggccacatcttctgtgcctgtccttggccacactcagtggcttgcatgcttggtgctcactgtgaactatgctgccctgggtctttcaggcccatccccaccaggaagtcttctctgagcacctccacaggtggctcagggctggcctcctcctggcttccgtggcactctgtgcttatggcattgctgtggatgtgtctgtctccctacctaggtcgtgagctctcaagggtaggcaccaagcctgattcttccctgtgctcccagcccctgaattggcccagccccaagcaggctctgggagggttgatggaacgggtcagtgaagcagagggaggaccccgccgaataccctgtggttggtgtcttggggagctctgcattagctgccttacagactttccagaaacaccaagaaataccagctctagacaaaccaaagaaatgaatccagttttcagagtggaaactgacgcccagccggggacaggtggtgcctagggatgcaggacctcttggtggtagagaagtcttaagggggctcagtgcaaactcccttaggcctctccaccctcctgctgcctctgagacctcagtaagagcctgcggaagctcactcagggctgtgctctgggggactcatttctattccttccaatagacaccttccaggccctgggcttggcctgggacttagtcctggtgctcacggagccgtacagacatggaccaaaagagctgcaaagcggggtgaaaatctaataacagaaatgtgcacaaaagtgccaccacggaagatgggggaggtcaggggagacaccatggaaggaatgacatctaaactgggtcttaaatgagagtttacaagaggactaagtggagatgggagatgagaggaagtgggtggttcagtgaaagagaaatgtgcaaagacagagaaacatgaaacaacacagcaaaatggggatctgcccaagccaagtggtggggctgaagcccccaaaacagaagggaacctgcactttaaggctgaagcagtgggcaaggccacatcaagaaggacttgaaagctacactaagccaactggaccccagctggtaggaaaagagccttatatttgcagtccgtgtgcctcatgcagagctcccttccaccaaccccaaagtgggaaaaggcactggcatatgacataatcctattctatcccttacccaggcaaccccctaggccctgtaacaaacacttcaccactgatgggaactcctcttagccacagacatccttgcatctcagagctggagctgtgaagtgctaacaattaatcattgcagagatgagttcacggtgacttcagaatatggagtccttagggataagttttataaacaggtttggaacttcagcaaaaacagcttctcttgagtctgagtaaaggaaagggttattgcctggctcagggctggtatggccatggctggaggctgggaggaagcccacaatggctgtgtgttttcccgtgagattttacctacactgaaaatcctggagcatcttcttggactctcactagggcccaggactcagtaaaaattcaagagcatgagtcaaagcagcctggcagaggatagagctaagttagaagaggctcaggacctggaggcagccctctgtggtgctgcccctcactgccatctctataccagcacttcgaggttcttcccatcaccaccctcctggtcctatcactgctggtgaccctcataacccatggaggaactcagcaagttgtgtggggtgcagggtgttgctacagagctcagatgactatcagttcctaattggttagcagctgtgtggtcctttgtcctgtcttccaaaagcactgcctttaaaaaagacctttgcctgaccttgagatcaagtctgctcttttgacaaatgtggaaactgagccccagcaaggggaagtggttaacccagggtcatgaggggaggtggggacaggggtgcgggaggacccaggtctcctcactgtctgcctcaccactctgacttcctggaggtgactcagcgagacaagcagcagaggaaggaagtgggaaagggaagcccagcctgctggattccaggtcaccactttgttagtccaaagccaccaaccaccttggccatgcagctctgcctggtgccagtgaccttccagcccttccttcccaaggctgcagctgctgaccatttcctccaaggccaagctcacatggcctctccagggtctccagcgactccctgctgtacagtcccatggtgctgccctcctgctggggtcaggagtcacctccatagacctggcatctggctgaacctgtgcaggccgaaggttcatcagtgagatgagaggaggtgtaattactgcctcatgtttaatagctgggctctggggcctgttttcagttttcatcacttgctggccatgggtgctttgatcaacctccctgaactcagtttctttaatctgtaaaatgagattacatgcaacagtatctactttgtaggttgcttgcaggattagatgagataatggccagccgcagaccatgaacttaagacacattggctcttgacatcattgactatgctaggtgtgtttacatgcatcctctcatttaatcttcacaacaacctgccaggtggataccattattctctttcactggtgaggtgagggcacacagctcatggccagacgtgaacctggttctgtctgattccagagcctaaatattctcctaccagctacagaaccttctcttactgttatatggtcaagtgcctgtttttgccctatcaccacgtgcttgtgtggacagggcctcttctccttctccctggattccagtcctggctctgacacttctcaggaatgagacttgtctctgagcccccactgtcccatccatacactgaaaaattggcactcccccagccttcttcttggaggaacacacaagaggacggatgtgatggtgttttgcaaactgtaccttgctgtttgaatgcaaggtgctactcccccaaacagaaatgcttttgggactgttgcgagtgcagcctgagggcagagatccaggaggaccagggcctgtaggagtacctgccttggccaccacaggaattgctgcaggtcccttcagtttgtggctttctatatgttgagagcaggtccttgagagcaaggcggggaggctgcagatacagtacaagtctttgtttccttgcctgtttcctccactgcactgtaagttcctcaagggaactggactggctcacagcacatcccttggatggatggcattcacccccctctccagccacatgggctcctgggagctcaccaagtgggccatgctgctttgcccccatgcccagctcaactccccacgggaagagatcatctttctctcatgaacccaggtccccacctcaactgtagcacttactatatcacaaacccgatttctaccttgaatcctttttggaacagagtcagggtttgaataaataaatatacttgaacttatttgttttctgtctgtttcttttgctggattgtaagttccctaaggcaccttctgtgtgatactcatctttgtaactctcaataaccagcaccaggaacctttggggtatgtgtagcatggttctctctccaacccgcctctctgtcttgcaaactccccctctctcaggggctggtgtgtgttggaactgtgtgtaacagtggaaacaacaggcaccagtggatctgaccagcaaatggactggcttatcatttgggggttgcctcatgtcttgatgaattctgggtttacttttgggttctagactgtggtttttttgtttgtttgtttgtttgttttgttttgttttgttttgttttttttgagatggagtctcactctgtcacccaggctggagtgcagtggtgcaatctcagcccactacaacctctacctcctgggttcaggagattctcatgcctcagtctcccgagtagctgggactacaggcacacaccaccacgccaggctaattcttttgtatttttagtagagatggggtttcaccatgttggccaggctggtctcgaattcctgggctcaagtgatcctcccaccttggcctcccaaagtgctgggattacaggcatgagccaccacacccggccatagactgtattttcaaagtcaccacttaagtaatctcctccagaacaatgggcccatcgatgttcaagatacacaatggggagaaagcaaggagtaggaatccatcaaaagccccgtacagttgtcttcttttctccttgactttgccgttgatgagtttacatgcctgaccacttccaggacatatcaagcctggacatagctggattgtgagagtgtgctgtgtacttctaagtactgactggaaccatgcaaaagcccagcctcttttatgggtcaaggagtcctggtgaagacagtatcaagccttctgggggtggggatggagtataaacagacagcagttctgagaccccagaacccaggaagcagttctagctgctatgagtccctggttctcatctgtgaaaagggagaataataaaatccaccctgcagagttatcagaggagcagcatgagattacaatatataaacacaggagcatggtaagaatggattcattcactccacaaataatcatttagcatctactatggaccaggccctggtccaggcactgggcacaatatacagccagtggcatgtgggctggtcctgagtgctatcaagaaaggtgaagcagaaaaagggaacacggaatgggggtggtggcagtaggaggtgctgccatgttaagtaggggaccagagaaggcttcactgagaaagggacatttaagtaaagacccaaaggaagtgagggatgggccatgtgcatatgcttcctaacagaggaaacagtaagtgcaaaggccctgaggccagagtttgtagaacagtacacagtccagaggatatgggggcaagaaaatcactggggctgtgaaggcatttatgcaacttctgaatttcactcagagacaggaagctatggggggttttccagccaagatgacataacctgacttttagagctaatcactaaactttagctgccccttctcttcaaagcctcatttaatatccagacctctgcaactccagcctatgtgcctctcctttctcagatttcttccagctttccacatctctccaaaccaagagggcttcatcatgctctgccacatgcaggctggagagggacctcgcagagaggctgtagttgggaagggagagaaacagagcagtcttaggtaatggatcttgctctcctctctctgtgctctgaaggcctctgggcctggcccagctgcagcaaacgcacacacttaggtgcacggcgatgctgggagcaatgacagagtccccggtgccccttcatcatctgagaaagctcagtgcagaactgggaatttcactccatgctccctcaccctgcttatctaccaaaaggtgaaatcatttgttttaaaataaaacaattcccatatctgtcagtggtttttaaccttttttgggtcactggctcctttgagaatctgctgaaagctatgagctatcagaaaatgaacatgagatatgtactcattttcttatcattttaggggtttcacagatccttgaaaattcagtgaagaaaccattatctaagccaacaatttcccagccacagctccagatgaatgaatgaatgaatgaacaaataaataaagaggctgagtgcagatggaggaacgatgggggatgaacagagcagaaagatgcatgtgcctgtgggcaccacggttcttgttgatagttcctgacaccttcaaagaagccaactgggaagtgatatggggtcagggtgtgcttgacaggtgacctccagatagccaagccgatcttcttcagttcctctcgtctgaccccttctgttgttctcctctgaccccttctgttgctctcctctggcccctctgggtgactatcgtcctaaaaggtatcaaagcacacttccctgtctttctcagggtgtcctgaacaaaacaggactcttttcctggatggctatggggcaagagaatgaacgtaaattcagatgtataaaatgtaagcaatcactttttctggtcatatggctgacctggctgaggcccagagcccccacatcggtccctccccagccctctttctgggatccaggtttctggcctcccagttcattttaatttttgatacatctccagggaaggtggaatgaacacttaactcattcttaaagtcacaactcccactgtgaaacttttaacacaatctcatttttttctaatcattgttctacactgtaacatagggagaccttaggtggactagggtgggtaggaatccgtccaaacacacaatggtcccagggaactcttctgacagagaagcacctccaaggccccggtgatgtggctccgccacctctcctctgatcattctgcctcctcctcggcaccatgctccagacatcctgagctgggagttccccaaacggatctgttttttttttttgcctctgttgcttcatgtgtgctgtgctggccacctggaacacaggccaccacctgcttgtctcacaagaaagctcttacctctctgctcaagctcacctcccagcctcctcagagagcccatttccttcccctgggaatcccgcgtcctcaccttaacctcagcacttaggacactgtatttccaacttctaaaaaaaatctttttgggagaataaagttacagtttagagaaagacacttacaagtgtttacttaccgattcatttcatgaactgagtcttatttatctttgtttccccagcaaacagcacaaggtacgtattgatgtttccgtaggtatttgcaaataaatgttttcctggtagagtggttctctctctacccttccagctagattgtctgttgtgacctcaaccccctgctggtagggtcccacctttcactggcctccctcggcctccacagggcacctgttagaactgtgtgcaaaccacgagggaataggcgctgaggggctctctcgggagtgaactcgccaacttagtgtttggaggttgtgcctcaagttacggctgccctggtgagtctgtgctttctgggatccgggtgggtagggtcactggtggggaaacctcctccagcaagttgtcatagtaaccaggactttccatttcacgggagagagtccctgggaggaaaaacacaccaagggcttgggaggagtggtaggaagccatgaaaagccttctgacactgtcctcctgtaccctttgctttgcttcctactggtttacatgctcaaggtagaggccattatgtgtgggcatctgagtagaagctgctgaaaatagccgcccgactatttcagggagcagctgaatatgcatgaagctattttagaaaagatgtccctggcccagctaatccaaaccccatcctttcccttagaagtgccaagacaagttgaatgggacctttcttagtctttcccactagggtgggggtgcttcagaagccacagaaacaacaccctggctaatgttggccttgcagcctgtcggctccgcctcccagtcccgtggtcacagaggcttctagccagacagctcagccttccacggtcctccggggccttggcagccttcaacaactactttgccacaatcccgtgtgcctaggtccttgggagtctcagatcttagatatttccacatttgttcatttattcattcaatacacttgtattgctggataacatgtgtgaggattgttttgggtgctgggaaaaaatggtttctgacaccagcttatggcaggggagtgtggacaggtgagtagaaagacaataaccataaagttccaaaacagagaggaatcaggtgttgggaggttggggaaggagcccatgcttcttcctgatggctggagaaagaagatggcatttgagctgagccttgtctgagaaacatggctggctcaaggggcaggggatggctgggtgtggcaggggcaccctggtggaagggtgtgcctgacaggaagtgagaaagaagggcaggagattgtggggacactgaatgctgggctagcaatgccttctctgagtcctcaggctgggatggggagcaccccgcttccacgagcctgaagtgcctggtgcacccttgccactgccttcaacctagaccggaagtgccttgggccaggagcctggtcagatcctcctgagcatctccagagccctgtgccaggcttgggactgagtacacttacatattgttggctgaaagcatggattctggcccggcacggtggcttacacctgtaatcccagcactttgggaggccgaggcagatggatcacctgaggtcgggagttcgagaccagcctggccaacatggtgaaacgctgtctctactaaaaatacaaaaattagccaggcatggtggtgggcacctgtaatcccagctactcgggaggctgaggcaggagaatcgcttgaacccaggaggaggaggttgcaatgagccgagatcgctccattgcactccagcctgggtgacaagagtgaaactccatctcaaaaacaaaaacaaacaaaaaaaagaaagcatggattttggagccagacttcctgggttcaaatctgggctctgccccttactcactgtgaccttgggcaagttatctgacctctctttgcctcggctataaaatggggataatactagagtctatctcatggagcttcttggtgaaaagactccattacatgaattaatatatgtcaagggcttagaagtctgtgtggcacatagcaagcaatacataaaagtgttaactatattattctaaagaatatggatttttatcttgaaatggagtgccatcaataacaagttttccttctaaattgaaaatagctttattgctttgactgatcatatcatatgtacctactgtaaaaagttaaagcattatcagtataaagaagaagagaaaaaaatcctccccttaaatcctgactcagataactactgacatgaccatctgctatggcctgaatgtatgtatccctccaaaattcatatgttgaaatcctgaccatcaaggtgatagtattaggaggtggggcctttgggaggtgattaggttctggggacagaatcttcatgaacgggattagtgcccttataaaagaggccaaagaaagacttctcatcctctctaccatttgagaacacagcaaaaaggtaacacctatgaatcagacagtagagcctcatcagatcacgaatctgccttgatcttgaatttcccagccttgagaactgtaagaaatagatttctgtttttctaagccactcagtttatggtattttgttatagcagcctgaatgaatgaagacactatctttttagatacagttgatcctctttattcatagattctgtatttgcaaatttatgtacttgatcaaatttatttgtaacctccaaatcaatacttacattcatagtcacttgtgggtgtgcagagtggtgaattttttttttttttttgagatggagtctcattgtatctgtaacctccgcctcccgggttcaagtgattctcctgcctcagcctttcgagtagctgggattacaggcctgcgccaccatgcccagataatttttgtattttagtagagacacggtttcaccatgttggccaggctggtcttgaactcctgacctcaagtgatccacctgtctcagcctcccaaagtgctgggattacaggcgcgagccactgcgcccagtgtggtgaaaattttgagttgcctaatgtgcgtgttcccagatgaggctgaatgaggcgaccttctgccttctagtttcagatcccatatggtaaacaagtgtccacgaaaaggacactatggacagttttcgcagttttgcactttttgtttggtgattttactttttcaaatggcctccaagtacagtgctgaagtgctttctggtgttcccaagcacaggggagctactgtgtgccttacagaggaaatgccatgttaggtaagctttgttcagagaggagttatagcgccactggccctgagttcaatattaatgaatcaacaatctatgttaaataaggtatcttaaaacagaaatacacataacacaaggttatacactgatcagctgagaaaaacattgtaaccagaggctcacaggaatcttatgctgtagttctcctaggagcaacagttcagtatttgctaattctgtgtttgtgaggactttatagaacataactactatgaataacaagaatcagtgacatctttctatatatatggatgtacgcttctgtgcaatttggaatggacgttccatacccttttgatactttaaaaaatcatgttaatatgtcaaaggcatctttccattttcataaatacaggtcctcagatggctgcatcactgtgcacgtctctgtaatgaataaccagtagctccctattgatggacaatttggttgcttcccattatttgctattacaaacaatactatgatgaacatccttattggtaataataaaagagctagcatttattcagcacttagtaggggcccaaccctctgctaagagttttataagtgttatctcatttaagctttgccacaagcctatgaaagtggtattattatgcccactttgcagatgaggactttgatgcttagagatgttaaggaacttttccagggccaggtggcttgaaacaaggtctctctgatctcagactccacactcttaactaatgctctgctgctttcctacacacataaaccttgggcactttaggatacttgtttagaagtgaactactgagttgaaaggtggggacatttgaaagtatcaatatataatctcccctccagaaaatgtgtatcaattcgtgacccactaaacagtgctccagtgttcctgtttctcattctgcatttccccaagtattttcattctttgaaatggcccccaaaggacactttgattgtttaatgtgtctcctttgcccctgggtgatgactcttcacatgctttgtatcctctgtattttgtcatttatgaattgcttgttcatagcctctgcccatttttccgctggcaatttgtctttatctaatacttcacttacaagagctctttgggtattagtgctgctaaccttttacccatcatgcctatgttgaaatacttttcttagtttgttatcatcctttaacctgattgttgtggggtggggtgtttgcccatagggtttttaattgttttccttcacagtttctggatttgatattacacgtaaggaggcattcgtcattccggtatgacacaaatattccctcgttgtctttcttttagtatcattatggtttcatgttttttaatctccttggaatttattttggtgtaggaactgaggtagggagccagttgtattccctctcctccatacaaatagctcgttggttgtctttagaacacatcaggaatcacctgcattttcatctctaattatcaatgccatgcattcacataccaatcctcacgtacactgatatctacttctgggctctctgttccttgagccacaggtctatttctgtaccaacactgattttttttctaggccattcatccatgtttatttttccagatgtactttgtaaacattttatgaaaaattttttttgggatttcgagattcaattttatttatagaacaatttataataccttcttcagttgactcttcataattttatgcttttatttctttggagaatgaagtctttttccctctatgctttctaactgccttattttggtaccaccttcttgatgaaagcttttctactcagccctgcaagagtcttttctaatctctccccactcagcactcggccttttgcatgccccacccgacctttttacccaaaattataattactgcttagacagtgagctccttgaaggcaggttccttgcatggcctatttatacatttcctaccacacctggcaggttgtcggggctctggagatatttgccgggtgaatgaatgaatgaacaagtgaatgaaagacatcctcctggaaagctaattgtgaaatgaaacaaatcgattacaaaaaccctctttcataggctttcattagaaaacaaaatatttgtccttggctaaatctccaagaacgtgtcagaatgagagaagtggctcactactagactgcgtgtcatgtgcaacatgccccaacacctgtcctcagagactgccatcctcaccaagcaacagggcacttctcaggcaggctctcaggccctaaaaggcctccaggagaaggaacacaattattcaccatgtgcctgtcgctgagctagacttttaccaataagatacaacaccctgaaagttgggatcactagtctcattttgcaaatgaggaaactgagtctcagagagatgtaaccctacctagtaagtggtagggcctgctgaagtcagggctgtgggactctaaaaacctcgcctctcctataataacctccagaccaccagagtctgggaggttgaggggctgtggcccagaggggaatgctatacagagtcaaagagcaagggtcctgctgtcactaaaccaagacagtccctagaaaacttgtttcccccaaagctgtatgatgccgcttctataaatcattcctaaagagcttgggtcaaagagctactgtcaggcagggggcacatcacacaggcattattgttgctatgggactggggagtggaggtatgggggaggtggtggactcgccatggaggcggggtgttggtctccagtacctatctggagatggccctccagagtcctcctccttgcttgcccagggggttgtggcttttagacagccctgcagttccatcctgggagtgctgccaagcagccacttccttatcaggctggcagtagctgggcaggcctcagcttatttctaagtctggattagagctcaggtttctcatggaggaccatgggttgggggccaatacatttactggacttgactttgtgcctggcccagtgtaggccccagggacatggggatgagcagcctacaagcctcctgcttcatgcagctccattccaatcaggaggtgaatcacaaggaaaacccccaaccctgcccaagagccacagtagagatctctaatgctgagggtgcccagatttggggggtcagccggctgcagactgtggaggttggatgtcaggtgagggcatatgggcttcatcctgtgggcagagagaaatgccctacattctgaagcaagagcctgccatggttagatttgtgctttagaaacagaccaactaggtatattcgttttcaataaacgtgaattctttctcaggtgaaaattaaagtgtttccattttggacaaataatcccaacgtaaggaatcacagcagatggctatgggcctggatgagccacttacctatggggctgatgaatgggaagagccctgggcttggagtgagagacccacatccacggtcaagtccctgccaccatcttgctgtgtgacctccagcaaatgacttccccatctcaacctcggtttcctcatctatcagacaggaatactgccacctaatacacagggccgtcttcaggacaaaatggggtatcaaatggcactgtatatttgtacctacttgacaaatgtgaggcatgagggtgagactcctgaagaccagtccacacccctgagggcatttcagatgccccacagcctgcaatgtcttgggaagtctctctcagctgttccagctccagtcaaagactatcctgtcaaaacatgaccccatccagagaagcaatctcccgtgtgtttggtgggccacctgcccacggggcgcagcctgctgggccacgaacatcaacagcagccccttcctggtgggagaaggaacagggagctggcttgttctctaagagcacagtgctggcgggtgacgaggcacattttaaggtgggatgcttcttcctgcaccgttggcagctgtctacataaggtgcccattatgtgcaggccccaaggccagcgggcctgagaggccaagctaaaattactgtcagatgtgcacccgccagacacactgaacatctgaaggtcagatgcctccaagcagccacccgggcaggagcgtggcagatgggcaccaaacagctgtggcagctgctgcctcttgttcctcccaagcacagagacagacggccctgtgcagcagcctggttcaatagcccagcttgagttaaaaaatagaatgtagagtataatcctaatttaaaaaaaaaaatctgcgtaactgcatagaaaaaaaggtggaagaggaattcactaaatagcccagtcacggatgtggaatagtaggtgaattttttttcctctactttccaaaattttctcaatacatatgtattacttttgtaatcagaagaatacacaataagatgctatgttatatattcctatgaaatatataaaatgattaaatggcatatgctttgacatgtggtatatttgtgtgtgtgaatacatttatacggctggctggtattaaagatcaacattctccaaccccgcgttgcacagaagagacggaggccccaggaacaaagcaggaagcagagaggcagattttcactgaggctgctgttgcactggagtttccccaagccttgccccacttaattctgtagctggttttattcccacttgatggagatggaaaccgaggtacagagaagtgaactgattcactcaaagatgaccagctcggaagccatagagccaaatcccaaccctagctttccacccacagcgcactgagcttcaagaaaggaaaggcctttgaaaaaagaacagaacaaaacaacaacaaaaacaccctgctccttgaagtctcaaacattcagaaagcaactccttaagggagtgagttttgaattatttcctgagcccctccacgtgcacgcctttcttagctctgcggggctcatggtcatcttcccagagctacccatgggaacctttgagaggatgggtaacaaatcatgatgtgggggcacaaaaggcacagcaaatcccaaggtgggactggctggcaggtgtcaggcctttgggacagggtgagggagagcgagttggctggagaggctgctgtctaaactctcagtcttccagtgctttgggaggggcagcacccctctgcaacgccagatgccctgatctgaggcctttgctccagctcttccctctgcatgagtgccatctctatccccacatgctgccctcagtcttccagggcccagttcatccaggcatttgtgcattcttattggtgaacacattttaattgagggcctgctaggtgctagagcaaaagacatagtatcaaccctgtaggtgcctctagtgctcagagaaaggctacccagggtcattcaagcatagactctggggccagactgtctaggctcaccctggctaagccacttcacagccctgtgtgtttgggccagtcacagtctctctgtgcgtcagttgtcatctgtaaaagaggatgaaaagagcacctgcctcacagactagtgcaggtggagtgtacatctgtgtaaagctcttagagaacagtgcctggcatgtagtaagtgctcaataaacctcagttgctataaacattctcatcattaccctctggtgcagattccctccttatgatgcccaccctacttttgtcctctggctggtacctcctctatggtcccatagcactttgaacacccctccatgagagcactgatgggcatgcagtacaggtgtctgaggacctgttccctccttgtctctacctgggtagagactaagtttattcatctccatcccagcacccagcacagatgttataacatcaccaggtttatgtcagcatttgcaggtaatgtgtgccttcaattccagtcgagaaaagtcttagaggcattagaggttgtctatctggccttatcatgtagctcatccatgttgcccttgaactgtggggtctgaccctgggtgtgatctttccgatgagaaccaagttgatgagggagctgtgtgctaagcttccatgaatgcttctctgtgacagggagttctgctgggcaggacatcgaaaacaccaactactgacaccccaacacatcctggtgtttcccgtgccatgcctttctccactggggccccatgaccccactgctgatctaagaactcccatggatccttcgggtgccagtgctcctggccccaccccccacaatgcttctgctagccacagcccccactgaatgtagctccctctctcctggtcttctcttgtttctgccctgggcctgtggggctgctcctgctctcagtgtgtggctgttcctttgtctatgtgtcccttctggagaaggggcaaacttgctcttgtttgggcccccagtgtccaccaatgccaggatcagaggggtgtcaggaaagctctgctgagctcatttttcagaggaaagtcaagcccgctggcctgacctcccattaaggcacgcacgctgactgatcacaccaccttctgaacccaaaactcacaggtggctctaggccagccctgcccatcagttgccactcactccatcgcagggctgagtcagcagggaagccccgaaagtaagtgctgagcacgtggtgcataccgtgctggcctctcgcttgagctcttgcgtttgactctggcaccgctgcaggaggtgggtgttctatacagagaggccttcctgaggctctgatggttccaccgctcctcaaaggaggggcagggcagggttggagcaaggctctctttggccccagaacctactcattctacactcctgtgagacgacaggtgtgtgaaagtgttctgagttctaccaacggaggaaactgtaaaaccatagaattgccagctattacccaccacacagaaatcactctagtacaaccttgctatcaagaagaaggcttcaggggccttgggaacagcattgaatccttacagaattgctgcccaggagggggtggcctattgtccttcaggggtaggaaaggaggagagtgagtgggaactggaagagcagaagagaagcagtcctgtggctggagtggcagcccaacgcaggatggggccccggggacctgaaaggatgcagagggatgctggagtctgtgagagccgaggccacagacacttcagcacggggtgtcctgccctgggcccctattgaggttctgtagattctgacatgtgcacctcctctcatctcggcctccccaccactttcctccccaccctcccacaccccggtaggggcctctctcagaaccacagggctgactgtctcccttccctgcttgtgtaggacccagcctgagctcctgggtgaccagagtcctgccgctctcttggcctcactcccatactcctcctcttgggccctgcatcccagcgactccactgctccacttgctgtcccttgggctcagaatgctcttcttccatttttcacccggtgaacttctattcatccttcaaagcccagttcaagcgtcaactttaaattgtcttccttgaactacccccacaaccaaaccccgacagaatagagccctcctgccttcacaggttttgctgttctgtggctatttgcacatcgatctcctccactggagcagaagcttcttgaggataatgccatgatttgttcatctctgtgcctcagtgcccagcacagaggatagagcacaacaggcaataaatgatgtcctgatgacgaggtcatgagagggcaggcatggggctggtgattgcatctgagtttgacttccagcagcatttactaggagaaatacaggccccctccccaaaatgcacacgtacacatataaggtgaacacacagctcagtccaggatctctgtggctgtaaagtccatggagcaatcaaacaggagactgagttctaaggatgtggtacacagctgcagtgtcagccccactgtcctccccagagcccagggccttggcttgagccctgctgggttcaccgagtcccactccctcactttgcagacaaggaaacagagacccagaaaggagatgcttgcttaagattttcctgagcaataaaggcaggcctggggtcagaagcatttcccttggctcctggcccaggactctcccatcaccatatgctgccatttgcagaaatgccagctgcaggactcgtgacatttgggtggctttttcctaaagtgtcggtagcgtgtggggctccattctcctgcccgaggctaaggtcattcctgtctacctcctggcctcaaaacacagcctaatggcctttgggctgtgctgaaactgccctgtgtcctgtgggggatggggagggctcacctgccaaaaaccagccgtggtctcatggtcaagatgtgtcagagatttctagagcttggagaactgtgttggagggaggcctgtgggaagtagagaaagtgagaatattatgccaccgccatctgtcaactttcatctgagtttgaaaaaggcacccaaaaatggtgagcacagccttgctgaaagcaaagccccggccactaccccttctctaacatggttatgacgaggtcaagatcaggtccctgcggatgaaaccacagcctcaaaaccccagtacagagctgcaagtcacaagttgtctgccctgaggaaccccacaggtatgctggtcctgtactcaggcctaaggctggaggaactcccacttccaaacactcctcggggaaaacaccctttgtgggttccctaagcactgctcattgtaattcactcattcttgctttcattattcattcattcatgcaagcattcaacagccatttgggaaattgttaggtgttggtatcaggtcctcatagagatgaagtctctgagtgtgacagcctagatccagtaagaaaggcgtgtgtagacccaggacaaatgccacaggctggtgggttgcctcccttctccaagtgacctctgtgccaggtgctgggcaaagcactttggttaagctgtgcaggatggcagaatgtttctaccattttcggtacaaggacctctctttgtatgaaattatttctccaaactcctgatggtaactgtatacctattatcttctcattgagaaaataaacaatacaaaagttacaatgaactaatgctttacaattaacttgtattttagtaattatagcaccactacatatatttaaattaaggttggacacatactcatttgagacatattatttatgtcttctaggcttaaggctttgagcccttggggatccattcattcaatattcattcattcaacagacatttatggagcatctctgagatgcccagccctctggctcaaagattagggatcctggttcaagaaggagctccagctctgcagtgaggtacacttaagcttaagcccaggtaacactggatgtgtgcccttagggaggccatctggtcttcttccagctctgagtcctcaagagtaagatggagatgtaatcctgacattggaaagttgttacgaggagtaaatgagatagtagaaagcatccaggtaagggcctggcaccaagcagaagctcaacaaatgggcacccgaggattatcatcatcaccatcatccccaccaacatcaacatcattactatcaacaacagcagcagcagcagcaccaccaccatcttgcttcccttctcttactgaaccttgagaagcctttccttgtccctctactagggtatacagtagtttctaccttataatagagttatttgtatccacacttaaaataccttataatagagttatttgtatccacattttctttctttggttcatgcccagctctgtaatttcagagttgcgtgaacttaggtaagttatttaacctctctgaatttgtttccctgtatgtaaaatgggaactgtatttttagtaattcattgaattgtaatgactaaatgaactgatgtacataaaacctcaacacaatatctgtcatgtggtaaatgctcagatattgcaggtcattattattcatgttattgttattattattaacattagtattaatacaatttctcctcctggcctgtgagcccctaggggcatagtccattgaaaattcatttctgtctccccacagagtctagcacaaggccggtctcccagcagatattaataaatgattgctaaaacagtcttggaggttcacacaaatcaagtgcaaaataactcaaagggcatggtcaagggtaaagagccttgtcaggaccctgaaaaaccccaacagatgtcctgaagggagttttttgtcacccatggagccaggctgcaggactgctaggaccattcattcattcattcgtttattcatcacactgacacccaattttcactttggttgactaacaaacccttgcccggtgctttttcctattgtgaaatctcgtttccatctgctacctcatttagtctccacgaaaattttgagaagaagatagaataggtacattactgacaatccattctgtaaatagatgaaggcccagagaggtgacaaggcttgacaaaggacatacagctgtcaaggccacagtgggaaacggaccaaggctctgctcatgatcttgactccttcctgctggcactttccaaatccaggatcattcattcttgattctcattgtccagtttgcttctcagcaaataaaactgaattaaattatttttggtgttattttaacatgactgttggaaaagaaagactctaaattccataagggcagagactatgagagccctaacagtgtgggggcaggtaaatgtatgaactctgatcccagactgcatgcgtccgaatcctgattctgatacttaatagctgtgggaccttgggcaaattacttaacctctctgtgcttcaatttcttcctctataaaaaaaggataataatagctatctatagggttgttgtgaggattaagtgatccaatccgtgtacaatccctagaacagtacctggtgcatagtaagggttagttgtaattattatttgtattattatttgtgacgtatctcctgcacctagcataagacccaacacataaaaaatccctaataaatatttattggattgttgaatggataaaatactttctgtaaagaagtaagtatctatgctttaagtattattaaatatctatgcttaagtattattgagcaaggcaaaagaatagctgaagctctggccccaaagaagctggagtcccccagttccttgctcacagatctaggcgggaggagattcgtgattccaggattcaaaggcctgtccaccaactggcagtaaatgtgactcatggttaggaacacaggttttagagtcagacacttaaattcaagtcctcactcttgttctgtcactcactagttgtatacttacctcctgtacttgcctcagtaccctcatctgtaaaatgggaatactcacacctaccttgaagggatgttgggtggattaaatgtcatatgcaggaggtgaagcttcctgcacctgggcccagtccacagccacagtaacaatgagcttacaggatcaacagcagctcatcctatgggccaacttgttctgtgctaagcatcgcttccaccgctttctccctcacatgggatttgggggccttcaccagggatggactcatttgcatagcccaggctccaccttctaggccaaaaggctgctatgaaaaggcacattctctatttggcttcagcatgaactgggctctgtggaggcgagacagctgcttaggaaatgggctcctgggaaaggtggtctccagagaatcagcttagagaattccttgcaagcgccagtgccagcaactagcagcctgtatgcagctgcctctgagtcagtcccagtccctgtggtggctacagacccttcctttactctgtttctcccactaagaccccaaggctggcagcctgtcctgcttatgggaaggagctaacatccattgagccagaagctttaattctttgcctcgtttagacttcacaatgagtctgcagtgggcacttgaatcttgccacataccagccatgagaccctgggcaaaccattcagctgcccatgtctgtttccttaactatgagcacatgtcaatatccttgtacactagacccattttgcagaaaaggaagctgaaccatagagagggaaaggcattgtcaagatcatagaactaataaatgacaaagctggagctgtttgacttcaaagttccatgcattcattcatccatcaattattattttagagcctaccttatggtgggcactggctccatagactgtttttaaaaatatctgtattatcaatttcccactgctcctaagataccagtatgcaaggcaattcaatttaacaaagacatcaagtccttctatgtgcccaggcactgtgcgaggttctggtataaaggatcacattgaaccctcatgacaatcctgtgcagttgacctttttatgccctttacagaggacaaaatgggtaattcaaagaggcaagagaacgtgtccaggctcactcacggagcctggatggacgcctatgcccatgtgatgccaaaactcacttctttcccttcccaccatgtttctttctctacgctctcatctccccaccctggcctggcctgcaatgatgcagcctctggaagttccatcagtatccctggcagagggtgttctccatccagcagagaaggacagctgtcagccctaccagcctgtgccatccacactggatcttcaggactctgcttctccctggctccttccactccctgaacttgaccccaggatgacagacctataaaacccagaaacatgtttgcttgtatcttgcctacttccaaaaaggatgtgaggaaggttaaggaacaaaagtgcagaccgaggctcaaaacactggacaaaagcaaaatccagatgtaaaagagcagggggtgctggaagcaaatgttttgaaggacactgcccggcgctcacagggtgtgaggaaatgggtgctctcacatcgctgctggtagtgaaaatagacagaatgcttttgaaaggcaacttcagagcgtgcatcaagaactttgcctcacaaatatccacacttctgggtgtagtcatcccaattcccagaaagacagtctaagaaaaaaaattctaagcaagttccatgcagtcttacttctaatactgaggcattgaataccgacagcaaatctaagtgctaacacagggaaagggctaacacaccattgaaaactagggtacagctatatcaagggttgatagcctgcagtacaaatccaactggtagcctgtttttgtaaataaagttttattgggacacaaccatgcaaacacatggaaagggttaacctaccattgaaaactagggtacagctatatcagaggttgacagcctgcaggacaaatcagggtacatgtgcaagtttgttacatgggtatattttgtgatgctgaggtttgggcttcaaatgatctcattgcccaagtgtgaacatagtacactataggtagtttttcaacccttaccccctttcctccctgtccccttttaggattcccagtgtttattgttctcatcgttgtgtccgaatacatgtgttttatttttatttatttacttattttttttgagacggagtcttgctctgttgttcaagctgaagtgtgatctcagttcactgcaacctctgcctcccaggttcaagaaattttcctgcctcagcctccctaatagctgggattacatgtgtgcaccaccacacctcgctaatttttgtatttttagtagaagcggggtttcagcatgttggccaggctggccttgaactcctgacctcaggtgatccacccaccttggccttccaaagtgctgggattacaggcgtaagccaccgtgccaggctggaatacatgtattttaaaaagagagataactagctgaatatgctctgggcgtattagtggccacagtaaagagtgaagatgggttttaattgtctggcagtaggaggggaccaggaaaccaggaaagtcaaactctcctggcccagattttggagaggaattagtcaccagggtctttgtttcaaggagtttctgagcaacacaatggacaactttctctactgttccgccgatgttctgaggtgttgcccacatagacagcaagtcctggttattggtcctctaacaatgtcaaagaaagaatgttaagctatcgttctataaaggcaattcactcagtggtcagggtgatataggagttcagttcaaataaaatattgcagaatcttctagaaaaaagcatcatcatatctagctgaccagtgagttttagccagagaatattttctttgaaaataacccttaaattgcagatcagcatgtaagacagataaaggcagggtactctggtggaagctgtgctgggtatatttcatgctgctcccctcagctcccccggggctgccccttgaaggggttctgcaggacctctggggcttcttagagcccagctggtgaactgctacattagaccatccccagggcacctgctgcatccctggtcttttgccaagtcgagggcactggcaggagaagcagaggatactctgctacccacagaaggcagaaccatgtcctctagaaaccagaactaccacgagggcaatgacaagatttcgttgtgaaaattaaaaagtgcgacttatgattatgcttccatggagggccttgggtggggcaagaaaggacttaccctctctcggatggcagttctggagcagtttcaaagtctcttaaagggccaaggctgaggcccaagtccccgtactgggaagggtgaggagggtctctggcgggtggatatgcctagaggacaaatgtgtgaaccaaggtttttgatccattttcattccaagagggaagaacaagaagcctattgggagttgggtgtagatggtacagtgaagtcactaagagggggatcttgggtcagatttgaatcctgctctgctacttattagctgtgcccatgagaaagttactgactctttctaaacctcagtttcctcatctgtagaaaaggaaaatgaaagccatatatgatagagttgtgggaagaataaaatgatttactgcatgccaagtgcttagcaccttacctgccctaatgaatacatgctcaataacggtttgctatctgcagcaatagacctggccaagccgaaccctggcctgtcaggagtcagtaagcctggggtttgaccttcaattcatgtgggcttgaagaaagattcagggatgttccggggctgacaccagtttcctgtagctgatgagcagaagacttgttagaatttctagagtgactgggagatgccaggaggggccatcccccaggtgagtgcacagggagcctctagaaggattcgatagaatcctctgccctatcagggtgacattagggagggactacctttgtggggacctgagagagtgcttcatgtaccttctgctctgagtgaccagccccatgcagttgagattgtacatcgtttacctccacatgggaaggcatgccagtcaatctctgctctgtctctgggtcaagcatcatgtgctaccgtggtgggcatttgttgacttttgcccacttggcaccccttctccccactttggcaatagcattctgatttcatttggggaaatcagctctcctggtcttggtggacagtaaatcagggcttcctgctttctcacaaccaaggggagggcatgagcctaagccaggcatctcagatgctctttgccaggccctgactctgcgagctcattcttccatctctgtggccatgacaagaccacttctgattagttcctgttttctggtccctggaggggccctggatccttttctgagtctgcttcttcagccttcctgtcaattccgtaagattctcattatccttctgatatattccctctttgcttaagttatctcaagtcagcttctgttgcttacactgaagagccctaatggtttctgagaggaacaagtcaaatggcttcctttggcacaaaaagctatgaccaggagctctggcaccaaaactgcaaacaagaaaacttcaagtcaagtactagaagcaacctagtagccatgtcatcccccatgtcttctctgctgttggaggctgcttttattggggtgagctcagaactgaatgaaactccattccattttccagtgattggctcatatgactcagttctggtcagcggggtaaattactcccattttagagttaagggaagcctttctcaggggttctgggaaagagtttctttgctaataaaaagagaatctggggaagatgttcctcttctgcaccccctaccaccacatggcatatggccctggactgtgccagctacccatggccttgggtcatgacactgcagctatggaggtgaggctggccaacggggaagctggaacatgcctggattctggatttctgggctgtacgtttttcagcttttgaaccactcctacctccactctttggagtgaaacccctattgtgtaagtcccttgtagttagctttctgttacctgcagcccaaagcctcctaacagccaagcgagctttaaacctgggaatgggcaccccagcagcaggccaggacagctgcatccgggtcatgtcaggtggaagcccagagaaaggagcatccagtgagtggggcagacctgtggtggatccaagcagggccattcacgggtgggacagaggcagcctccaggcagtagcaatctctgaggtcagaagaaaggcagtgtcatttcctgacgatcttccttgtttagggcaggaaaccagcctatagcttgaggacatggagaacagaaccaagccccaagtggggtttgggtggaatggtgatcgccagtcaggggctcactgaggactggagttcatgtggggctctggctttgtagataattggagtcttaggcagggaaattgaggcagaaagaggcaaatccagttatgctgagtcactgacacggcaaagtttaggcgagggtgcagctcagtaacccccgccctccactgccatccataggaatgccagatgcagagttcagggcaatggggtcaattgcagcttctgctggcccactgggaactaagattctgctggctttagccaggttcagctcaggtgatgaataggcattttggagggacgtgtctggagtggggcagggggaggtagggactttcggttaagaacccacttccaccagcagctgagaaagccctagggaagtttctagctgtgccaatctgagtcaacatgcaagcaaccctaatgcccgaagagagctctactcaagttcaaggcagagtgttggtccagcactctgccctccatcccattcttcgtgcatcagccaggggatttgtcacttcctcctgccacatttctcatctgcacactctgcctcttcagagctcccacctcccctctcctagcatggagcaaaaccccaaaatagtccctgggggtcatctgcagggctagaaagattctaaaagtgtaccctcttcatgtgaccaaaaggaaaacagaagcacagagaagagcaagggtgttctgtcatcctgctgtgtgacccagggcagccaacaccatttctaaggtcgcgccagctctgacatcccatggctttgcttcaaaaggacaagcacatgtgaagtggtcaatgaattcttcagagccttatggaatggctctaactctaagccctcagtgagggtctgactatcctctcccccatctcttctcttccaatggctggtcccctgcgccaactggccagcacagtcctactccttgctctcagcccagtcctccctctcacaatgaggcgcatctaaagagcccccgcccaggcttccctgccctaatactgtgtcctgtgtctagaaactatgtgtctgtctcgttcccaaggccaagcacccaccttattcctgggcactggtgctgtgtcctgccgtggcctcacaccccaagcctgactccccaatccctgtggccgtgcagcagtggtcaccataggatggcggctgatcatagcttcttaaggacctgattcctgctaggttctcagctaagaatttgacatggattactccactgactccccaaagagggccttatcgtatagtcaccatcgctactctcactttacagataaggaagctgaagaccggagaaatcaaccagcttgctgaaggttgcttggctggtaagcggtagtgcctcgaagatgtccctgagtcagcccttttctctggactctccgctctgctgcgggcctagactgcagtccccactgccacccaccgggctggccttctagtgccctcccttccctttgcgcactattggtcacaagttcctggcttctctcaattagtagccccaggcctatgcctggccatgatatctccttcagagaggggtgagatttgacaggacccagaagaacaggcagagggtacggggaggccaggaagaggccagaaatcaaggctggtgatttgcaaatgcagagcccatggcagcatccatggcgtctactggttccctctccagctcgctcactggcagttgctgggctatagcttcatgggctgatggtggccgagcaccaccaccacccagcagacactaaggagcacggtgaaaaagcctgggctttggggccagacagtcctgtgttcagatcccagctctgtcccttagaagctctgcaagtttgaggaagttccatgggaaggtgatctctttgagccttagacttccaagcaataaaatggggttgataacaccgatcctgcatagcctttgtgaagacatatgaaaagcatttgtcaaatgcccggctttcggtaaaagctggttcccttttatgccttctcctcgtccttcctgctaccccttggagctggctgtctcccgatgccagagacaggctctctgtgttgagcggcccgagtggttccaacgatgcccaccacgtggctggcaggggcccgagcacactcggcacactggagataaatacagggtccaggcacctgactctaaacaatgggctattctggggttttaattgctcataaaagggaaggcaggctctgggcggtgaccaaccttggaggtcaggacatgcattggggtggcaaacagggcagcaaacacaccaaggtgcaggtgcagaaacgccagccagcaggtcgctaatcccagaatgtcactgagggagggtggctaacaagcctctaggatgattaccctctcagtgtacaaatggggaaactgaggtccggggaggagagcactttattctactgcttcaacaagtactcatcaagcacctgctccaggctgtgctccgtgctctgcctcagcatttcactgcgtgaagcagagacagattcgacacatgcagttacagtgccctgcgacaagtggcaggagaagcaggaacagggccatggtgatatgaaggaggcatgccgccctagtcgcatgcaccattcattccgtaaagatgcgcccactgcttgtgcgcaccaggcactgctcaggtgctggagacacagccctggacgaaggccaggccctgcctctgtggggtttccagtctcctggcagagaaaggcagtagtataaatgaagaggtagagaatgtaacatcagggtgtgtaagcaccgaaaaggaaaacaaagcagggtaaggggacactgggcacctgtggctggccgatggtttaggcagatggtcagggccgatgctaacagtgacaaattaactttagcacatgagatgcgcaggacaataaaggctctgcccttctgagtgaagagggaaaccagcgtcctgagctgacctgcctcaggggtctcagaaaaccagaaacagagccacaacctgtcccaggtctcttgtatcacaggccagagctggtcccctgcatggcccggcagcccctcccttcatagacaccgttcctccctccatcctccctggggagaagcaacaaactggtgccctcccaggctggaggccaaagccaccaggccttttcagccatcacctccttcctggccagttgcccatgctggcctcaggcagtggagcctgacaggagatccttggcctcctgacacagcggggcaggcttgtccttccctctgccacctcccaccgatgtggaagtcttggtgtcagacacacgtggtccttccacttctgagatgtgtgaccttgacaagttcagcagagcatttgtcaaaactggatgctgggccattctcacagagcccctgggaggattaaataaagtaagaaataaaaggcccccaggagcctatggcctgcagcaggcttggtaggcacggacaccttcccctcttgcagtgtcctcccacccccgatctgcgccccagcccagagcatcactccctcttctgagctcccactgccctgaaagcacttgttttctctttctgggtctgctctttgtccctgaataggactgccaactctcagagagcagtctctggcttctgcaagtccctgagcctcctgcctggggctcagctcagagagtcacatgcagtcgctgctcaataaatgttcttccaagtagctttcagccacgaaagtttaacttggagaataatggggcatgtagagctctggattcacagtcagcctctttatcagctaaatgaccctgggcaagttaactttttatgtaaatgaggataatcaccaaataccccaaggttctgcaaaattatatggtgattttaacattattgtttccattatggaatcataggtggagacaagagtctattaaatttgtaacctggtactacagttcttcccacaacatccagccccctggatgttcggcctctacttgaactctccagtgacagggaactcactacctgctgggcagcccatgccatgttttgactgcttctgagcattagaaacttggctttctattgttttaagacctgccatgctgagctctggaatgcagggaaatgagtgggtgatgagcaagcctgggggaggggctggagagagctgcaggatgatggtgggagggtggcagggagctgagagccccccgaaacaatgctgctggtcagtgggccacaggctgtcagctccccttccaagagaagctcctgataatggtgcctcatctgctcatggcttcagaacctgccagcccttccagaagactgcctcctgcccagggctgctcagcagctggactacaggggcccgggttctcaagccctgatgtatgatttatgactccgatgagctcaccagctcagggagggagggtgatccgaggggaggctggaagaaggctggttatggattttaaccctctgatgttactggctgggaatttaacatcaataattcaaggcagtggggagcaagggatgggaaaaaggcaaaagagagagggaggtggggatggaaagggagaaaagaggagaagaagtggaggacgggaagaagacaggaaaagaggcaaagatgcatttattgagtgtttcccatgggtaccatgccaccttcgcctcctttagctcatttaagactcactgaaatctatgaggcagatactgtcacctctaatgactggataaagaaattaatgctccaagaggaaaagcaaagatttcaaggacagcaggggggatgaggggatgggatttggatccatgtttgctgattccagaacacgggttctttctactacaccttgactttagagggtagccaggtcaggggacacagagggtccctgctggcctcaggacacctggccccagctcacactctggggctgacatggggagagatgagtctgaagggcttggcccctgggagagaaaccagccactggccttctggacagcaccaaaactttgttgctgaagctgaaaaaattaactgctatatttaaaagcattgttcagttgctatggtaacagaggggctaagaataatataaaaagaagatgatatgccaggttgtcactggcaacccaattttaagggtgtgtgtgtgtatgtgttttaaaaggagttttctggggggaggtgttgaggttcagactgtcttccccactccctccggcaccatctgccccagcgacatgtccaaggtgcagccaggcctggcatctcactggtctgctggcatcgggggagctggcacaccctggccctgagcctaaagataacgaaggctctcagctccctaactgctgtcccctcctggcagccccccactgcctgggctgcttccttcagctgcggaaccccagccggaggcacctctcaaacagatggcccccaaatagcttcttctctccgacctgggagctttcagccagcctggcagactccctggggaccaccagggaaaacagatggtcaggagagaagagcaggagacagatttattgatctgcagcatggatgtcagagataggaggcggcttggcagatctgggcatggggctgccctactccctgacgtgtcctggtgagacatgccaggtccagcctgagtcttcagcctgggcccaggcgacctgaaggggacccacggcaagcctggggagggtgggaagatggatggggactgggggtcctcacgcaccagccaactgtttgtcagggctgtgatggcagcacccatgggaaccatgggaagaactgggtggcaaaaagacaaaatccccaaggcagtttattgacagccaaggattagaaagaggcctggtatttttactgtgtcatggtcatgcaatatgaaggagagttttgaaatcagactggggtccccaggccggctttgctgcatgctaccatgtgacctcaagccaggccctcagcatcttggtgctaccatagggaaaatgagagtgacccttaggactatggttgggcctcaataaactgaagtttatcaaacaccaggcttcatgcctataatatcctcagcaggcagccctgtctgccaggagaaaccttcaccttagcatttctctatgtcaggcccaaaccgaaagccacagaggaacttgcacatatacacagggaatgagacacagtgagaggtgccttcacatggaagtggacggtggggccccgagcaaccgatcatgcctggagtgggcagggaaatctgaaggaagagtttgaggtagtccttgaagcaggagaacggcagggtgacagaagcacactccatgtggaggaaagcagcaaaggccgggcagggtgcagggagcacagggagggcttgctgagggcaagtcttagcctctgaggccagaacctaccagcaaggtgggcaggaagaagggaaatgatcagagctgggtgaggctcgatagggaggctggctgggctgggtgaacccagaggcagggaggcccatggggatgctgggcaaaagtcccagccagagataagggggctgggccaaggtaggacagtgctttacagtttacaaggcgtggccatgtccattacctcatttatcatcacaggatggagagagtttgctgccccacccaagctctccccccatcaccacctatcagcacttcccacaggctgggggcacccaccatgtacagaaggagctacatctagattcctgagcatcccctagaagtggaagagtccagaagagctggggggccccgatgagggtgagatctcatgagtgggtgtggccacaaagggcttcttgtaggaggagcagtgggagggccctctggacagacagcatgcttcaaacaaagctgggggatgggacaggtcatggtgcattgggaaatagtccctggaccctgctgggagaaagcaggttggggatccaggcaggtctgggtcacggagggccctgaattccagctgagaggctgcatcctcctgcaggcagtaacaagccgtggggagctcagaggggctggggcaggagagggagatgtgaacgaagccggttagaagccaggctgcatcagacaccactgccttcctcctctctgtcactctcaggcatgactctccttctcccctggctgtctgagtgccagcaacagaaagcaggcctcaagctgcacgcacgttgtggaagacgagtatgtttactcagcagcacacagccagctctgcccaggcctcggcctggcagtcttctcttttggggagagctggttgccctgtgtcctgctctgagggcacgcagttgtgaccttggtttcccatggtgaaggcacccagagtggtacctgggggaaggttctgggtctcgtgggagttcaggctgagccaggagagagctgcccaagtggctcagcatctggggaccagaacttgggcaggggaggatcccatggagcttgcattttccgacgctctttcccttattccctccaaccaatatttgttgaatacctactttgtgtcaggcgctattctaggcggtgaatcagacaagaaaaactcctgtcctcttggaacttaaattctaataggggaaacagacaacattcaaacaaagaaatgttgtcaggtggtaatgagccctatgaaagaaaatacagacaacttgagaaaggaaagagaaagtgactagagaaggtgcttgagttgatgtgatcagggaaggcttctctaaggagatgaggttctaggggtgacatctgagcaaaggcctgggtgaagtgagggagcaggggcacaaggatttcaggcacggggttggtacatgcaaaggccctgaggcaggaataagcctggtgtgtttctctgactccttgtctagtgctcttgggaaaagagaggctcaggcaggttaggtgacttgcctggaaccatgctgcagatcagtggctgagcaggaccagaggcaagttttctgcctgtttatccaggggtcgcccaccatatgtggactgggcacatttcaggcatggaccctggccagaggatggacattgactgtaggggagggtgagtcagtcattcagtcaacaaacgctgactgagcgcctagctcacggcaggctctggctgtgctgggccctagcacacagcagggcacccatggatggaagcgcatgtccccctggagcctgcattctagtggagatcagagattatggggatcatgggattccaggaccctagaatctgtggccagaatctggaaatcccagaatcagaatgaccggtatcttagcatccaaggattcggaatcccccaagcacggcttctccatatgggaaattggcagggcccttcagcggcatccagcccattttaaagaggggtggaaccaaggtctggtgcactgaatgtcccacatagggtggccagtggtggaaccagggcctttgccaaggagtctgggcttctggggcagtgaggcgactgtgggcaatggggatgaatacaggcttaggccagacagactggccgtgggtctgtaccctacgcttgctatgtcgtggaatctttctaaatctcagcttcctcatctgtaaaatggcactaagatggcatctacctcaaatggttgtcgtgagaattaagataatctacgtaaagtgcttagcatggcaaatgcttctaacacttgctgttgtgctggtaattattagtgagacttcaataacactggtatgaagtgttagatgacagagattgaaccctgctggaatgggaacagcggacctgccccagccacccggcttagcatcccacagaggatctgcccaggcgtgtcagctgatgggaataagggttgtttcactctcacctccagagacaaacatggtgtgtgtggcctggcacgagtccattgccctcctctctccatctctcctgtcttcccattccctcctctgtctctgtctctctctttctttctctctttcacacccacacacacacacacacacacacgtgcacacacacacacacgtatgtgctgtaattatagccataagaccttgacccagcccagagcagtgaaagctgagaccaaaggcattagaacgaaggcgctagtggattttagctgggggtcaaggtacatgttttaacccttcctctttgctggactgaaactaggcttgatggactaggacccaccaggaggttagaagggcaacagcccatggccaagtgggagtaacaagaagcacattcttaatactgtgagagataaaggccagatagctaaaattgagggctcagagtgtgctgctgcagctaaagacaagagctgcacaaaggacaaccaggtaccctggaagacttcctggaggaggagagagaggagctttgaaggatggggaggatttgaccatataatttattgctctatatgaaaacagcattcaaggacaaagtcaaacaaaatcaagtacaaaggcacagaggctcaaactgttagggtgcaggagacagtgaagctcctcttacaggttagatggaagtgaaacagactgggaggtggagcaagaacttgttttgcctttagttctcgcctttaccttgaaacaatggtcattccttcattcatatgaataactcatctatctaaaacaattttaggcagccctagtgagccctagtgagttttccttcccttggctcaatttctccatctcctaaatggatttgtcactgacatggagagggagactgcccaagagcagatgttcctgaactagtagtcagctgttggctgctccacatcactcagggacgtccctgtccccaccatgaagtcttaggctcattggaaagccttggggttcttgagatgtccgtctttctggggcaagttcacaataacagagaaagatgacacggtgaccaggctccagaaggagacacacagagcccttcctcagggtcacttcaacctcacagcagccccagtgggactcctgactcatgttagcaccaacacagggaaccactaagccttggagaagttcagtgtcttgcctgagtcctatatctggtaaactggcagagccaggctaggaagcccagacgcttcctggctcctatgtcctttccatcaggccaggctgtctcttgccctaagttgcacaggccaagaacagaagctaagacggaagtgatttattcccaggtacacaaggactcaaactgtggagcggggctggggtccagccacacactgagctccagaggcccagttctggtttcagctgagtggccctaccaagctacttgctttcctacgtctcccctcaaacatcctccccaccctccatctacatcgcagatgccaaaaagtcatcagagcaggcaggaaattccataattggcatgctaaacctgatgagctcaggacaccacctctgagtgggcctccagggctgctcccaggccccagactgcaactcttgaagggcctaaagaagggagatcctataattttccccatttgggacattcaacaaatagaatggttcattcacagatttactccatttggacacatcgggaatagccttgggtctgtctagaaagagacatgttcatccagctctgactcacccagttccagcactgaatatactacattattattctaccttttcaaagcctattatgtgtgattcctatgtgaggagttgagggagctacaggtgagaccagagtcaggctctaatgtcaagaggctcctaagacaagaaattagaacacttgtgcactgctggtaggaatgtaaaatggtgcagccactatggggaacagtatggaagttcctcaacaaattaaaaatagaactaccatatgatctagcaatcccactgctgggtatttatccaaaaggattgaaaacaagatctcaaagagatatttgcactcttatgttcattacagcattacccacaatagtcaagatgtggaaaaaacccaaatgtccatccagatgaatggataaagaaaatgtggtacacacatacagttgaatattattcagccttaaaaaagaaggaaatcctgcaatatgtgacagcatggatgaacctggaggacattatgctaagtgaaataggcacagaaggacagatactgcataattccacttagacgtagtgtctaaaatagtcaaactcacagaagcagacagtagaatagtgggtgccaggagctgggggaacgggaaatgggaagttgctgctcaaggagtataaatgttcagttaagcaagttgactaagttctagagacctgctgtgcaacatttgcctatgatgaatgatactttatctacttaaacattggttgaaaggtagatctcatgtgaaacattcttactgcaattttttttttttttgagacagagtttcagtttcactattgtcgcccaggctggagtgcaatggagcgatctcggctcactgcaacctccacatcccaggttcaagcgattctcctgtctcagccccgagtaggtgggattacaggcgcatgccaccgcgctcgactaatttttgtatttttagtggagacgggatttcatcatattggtcaggctggtctcgaactcctgacctcaggtgatccgcccacctcggcctcccaaagtgctgggattacagatgtgagccaccatgcctgacccttactgcaatttttttaaaagctcataagctagaacaagagacgtaggtaggtgcataggttaatcaatagtgctaatagcaaatatttatataatctggatcctgcatcaggcacagttctgagtttttacctgtattaactcacttgacacttgcaatgctattaatactatgaaggaagtatcattatcatctctgctgtacagaggaggaaactgaggcatagaggggttgagtcatggactcacaattgctctgctgctcacaggaacagagctgggatgggagcccaggcaggcagctccagaatctgtgctcctaaccccacacggtgctgtccatcggtgcacagaactgccttccctaacagaggtgtgccctgggtagcacagaggctagtgagcgtgatccactccatcagagggaggggcatggacattttcctagaggagtgatgcctgcacagactctcaatgatgaagctctccatcatctctgaagactaatgaagccagccataaacatgccatgggaggaactgagagggcctctggccaagcaggctgcccctacccctgcccctgggatctctacctccccacctgaccctagtagggtcttcttcctccctcatgcaagctcctggaactcttggtgtgtatctccttcgcagtgtggaccacaatcagctttgtctctgctgcagacttgtcttacctccctccagtggagtccttgttccacctcccttcacctctctgacatctctagctcccagcacaggcctgggatgtagctcgtgcttgtgaaatacttgttgcactgatactagttttccacatatatcagggctggccctggctggacctggagatcagcaaaataaatttggctggccttccttccttccttccttccttccttccttccttccttccttctttccttccttccttcctccccttccctctcccctccctctcccctccccttcccttcccttccctcctttcctcccttctctccctccctccctccctccttccctccttcccttccttctgcctgcctttcttccctccacttttagcaggtatttattgagtatccattgtatgtggcaggtgcaatgcagcaggacagtctctattctgtgggcactcacagtctagtcaaggagacagactagcaaaaagacaattgttggtgaaatgcattctgacatgagtccagggagcataggagcacatgaaatccacaggcttccacaggtgtggaggaagtaatcaaggaagacttctgggaaatggcatctaaactgagacttgaatattgagtgtgcatgcatgtgcatatgtgtatgtgtgagagaaacaggaagaaagagaaagacagagagagagatgcatgtgtgtgtgtgagctaggaagcaagaggttaaggccagagctttgagggaaagaggtaagaccaggtaggagatcctgagggtccttgcaagttgctctaaaggaatttagcatttaaccccagaggccatggggagctattaaaggattttatttggggaatgacgtgaccaggtttgtgttctagaaagatccccctggtgcactatggggaacaaattagagggggcatggtggtggcagataaaagcagctacagaaatccaggtaagacaaggctgttagcagtaggagtgacaggaagggacacatctgccagatcttgagtcacttgattttccttgggggttgggggatcaggaatgagccctgagtttgggtcatctcatcccttccatggggcccctctctttcctgccaccatccccatccttatcccattgttgtaacggaaagtcatggaattcttgggggaactccatgaaatactaaagttctggttccatcacaagaactgggaacaattttcactagcagaaaatgcacccataccataaaatcatacacacacacacacacagccaccacacacacacacacacacacacacacacagccaccataaaaaaatatgctgcaaaactccgcagaattggctggttttgatattcctcattaatatttgtttgctacttgtacatttcattttattgcctatgagcactcattagcagtcaagcagtagcaagtgcccagagcttatgaaaagccaatgggagaaaactagaagaatgagataatgataagtaataactttgtcctttactgcaaattgggaagagctaggtattggtttagtgtaggagtgaaacatctcagcacagccctcagagcccagggtcagggttaggattagggttagcactttcataggtttcttctggtcaaggctggaaagcaatctgattaactagatcatggtaaggaatgaatgaccaccagagtagcttaatcctgcctggaggtactagcagctcggctttagagatggagaggaagtaagctttcccaacttccttcaaatgctataatctgcctgtaaactcagaggataatacagatgttagtttctcttgcgataataatatcatgaggggggaggggcagctcgaggatgaatctttttctccaggtttgcagcggtagcttgaagtagtgtcttggggtggactctgacatccccttccaccactatccactgtcaccttccgaagccactccaaatgagcaaacataaactctaggttaaaagtgtgcttattctacaaatgcagcttcaagataagtcttctgtatgttcccacccctcaccagaatactgtccctgggatcctcctctgagaacagttggcaaagctggttggtccccttagggagaaaagggctggccttcatatggaatgcctagggctgaataaacaatcagatggggtttccttcctgacctactactgctgccaagtaaagtgaacagaaacgtccaccacagaaggccattctccagatgagaaaaccaaggatcagagaacaaagacttggcttggattacatatgcaggaggttcctgcacatctggccacacctaccctttctggctctttgggacatatgatggagactggaggcttccaactctgagctgatgcacgggtaatggacaggggcagctccacgtcagtgagacgtgatgcattaagatgctgataccatggaaaaaactgggaggtgtgagcccctccccagccatcacacacaggccaaacatctggtctgcactaagggcacctgccaaatctcgcctgaggccatgaactccagcccaggtgagacggttctgttcctttgcaagggtggcccctaggcctggacaaggctgaggtgagagtccggctggggctcagcagaagcctgtgaatgactccggttgtgctctcacaccaagacaaagaatagcactggcatctcccacctgaagtttcacaatggtctacttagcctttctcacccacaatcccacaccaactcagggaagaaagaccagctgtttgttttcctacttggcagaggaggaaactgaggttcagagtggtcaagtgacctgcccagagtcatacagcaagtgaatgagaaaggcagaattgaaacccaagactcaacactttttaccatctttgaatgaaacagctgaccctaagcaggatgggcacataagaggcacctctcatgctgtgaatggcatccctgaatcaagaacgcttcgggacatgcagacatgcagctgggcccctaactggttgccacttatcagccgatgtctcctcactcctgccacaagcctctcccagtcacagggacaagggaatgatggttccttacaaggaatagctgtcaagaggcaagagaacagacatctctttttcctgaattatgttagagcccaggagggatgttcaatcttcaagggcatgtgcggacctacctaatgcaacagcaatggaataactaagaattcccaggacttcccacctcccaaagcccaaactattgtctgtgctgatggtaactgctcgctccaagatgaatgggcagaagctgggatgaaaggcccagacacataggactgataaagcaaacaggttcagtgtccagcatccgtatggaaactccataagaggcaagggccaacagtcctctgtcccttcctccagtgacccccaaaagacaggcaggcactatcagatctccaggataggctcaacaatactggaaaacaggtgtattgtccccattttgcagatgaggacatagtggctcagagagatgagttgaccagtcccagggtcattttaagacccaagctgcattacttttggaagcctccccgacattctataaaatttatcccttgctgaatgtaatattttgctggaaaacaactatacatttaaaagataattttgtttttgaagtgattttcagtgagtaacctgtagtatgaatgatatgctctgatttctcagcagtcattgtctgcaatcaggaaccttggcaaggtgaggcatgctaacccccaaaaggagggctgtttctataaaaactaaatcatacaattcattatgcttgagtatattaactaaatattaattttgatgagcagttttcatattttgaaaccaaacctttttcttttcatgtctcaagcattttcatgagccctcgagaagccacatgggcccatggtgtctcccgggtaaatcaaacccgggatggacctgagatttgaacacaggtctacttccaaaaccagggctccttcctcaatgtctggctgcctccaagagtcaaggcaccatctctaagttgtaacagggaaactaccaaatagaaccagcaggcaagcaggcatgaagggggctggaagtgaggccctttgagaagctgttacagattttgtagatgtttgatcataaacagccatggcagtgggtgacgtttacacacccgctcatgttaagtcccacagttacctccttttgagcgtggaggggttaggaaactcccagtgtcacatagatagcaagtggcctcaccacgatttgaactgggggagttgtgctctggagtccaaaatcttaactgctctgggatactgggacactggagcagaaggatttggggcaagtctggagaggcccaagtgcaatactgagacatctagaacaataggagagaggagatcagttcttttggggaaggtcaaagatagaggacaggtgtggaggctggcaggtctcagctgactagagagaagaactttcttaaaaaaggcagagctgtcgaacaatggagggctgccctaccctgagtgttgagtgcctggtggctggcagtctgcagggaaaatgatgcctctgtgctgggcatgggggcaggggctcttgctgtggtagagggctgtacatatggactccagagggcgtaagtgataatcctctcttcctttctcagaaccacctttctacaggctttggtgtctcagcgcgggaggcacagatggcgaggtctgcctttggccaggtgtgggcgcccagtgttgggggagaagactgcaggcacagaagactgaactcacaggcaggtccggagatgcagagctggtgttcactgggtttttctatgtgctagttactggagcttcacgtgtgtcatctccttctctcctcacactctctgagggtggacttcctcccatctcatagatgagaaagagcctggggcccagagaggctaagcagggaacctggggctgcttgggatcctagggcgatctgacagccacctcagcttccccaccacgagggatgaagccgggaggcagccccttcctgtgcctgacccctaccagctgggaaatgtggcccaggcaggcaaggcctctggggatcccaaagtggcagcaggcagtgggagctgagcagagaggagtaggggtgggctggggggacactgccagacggaaatgaaagtggccttgagaaaaaggaacgagggaagaaaagcagaaactaaaacaagtgacaaagaaaacgagagtgtccagaggaagtggctgaggggcgcggcgccgccggaggaatcccccgcagaccggtgtttcctctcttctcagaggcctcggggtggaggactagctgaccaactgctccgtcactttgggccagaggcagcccgggtgactttggcaagcatggcctcatcccgccagcctaggaaggagcaccagacacagagccccaagccctgggctggagtcgtagtcagctacttcctgctgggtcattctgggacatttattagacctctctagtacccagtttcctatctataaaatgggtataaccatcctgagcccaccacactgctggaaggatctcctgagcaaatgccctcatccagggcctgacgggtgcatgttggggtaggtgggctgtgcacacagcggcagggtgcaccttcaggatacctggggaacagacagggagagtatccaccatcttattgttgaacaagaatgcatcaacgcttgctggtccttaatcaccctaggctttgtcaggcctgggaacaaagggctgaataagggccagtctattcccaattacagactctgcatgcaactccagttccttatcccagctctcctacttggtagctgtgcaaccttgagcaagtgacttgacctctctgagtatctttcttcacccataaagctagaacaataagcatatctgtcttctaggttgcaaggaataaatgagaccacactcaatccaaagccaggcacaaattcctcagccccagcccagggagtgcccagcctagaggggagctggagtccaaggacatgagcaggctgtaatgatagacggcacccaggcctggggcactcagtgctgggcaggggatgcggggctggttctgccaaggcgacagagcagggggagtaagggggggtgaaatgtaatcccaaggggacagcatgagcaaatgtgcaggggaggggccaaaggcgatatgcttgggatctgcagagggtggatgaggccagacttgttctcaatctacagccccactgacagttctcagactggccctggaagtgatacgggcatgccactggggatgctacagtcagctcttaatgcagggctggcttctagggtcagcttctacagccagacttgcctaggctgcagtttgtctccagacagacacgggaattcccccaaggggtgggcatggttcttgtgaactgctgtggcctgggactgggcttagagtacaggcagctgctgcggtgaaggtgtcagaaggcacaggctagggtcccagagaggtttaggagggggtttctctgctgggtgtttgctcagtgctggatggtgggtgctgagggcctcatttgcatagggagagcagctgctgtcccagccacactgctgcccacaatctccacgtggctgcaatctcgctctcagtcaccatctcccacatggactaggggttacccaggctgccttggccacgtgcttcccccaacacacagccatccaggaacaaccagaaatcagactactgtctccgccaccctcaggggttccattcagggagtccacctcccaaggtggctgtgggaataaaacgagatcctgggggaagcagagagcccagtgcacaggggtgatcagtaaccggcagcccctttccctgcctttccctctacttccaacattatgttgtgaagaacagggcagacctgggcccatgctatctctcaccctggctctgtgacttgaggcaactcactccaactctgtaaatcaactgctcatctgcaaaactggcaagaaactgagaaggcactggttctcagattggcaaagctcatcgtcactgcctcactccctcaactctatgtccagggaccacgggtttcccagggttcccaaacttgctgttggcaaagggcctgatatccgtcactgacctttttattctgaatgggtccccgttgactttaaagctggaatattcttagaggaattctaaactcctcctttccaactccctactcattttacagaaggagaaagtgaagagaagagagggagaagggccctgaccgaggccaccagcttgtaagtagcagccctaggcttgggaccagggcctcctgaaggtgacagtcctttcagccatgtgtccttgttcctctagttacctccaattaactctaggtaacccagcccagtctttgattctgtgttgaaaggtgcgaggtgctggagccgggaagaggtgcgttcttgctctcgacaggaagtgtcatgtgagtttccggttccctctcctccactaccactctggatcctcacaccagcccacagagggagacaggaagggaggcacaaaggcagggcagggaatactgtgcctgttttccagatgaagacacgaaggccaagagagggaaagtgagtcggccaaggtcctccagctagtcggggttgagcgtgtttaaccttaggaaacgtgactgcagagcaaggggctttcatcttcctgtgggaattcgccccctttctcacaggggccctcaagagactaggcaggctcctcctgcaaaggattcctctttgtccatttgagaggcctcaccccaggctctaggagctgacatgattcagctcaaggaagactcagtatgaagggagaaccaggaacctgggcctctgcccctcacctgtggccttgaacaggtcacttctcccctcaagccttggtgtcctcccctgtagagctgagggggtgaggagtagatgagctgatccttcagtttgctgccctctttgacccggaagtgctgggcctgcacaaccctgcatccctggcaccagtgctcctagccccaccctgctccagatgcccagtgcctgaagagccagctccccatcagcactcagtcctggggcagagccaggcctggcaatgctgggggagaccctggaggggaacatcatgggccaccaggggcacgctgcaaatgcagcaactaatgcaccaggggcgccagggtgcaatctatctaagcagttctctcacgctctttgcacgttaataatgcatgggcagccggtgtgggggccatcacaggcccaacgtcaggtggcattaggaggcctctaatggtcctgattatccggtgaaggctcccagtgggatgtgggcagcatgggcaggaagccaggattccgggcacttagaccccacaggtgggaggctggggggtggggcaagaggacagcttccataggccagggtcctattcaggggatctaatgggactagctgaggcttcctgtggggggtgaatttgtttgtgaagaggagcaaggacgcaactcccacagccagatcacaaagaaagtgggaagtcagaaacccagggctgagtgaaacctcttaaaatctctcctctgtggcgtctctgaccagtggctctgcagcaagtgcctctagggacaaggaactcactacctcctagagtgacacatgcccattctttgaacaagtgtgactgccgggaaaaaggtgtactgcgtacagctgtcaagaatgcaaatgccactgagtgttgggggcatgggtaagttggataaaggggctgatttgagagacagaggtgctgggttctaatactgaggattctccttgtcctcaggcagctccggagccatcaacctggccagtcttcacagcctaccccagtggcagaccccctgaatccaccccagggccccagtaagcccccgtgaacctgtgaactttgcatttctatgctcaacactcagggtgagcagtccagaaaaaacaacccatgcacagcaggtgctgggggtagtcaggcttcaagatgcctccaaatggttctcatctctgagtattcacactgaatggaactgacctatgtaactaacaggatgtcgtgggaatgacaggcatgacttccatggctaggtcataaagagattgtggcttctaccttgctctctcttggaccccagttgctggaggaagccatctgccatgtcaaacagcctatggagatgcccatgtggggaagaatggaggtcccctgccaacaatcagctttgacatgccaagcctgtgagggagccatctggaaagggagtcttccagccccaatcaggccttcagatgactgcagccctggccagctccttgactgcaacctcatgacagaccttgagcaagaactgctcagctaagctgcttctgaattcttaacctacagaaatgtctaatgctttaagaagcaaagtatggggtaatttaccacatgcaatagataacaaaaccatgtgcaataaatactggttaaacaagtgaatgattcccctgaccgagtgtttctctatggaagggtctggcatggaaccaggccctctggggcctatgggggatggagaggaaacaaaagatgaggacatggtcctctaggaaggctgtggcatgtggtggggaatgacaggtgcagaccagagggagcagtgtgagagctttggatgggctagactatgtggggaagatgaggaaggagttctgagagaggggaccacatgagccatggtgcagcttgggccggacggggagcatcagcagaggcgggttctccagtggctctcatcttgactgctgtatccctagcctccctgagacagctactattatcatctcaattttgtggatatggaaacggagattaagcaactcgcccagggtcaaaacgctgggaaatgatggagccaggatttgaactgaggagaccatggaacagaaaactagcagagggcggtcttaacaaggcccaaggagatgaggctccccagcagggtgactgaggggagggcacacaggtgctagggaaggtggccaaggaaaggccactggggctggtactataggagcatagaaaggcaggggaaagtagccttggggtggggggtgacaaaggccctgcctgagttgaggactacatggctttgtacccaagccactcttaccccagctggagcctcatgtctctcccaggatgctcttgctgggctctgtgcctgggctgaccaactcccttacacagctctgcctactccccatcatacagcacctggaccgcgacgctctatccccgaggacaaggcctgccttcccccaacagaaccccaaacacttcaagctacagtctccagagactctcttctccagagggccctgcagggatcagatgggactgggggtcggtaggagggcagaggacaccaggtttcagtccccatgggaggcaggagcatccccagcctgcctagtccccaggatctggttcacccatgtccctaggacccagccctgggcctggtacacagcaggtactcaatacatgtgcatggaataaataaaccagcagatgcagaactccatcctgcaaacacaaagcagttcagagcacactgggaaatcacatggaggaaatgttctggccatgaattttcatgctggtccctgataatccaggtcttttctgtcattgcccccagggactgctggcatcttcccggctgcactgggcaacactccatatggggctgtgctgagacatagtgacagagtggagggggtggggaagatgagaacacaagcaggggcagagccaagggatgggatgtccttggattctgaaacccgagtgctgacagccaatgtccaactcccaggtaccaagtggtaattactgtgaaaagcagacagcttgacaatggaggatgtagatttcacccaaggccttaccttgaaccctcccccagtcacatcacaggccatagggcttgtgggaagggtccttagtggccatccagcctctccctatatccaagaggaaactgaggcccggccaggagccgagaccctcaaagctcacctgagagttggtggtggagttagaactggaagccagagctcccatctcctattctgtcgctcaccaaacatggcctggctcttggggcgttgccctgggagacaagcctgtgctctgagggtccactgtggctgagtgacttaggggaattggttctgcaaaagaaagtgccaggcagggaagcagcaaccaagggactggaaagaggaaagggatgtggggaaggctctgggacaggcctccctggctcctcactctctttgtccccctgccaccttctcagaagcactctcagcatcccaggccagcctccagcccagtccttctcccaggctgttcctcggctctcaaggcctcagctcctccaggtgtcccactcctctcaacctccagcccctgcacagaactcacactccccgccctctcccccagcacaagctcacagtccccactccctggtccattccccttcctgcctggctgctgtgcaaggtgcaactcagccctcaccccctccttgctctattctccatgcccccaaatctgctgctgttcccacctcacccctcctggcctctccagtcagtgagcagaggctgcacccaccaggcctggggtgggctctctgaggctcatgtgcattgcagctgtctctgctgcactgagtggatggtgcctttggcttcagagccccctgcatctgaattgagttgctgccacctattctagctgtgtggccttggccagccagtaaacctctcttttcatctgaaaaacggagcagacaccttctgcacaggttaactaaagaaccagctggcacgcacatggcccagcgtttggcccagggaaggcgagagatagacatacattcagtgactggactaactcggcaaatgtttccagccaccccctcccatgcccagggtccaggctggtgttgaacatagtcaatggccactaagcatttcactgactgattcattcttgctgctgaaaggtgttcagccaaggagcgatgggccactgggtgatttagaaaggccctttgggctgccatggcggagggcagtctgggaaggaggggacagaagccaagagaccagagaggaggtgactgcagctctgtaaaggagtggagggctgggcaggtgggttgggcagtaggaagtccagccagagactcaggagcaggacccacagcagccagccccggggcaggacggcagttgaggactggggcagaatagaggaaaatatccaccaacgtgggtggctgcttgatgccattgggtgagacatgatctaaagaggaaaggcaggtttagggctgttgtctgcagcagtgaaaatgatgaaatgaggaattgggttttgcagtgttaagagagtgcttacagggtattcagggtgttgtctgtggggtacaatgtttgcgacaccaaacacatcccttcttcagtgccaagatagtgccccaccaacatgctctgcaacagcaaatcatttgccagtaccatgacttttttcaagtaatttatgtgcttcaacacatttgtcttcaacaaccctttgcagaaggcactataattatcatctccatttcacagataagaaacctgaggctcagagaggtggaatcatcttgcccaacaaattatcaacaaagcagaaattggagtcagttgcaaataatttctattgagtgcctgctgtttgggagatctcttcctacgtaagggcacgtagaaccatgtctagcacacagcatgcatattaacacttgctctgatggtgacgatggtgaagaagatgatgacgatgaaggtgacagggatgaggatgcacttctcacatctgattgaatccatttgacaattctaggaggagggcatgagtcccccttgtctgtggggaaaatgagccacaacagtgtgggagtttgtggcagtatgagggctgagctcaggtcacagaggtcagtgtcacccagagctcattcactgctctaaaatagaaccatccaggctctgctcactcccttcccccaaattagcaactttctaccactctgcctttctcccctatggctggcaggctggagatatgtctccagcctggagatttgggactcaggcattgctggggaattaaaccctgctctcctcctccgtcagcacaggcaaactccatgacaggcggatggaggatgtctgcctgctccctggccacccacgtgctatctaaattcactgccagacaaagccgcctctcgatcttggcgcctccctccctccctgccattcatgcactgagagattgcatttccagtaagtggaggctggagagagaaggaagcaagcaggagggtgggggctctgggggaagaaggaagaggagagaaaaaggcaagaacactgaatcaggcccaagagttagccccaccatcaaagtgacaacccattaaaaaaatgatttgtgggtgtgcaggggagacaccacctctgaagagccaccttttccatgctcaatgaggcagcatctgcagccagtgcccgcccagggtgtctgggagccgatggttatcacaacagcccttcacgctcccacttaggaaggaatctcgagagttccaatgttctgatccctccccacttttagaagcaaggagtgcccgggcttcatgcctccatggcattcgttctgggggaaacctgaacgaatttccaattgcatcccccgtggtgttcagatctctccctcctgcagagccttggcaggtgcattctctgtccataagaaaacagaccaagctcctttgacaagctacagatgctcagctccccgtggaaggggttgaggggccaagaagggtgggtcctggggccctgacaaggcttcctggctttgggagaaggaaggtagggccactgctcccccagctccttctgccacagaaaacagcctccccaggtaacctaagcaggggtcttgagaaaagtagccatcctgggtcctggctgtcttgtctgttaactgagagggctgcaccacatgccacccttccatgccccagatgcaggatgagcattcactgtgggcagatgcaggccaaggaaccagggcgtgcatttctggcttccctccgcaaactttcactgccttccagactctgtactggatgcctggggattaaggcacaaggatgatcacatgtgtgtccttgggtggctcagagtcccaaggaagaaacagatggagagcagaggccccatcatgaccggggcaggatggtggcctgtcagagggatgtggcctgaaggaagtgttgaaggaccaggaggagttctggctctttttctacccagagaagctgacacggttggccagggcactatagtcactccagggctgactcttcaggctccagccaccacctaccccttcttagaccctggtgcctactactcctgccccacctccaggcaccagccacaaataatgttcgaggtcttctccgccctttcctttatctgctgagaaacatggctcccctcgttccccgctcaccagtgggagtgcccactcatgaacatagacttttggatctaattggccagggtttgaagaccagctgagccacttacaagctacgtgggctcagaaaagctgcttaacgtatctcagcctggtttcctcatctgcaaactgggatgaatagtactactggcagggttgtctgggggactgattaagatactgtgtgtgtaagcaggcacttgaccgatactcttgccgttcccactgcccacagtgcctccaacccctgcagtcccatttttttgtgtctggctgtggtcaaccgtcatatctgagatgagacctctatctctgccatgaagggtccctgactctccaagactacaggttcaaaggatctgcttccccaaaaggctgagcatacccctgtcattgggtttagtgtcctgggctaccatggcccattgaatcatctgttgtcccaccagctgctaaacacctgaaaaagagtcttatttgcagtaactcatttgctccttagcatccttggtttacagatgaaggaataaaggctcagagaagagaaatgacttatcaaggtcacgtggttaattaaatagaaggtggggcggggaactcagtctggcactttatgtaagaactgtgttttaataagggtcatcaacccaaggccttggtgatgatgaggacctcaggctcatgacaaaactgggcagggagatatatttggaaagggagattttaatgtggaaacggcttacagatttgtgaggctctgaggccctaaaatacagcaggtgtcacttaacctgttctggcacatcctacttgccaggccctgtgctggggcctttgctgtacctgttctgttctgtgtcactgaaattctgaagaaggatatggatccatgccatgtctatagaggaccatgaagctcagccatgtgatctgtccaaggccagagctggtagcactgaaactcaaattcagcattggccacctctgggagggcagggtcctcttccatcctgctctggccagtgggagggacaccccatgtggagaaggcctgccccaggccttggcctctaggaaggacgagcgggaagcagcgtccccagagacatatagacaagcagctgggtctcacaaactctggccaagcccttgtactgcgcagaaatcgcaggcactgtcgctgaaccagtcctcagaaatcagtaaagccctgggtttctcaatccaggtggcggcctcagcacggagccatggggtagcggggcatcttctcagaccatcaattctacttggagatgtagggaagaaaacaatttaaaaattcctaaagtaagttctgatacatgctatagcataagaatgtttaaaactcaaagaaattcattgactcttctctgtggaaaagcttaagaagttttgagttaatccaaccctcccacaaagcagaaagatagtagagtctgaggcatcaggtgacttgctcaagttcccatgatccatcagctcacaggacctggactcaggcttggaaaccagcggctttgtggtcaggaagccctggattccagtccaagctctgctgctgtgtaactgtgctgttttggcttgatcaattcctttctccatgccttagcttcttcaccagtaaaatggggcagctgtcttggcagctatagggattcctgggcccaccataaatgcccgcctccctgtctgcctctttccctacaaacagggtaaagaaacctatggagagaaaactcccacatcagcactcacatccccaagagggtagattctaaaatcttttctccgttggtaatgaaccatggcgccattagaccacaacatttcacgtagtttctgaaatcatcatccatatgaagatattgtgcttggaatcatctcacagtcaccggaaggctgaattccctcggccacccactgctttttgcggaggaaacagaaatgtctgaaaatagaacgtgaatcgatgcccccgacttgctgccgcaaagtgtggcaaagcccaaggagcccgcgccgcctctgcccctgcatggccccagacggctgggggtttccgggcagcctggagtaggatttcaacatctcaagctggaggtcacgtgcacagagcagccggtggcaaacggggaactccaggaagccaggctgtttcagagaagtacttggagctggggggcatttaggcaggagccgagtgaggtcagagggtcggtggcagccgtaggcctaacttgccagagagggaggcccagtctcagtgggtcactccttccaggagcagaggaacagcgtgacagcccagtggcggccaagtgaccgcccacagagcactgggcacccacaactctctttgcagatgggaacaccgagactcagggagggtgagtaatgtgcccccaggagttacccagctcagcagagaaaaaattggggttgcccccaccccctctgcctctcttggaaggaagtcttggcttcctcaggcgctccttccactccacccactgtacccacccacctaacatctaccaagcatgtctcaaccccagactcccagtatcatcttgtctgcttccagataaccctgtaagacaggcagggtaatcatgcccacttcacagatgagaaaaactgaggctctcagagaccatgtgacttgtttaaggcagaggctcaagtccaggctgtctggcccacctccccagtgtgcttcagaagagagcactagtaacagcacagtggccatgacattcctacatgacagcatctcagcatttccaaagtgttttcactgccaccctagcacccagccacaaacagccctttcctacccacaaccacggcataaccaggaagttgtctatccccattttagagatgagaaaatgggatgagagggttgaagtaacttgcccaaagtcacacagctaagaagtggcagatccaggactcaaacctaagtcctccaggtctccccatactcaacctacccatccacattgctggccagtggacgggatgaagatgtgggcgctggcaatggtgtggccactgcctccccggccaccaccaatgctctgggccctaaggccctgcaccccttttctctgatgaccactcagtctccaaggccatcctgaaagcagcttattgcaagacctgctggaggctgggcagccagagagtggatgagttaatgtaggtgggacaggacacccctggcttctctgccgctcttctattgcctatacacagctgcaccatgcaaacctggtgtgattgggcgaggagggaacagacactgggaagcccaaaggttctggaatgacattgcctgcttttctctccagtgctgtcagggcaagcccatgacagcagttttgggtgcaaagagtggggaagaaggtaaaaactgccatatacagagaggctggctctggggcatgtgtccttcatatttattctacaaacgtttaataaacacccaccactacacaggccctggctaggagctctcacacttcctccttcactcatcctgacaaccaacgtgtggggggaccccactctgtgccccaccaccatggcagacaggcaagcaaaatgggaacaggagcactgcacaaggagtctgcagtcatgggtaccagccctggctctaccattcatccacagatgtgtgacccaagcaaccccctgccctcagtgggcagaagcatggctggggaggacagccaggcctatacgaggcagggaggaacagggacagctggcagggggtgggggctcagtttcctgtgtctggccagaggctggtgcttttctgtcctctcatcagacctacccagagacggtagggcaggaagagaacgatttcctggactcctaccatgtgccagccctggccaaacattttcacatgtggtatcttgtctaatttctgtaacatccaagtgaggcaaaaacaggctcagagaagggaaatgacttgccccagatcacacagctagagcagggaggaactgcaagaggatagaaacacagatctgtttgctttcaaaaaaggaggggaagcttccccttcctttttcttctcccgggtcccctagcacctttgtcttcctcctccgcttagctagaatgtgttagcactggaggagcaatggaaccaagaggcaggtgtggaggaactcatctgcttcccacctttgcattctcctagcagggccggggtcccaagctgtctttccatggtgggagtgggaggtgctctcctgcggagtcctgacccatccccactctcccacccaccctatctcagtgactaatgggccgtgccgctgactaagctgccctcgcagggtgcacagtggaaacaaacccaggttccttcctctctaatcctcacccccatccttggcctggggtctctagccaggccctgtgttacacagagaggtagcccatgatacaggtgagtcacgctgaggctgcagccacctggatctgctgcctaaagaagtgctgccctatccatctgatttcccatggggcgtcgggatgagaaggggctgtggaaacgaacagcctgaattttcatttctggctcaaccactgattgtgtgaccttgtgtctgctgcttcacctattggagcagcctaaacatcccgatttgtcaaacacagggctgttttgaaaactagaagccatcctatctgtaggatgccagaaacatagtaggtactcagcaaatctgagcttttcccttcaactgtctaagatagactgagggctgaaggccaaggcatttgtttacattgattgtccaatgaaatgaaatgttttcctattcctgacttgatttgtggcaagataatgctttttagaattgattctgacttgtagtttagccctgaattctacaccattgtgaattggaccctgaatatatccagcctctacagccagaagttcgaggtggggctggtaccaaatcttatccacccaaccatctgtccatccatccatccacccatccacctgtccatccatacgctcatcttttcttccattctgccatctatctgtccaaccgtctatccatccatctgtccattattccatccacccatcctttcattcatccactcatccactcaatgattgaatccccagcatatgccagccacagcaagggctccaaacaaaaaagagcttcaacagcttccgcatactctgctgctgttgactcagacacacatcacaggcagctaataattacttttccattggtcggatgtggagaggaagagcactgcctccctcccagcatctggcttgctcgacattgcctttctctgttccacatgcaagtctcccagtgactatctttctcgtgaatacttattccttgatgaacagggtattccccataagagcagaggttttcactaaggtacatatccctaatgtgcacatgtatatactgcctgcctcatagttctaatggggatttagggcctgtgtggggcttgcagttgattgtactgtgtctatctgcccactgggtcagcataaggctttacacacaggacacacttcccactttagcttctctccctctgtcgcatcatcttgatccattttcaccatcactcccctcactgtctagaatttgcagtctgtgttggtttgagaatctgtgtaacaggggagtgaggagtgcagtctctaaagctgggcccctaggtttcatatccatcactctaactgtgtggtgtggaacgagttgctaaacatctctgtgtctgtttcacatctgtaaaatggggatcgtaacagaactaatttcatggggctgttgtgaggattaaatgagatcatgttgtttttctaatggtgggcaataccacatcatgagggggcatttttaactgtaagtggatattaggggatgttccaaaggctgcggtggggtatggggtatggggtatggggtatgggtatgccactgacagcatgaggcaggaaccagaggtgctaaatcttgcaacatgccacacagcctgcacaacaaaaaactttcccctcaaaatactaactgcacccctagtgagaactcctgtgaaaagggcctcagcagggcctggtacaaggtagacacccaccaactgtgagcttgccaccacgtaagctttgtaagtaaaggaaagaaccttgtctgtctctttcagtgctaccaaatccccagcacttaggacagagcctgacatctggcagacactaggtgaatgaatgaatgaatgaatgttacatgttcagtcaatgactggtgagtagctgtttggtgaaacatgtcaaatttaatcactactagtgtttgctatgcagctccaaaccacaggataaggagatggtgggggaacagctgcccctttctgaatgtcccgtcctatccttccttcaaggcctgagacccctggagatgacgctcagggactcgtcatttgtccttcactggtgaatactatctgactcataaaagcttctctcttctccatgactagaatgtgggggtaggatctgcctctcttccctctctggtcctgggtataggggacttggtccctagcaggctcagtagacttgtgagtggttgcattgaatgccggccatcaggcacctttgcgtaaatgtgggcaaacctggtcaagcagagtaattgggaaatggaagggaaatgggggagggagggactccctggatattctgagaagaggattcaccagaaatctcgatttctacccgtgtcaaaaattcttccatccttaggcacctcccctccttggtaacacatagaatctttcccttctgacttgagttcagaagccagccagcatttttttgttttttttttgagacggagtctcactctgtcgccgatgctggagtgcagtgatgcgatcttgactcactgcaacctccgcctccaggttcaagcgattctcctgcctcaacctcccaagtagctgggactacaggcgcctgccaccacgcccggctaatttttttgtatttttagtagagatggggtttcaccatgttagccaggatggtctcgatctcctgacctcgtgatccacccacctcagcctcccaaagtgctgggattacaggtgtgagccatcacgcctggcccagccagccttttaaaatttatgtcactgaacttttgctaagtgcctactgcatgcagtggaagagctgaatcaaactagttcctgcatgctggaggtgccagtctttggcgggtgccagtctttggccatgatcagggtgtgctggccagatgggagacttaggagtttatgtcaaatggggttgagttcctgatactcctcagaagctatgttttggtatttaatgtctaacggaagctcatgttcttgctggattttcttgtttgatttgcttttgtttttctgaaaattctactcagtcgatgtattgatcagtgagattgcggctaagcgtggttttatagggtgggctcattcaaggggtgaacaagaagacagttcaccttctcatggaacttacattccaacacatacatatctaacatattacattccaacacatacatatctaacatattacattccaacacatacatatctaacctgccaggtgcttccaagtgctgagaagcaaaccaagccatgtttgaggataacaggagtagaaggcagggggcagggggaagggtgggagaggaaggtctctgattaggtgccatgtgaacagaggctgaggaagtcaagaagccagtggcgtggatctcagaagagcttggatgtcagccagtctcaggattgtggttctggaaggtgtaagctccagccagaacctgggggtcccagcactatcaagggagagagatggttcctttccctcagtttcttctctctggactttgggcccaaatgactcagagatggtgactttctctaaccctctcaaaacccatactcaagacatttcccctttctctaacctaagtctgccgtgtcctttctcaccccactgggcaggtggagcacaggaggtcactgcccccacagatcacatggtgaaaaagcagccctaaggtgggaggatgctgaaagatgtccctcagggaactccagggacatccccaaagcagtccccataagccaaaagggctttagtctcctgtttgatcgttaaaagccatgcatgtataaaattctgctttgcaatctatgcatgtatctacccatgtggtaaaatatacatgtattcaattattcacctgaaagatgggccaggtctacactgaagatccactaggcctccaacactctgctctgaccctggagacaagggcatccacagtcgagagcacagggcagaggagacccctggaattctaatcgtgacttgctatagacataccacgtgtctttcctcgacagagggaggggtccctgtggctcttgggccccctttccaggcagctgatgtctctgaggaccccagtgaagggcaggatgacgtggatgataaaagcctgaattagagcagggttgtgggggtgggaatatgggaggaatgttctggccagaggctctcctctttccaccggagggaatataacacatcccctgagaaagcagatgcggctgtttcacaggcctccttgctgaggcttcagggcctgtcagtgaatcctagcagatctggtccctaccatgatgcctggcatcaagaatcctcaatcagtatctgttaaatgaataaatgaaggaatggtcaacgaatgaatggctaagtcacaaagcaccagcagccagcccctggctgagatgattctggggcacttctggccctaatcatgcattggcagtgcctccaccacccttttgttccactctgaagcaatcatttgatggactgcctgctgcccccatggtttccctctgtggctaatgcagtaaaaagagccatagattataaaccactaattgtatttagagaaaaaaaaatcttgccataataatgggtaccaaatgactgggtctctgctaatcacctcgcatttattatctgtttacttctcacaccaactttccatcaaccccgtttgcttcagattagaaaccaagggcttcaaaaggtgacatgtttgctggggaaatgggactggctgtgaagtcctctctcttctttgcttggcacaggaagaaagagcattggggacttgctcccctccccatttcaacttcccagtcacattccttccaataagaagaatctaaggcacttaaatgctatttatttatgcctatgagcatggggtgcaagagcttctgtccagggaagctatgcatggggatggcaggtcccaattgggcttcggtggctcctgactcaaggcacttgtttctaggctgctgtaacctatgagtggtctggtgtggggagacacatggcatggggcaatggcacttagctaagccaaactgcccaggtctgcagcagacactgttggagcttggccccttcccctgtctcttgtcatttccttgcactccagcctgacctcttggcctcaattttgcatgcacagaggactggaagttcttgggaattaatggctgccactatcactatctcagccgtgggccagccctcaggtaacggctgctgggtgcagggtataaatgccctggttccctcgcaggtgcacagagtagagaatgagcaagtcaggagggccagcatgtgacctggtgtaacagcatcacccccggctcgaggatccatgggtcagggagcatgaaatcaccctggggtcctacaaagtgggcactatgactcccattttgcagatgaggaaactgaggattcccacctgtgagaggcagcagcaggataggaattcaggcctgtcagatttaaaggccaaacacctgctgcaggagagaggcaggggagagggtaagaagctaagtgccaataggcagacctcagggctaggaagaagggcagtgagggtgaggggtggtacgctgggccagcacaggcattttattctgagaacatgttggggctggtcagtacctagagaggagtgctgcaggacacccccagctcccaactgatcctgccagttcttgccatgcacccatggcagtgccagtcacccaggacccaatctggcagctgcctacctccaaagctactggcaactctcacctgcatttctggcagggggatgaggaaagtggaaagaatccattttttcctgattataaaaatagtacatactgtgaaaatttcagaaagtataaaaagaaaataaaaatgacttatgatcccatcctagagatcaccaccattcacatgtgagtgtccttctggtagacctttttctagacacatatgcagtttgattttagtttttacatctatcagctatactacttttttcttttattgatatattatctgtatctttcaagtcattgaatatacacctatgtcaccatctttaatagctgcatagtattgtgttgtgtagatggctcccattttatgtaaatcaaccttactgatagactattgctggttttacagtaaacaatgctgctatgagcatctttaaaatagtgtctttctggggtcaattaagaacatggatcaaaaggcttaaaaggataccattccctttgacccagtgattccactcggaagcacttgatggtcttaaggcagtaatcagatggaagaaggccaccagcacggatgatccagagaatccagagaataggaaccagacagcaatggaaggatcccccattcttgagttaaggccagggcaggcacatggttcatatataaacattatatgtctttcagtcttgagtgcctggtgtggactaagcacctaataaatgaaaggtgagactggtcacaaatgcaaggtgggaagcccgtcagaagtcacggcagggcctttccacaagctggattggtgctacaaccctggaatactggctttaggttcctctgggtgaggaacttgtccctctcttgtccacccttgttactttccctcagcttcagggagagtaaatgaagaagccaggggctaggaaggtgaccagaaaccctagtttcatggaacaatgacataccaaagccacacatatctttgttctgttcatgaccatggagaggtcatttcctcatctctgccccacctccttcaactattgaatgggaaactgtggtccactcacctgcacaaagcaatcagggggcagcgctgtgaacagagactttagagtaacatcatcatgactgtcatcaccatcatggcaacaataagggcggttaacatttactgagcacttgtcacctgccaggtactgttctaagtgcttaggctatgctaatcttcatgctagctctatggcgttgatactatcacagtcaccattgcatgatggaggcaggaggctcagagaggtcacccagctggcttgctgaattgttggggtctgaacttagcagccttcttctaagacacagatattggtcagaatgccacagaccccctgccgcccaccagcggggtccttcaggcttcttatttggcctctttgaggcttgagtttccttgtctgtaaaatggggataccactttccatctcattggctttgaggactctcaggggagcagtgcacacaggaggaccaccactcagctgggctcagagtgtgtgtgccttccgcaagcatctgagacaggtgccacaaatgagggctgcttgctgcccacacaaagatgatctgcccccagtcaatatacacttgtctctctcttgtccaccctgttagagacagaacaaggggtctctattttcagtcatgacagggattccttctaaccctccaataggctgcagacagtgaatgtcacccactagaaggtataaaggcataaaaaggtatgatgggtgtaaaaagaggtttgtttgaaatttgtgacttcacacttggcactcctggtagggatgggtcaccctctggcatccatgaccatttacccatgagcccctctcacttcccctgggtgggtttcagcaaaggcaaaaaatgcatatgattcctgacctgagggtttcttccaggattcaaaggctctctggactctctgaaaccttagaaaaaattgtgtgtgtgtgtgtgtgtgtgtgtgtgatggagagacagagagaaggagacagagagaatgagaataattctagagagagggcctgtagctgtcaagctgtcaacatagtttcactgaggctccttcattcctaagaaaatttagaaatgctatgacaaagggttttccctgtgaaatgtcattacatagatcagccgtgtgctctctggcgcgaaatcctcccatcccctcaccccacggaacagagctcacctggggctcacatagccctaactaatttggtcttcattagctatgtgatcttggataagacatctcgctttctagcccctgttcttcccatctgcaaaacaaataagttggacttgtgagtggcttcagcatgtgctctacggagctccgggggcacaggggagagtggtgtggccttgggggtgaaatgtatgtgggggtcacctctgtccaacaacagcagctctagctctcacagaatctgcatgaaatgttacatgagcaaatggctctgtagcctaaagccaaaattgaaacaaaaccctggcccagttgatcacttggaacctttctggcttgtgaggtctgagccctgagcagcaccaagctgctctggttctgtaatccttagaggcggtggagcctcctggttaagagtcagaacctgggtggaatcttggctctgccactcattaagcgccatgaccttaagcacgttgcctaaaactctctagcctgcttcctcttctacaaactgcacacacctaccccacagggtctctgtaatgattaaacaaattaataaacctacaacacctcgccagatccacagcaagcacttgtaagtgttagcagctatcttctgtcacaacttctaacatgagtccacaaacatggaattcatcaacaaatggcagctgaataaacgagggagtgaaggaatgaatgactggagtccaaaattccattagttgattctctaagtgagcccactcaaagcattaatccaaggcttcctaagctccagtgtgtgcatcatctgggaaccttgttacaaggcagaatcagattctgcaggtctgggctggggctgggccttggcatttccaggttccaaggcgaggccattgctgctggactgagtagccgggccttggttcattgccactcatattcattagcttgtaggcttcccacctgcagttaccaaaccactcaagacccttgaaaatctctgtagattgggcactctttatcacctactgagctaccaagcccagtgcacttttttttttttttgacacgcgtctcgctctgtcgcccaggctggagtgcaatggtgcgatctcagctcactgcaacctctgcctcctggattcaagtgattctcctgcctcagcctcccaagtagctgggattacaggtgtgtaggattacaggtatgcaccaccacgcctggctaattttgtatttttagtagtgatggggtttcaccatgttggtcaggctggtctggaacttctgacttcaagtgatccatccatctcggcctcccaaagtgctgggattacaggtgtgagacaccgcaccgcacccggcccccagtgcacccttggactaggttcgtaagaacggacatgggcatccgtgttaaacccgaagttcatgtctaggctctaccatgcaatgaccggccaagtccctggtttctctggggctcagcatcctcacttgtaaagcaagatcagcaacaccctccctgcccagcccatagaactgctctgaggataaaaagtgacaacagatgggaccatccaggggccagaggtcgtgattaactggcaggctttatttccaacttctcctcttcaccctttgaattcatcccgagggaaactgacacacattttttttttttttttttttgcataatggcatgcaagggaagaggagaggaagtcagcctgctaaatttagcagatgcttacgccccctcacccagggctcagcccacgcatttcaccatgagtaggtgcctttctatatttaacttctgcctgcaccttccccttgagctctgacaccaaaaaccccaggaggatgtggtgaggagggaagggaagttcacgaaatgagcagggttgacatcacatgaggccccacctgcaccttcaggtgtgcgttcttcaacctttcccctgtccttctcttggagcttaagactcacccagccaaagtgtgaccagagatgctactgccctttgggacaacagcactcagtggtgggcaagggaccatgaaaagcccaacagaagtcatggcgaggcaggagagtgtctaatgcttcccataggcacagcactaggcccatctgcacaagtgaccaaagtgaatccacacaaaagcatcacacagatggtatcatactcaggctgccgatgagcaagtgggggccccaagagagggagttgtccaaagcctgtgatgggtggagggtccaaagcctgtggtgggtggaggatccaggcctgttctccaacatgaccctgtccatatcacatttgtcttctcactccaccttctttatagaagactgctggggaggtgatgggttcaagtcttacctatgtcatcactcaggggtgtgactttgagttagtccctctccttctctggttcctcactgcacaacaagtccactggactgcctttctgtttgatttccgaaaatcttcttgatgacatcagaatccaacgatcagaggaagtgagaatgaatccggatgactgactttcaaaaccacagggtgacctctgtgctgcacctccctggtcagcacacatggagtctgtggcagtcacccacggaggctccgcaatagctcctcacccttctggggagccctcactgaatgcctctgtgccaagcagctcagcaggctctgggtggactgagatgaaccaggggcctagaccagggtccacctccaaagaggggaaaaagaccagggaagactgcggctctgactgtgatgtggtcagcacggcgatggagctcccatggggcacaggggctggtgcctaacccagcctagggggctgagggaaagacccagtgggaggcagacaaaatacatccaacactccaggccagcagttctcaaagtatggttcctgaacccggagcatcagcgtcatctgggaacttgttaaaaatgcaaatccctgggcctgtcccagaccgacagaaccagcagtctgtgtttgaacaagcccaggccctccaggtgattctgaggcactctcagtttgagaacccttggcttagggcaggccttagaagacagcaaaaccttgaactctgacctctctgggttctattcaaagcttggctaggaaaagtaacaattcaggaaagtgttctaaataatctggcgtcccttctctccgctggacaatctcagtgctcactttacaaagtgttaggctcagggaaagatccacatctgagtctggctactagcctggctgctgctccactggctacatcgctgggcactgcctttgggttttattgagcgtgtttacaaccacagaaagactgtctctgagttgctgtaaagcggttgtattctatcaagttacacaaaactccttctgtaaaaactcacgtgagaacagtggcaggtaacttggcaaagactttctaaaaatgacaagacccagcattggtgggagtgtagggaaaaagacacagtcacacatttctggtaagtatggaaattgatactgcctttctggagaaatacctgtcaaaagtgtttttttaatgtgcatccccttgacctagcaattcaatcttagaaattaatcctaaggaaataatcatgactgtgtatgagtaattcactccaaggatattcatgttagcattgtttgttttaaaaattggaagcaatgggccgggcacggtggctcacgcctgtaatcccagcactttggactttgggaggccgaggtaggaggatcacttgaggtcaggagttcaagaccagcctggccaacatggtgaaatcccgtctctactaaaaatacaaaaattatccgggtgtggtggcatgtgcctgtaatcccaactacttggaaggctgaggcaggagaatcacttgaactcgggaggcggaggttgcagtgagccgagatcacgtcatcgcactccagcctgggacacaggagagaaacgccgtctcaaaaataaataaataaataaataaataaataaataaataaaaatagaaaacaatggaagcgtttctaatgaggggctgtttactaggtggccgttcattttcattcattcaggtatttattgagcaggcatcatgtgccaggcagtgtattagacattaggcatacagcagccggtgaatgaatgaacaaaatctctgtcctctgggaggggagacaaccagggaaccagtaagcaagtgcaatatccgttgtgggtcagcgggtggtgggggtaagaggagaaggcagcaaaggcaatgctggaggtgagtgccgatggagactagagggaaggtgaggaagtgagtgagctctgtggacagctgaggaagacattctgggcagagagaactgtcttccagacagaaggaaacagcaaaagagcaagagcacgcggcattctgggtgggtctgaggaacagcaaagacaccatagcggctgccgcagggtgacccagcaaggagagtgggacctggccatcagggtcgtgcaggaccttgcaggccacccaggacctttggctttcactctgggtgagaagggaggattttgagcagaggaggacccctgatttgtgttttagaggcaaccctctggcttctgggtggtgaagagactccactgccctttgagacaagagcacaggagacaaggatcagattgcaatgctgttgggaggctatcacaacaatagtctttgcatgctagagatagcagcaagtgagccaaggtaatggcaatggaggtgagaagtggtcaacttttgagtacaatttgaaaatacgtttgggcttttctgcagagcgatgcctgcctgccgtacgtgtggctgcctggacagacgacttagtctccagaagctgagatgagcgacaataagcaaggaagagagggtgcaatataccttcagagggaaaaaggagtcagcaggggtcgccacacaaacctgcctgctcactctgttggacatttctgaaacctcaaatgtgaatcttgatatcaccaaggtaccaaactcttctactcagatctgggggcactggctgcctgcttaggttcaaaggcaaccaaagaaatgcaatttaaaataaggatgtgaataatttttcagttatcagataggcaaagattttttaaaatgataacagccggggttggtgtgggtgtatggaaacaagcgcccctacactgcagcggaagtttaaattagtaccacctttcaggagcagtttggtaatacgttatcacaagccttgaaaaagtacatgccaaaggaaccagaacactgaaacaattttgaaaaaagaaaaataaggtgagaagcatcactttacctgatgttaagacatgatatagctacagtaatcaagaatgtgtggtattggcaggacagatacataggtcactggaaacaaatagcgaacccagaaatagttccacatggctacagccaaccgagtttggacaaaggcaaaaaagcaattcaatgaaggaagcatagtttttttttaacaagcggtgctagaaatattagctatccataaggaaaacatggacctcaatgcaaaccttccactttatacaaaatttcatccaaaagaggtaatagatttaaacataaaatgcaaaaccataaaacattcagagataacacaggagaagattttcaggacctagagcccagtgaagagtctttaggtgtgatatcaaaagcacaatccataaaagaaaaaaaatccacaaaattgaatttcatcaaaattaaaaactgcttcgcataagaccctgttaagagaatgaaaaggcaagctatggactaggagaagatatctgcaaacaacaaatctgacaaaggactcatatctagaacatacaaagaactctcaaaacacagcagtcaaaaaaaaaaaaacacccaaaacaataaacaatctaattagaaaatgggctaaagacatgaatgaacacttcaccgaagaggatatacagatggcaaataagcacgtaaaaagatgttcaatgtcattagccattagggaaatacaaattaaaactacaataaaatacccctacatggctattaaaacagctaaaattaaaaatactgacaataccaaatgctggaaagaatgcggagaaattgcatcccttgtccattgccggtgggaatataaaatgatatagctacactgaaaaatattaatagtttctcagtttctttaaaaaaactaaacatacagttagcataagacctgacagtaatactcctgggcatttatctcaaacaaatacaaattgtgtgcacgtaatctgtacttgaatgctcacagcagccttgtttgtaaaagccaacaactggcctacaataggtgattagttaaacaaattgtacacccataccagggaatactactcagtgattaaaaggaacagactgttgttatacagatctcggataaatattaagggcaatatgctgagttttaaaagccgatctcaaaaggtcatctaatgtatgattatagagatagaggacaaaccagtggttgccaacagtcagggatgactgggggatgggaaaagtatgactataaagaggagcagtaagaagatctttcaggtgatggaatagttctgtatcttgattttggtgaatctacacatgtgatgaagtaacgtgataaaatgacatagacctgtatgcctactacaatacagtatcaaaaccacggattgattcctggttctttttccaaattccacttttacaaacttatcctaaggtaatattaaaaaggcaccaaagagccctagatccctggataaacaggatcatttcaaagttgtttataacagtgggaacttagaacaaacctcttcatgccaataattggttaaatagactaggataaatatatccaatggaatattatacaatcattgaaatgatgatgtagttctacattcgttgatatggaaagactttctcaatatactcttaaagggaaaagattacttaaaagcaccatatggttctttaaaaaataaaaagttatatgaatatatagactgcaagctccctgagggcaaggatttttgtccgtatcatttactccagaatccctggatctcagtatagtgcctgacagaaagtaggcactcaataaatatttgttgaataaacaaataatatacacacacatttgcaaagtctagaaagttattctgcaataaaatattagcaatggttggctggggtcagtggctcatgcctgtaatcccagcactatagagggcaggatctcaaagaggagggcggatcacttgaggccaggagtatgaggccagcctgggcaacatagcaagaccttgtctctaaaaaattattattattattattattattattattattattattttggagatggaatctcgctctgtggcccaggctggagcgcagtggcgtgatctcggctcactgcaagctctgcctcccaggttcacgccattctcctgcctcagcctcccgagtagctgggactacaggcgcctgccaccatgcccggctaattttttttgtatttttagtagagacggagtttcaccatgttagccaggatggtctcgatctcctgacgtcgtgatccacccgtctcggcctcccaaagtgctgggattacaggcgtgagccaccgtgcccggcccaaaaaaatatttttttaattagctgagagtggtggtttcacctgtagtaccaaggaggatcacttgagccaaggagtttgaggctgtagtgagctatgctcatgccactgcgctccagcctgggcaacagattgagactgtgtctcaaaaaacaaataaacaaaaaacaacaacaaaacccaaaacaatggttatctcagaataggggaatggaggaattttggttgatttggttgattaattacagccccttcagtctgtttatattttctactttgtatttatttatttatttatttatttatttatttttgagacggagtttcactcctgttgccctggctggagtgcaatggtgcgatctcagctcactgcaacctttgcctcctgggttcaaactaacctcctgcctcagcttccagagtagttgggattacagggatgcgccaccacacccactaattttgtattttcagtagagacagggtttctccacatttgtcaggctggtcttgaactcccgacctcaggtcatccacctgcctcggcctcccaaagtgctgagattacaggtgtgagccaccgctcccagcctactttctactttttaataacaattatatattctttatggaatatatatttttgaagtacacaatcacaaacaaagtggagaatgtgctgtggagatctctggcctgattgggcaaaggtgggggtggtgcagttggatgacatccaaccaaggctgccttccccggacaggttttggtggggtctgaagaccattcccagggctctggtgtgagggacactatgtctggagtgagaaccctcataagagatcttcacaatagtgaggccccctataagccagagagatgatagaatgatgagccaggtacacagggaatggggagagaaggcatcagtcctggtccaaatctcctctggagaggggctgggggaggacacaggacagaaacctgcagacacatctatccaccagggcctatcttatgcacagccttccacgcttcaatggaccaaggtagtggttcccaaaagacctgtctgaagacaggctgcatcacaattcctaggaagctttataaaatatagatttccgaccttggaacccaagtctctggggaccagaacccaagttctagagaccattgaacccaagtctctgggccgaggcccaggaatgtcattttacaaattccttgggtgattgtgatacattgtggggtttgggaacctccaggcagtgggcataaagccaaaacagcatcatgttggacaaactggtagtagttatgccatttgtgatgaaaggatatgggaactagcagtgattgatttgtaagattttctctgaagcactcagaaaaatttaaagacattgctagaatcttagacacctcccttttaggagaatggggggtactggccccactgctcccccatagtgtactgtgaccaatgactccctcactcccatcttttttaaattgtcgtaaaagatacataacatttgccattttaaccattttaaagtataaaattcagtggcattaagtgctttcgcagtgttgtgcaaccatcaccactatcaaggtccagaactttttgatgactcaaatggaaattccataatcattagcagtaactccccatttccccctttccagctcctggcaaccaccagtctgctttctattaggttggtgcaaaagtaattgcggtttttgccattacttttaaggtcaaaaactgcaattacttttgcaccaacctaatatctctgtagatttgctcattttgggtatttcatataagtggaatcacacaatatatggccttttgtatccagcttctttcacttagcatgttttcaaggttcatccatgttgtagcaggtatcagaatttcatccatttttatggctgaataatattccattgcatggatatattctattttgtttatccactcatctgttgatggagatttgggttatttccaccttttggctattgtgaatagtgctgatattgtgaatagtgcagatatgagcattcatgtacaagtttttctttgaatatctattttcaaatctttggggtatagacctaggagtggaattgctgggtcatatggtaactctatgtttaacttattcaggaacctccaaaaggttttccacccacactcactcttataaggcatctgatacctcagtctgtgctctggcacaggcacccaaggcatcccagtctgtgccttggaagcctgtagcagagtcttagggtttaaaagatctgggtgtaggtcagactgtgattctacaagctgtgacaccatgggttggtcatttctttgtactttggtcatctttgtgctttggtttccacataggacctcacagggtggtctaaatattgaatcagataataagtgagactatggataaaacgagaggtgccatattagagtagtagggggtaagggctctacctggccctattgttcagtgatggtaaaaccttggtcaatttcttatagcctatgcttcagtctcatctataaaatggggtgaataagctgggcatagtggtgcaagcctgtggttctagctactggggaggctgaggcagtaggattgcttgagcccaagagctggaggctgcagtaccccatgatcacacctgtgaatagccactccatagctctagcctgggcaacatagtgaggccctgtatttttaaaaatgggatgaataagagtacctgcctcataggactctagtgttaaaacagtcaattcatggaaagcattcactggaaagtggtaccaacttagctactgctagaaaatgcttagcaatactggtgggggccgggggactggtgctcacattttcagcttgcacctgggttcctgccctccctttctcaacttctctacttctgtctctgggcttctctgctgggacccttctctctcacgtccacaggtcaatgcccagcctgaccccttggttaatccctcttctgtgctccatgccctgcagagcttactttgctgagtttgacttgagtgtagactctggcttgttcattttatggatcttctctagggcctattatacagtagatactcaatagatacttgctgattgaataaatgaaagaaaacatttctcttcaactggggaattggctcatggggctgatcacagtacagggccctggggcttgggggccctctccacaactaagccaggagcatgcccaaatgctccacaatgcctctccccagtttcacagtctgccaaacagcacagtgagaggtcacttcaggatctaggagtgagtggggcagagcagtgacaaggcccagccacctggtctccccagccttcctcagctatcttgggctcagaaagtggtgatgggtaggcatggactctcctcccatgaccctcaaacatgtcccgtctgtctccccactttacctgtcctctcaaatgtaggccatttgagcctacactcagctcccttctcttttttggaaataaaagatgctctgagaagaagtgtacattgccagacatggaggcactgaggcctgccagtctggtgagagagactacagggcagagagattacagggacatttggaaggaacattgctggtgaaggggttctaaccaagagcagtccttgagctaggtgtatgcgcatgcatgtgcatatgtgtatgcacctatgtgagtgcccaggtgtgtatgcatatgtgtgtgtgcacatgtgagtacatgtgtatgtatgcatgtgcatgtgtatgcctgtgtgtgtatacacctacgtgagtgtgtgagtgtatggttgtgtatgtgtatgcatgtatgtacctgtgtgagtgtatgagtgtgtatgcatgtgtgtgtgcatgtgtgagtgcataggtatgtgtgcacatgcatgtgcatgtataagcatgtgtctctgtgtgtatacacctgagtgtgagtgcatgggtgtgaatgtgtatgcatgtgtatgtgcatgtatgcttgtatatgcatgcacctgtgtgagtgtatgagttcacaggtgtgtatgcataagtatgtgtgcctgtatatacatgtgtgcatgtatgtgtgcatgtgtgtgttatgcttatgtaagtgcatggatgtggctgtgtatgcacatgaatgtgcatgtacacatgtgtatacataagtgtatgagtaaataagtgtgtgtgtgcatgtatatgcatgtgttcatgtgtgtgttatgcctatgtgagtgcatgggtgtatatgtgtaggcacatgtatgtgcatttgtgcatgtgcacttatgcacccatgtgagtgtatgagtggatatgataatggcaggaggcagacaaatcccaaggcagacaggggcagatccctagtgaaaaactgactttcaaaccaaagacagtttaaagcctgaaagccgagttacaagtcccaggtaaatccatggactggattgagaacctctctttccatttggcgtgctttcctctgattgatccccactcctcacctattttacacatacctacccttccctaattggttttttacactgtcatgctcacctttgagtggtgcctttgttttagccttttttgcatacccacaaaccaatcagcatgcactgctccattctgagcccataaaagccccggacccagccacattgagggagagagaccacccaacttcagatgggggaccaacctcacatcccctctctgctgagagctattttgtagcttaataaaactcttatatgcccttctcacccttcaactgtcagtgtaatctcattcttcttggatgtgggacaagaacttgggacccactgaaggtaagtatgaagaaagctgtaacactgtaaccctcccattctccatcagcagagggcagccaccccatgcagcaggaagcagtgtcagggtcaggccagccctggatccgcaggctggagcagggcagtggactaaaggagctgttagcatgctctaacacctgctctggggcttcagggttgtgggcatccccgtttgggtgccaccgcattcccctcatctggaggccagagtccaccacagcagtcggtcatgacatgcctggtccaaatgcaagccccacacaaagcctgctcctgtgctggcacttggagcagctagccggaccccacacttgcttgctcacacacccacttctgccatgggctgagtgcgctgtccttgtggccatgggatctgcgctggagtgcaagccaggcacagcctggtggtttgagtgagcaggggcatcaccagccatgaaggtctctggctggcaaagcggcactgaaaatatcctgcattagataggcatgtatgtgtatgcatgtgcttgcatgttagggggctgagctaggggaataggtggaattggccactccttcctggatgcccaccagcttaatttcacatgtgcagccaggtctgggcagctgagcctgcaggcctgccaaggtgactggggaatgcctgagagtgtgaacactaatacaaaagccagatgccaagtgagaggagagttcacacatcagagtgtcatggtcaccttgggcaagtctcttctctggggctttaatttcctgcccatcaaataacaaaggggtcagagaccctctttttcacattgcattaacatctctgctaagagctgctccagcatgctcaaggagacatgctgctgacagtccacccctctctcccgaggctctgtttgctgaggacatgggctggcaactgaagagagcctggaatcctggggcaagcactatgcccagctgccgtccccctcctgccctcctgcacaggggtccccaaacctttccccaactgccacactccatctggctgcagcagcagccatccagggagtgctcgtcctctctgagacctgcctggctctcatgcttgcttccattcaagttggatgccccacccctgggaacagccctgacttcatgtcccctacagcctaagcaccgttcattcactagactggtagtctccaaagtatagtatacaccattattgagcataggaggaaaataccagggctactatttctacttatcacatccttctgcaaattcctaatttatatgtgtatgtgttagtatgtacaaaatatatcatatagtaatgctggagtacgttctcaaaaatacttttactggaagagtatgcaattaataaagtttggagattgtgttagtggaggtaaaatacacagaatgacgataactacaatttggtgtttggtgacaaatgtcacaatagaggtgaaggttaaatgctgtgaaagttcaagaaaggatgtaattgctactaactaaagtgcaggagaagaatcagtgaagacttcatcagaggattgagtttggggctgaatcttaaaagataggatgtggccatgtggccatgggaaggaagggctctcccagcagaggtcatcacataagcaaaagcacagggctggagagcagacaagcacaggacagatgcggggcccagagccctggtgtcccagctatagatgggaaaagcagtcggatatgagatgggaagggtgggttggggacaaatgatagagaagggactctgaataccccagggatgtgtggggaatgtgcacaaaactgaaaaaaaatgaggggagccaatgaggattgcttaggagggaagagacatggcccaactgtgtttggagacttttaatctaggaggggagtgtaagattggaaaatggaaggtgaccatcatagcccaggcaggagggcctgaaatcaatcagaaaagaaagggaaagaaggaggcaggtgtaagaaacatcgtaggagcggatttaactgagtgccttcactgatgggacaaggtgcgggtggggggcatgaggacaggagaagcgaaagataagtcaaccttcaatgctcagtgaccagagggacagctgcagagggaaacctgcaaggaaagttcaggttgtgaggtctgtctccattgtctagaagtgacaattaaaggataagagtctgggtggttggttgattttacaaaaaagatgaattcgccaagggctaaacctgtctgcacttttgatggaaacaggtctttatcttcatttgacaaacatttttgcatccctcctacggggaaggcatcatgccaggcactgggaatgtagagaggaaccagaaatactgcccctgtcctcaggggccctcagtagagaagggaaactaccacacaaagaagtttttgacaatccgtcagctgagtgctccaacaagaggccagaggagggttcatggcagtgacgctctccctggctcggcagccagagccatctcctgagaggaattccaacctttcttcacaactcagggccatcatcacaggtgggggtggcatgggatagatgctaggtgcccatcaccttgcatttttagagaaaactgtcatgtcaactgtgtcaccctttaccaagcaagccaacctcagagtgcacagcaccatgaatttggatcttgcaatctcttttattcttgcctcttgagcttctttgacctccctttatttttggatttagggggctcccagaaatttggtggagaggagagctctagatttctgagtgtactttggcttattttaattaattaacgttttccctcctggccccatcagccttgttcctttttcagacttcctcatctccccagctatttataaacccctgttcccttggcctatgactttgttcctttctcactgttgaatattcatgctgtaaggtctccccagagagggaggtccccattatctacccaggctcgtctgatgttgtttaaccccgatgtgtcctgaaacttggcagagtagaaacagcacaagctctcaagtcagccagatgtcaacatctggctcctcccctgttgtttgagtgtctttgggcaggtctccaaggatcagcatccttaagaataggatggttcaccatactgttccctctttgtttggaagttaacctttagtgttgatttattttgtatttgagtctcaaatactgtattggtaaatttaaggaaagaagaaaacagaaattagcctgtaagctgtaagccttagaccttctaagcaaggtctaccctatatattatcacaccaccttcccaatcccctggtacaacacttggcatacagtaggtgctcaataatgtcaccccctccatctttcctatcccattgactttccccccacctgtttgatggttttcatggggtccatatgtcacagaatgtccctgccctcaggcagtagggacttcatgttgtggcctctctttgcggggagcacccctgtctggggtgtgcctgctccttctttctctccagctgtctctctgagcctgccctggcccacgctggctgacatacacctcctgcactgataactatttgctgctgcacttgcccctagctgggcttggccgctgctgcagagggccatcctctgcctcacatcctctgatgagtcctgggcaggttcaggtgggccctgggcctgagccatggtatgtactctctggctgcagccccaccagaaaaatactcactgtctgaagaccagcacctggaggctctggagttagtgcagtgctttcaactgggggtgtcttgcttcctctgattcccaggggatatctggcaatgtctggaaacatttttggttttcacaactagaggttactactggcatctagtgggtaaaggccagggatgttgttaactatcatacaaggcacaggacagccaccccacatcaaagaattattcagccaaaaatgtcaatagtgctgagatttaaaagctttgggcagtgtcattaaacataacaatacctgccattaattgagcacttgctgtgtgtcagaggctgtgctaagtactttacatgcactttctcatttaatcctcaccaccacggtatgagacaggcagtgccattttcccattgtacaaatgaggaaatagagagactgaaggtgaactcacttgcacaatgatgcacagctaatcaatggtgtaggcagggtttgctcttgtgtgccgctgggcacatctggacagcacctgcatcaccaactccctctctgctgtgttggctcagtccagtgggcagtgcatctactttggttttcctgatgagcactccattctccactaggcttggagtctggccagatccacttaatggactccaacatacctccaaacactctcagccttgtggaagccatgtcaagaatgaacagtctcttggaagtgtcacagagctccccatctgtctggcctccttcctgctgctaagcagtgccccaaccaaccccgcaggaggaaagactccccaaaattgtcctacccaatggatactctacaccaacccgcactagactacagctttggcagctggctgagatcccagccacagttccactcagccccagatcccacttcctctgccccatctgggtcctgtgtggtccacaatggttcttactcaggtcctgaacctctcatcttctgtctgacacccacatctcatcaaatgcatcatctgggcatccttatgcaccctgattccatctcctatttggactcctccctctgggccccaagattccttccacattttatactcagttccactcaaattctgccaagctttcactaggaaggaagcactgtgctggggattaaagaggacacagaatcaaagcagatacagctcccccaaccgctagagctctggtttcatggcgggagtgaattttccacaatgggatcacagtaaggtaggctcccctcctttagggacatgcacagaggcagaggtgtggttgacctgtgagcagctgaggcttcccagaggaggcaacactgggaagaatgagggtgtgggccccaccagttctgatactggagagttccagggtccttctgcagccctgcctttgtcctgagggcctggctgtcacctggctctgtatcaggactcatggaatcttagcctgcatttttgctgtgcttcccagagctgaaggactctcccttccaaatacccgcgaacaagcacactgcttgacctgcttctccctcactcagttcatgcagttgacttatctgcatatagtgcctgttttatgtcaggaacccagcagcagctggagtcacagattctctgagctggcagggcttttgttcatctggcccaaacttgtccatccttagtacagtttctttccactggatcgtgtttgtcaggaaatgaacaagaagcctcaggctgagtttgctcaggattcatttttacctcgttcttcctagttctgcatttgttccttataacaatccttcatgctcatgaagccatgatggattgtagatgtagatggcagacatcattcattgtcatttacagatgaagaaacggaggccaaaacactaaaagcactgcattccaggcctagctctgtggctggctgctctttcccctcaagctgacaccatctgtattagttcattttcacgctgctgatagacataactgagactcggaagaaaaagaggtttaatggacttacagttccacatgactagggaggcctcacaatcatggcagaaggcaaggaggtgcaaatcacatcttacatggatgacagcggacaaggagagaaagcttgtatggggaactcctctttttaaaaccatcagatctcatgagacttattcactatcgcaagaagagcaggagaaagacctgaccccgtgattcaattacctcccaccaggttcctcccatgacacatgggaattgtgggaattataattcaagatgatatttgggtggggacacagccgaaccatatctccatctaaggtaagcttcttttggagacccagttagatagttctaccaatctgtaaatttgtggaattataaaaaggtgctggaattgatcttagcagtacagcagctagctcctttgacgtatatagacccttgttaaccagcttcccttgttggggtgtgaaacccccttcgtggggataagaggaactcttctcgcaggctgggaggaaatctaccagtccagaagaggaactgccttcacctcctctacactgaggagttgctgcttctggtcattcacagagaggaagctgagggttttttgcctatgctattccaaatttaatgtaaatatttcactgcaagtctaaaacccgccctgttggctttgcttggcctaaccagaagtatttcagtgcaatctgatctctgagctcagggctgttcctcaggacctcaggccgcatccggcaggtctccccacaaggcttccattccaacccttacagaaaagagtggccttgtgatattatgaagcctgccaatctcatgtcccttgtgctgcagaagcacttggccagcgtgttgcaatgcaagcgctttctgatcaatatctgttagcatcatggccctaagcagctaaaaatcacacaccaaatggttcccttttgtagcaagaatcatttcatttgctccttgactttcaggtaccttggacactaaaacaacagtgtatcaaaagccagccacagaaatcagcctttacacttgcaaagcattgtccactttccaaagcacgtgcacctccctcagcccatctggccaaccctacggggggttagtgactcagggttactgctacattaagcaaagggtcatgtagtatacaatcaaaaagtaacttcacttttatctccccctgtcccactaaatgtgtccagaagagctggctgttctctgccctttggaagaaatctagggcacatcccatgatgttttccatccctctttaggtaattaaaagtcttctaggaaccaagattccttagagaaagcactgattctaaggctagggctcagaaaatacaagaccagcctggagaaacttgtagtgccagaaaataagaaagaagtaaaaaaagaagttaagaaggaagaaaggaacaaaggaaggaagtaaaaaggataaaacctctaacctgaaaaagcttccaatgatcaaaacatccaatgactgatattccaaaggtagaacaatttgagtaacaaaataaacaacaatagcattgtattatgactcaaagaataaaaatctttgggtcaatactaatgtaaataatgtattgaataaataaataaatggataaatggggagaagggacaactctttcttacaaaagaattctaagtaataaatgaaaaattgaggaaagtagaaaaatcactcttagaataccacagtaaaaatggcagcaggcaagattcactgataaatgctaaaattgttttttgtttgtttgtttgtttgttttttgagacagagtctccctctgttgcccaggctggagtgcagtggcacgatcttggctcactgcaagctctgcctcccgggttcacaccattctcctgcctcagcctcctgagtagctgggactacaggcgcccaccaccacgcccggctaatttttttttttgtatttttagtagagatggggtttcaccatgttagccaggatggtctcgatctcctgaccttgtgatctgcccacctcggcctcccaaagtgctgggattacagatgaatgctaaaattaaaaggtaaagctttaaggagaaacaggatatctgcatagcctcaacgtatctcccccagaatattttctaatgactgtggtagttttaacacgtgtccgaaaatgatttgatattcctccctgcagcaggtggagcttcgttcccctgcttgagcatgggccggatgtattgactggcttctaatgacagattatggagaggggacaatagtgacttcgcaatgaacccggcagataccaccttagccaagtgattaacataatgagcaataaatattattgttgtcatgcgccccccaatataatgcaatgagaaggggacagcacttctaccatattttccctcaaagtccataacctcagtctgctcataagaaaacattacgcaaacccaaggtgaggaatgaacattctatagtatgcccgatcagtatgttccaaaagtgtcaaggtcatgaaaagacaagaaaagactaactgtcacagaatgcaggacactaaggaggtatgacccccacccccaaatgcaatgtgcaatcctggattggatcctgttccgggatgctgttgtgctaatgttaatttcttagttctgacacacctaccacagtagctttgtaagatggctacattaggggagacagggtgaaaggtacaccagaactctctagagcatgcattgtcaacggggcatttctcccccaaggggagaaaattgtctgttgggtagaaaaaaaaaatcacaatggtttgtggccctctaaagggccacagtacataaatagatatccagcatatctgtgggactaaaattttatgggagaaaaatcatagaaataaacacctaaacagactcctggggtgggagtggagcaatgatgaaaataaaattggttgagaaatcctgctctagaggtaccatctttgcacctcccttataaatagaagattatttcaaaaaataatttcaattgctgtttctaaaagttggtctgtgaagaccttacctccccacctccccccacccccaaaaaattaatttactaaaaaataatcctctggtcacttgtacctgtaaaacagtttcaatttagtaattaataaggctgacctggagtaataataataggagaaaagaagttaaactttagccaaattaaagcttctctcctccggagctcaggcctgcctcaagctggcccctgcaatgggaaagcagtttaggttgacctcttctctcctctcctccctgccccgcgtgtctacccctccttgctgggctgccgctggctgctttgtggttttggcaggaggggctggaaggggtaaggaagcaggaggagttggatttgactgttgctctcaggaactgacagtactctcggggcttggcaggtttttttgttttgttttgttttttgagatggagtctcactctgtcgcccaggctggagtgcagtggtgtaatcttggctcactgcaacctctgcctcccaggttcaagcgattctcctcagtctcccaagtagctggaactacaagcacatgccaccatgcccggctaatttttttgtatttttagtagagatggggtttcaccgtgttagccaggctggtctcaaattcctgatctcgtgatccgcccgccttggcctccaaaagtgctgggattacaggcgtgagccaccgcacccagtccctggcaggttcttaagctgactctccctctcttgggtccagtttgggtttttcagagactcccacttgccacgagcggcctctacctgcagctgctgccgcgagtgatgccacctcaagtaggccatgcttgacctcctggttctagtggtcactcttaccagaagccactaaaaaggcacccagggttgtgcattcactctttgcaccaggattcctctatacaccaggaaatctacacttgggcatgaacagggccacattcagtcccatttgccgtcaacaccttccatcttctaatcatgtggaatcctgctgagaggagaacgagagctgggatgaactaatctcttcatggctttttggggacatgagatgtgccctccttcctggtgcatgacaggcacatttccacacaggttaagccagctgcaggtgggttttctggcacttgcagccaaatgcatcagagctctcaaagctaatactatgatgcacgggagaggtggcagggaaaggaacaaagaacaacagaagagggaaggaggtggcagccatcagaagctaacagtgaagaaaaaggtggaagaagccatcggcatggtttcagcagacccgatgtggagatcagtgacaacagagaacaaacaaagaataaaatagggccaggcacggtggctcatgcctgtaatcccagcactttgggaggccgaggtaggtggatcacttgaggtcaggcgttcaagaccagcctggccaacatggcaaaaccccatctctactaaaaatacaaaaattacccgggtgtggtggcaggtgcctataatcccagctactcaggaggctgaggtaggagaatcgcttgaacctgggacaggttgcagtgagccgagatagtgccactgcactccaaccggggtgacagagtgagactctgtatcaaaaaaataaataaataaataaaataggacccatttgtgtacttactgtctaccaggcactgttctgaacactgtatgtgcactgcatatgccccacagattgacccattttatggagtttacaggaaacaggttcatggaatcagtaagtggcagggctaggacccaaacaatatgatcaagttcagatgtagattcaggaaacacctactggtcagccagatgctgtgctgggtgcttccctcacaaggccccatttcatctaaatgccagctttggaaggtgtggactatttactgcattccacaggtagagaaactggagcacacaagagtgaagtcacttgccaagtgactggtggaactaagcccagaactcaggtcttgtgattcgcagttcaatattctctctgctgggcaaggctgcctttcctcatctgcaggaatgtgaataaaaacatcacacagggatggcgttcagtagggatgtgctgaaatgactgtactggttgtgaaagtgctgaaatgcctctgtaccacttggtaatcagccaccgctctgagcatcctcaaacgctgccctggctccttcttcccagacaccctcccggaatccagtatctaaagaattttaactgaggcctccaagatgctgttttggtgctctggcacacatccacttcagccaattggtaaatgcttggaatgtcatctctaacaaccatctattcctctggtgcttcattccttcctaagcactcttgtactgttacctcctctgatgtgcacagatgagaaagctgaggcccagagaaagtaaaaactgcccgaggttgcctggtgatgctgagttgagctaggcttaagccaaagtcatctgacttctggttaagggctgtctccattctccagcttttagtcagttaaatagaaaattttatactaggtagagttaagaattctaaaatagataaaattagaacatgtcacagatgaaggacaagtctttgtgaatgagatttgtcaattaaagacaaaatcaatgctactggcaaagattcagtaggcctgagttaaatgtaacactcttgcccattgtcatgtgacctgcctgagcatcctaggagcagatgcttctggctttggacttgaccatatgacactttccaatgagatgagaggggatgtgctgtgtgctgggtctgaggcaaagctgtttctagtgattgtgaggttcaggacagtcactcctgcacctgcctctgcaacaagagaacagcgtgtctcgggtttggctgcaccttctgccaaggtccctgaataggaaggcatacggggccttcagagcccagagatgccaccatcctcacatcatgtgagtaagaaaatacatgtttattttcataagttattaacatagtgggttgttttttctatagcacaagctgactgatgcactgggaagaaagaatgctttgaaaatttgaagaataaaaatgatttgagtttaaagtgttaaaggactctagcttctaattaaacatcattttgtgagaaagaattcaggcacataatgggcaagtacttagaagatatttcgattttccagaaatacttttacatacacatatttcagaaaggcttgtaatcaataaatcctgggccatacatattatggaactcctagggctatctgtgcagattactcagaaatagaaaataaatcacatctttcccaataaaaggagttgctcaattcacaggatgattaaataatacattttagagtaagatgagatcttaggatcactgcttctaattaaagtcatgtgtgaattttcacttaagttttcacaagcatcttttattttatttatttatttatttatttatttatttatttattttttgagactgggcctcactctgtcactaggctggagtgcagtggcatgaccttggctcactgcagcctcgatctcctggactcaagtgatcctcccacctcagcttcctaagtagctgggactacaggcatgtgccaccacaactggctaattttttctttttgtattttttgttgagatggggtttcacgatgttgcccaggctggtcttgaaatcctgggctcaagcaatcctccctcctcggtctcccaaagtgctggaattacaggcgtgacccaccgcacccagccacaagtatccttatttactatttttggtaaactgaatagccacatcacattctgttttctggtgttgaaacatgaatattttgaaacaaactccctccctccctccatccattcgtccatcatattctggatacaagacaaacatcaaaagtctctcctcttagtctttgtggaagaagacatttctgcggagcatataaatttgaatggcaatatactcccttaagagggacttcagacactatgctgttctttctagcagagctgttggcttcagaatctaaacaaaactcctgagttgccaaaaacagccttgcattcttctttcagatcacctcaaggctctaagaggatggaaggagtgttttttgtttgtttgtttgtgtttttgtttttttgtttttttgagatggagtcttactctgtcgcccaggctggagtgcagtggcgcgatctcggctcactgcaacctccacctcctgggttcaaacgattctcctgcctcagcctcccaagtagctgggactacaggtgctcaccaccatgcctggctaattttttatttttagtagagatggggtttcaccatgttggccaggctggtcttaaactcctgatcctcatgtggtccacctcccaaagtgcagggattacaggcatgagccaccgcacccagccagaaggagtggttttgatacctgagcttccaacatggagagtccatgatttcatggattcactgtatggcaaaataagctcctgacatcacacccacaaaaaggccagcatcctactctgcagacaacccaacagcccagcattctgcctagtcagttatgtgcagttacatgtggacacagttatgtgcctccacatccatttttatgtgtccactgtcagtgaagaatagatcacagaagatccactgcaaggggaaatctataaagatttgggtttcctgcagctgaaataacaataataaaagggatgagctccttggcatttaaacaaagccctcagtcagaacgtgaacaaaaggaaagaggctgccaagcaggccctgcccgtgcagtccataaaagaaaatcttgtggaccctagagtttacaaaggcaagaaacctgttcttctcattgatgactgggcccagaacttaaacactggccacatgtccatgaagaaaaaagaaagagccttctcttgagacaggtttgaattcagaggcagagacgttccctgagcatgccctctgtgccaggcaccactggccttgtccacgcttgagccagtgttttgggcagtggggtgtgtgcatatgctctgggggcagggtcaggctgactgggtccttgagataatctctttccaccagtggccgtgggacatctcggtctgtctttgggtctgtctgcttatgaaaggtggccctttgtccttatgcaggtgaagatgaggctgcagaccagcctgtgacacccattcaggtgggtgttggcttttagccccccacttcactttacctggatttcttggttttacgatatagtcttcaggggtgggggtatgaggtcatagctgttgtctgctttcagcaaagaaggtgtttccctctccatttctgactcttgttcattctggaggcttcagagaaggaagttctgaaaacaggcactctctctgccatctttctggaaaccccttcagctgcttcaaaatatttagggaacacctgctattcctccctcccttcactcttacagcagatcttcactgtgagtgtagtgggtgacaggcagggaactaagctctttctctgagctcccatgacagctctgggagggaccagggaggagaggttaagcaacctgcccagagccacagacatgagcagttacactggacttcagcccaggacttggactcctggttcaggttctcttcccctgggttactccccgagtcaacaggagggccgtgggagaaaagaggtcctggcttcagctgggcagcctagggtgctggtcgcctgccaacctgggtgcagagcctgatctggggctctcccagaggctctccttggctggcaagcaggaagctccaaatgctgggctgcagcccagagggaaaggaaaggggcttctctatgcttctgattgtccccgtgactacccaggaacaaagcggggactcacactgcctcctgccaccagcctccacccagctgttccggccacgcagccccatctcttcagcctgtctgcaggaacactgggcatttgtcagctttcagaatcacggctgtgtgcccagggctctcttgaccctccagctccaggcctcatggggcagaccaacagaggcacaggccctctttcaaacccccaaacccaccacccagtgaagccaagtccctggtccacggtatttaactattatatagcctaacaccccactggggaggttcacaccctgatctgattaagctaaaactgcatataacagttcacatgcattcgctttccgtgtgtgcagaggaaagagctttgggttaaaagtcaaggcagttcatcggttagacctcaccaagcctgtcatcatctctcaaatgggaacagtagctgccaattctaaaagcaaacatctgctgggggcttcttagtatcaggcgctttcctacatcccacgtgtgtcatgcatttaatccgcacagtagtccacccagctccttgccctctgggaagagcgcagatgttgctaatggaatcttggtaaaaggtatcatgtggccccagaatagtggtatgcatcagattaccgcgtgcttcacgcatggtgtggtggagcttgcaacgtcacactttcaacaaatctattcaatcggcgggggttcttggcagcaactatgtgccagtcactgtgcacaaccaaccaaatccctgtcctcctgggggtgttgttctggtaaacacagcaaaggctcaaagacagcagatgatgccattagttgcacgcacttcattgaccgaaaagttgattttctccttatcttcggtaatgaacgaaggaagaggggacaagcagagggggtgcttgtcatttcctggcgtttgagtggatggcatctgctctgccccagcagtacaaggtacctcctgagtggccccatttgacaaggcaagagagtagaacttgcttttctcttgtagtagtgcagaaactcagtgtcccagtgtagttcaggtggctctccaggccctggtggtagggttcctgacactcaccatgagcctgcccggcttggcatatcacagtcctctggctaccacgggtccctgataagagcacctgaaatgacattgaatacctgggagtgcagctgggactcactggtccccaggtacaggctcagccttgccccaggctcagggatccaatcttgttgctggagggcggggcaggtcagcctgacagttgatcccgttctgacatagttttaggggctgagctctcgcttcattcatttattccctctgtaaataatgtttattgggcaggactatgagccaggtactgtcctggtggctgagaaaatcccagggagtaaaacaggccaatctctgtcctcctgggagcttatgtgctagaggggaggtgaattaatatgtatcatctggcagtaagtggtaagaagaaaatacaacagggtaaggagatggagcatgatgaggggtctatgttacatcgggtggtacggaagatctctggaagaaggagatatctgggcagagataggaagggtgagagggagaaagccaggcatgtatctgagggaagagcatcacaggtggaggaaacagcatatgcatatggcctggaggcaggaacgctgagagaccagtgtggctgaagggcctactccatacctcataccttcatgccagcagctgggcccatcagttcctcctgcatctttgggcctgggcctcagcttgctgcttcctgccctccaacccaagatggtgcccacctgcctggatcacttgccttcctcccaccccctcctgctgtcccccaaccaggtgcatctctctgttctccacctctgcacgctctccttgcaccaatgagaggtgtctgcagtggagtggttaaagtgctgggctttggagtcaggctgcctgggtggatcccaactctgccattccctacttggggaagcctgggtaaactgctcttggtgactcagttttctcaactggaaatgaggatatgatagtgcctatcacaggggctattgtgagattaaatgagttacatgtgcaaagcacatatggaatagtactcagcaaatattcatgaaaaaatattaaggtgacagaagccccttctttttcttttcttttcttttgagacggagtctccctctgttgcccagcaggcgggagtgcagtggcacgatttttgctcattgcaacctccacctccagggttcaagcgattctcctacttcggcctcccgaatagctgggattacaagcataaaccattatgcctggctaatttttgtattttttagtagagatagggttttgccatattggccaggctggtctcaacctcctgacctcaaatgacctgtccaccttggcctcccaaagtgctgggattaaaggcgtgtgccaccgtacctggccagaagcccctccttaccaggaagggtgaccagaattgggtgcttgctgcatggggagaaagtggaaagggcacaggctttggggtcagacagatgccgatgtgcaccccagctgtgtgttcttgggcaactaacttagtctctctaaacctcatttccctcacttccacaaggagatcatgatctgtcccccacagggtttgaaaaagggtaaattaaatgacaatgacaaatcacggagagattggcccaggacaggcagcttcactgatgggaagaaccaaccttgctagggacgaggttgcagatcaatgatcagggaggagagaaccaaagtggagagacaaaaagactggggagcagacgctcagggtctcaaagtgggggccaaggtgggccacagccagttcatgttgtgcagaggcccaccgcagtgaggggagagctgggccagtcgtgggatttgtggggcgtgggggtggggccttggccactctgccaaggctgggggcaggggtgtcaagtgccaaagggagcaccaggtgctgaaagccagtgccaaggggtagtgaagaaaagagagtcaggacacccatggccaaatccagacaagtcagacctgagccaggtgagtgctgagccagagcagggcagggcaaggattgttctgaggctgagttggttgtgctggtttattctggggatgctccttgcctgtcttaaagtggccatggtcagggcccacctcctaaacctgcagattggagcaggccccttgacatccctgcaggaggctctggggaaaggataaggcaggaccttcctgccccacagaggtcaaaccagtgaatagacacaaatgcaggaccgaactggaggtgccagctgacccaagggaggcaaagctgcttctgtctggggctcgggagtctgaacagcccagatcagcaaccaggtcaaatctcacaaacatgcacctaggggcttctggtgagcaaggaggaaggctatgctaagccaggcatggaaggtagtgcaggcctgattcctgagacaagaacaggaatgacctccccagaggccaccaagacaagcatttgagaaagaaaagaatgctactgacttagctccactgacatttgaatgaagagcaggagtaacaaaaacagagaattttaattacaagttcttgttcccccattgttcgtgattttgttaacgtctctagatctcccagtggtaattggcaataaaatctcttaaaacaaacagggttgtgcagtaagtggagaaatttcatttggttttatagctggctgaccagaggaatgagaaggccgtgtgcatttgggtggattgagcacctctttgagcttgtcttcccttttgagtaaaatccatgcttggaccagaccatgcctgaaggggtccctatcttaccagtgtacacaaccaggtggggaaagttatcattgtgacaatgtacaatgctgtccatgttagaagcctcagagtcactcccagctcctccctcctgctcattccacactaaaccctaaatgccatttcttaatgatctccttacccagctccataattgctgctgaaatgaaataagtccatcacatccaaatggctcctgggtcctgtctattctacttcctaaagggctcttgaaatggctgcctcttttctagccaactgccatagttcagacgctctttctcactagactgaggcaacaatctccctctggccttctagctggagtctttctcacttgaagaccatcttccatatggccacagaaggagctcttctgccttctaaaggctcctgaaaaccctaccatggtttcccagggtcaatgggatagagaaaggtgttctggctcttaatgatgggccccatatccactgctcctcaatacgcctccttgactgtagccaggcctagctacttgcaggcttggaagaaaccaagattttcttgcctctgagcatttgcacatgttatttcttttgctgccatgtccttctgtcacttgtcgctcttcaagtctcagctctcctgtcacctcctgctgttctaaggtgtctctcctctgctcccaggtgatctctatgcattataaggagtcagccttccacccataccagaaacccctcaaaagcaaagaatgttctaggcactgggaaatgcccaggatggagaagagtgtgacacaatagtcaaaaggcaagaacaacccaggcgtccaacctttgatggatgaatcgttcaaccaaatgtggcatggatatatgcacactccagatagcactcaaccttgaaaaggaaggaacttctgacatgtgctacaacatgtgtgaatcttgaagatattatgttaagagaaatacgccagtcacaaaagaaggacaaatactgtataactccacttatgtgaggtacctagagtagtcaaattcatagagacagagagcagaatggtgattgccaggggctgtgggcagaagggaaagggaatcactgtttcatgggtacagggtttcagtttggagaggcaaaataagttctggagctggagggtggtgatggtcacataatgatgtgaatatgccactgtaatgtatgcttaaaaatggctaaatggggccgggcatggtggcttacacctgtaatcccagcactttcggaagccaaggcgggtggatcacgaggtcaggagttcaagacaagcctggccaacatggtgaaaccctgtctctactaaaaatacaaaaattagctgggcgtggtggtgggcacctgtaatcccagctattcgggaggctgaggcaggagaatcacttgaaccggggaggtggagattgcagtgagctgagaccaagccattgcactccagcctgggcaacagagcaagactccatctcaaaaaaaaaaaaaaaaggctaaatagtaacattttaatgcataccacaattttacaaaaagaaaagtgactacagaggagtttaagaccacaatataatgaatgaatgaaggaggagttaagcaaggaaaatcttaggagatgatgtgaccaggtcagaacggaggagcctggaggctggggtgggggccacaacacctcactccccccacactccctgtcaatgtcactccttttcagatcagcagcggggcttcagggtgccagggctgtggttttcaaacctggaaaccaaaccaggttccagggctcctgggttcctcccaaaacaaaaggaatctttggggatgcagctgactctggtgggtgtttgtcctcagggcccctgctaagttctcctgggaaccgagtacagagtcaccaatgggacagaatcacaggagaaaaggagaaacatggtaagcccttggcagaagctggcacggactagattgttgtcgggtgtgggtgttggggccaggaggagcagtgagaagccacaggaggaaggctggcagagaggattcattccgtattcattcccctagtgagccacacgcttcggaaggatcacattaaagagatgaatcacacactgactcaaagagagggggtggcacggttgtaaatcagaggaatggcttttatttgtcagaatgctacaataaataacctctccgtgtgccacttaacaaaaggagagtgggagggagggaagcaatgtggcataggccggagggctcgcagggtgatgggagggatgcgggcaacctcacagctaccagggcccttcaggacactcttgccagtcactagatactctgtgctccttcacacacacacagagacacacacactcgcatagatcatctttccctcaaactttctgagagcaccagctttattttatacatacaggagatgtcttgctggagatgacattcgtgggtattactttttcagaatgaaggggccagaaaatcacccagggcccctcgagggctgaaccccgctcagaaagggagaaaggtaaggctgctccctagaatcaatgaagttgctgttctggcaatggtctgttaggacaagtggtcatgcagcaaaatcatggaaggaaactcttccaaaaagggtgcagcagggtggcggtattatctattgtccattttcttggggtggatttagaatcagacttcttgggtcgccaggagtaaaagtaaaacgctttaaaagtaaaaagctgcctggctctgcagggagtaggtagggaagaaggatgggaattctgggtttgcagaggggcagacaggcacatgacaatcaggcaggagggaggcagctgtgcttccagggagagcagggttcctgggggaagcccagggtcccacctcccctgccctagagcagggctacaggatatggaagccactagccacttgtggctattgaaatgtggctaggccatattgtaaggtttaagcacatactttatttttaacatgtagtatgaaaaaataaagaatgtaaaatctgttattaatttttttaatattggctacatgttgaaataaccttttggatatgttgtgttaaagaaaataagctattaaaattagtttcaactgtttctctttgcttttttaaatgtggctaccagaacatttaaaatcacacgtgtggttcacatttgtggcttgcattatatttctactggacagcattgctccagaggagtcctgggacccagaacagggagagcaattgctcttgacttgctgcttttatacctaggtgagtggggagcttacacttatgcactcagggatattttgggatacaggagcaacaccccaaactgtgaggggctggggcaggcaagctggttacacaccccatgggacggaggctggagagtttccatgacttactcaagtaaattaaggagaagagcttggcctagaatcaagccttgtaaattctattgtagtcttcttacaaccacatctccgtttacatagaaaaatgctcttttgtaattattagccacaaaacaggtttctggtgagaatgtaagtttttacatttttttttctggcagataatttacaaatttttatcaaaaccatataacctaaataaaactggacctaaatgcctgtctccacatggagatacacccaaaagaaacacaaatccagttccccaaagttttgaaaaatactgttaattgttgactgagatcccccaagagggcagcaaagggaaactgtcctgcacaagtcacggaaaatcttctaaaaggtctttagacatagttctctcttttacagaagctgctcaaatcactctctttcccctcctcaaacctgccctgacttccttctttagttccctctctcctctctggccaagctcttctgagcccctcttctctctgggatctgttctcttttctcttatttccatacctccaaggcccttctgtatgagaaaagttgttttcagttttcctctctgcccatcatctgatcagtcccaagaaatcctaaaaccaactgagtaggcagagaatggggagggttgcatcggaattttacatacttcgagcaaataaatccacttacagggatttaggatggatcaaaggagcaacagaccaaaaatttacatacaaagatacttatcatagtattatttaacataacgaaaaaactagaaatgacctcaacatttgacaaggaatagtggttaaataaattctgacaactctataaaatggaatattgagaagtcactaaaatgtctggctttgaaaatatttattggtgtgagaaattatccatgataatattaaatgagacgaaaccaagaatataaagctgtatacaaattttgatgctaatttcctctcaatttatatatgaacatagaaaaattcttctctgggctgggtgcactagctcacgcctgtaatcccagcactttgggagaccaaggtgggtggatcacctgaggtcaggagttcaagaccagcctggccaacacggtgaaatcccatctctactaaaaatacaaaattagctgggcatggtggcaggtgcctgtaatcccagttactcaggaggctgaggaagaagaatcgcttcaacccgggaggcagggaggttgcagcgagccaagaccgtgccattgcactccagcctgggcaacaagagtgaaactctgtctcaaaaaaaaaattaggttactaaaccccacctcataagggtgttgggagatgtagtgagggaaaaaaagacagcatgcgagaggtggcactgcatgcagagtcacagccggctgcctgggcatggatcctggctcagcttacactgtggtcctaggcaggtcacctggccccacattgcctcaatgttctcatctaaaaaatgggaacattaatgatacttgcatccaccctaatacaggcttgttgacgatgacaggagtcaacagaggtgaagcatgtgaaaaatgcctggcacacaccaggcactcagtagagatgagtttcttgtcttgtgatctttctagagggcctttcttaccctatcctctgctcagggcctgccccacttctcagcctagccctgaggctgctcatctcttcctcatcacttctgattttacagtccattactggttggctgccattactctagactaagagtctgcaaactacagcccacaagccaaatctgagatgctgcctgtttctgtaaataaagttttatggcaacgcagatacacccattcatttatgtactgtccctggctgcttcagccctacagcggctgcattaagtagttgtgagactgtatagccagcaaagcctgaaatatttactactacctggtctcttaccaggaaagcttgccgacccctgttctaggccaacactgtccaaaaaatgtataatataagctacacatgtaattttctttctttttttttttttttgagatggggtctcactctgttgcacaagctggagtacagtggcaggatctcggttcactgcaacctcctcctcccaggtccaagcgattcttgtgcctcagactccccggtagctaggattacaggtgcgcaccaccacgtccagctaatttttgtatttttagtagacacggagtttcaccatattggccaggatggtctcaaactcctgacctcaagtgatccgcccacctcagccttccaaagtgctgggatgacaggggtgagctaccacacccggcctacatatgtaatttcctagtagcaacattaaaaaaggaaaaagatacaggtgaaaataatttttatatttcctttaactcaatattccaaaatgctatcattttattgagtaataaccataaaaaactatgaatgaggtaccaaaataatgcccgtgtctgatgcatgcactacgccgcaacagtatctgacaggatgcaaaggtgaaagtgaactgcagtacttcccaaacagtgcaactgtctgtaatggaaacatattcctcactgctttagcttttaaatgtaaatgtaaatgaaaactaaaagttcagttcctcagttgtaccagttacatttccagtgactaccatactggacaatgccgatctgggcataccccctccctacgtatacttacgccccttccatgcacacagcagatgagttttcacatggcttcattgacatgcaaagtgattttctcttttccttttctttctttcttttttttttttttttttaatgggattttgctctgttgcccaggctggagtgcagtggcatgatcatagctcactgcagcctcaaactcctgagctccagcgatcctcccaaatcgctgggactacaggtgtgcagcaccatgcccagctaattaaaaaaatttttttttttttttgtagagaaaaaatagagaaaactatgttgcctaggctggtctcagacttctgggctcaagcgatcctcttgcctcaacctactaagatgctacaattacaggcgtaagcctctgcccccagcctacaaggtaattttcaagggggagggaattttaggtgaggaatgggggcagagatagtgaaagaaatatgtggggaggggggtgtggatgtccccaggttcccctggtgggttctgagcccctggggagagagaagtcagagacagaagccaagggaactcctcaaagggatttaatgtgactttgggctcaagcaaagctgctctggggctcaggtgacccggtgccaccctctgtctacccagcctcccacctctgtccagagtcagaactgccctgggcctgaggactggaggcttcagactatccagacaacccaccgcaaggagtggccaccccccgacagtgaggacaggagcgcagcgtctcccagcagcttccagggcagcaatgtgcctcagtgtgaggcagtgcaggaacgcaggaggggagcagacacccatggtccctgcggctaatggtcctgtttgtgggcatctgtaagaccgcttagaggactcctcagaatcactaggagccagtctgggctgcatccagatgagcataggctcagagaggcgaagtggccacccaagaccactcagccaatgacccctagtagaaggtcagcagccaggagccccagggaaggaaggagagagaggcctgagcaggagagagagctcaggctattctccctcccagccgggatcaaagcaccctggagtctgctctctgatgcactctgggacccgggcaagcccatttgctacagagcagcacaggttaggcacaggcatcctgctagcagtcctgggacatggtccaggtaatcagtgccctggcctgtggatttctccatattgtatctcatccaggagagcaaaatttgaagaaagctgggaatggtaaatccttctgctaggaatgaatgcttaatggaataaggaaaactccaaataagtgcccaggaacatccccgtggaaaggaggggtcatgtcagccagctccaagaccttctcaactcattcctccttctcaacttgcttggtagctgagcccagctttcttccctctgaggccaaatcctacatcctctgccacccctgtatcctttctatctgtggttcttcccagctccatggaacgtgagagcgaaagcctgcagccatctcgccccctggctcctcgtccctctaggtacccagtgagtcaggacaaccctgtgctctcctcacctgctcctcacagcagctgcaggcaccctccttggacaccgctgtcttccctggaccaaggtcatggctggtctgttcatctcacagctcatatgaccacacctgcagcagcggaggtaggtgtagaattgtggcacctcagatggagccaaagtggggagcacttacctaaaacaagactgttttaggtggatgtagccatatgattgtgggcatgttatgtaaccacttcatgcttcagtttcctcatctgtaaaatggggataataaagcatctgcctcacaaagtgactgaggaggggaaatgagttcatatgcgtacaaggcatgagttcaacgtttgtgagctaccattgtcatgaaaaccaattttagcattttatttgcagctgtgagtttattttacacttgatcttagccagaatgctaagaagtgatggttatgagtttattttaatatgacctacagaaaatttaaaatgacctacggaaaattacaatcaagctcataatttggcagaccttattgtttaggtcaaagctaagtaaacaaatcaatgtaaacatatttaaagaacataaataaatactagtgtaggtgataggctagtgtgtcatgaattgccaagatggggcacacagactatttgggagctattgatctagtctgagccctctagttctataaggaggaaactctaaacaggaagtagtgagctgagaccttggtcaacaatgtagtcaccggctgggttgggaccagacagttgccccatgccctgtcctccctgtcctgtcattctgccccctcaacagactcatcaaggtcacatttaaataagtacacacaaaagcagcttatgcatagacagcttgtcatcagacaggatcacacgtaacacccaggtcaaatcctctgccatgtcaaacaagataatcccatggagtaaaagcaactcctttacaaaacagggtcaggtgctactttctgactccagggtcagagaggctggtggaactggcttctctggctctgccacttcttaactgcgtgctatgatttggatgttcattcccccaaatctcatgctgaaattggatcccagtggtggaggtaaggcctagtgggaggtgtttggatcatggggtggatccctcatgaatggcttggtaacctatccctcaagagctggttgtcaaaaggagcttggcacctcccctctctctcttgctccctctcacaccatgggatctctgaacatgccagctcctctttgccctctaccatgagtggaagcagcctgaagccctcaccagtagccagtgctagtaccatgtttcttgtatagcctgcagaaccatgagccaaataaaccgcttttctgtataaattacccagcctcgcatattactttatagcaatacaaacagattaacacaccatgtaaccttggaaatgttgcttaatctctctgtgcttctgttttcagatgtacaaactgagataagaggtggtaaatctagtgcacagaatgtgaggattaaatgtgagtttcctttcttcttcctctaagagcaagagcaagtacctcccgccaaagatatgggagaatccttacgtaggaagctctttatctatctgtgagttcacccatcactctctgactacaaaaccttcagccactccctgtttcttaccactgcaaatctgcaggcctcaacaatgtggccccttcccatcaagccaactttatctccttggtccctaacacttgtcctagcatatcccatgctccctcatggccccatggacaagatgcatccatactgactcccaacccctgtaccattttcttccccacattggtgtatagactgatcttgcaaaaacccacatctaattaaccttcctcctgaaagcctctgcacaattcaccctttcctgtggaataaagtccaaactccctaccactgcagtcacagtctctcatcatctaaccccattccctctcctgtagtcatccttagttatccataattctctccccacagcacaggcacacatgtgtacacacacacacacacacacacacacacacacacacacacacacgagtctacactcaagccagtcaggtccgctcactgttccttcaatagcttgggctcctttgcacctgcatatttgtgcactagctgctttttatccctggaacactgcattcctttctttgctgggtaaatgccttctaaccccttagcactttgctgaaacagagcattttgttttgcaaactcccacctccactcatcccttgcagcttaggtgactaagtcctggccaataagatgtaagtgaaaatcactgggtggaactaccaagaaggctcattgaaaggagcacagatggctgcatggcctttccacctttttctagtttttttatatataatggatgtgatggctggtgctccagcagccatcttagacacaaggtcaccttcagaatgaaaatcatgctctatggatggagaggccaaagagagaagttgcctgggaatgctgatattgtggtgctaccatataccaaggctagactggctccctttggttcttttatgagagaggaagataaactcttatgtgtttaagccactgttattttagtttgttgttatatgcagaaaatcgaatcctagccaatataacagacatacaagtcatttcctgatttggctcctacacacctctctagccacacatttcccctccccacccccaaaccccatactccacacctactaatctaatttcagtttcctcaatgcatcatgcttttctcaggcatcacacccttccccctctcctccatatccctcctcagaccacctgggaacacctgctcagccttccagacccagctcaaggaacacctcctccgtgaagcctttccagatgcactctctatacttctcccaggcagaagtgaccattcctcccactccgtatgcccccaaatatctaccatgaaccctctaacatgtcatcatttagtcatccacctgtacctccgaggtcctgagttgcttgaggcaagagctatttcaatcatctttgtctccagcatgtagcccaggacctgggaacactgagcacaagtaaagttgttcagggaaagttcccctgaggcaaggtttcatctgggattctggcccaaggggcagggctatgtccttgggagaggatgggggctcctgcagggcaaaagggcttgctcttgagcatattctgccctaggaggcaccaggaaatgtctgttgggtgggtaaatgaatgtgcaactcaacctcccttcaagcttctctctctaggatgctgacttcctccagccgtggtggtgctgcctgtcaccatctgaccctctctgcttcccttcccctgccatacttagcaggcactcacagctggaggcaggaggctctcaaagtgaagggaaaaactcttagctgccaccatcctgaaacctgccctccccacagccacaaaaggccaaggagcatggaaacagctgctgcaaggagaccagtgagcaggaaggtggggcagcctcacaggagctgccctgactggggccttccctctagcagtgaccttgacttagagaaaggacaccttccatggccactcaaacatacacatgacagtttccctccaccttcattgcatacactgaagacaactggacagaaaataaagaaagtaaggagaacttccagaaccatagccagaaatgcagagtaacttaaagtagctctgttttaatatattgcttgcttcccccaaggccctgcagggatggaagctgtatccttcaagggcaatgggatgaatagtggggagaggagaatgttcaggggatcctggattctgctctttccaatgtgaatggccaccatatggaagaacgattgggccactctcccagaaagctaatgatcagtgtagcatcagcccacacaggagtggcctgtcatgggaggctcatacactgtgtgccatgaagcagtggacatactcagaatcacatgccaccacaaagacttcgggttctgggaacttgggacctcctgccttctggggcttcttggaacatccatgcagtctggccccaagaatgccaattgctcctgatacctgagccaactttctgggctccccctgtctcatcagggatgctctctatctgcagagcactacaagtggctcaagcctggttctctgactgcttcaaaggtccttctcttaatctggtttacctcactcttctgcctgcttcttggagctcagcttcctatgactggtgccacaaaagttcctagggtcacacacagaggggcagagaagctgatccactggagaggctattagaacaggtgggaggaggctgcactgtgaaccagggtctggggccatgcctttcccaccacatcataagcattaattcattaattcattcacaaaatatatatttaatgtctactacatgctaggcataattctgggaataaagcaatagaaaaaaaacatgtgatgaaatatattcagggaaatatattttggtttaccaaagtagaaagatttctgtcctgcaggaaggactcagaatttttactatgtcagccacaggtactgtgacttgcccagaagggtcttagcatataggccctttgaggaagaaacatcagtgtagaaaatttgaaaaacgtagaaatgcacaaagaagaaaataaaaattactggtaatccaaccactcagaaaatactcttataaacattttttgtgtttgtcactgaaatatttttatatacacatctataactgcatagatgtacccaccataacttacaaaaccaattcccacattcttgtgtatttagattgtctccagtctcttaatattgcaaacaatacagtgaagagcatccttgtaagtaatcctgtattagtcagttctcatgctgctaataaagacatacccgagactgggtaatttataaaggaaagagttttaatggacttagttccacatggctggggatgcctcacaatcatggtggaagacgtaggaagagcaatgggacggcttacatggtagcaggcaagagagtttgtgcaggggaactcccatctataaaaccaccagatttcgagagacttattcactatcacaatgacagtaggggggaaaatgcccccatgattcaattatctccacctggccccacccttgacacgtgggaattattaaaattcaaggtgagtttgagtgggaacacagagccaaaccatagtagatccttatccatatcagtgattattttactagtataaatccttgaaaggggaacttataggtaaaaatgtagaactatttgcttttatactgccaaaatgccctttggatatttgaagcaatttatgctcttaacagtggttgtttaccatgcctgggtcctcacaccctaacaaacaaacaaacaaacaaaaaacaaaaaaaccctaagtatttggtttttatttttaaaaactgccattttgataggtaaaaatggttatctcattattgtaacttgcctttcttattactaggcaaactaaacttttcccatgtttattaggctttttgaatttctttctctattttatatttattttgtccattgctggggaagaatttttttaacttttaattttgcaataatcttagaattacaggaaaattgcaaagatagtgcagagtttccatatacccttcaaacaatttcatctaatgttaacattctccataaccatggcacagttctcaaaactagaaatttatttatttatttagagacagggtcttgctctgttgcccaggctggaatgtagtggcacaatcatagcttactataacctcaaatggacctaagactatatagtcatgtgctaccacgcccaggtaaactaagaaattaacactggtacaatacaatgaactaaactctagactttatttggatttcaccaatgttttcttgactgtcctttttgtcttccagtatctaatccaggatctgacattgcatttagatgtcacatctccttaactgtcctctggtcagtgatggattttagcctttccttttcatgatcatgatatttttgaagagtcctggtacagtattttgtatgatgtccctcaatttggatttgtcttatgttttctcgtgattaaacaggggctgtgggtttttggaggaatgtcacagaagtgaaatgcccttttctccatttctgaggtcacgtgataccaacaaggtgcattactggtgatgttaaccttgaccacttggttaaggtgatgtccgccaggtttattaactgtgaagttactattttttccttgccatactctattatttggaagtgagtcactaagtctagcccacactccagcggagggaatttaagctccatctgctggaaggggagtagtatatatctagaattctcctgtaaacaagatttgcactttcttcccttatttatttatttattcaattatttatttacaacaaatgtggtcagattctttgggttatagttcaatactatcattatttatttcggtgctcaaattgttctagttttggctgttgagagctctttctggttggctcctgggtccttcagacatcctaccatctttttttgtcttgctttgttttttgtttttaaacacttccttactttctggaactacaaaatgttttaggctcatttttttgtgtgtttgctttttgtttttccctgcccaggcctggaatcagtcatttctccaaggagttctggttctttttactagagaatggtctttagagactaagatctgggcagtgagtgtgcccatttctactagggtattattggttctaggctctttcagcggacagaactggaaaatatatgtgtgtatactaatccatgcatatctctacttctgtatacttctatctgtacgtatattaaaaatacatgatatttttgactctaatccagcactatagagttcattcgagcctttctagggcaaaaatgttaaacctctaaagcacctctgaatactgtctggaatctccatttcccacccaattctgagcaaaaattaaatcaagtagagcattgattggctatgactgatcccacggccatctgccgggaccacacgacagccccaggatggctccagctctgttcctctgggcctggagaaagcaacagaggacagagaactatatgaggacaaagaataaggcagccttgcccagagttcaaatcccagccctgccactaactacctcctggtcgattctttttccgtaaaatgaggggttaaattagatgctgcatagatctggtattctgtgattacagaaggcactcgattcatgttggctgagtgaatgagtgggtaaggagaggagtttggcacatgccagggcccctctctagttcaaatccacggtccatcattatcttgagcaggtaatttaccttgccaggcatcagcattttttattttattcttggtacttctctgtattttctagattttctacaataaacatgttattttatacttactaaaagaaaacaattagattttttaaaaaaacacaatagcatataccatccttctccctagaattattatcagtaagtacttcacaggctggcactgaggagcactgtgctcgtgtggatgaacttgaacccatgcaagcttcaagttcctgccataaagtaggtgttcaacaggcactagtttctgtcctttcttttctctctcctgctgatccagaagctacattgtgaaactggtggaaaaagtcttcctctcccttttttccctagtgtgagtgtgatggccatggcaaaaaaagtccctgtcaaatgagcccctttctttctcactcagagttctccctccctggcatcctccgtgaagggcctcctcaaggtgtctttgcagaaatgtggagtgtccaccatcaaggaagatggagggtccattcccaggtcccacacctggctgaacacgtctcccagtccagcatgaagctaaggagcttatgctccaggaagctcctgctcattttcaaccagggcccagctatggttgctcccctgagccctcattatctgtgctgaagaccttaggttgcagggtttgaagcctcacagagagcagagcacagtatgtgagcttcaggctacaagcctccaccccagcagtcctggcttaaattctgtttctctgcctaagatgaattcctccaggaaactattcccttccctccttctgagaggagggaggaaagacggcttttaaattacatgcttcttcttatttaaaaaaaaatgatggagaatttctggtaggaggaggggaaatattttgtacttctagaaccaagaaggcacagacgttccaccacgacagcaaaagtcccaagtccggaaaagctagcatattcagcaaaagcaaagggaactgagggcttctcatgaaaacaaatctagaaatacttgaatttgttttaaaaaattaggtcaggcacggtggctcatgcctgtaattccagcactttgggaggccaaggcaggcggatcataaggtcaggagatcaagaccatcctggccaacatggtgaaaccccgtctctactaaaatataaaaaattagccaggcatggtgcctgtagtcccagctactctggaggctaaggcaggggaatcacttgaactcaggtggcagaggttgcagtgagccgagatcgcaccatggtactctagcctggcaacagagcaagactccatctaaaaaaaaacaaaaacgaaaacaaaaacaaaaaaccatcattctcagcaaactattacaggacaaaaaaccaaacactgcatgttctcactcataggtgggaattgaacaatgagaacacttggacacaggaaggggaacatcacataccggggcctgtcgtggggtgcggggagtggggagggatagcattaggagatatacctaatgtaaatgacgagttaatgggtgcagcacaccaacatggcacatgtatacatatgtaacaaacctgcacattgtgcacatgtaccctagaacttaaagtataattaaaaaaaaaaaaagagagaaacactcttttccaatagggattccaaaatccaaatcgtggtcccttgtcagcaccattgagttcctaaccatacctggagggaatattacaagtccctttgcactgatgccaagcctcaaatttgtctgctttctgtattcatactgaagtgaacataaagccataggctgatgccacaccaggctgtgctgtcagtgaaacccctgaagaagtataccaacaaagatacaacagaataataaaatcaagcttggtcttttctccaaaaataattttaaaacctctgggtagctggttctcttctgctgccttttttttctccccaattaaaaaatgtatttttgcacctacactcttaatgttttatttttattgtctttgctttgttaaataatctattgtgtgtttgcatttgttaaatcactttggtccattcaataaatgtttattgaagaaaaaaaatcagcattttgtcatagagctcactttccacatgagctaccttcctttctagtggatttacaacccagacccctgcttctgatggggctccttcaaaattattaaagtgcttgactcttgtaatatcatgtagggttgggttatgtctgccccaatgttgacatgaagaaattcctccctttctaaccccacggacagacagcacttagcatctctcacctggagcatcacttcagcctcttgacttgtctcctccctccttttctttactgcagaacttctcagaacctttaatatcctgatgatcttccaagagggaaatacaacacaaaataatatatgtatttcctcaacttatttagtcatgaaatcttttattcaaagaacatctgttaatgcctctcaggccactaggttctaggaactcagtttgggaaaccccaccctctaaaatataatcctaactcctcagtaggcatgtgagcccttccattgtctgctgtctgcctccctccccaggatcatttttcacctctctcttatacctctgacattcgccctagaactgtttgtggttccttaaacatgctgtcttatttcaaacttcagtgcctttgcatatgctattccaccagcctagaatgctgttccctgctgtcctctgagttcaacactgccaactctttgaaatgtccccagctccctcaggctgacaaagtcacaccagccccaatgttcctgcagtgctagctttatgcttatcagcacttccccagactataaatgtgtttctcgcctgtaaatcgtcttgcttcttgctctctcctggcctaattcttcagctcctatcaatcccattagattcccatctccctttaatacatttcctctttttttaaaaaaagttaccaagaatgagtttcttagttgcatgagatcaaaaaaatcctaaattctacactcagaaagaagagttttaaaacacttttagtccaaaaaatgcatgttaaaaatggcacccccccttccccccaaccccaagcatacaggtctcttttcatagggggaatcatgttcacagggccccagggaaaaatgcagcaggatctgcctggtgcctgagaagctgcacactatgctgactcagatccagagagacagcattactcaggccaatcagaaaggtggtacccacatccctaggagcagccttacccaactctactctgcaaatggcctcttcctgggctttggggcaggcagggacaagagcatcaattcctgaacttcctgaccatgccacgttcagaatgcttccttagaagccatttcacgaaggtttccaaaaggaggatttttatctttcaaagtaaatgaaagaggatatagtaaactattgctaaactgtcccaggccctttgcaatctgactttgcccctcctttcatcaggggtggagtctatttctccctcccctgaatctggctgggcttgatttttcctttggtccaaaggatgtggcagaagggatactgcaccagttctggcctctgccttaagaggcatggcaggcttgcttccgcattcctggagtcctgagcctgccatgccatggaggagctgggtctggcccactggaggacaagaggtcatgcagagaaccaggctgctccagccaagagctggcaccaggcccctcgatgtgagggaggctctcttggacctcccagctcagccccaccaccagctgaatgcagctgcaggagtgagcccagccaagaccagcagagaaccacccagccagaattgtgagaaataataaatcatgattttaagctacagagtttgagtgtagtctgttaagccagcaatagataatgaaacagaagggaaggctcagaagccagcagggaactcaaatgtgtccagtgatagaggatgtgggaagtccccttgctatagaaaatgcaagagcaaggcaggtgcccctttcactatatatgcaaagtaccaagggtatcagaaatgcaagtgatcagatgcctcccacatagagatgggctaggatatgcccttcctgcttctcccataatgttccagacagggcctattaccctgagacaaaggaaggaattcgttacctgcctacctaaactccctccctccctttcgtctacattatctggccctgaaccatgactgtgcagagaacaaactacaattaatgctatcttttacccacaaggagctacaattactaagtggagttaaataaagtcacaaaggacttaaaagcaggtacgatgaagggaggtcagaagacaggcagtgtaaccgtgggcttattagggcccagaaaagaagaagatgcaaggctttttgctgaaggaccctctgtgctgagcctggaaggaagagaggtccctgcaggaagagattaagtgaagatattattaaggttgagggagtagcaaagggatagcataagagcaacatccccctcccttgccccaggtaattcctcccttcaatctggtctcccttcttccctttccaaggttcctcaaggccatgccacctaggctgatgggttttcttatctctctactccctcctgcacccagccctaggttgagttaattgggaatactaatcatttgagaagagctactaagacctgagaatgccccccaggtagtagttccagccttggtaattttaagactcttacaagaaattactgatacttttagcatctgttgattgagaaaatacacatgtgaaaatagatatcagttctccttataataatgcccctagggaatcagctgggcatggcagcatgcgcctgtagtcccagctactcgggaggctgaggcaggagaatgtgtgaacccgggaggcggagcttgcagtgagccgagatctcgccactgcactccggcctggggcacagagtgagactccatctgaaaaaaataaaataagataaaaaaaaaatgcccctaggggtccaggagcaggttgaatccaccaaaaaccactgatgagaggaaataatcagccaatgaaacagacccatgcttttagaagggccttcgttgctttgaccccaaaagacaatgagggaattgcaggatctgaagctggtatgtcaaggagtggggggcaggggagaggcatacccttggcccacaggtcctactgggacaccactatccagctgctctgggagagaagcaaggtgtccaaatgtaaatgccatggcggctgggcctggcttgcctagccacaagttcaaactctgctcaatgctggactggtatcatgtccctgccagtttagaaagcatctaaggcagtttggaaaagcagtagactagaaaccactagttaagtaactttcagactcagctactacctagctttgggagtttttccaagctttttgtttttgtttttggagacagagtcttgctctgttgctcaggctggtgtgcagtggcgccatctcagctcactgcagtctcaacttcctgggctcaagagatcctcccgactcagcctcccgagtagttggggccacaggcatgtgtcaccacacctggctaactttttatttttcatagagatgggggtctcctgatattgcccaggctagtctcaaactcctgggctcaagcagtcctcctacctcagcctcctaaaatgctgggattactggcatgaaccattgcacctggccccaagcttttttctttttttggctttcatcttcaataaaaaggtgatggagggtgggaataggagaggaatgctgaacttgctctccaaggcattgccaaagtgccaacatcctgagcaaatgattctagtcgacttactgtttctgagcctcaggcttcttacctgtaaaatgggaatgacatgtaacaattaaatgagatacaagttgtgaaaatgacagtcacatagcaagtatcaattaacatgggtttttctctcttcctcccttctgtccttacaatgacagatggttctttcttcccagtcccatccccctgctcttactgagttgctaatttgacctctgagtataaaatgtgtccacttttagtgacatgaagctagtcctcccagagagaggcattgccaaagtgagtatgatgacttcaaacacgctcagaaaccctaggaagcagctggcagggtgcccccactccctgcccctggcaatgctgggttcctctttggcatttgtacagaagggaactggcccaaggcagaaggatgggcctaggctggtgaggccacctccctccaggcctggccaaagccaaggcaggcacagacagcaacaaccacccattttgcaacaaacaggaaaccagtttaccagcctcaaaaatagaacagacaaaaaccccaaaatatgaggctctgacagtggggcagctcagctttctcacatggcttcctgacaggctgcggagtatgtgttgttattgttgctttaaatttcacaggcgaaaaagtcttgcaatgtctttataaaggtgaccagcctctggggcccaagaccagcaggcagcccagccaatcatgcttcctgcactgccaaggccccaccttctcagtctctgatccagctactaatgaccccaactgcaagggccacagaagccttgattcctgtcatgtcctaacaggattggccctgacatgtctgcaaagtgagtcttccacaccccagcattgcttttcctgtggcccctcacctggtgccatgccactcaccccaaaactgcttccataggtacccagaggccccactgggccacatggtccaagagccacactgacaataggcctgcagacattccctccacgtgaagctggactcatgctgtcccctctgccaagaacagtgttccttgcctggtacactctcctcagaagcaatcatactggaatgacatggttagaacagcaatgttgctaaggactatgtcacacaaactccccttgttgagggatcacggggaaaatgtatcttaggtcttagccccagggaaagctgtgcacatcctgggcactgggtgcatttttaatcctctggacatgatgactaagaaccgcctatcgattatgttccctttttgtcttcattgttaggaagcacagtgccaaacctgttcatcacctctagcaggtttatgtcctaacctgtccatggctttattttagtttctcctcttattttcccttgcatattatttctttattaaatttattttaccttaatgtagaatgtatatgatctcaaatctttatttggaataaagtgaggtatacataaataactgagcaaacagctcctacttactctgtaaaacccacttcgaatgtccccacctccgatttctgcctaacgactccacaaaggtgggcttccctccccagtggtcccacagcccctgcctgtacctgcctggattcacactcacccacagttctgtattttactgttttcatggctctccccaccaaccgacagaaggttcctgtgtgaaagctaaaagcccgccctctgccaaaatctgcccagtgctgcaggcacacgggcttgtttaatcctcaagacaaacctgccagataaggctggctgtgcccattttacagctgaagcaactggagctagccaccaccaggtgctcattcaaggtcatgtactattgagtggcagaactgatacagaaggcttatctccctaaggtcacccaagacatgaaaaagagtttttatgtgaaagagagaaaaggagagagagggaagggatttagatttccttagattatcaaatcattcactgcagatgtcaaagtcatctgcatcactggaaccatttaaaatatggcttgattcataacaatttatcctctacgactatctagaaaaatctacatgtatttaattgtggcagactcatgctgaccctccaataggctggtcagagcaagtggattagaggagttactcacatgctagattgttttagagcatctcctatcctcactccctcacccactgtgtatacacacatttttaaatcctggtaagtagttacaggaaaaaaaatatatactcagaagacaagagctaattctgcaagaagcttctaggagaaaacaaagcctactttcccggtaggcaagtgcacatgacccatgaggccaatcattaccctggctttacagtgtacagacaattaaactacatgaaatggccgggcgcggtggctcacacctgtaatctcagcactttgggaggctgaggcgggcacatcgcctgaggtcagaagttcgagaccagcctggccaacatggggaaaccccatctctactgaaaatacaaaaattagccaagcttggtggtgcgtgcctataatcccagctactcgggagactgaggcaggagaattgcttgaacccaggaggcggaagttgccaggagccgagattatgccactgcattctagcctaggcaacagagtaagactccctctcaagacaaatttaaaaataaaaaatcaactacatgaaacaatttttaatattccaattgagaacccacttggcctgaggcctttaaatcaaagtggccactggtatctacacgtgcccttccatggaatgaggaaggcaggacaacagaggctgctagggtctgggttcaaatggccttgggcaagctgggggctctccctctgcccctcgtttacatgcgtgtgcgtgggagatgataatgacaccacctcttagggttgcagtgaggacgaagctggcacagggataatgttgaataaatcactgcatcccaggcaagaggatacgtgaccaagagctggagtcctctttgtagaccttgtgttcttccattttaaaatgagaacaagagccagagagaagggaataaggcataagctatgaatggacgggaaggagaaagatttctgacccacctcttcacaaaagcagcccttccatcctgatggagagcacctcttttgggggtctgatttgtgtctctcaggccaccttacgccttgtgttctgtgtgtgtgtgtacacgtgcacgcacacacatctcctctgtaaagctcatgcacccaggtcctgagcctgattccccccactccctcccgtgtctggtacgtggttgagatcagtaagcacaggttgagtaaatcacaatggtagaagcagtaccagctgaggcacagaagggatcttcaaatgtcagttctctttgtcctccttgccagatgaggcccccagagcctgccctctgccttccttcctgaatgttccagggactcccctctgctctccagacaaacaccctcactctgccaccaaggcccctctcagcctgcaccagcagccaccccccagggctgcccccttatcatcccctctcttcctgttgacagccttggatgacataaccttaggagacccagccacggatcaacctgactacacagcgtgggcatggtaggggaataggtgattcaaagatttcctgggtgtggtcccctgccctctcccttcaccccctctgaagcatgtcacagtggttgacagattgaaggcccagccccggcatggagcccctgctatgccacttacactcttctggaccttgggaagacaacttcacctccataagcctccatttcttatgtgtgaatgggggtaagaagagcatggatgcatttcacctgcctctgaaggttgtcactagaatgagaagcactgatctccacccggcacatggcgagggccagcgcaggtggctccgtcccagcaccatgatgagtaaaagctgagcaggaagggggaaactgtgcttcccctctgtggcactccagtgggcaaggaggccttggaaggcgcagggccggggccagcgggaccactcaggctcacctgggactccagagggaaggggcatctcaggacgactccacagggtagggggctcctagctcaacatcttccctgctttacccaagagaggtcaagacgacaggactgagagtatgatgtgctcgccaccccttgccctcaccccacgccccacccacacagcccctacaccttcaggaggatgggatgagtcatcattaggtcactgggtcatcgagtaagcagtgggggccacagggtgcagtttcctcccttcctccccgcccagcccacctacggctctcctcctactctctgcccccgctactttcctgtgctctgatgtgggagggatatcgctcattgacaggtttcaaaactaaaagtagagcgcatttagtcttctcctgtggctgagctcagctcccagctcccagaactttgccatgctgctgcagggccggcatgccccctcctcaccctcacggggagggcccccatggtgttagccagggctcaagaatgaagctaggacaggaggggcagaagacgatgaagggaagtgcaaacatatgaccctgtcatctgttaggccttgaggtagatcctgggaccccagacgacagaagagtggaagggaaatcagaaaccagcatacttcacctgtctggagtgccagaccctgccaggtacagagagagagacagagggagtgagggaaggagggacctgtatggagactgaattacagggcagacacaggatccctacagaatcctgccaggcagttgttccaatgtgtagcgataagcagtgacagggcagaaatgggaggcgattttcccagcctgtcacctccagcaaggtgtgagccagaatgcacacgcaggcctgcgtgtctctggggctgatgacagagtcacaaggaaacagatctccatagcacagcgtggaaagggccaatgctgttgggtgaaagatgctctgggaggtcaagagaagggccaattaaccccatctggggaagcatttcatgacggttgtgatgcttgccctggatctgaacagcacatgcatgggaataggtcaggaagtcaaggggacaaagatcagggcaaaggcaccaaggtgtgtagtcatgatggggggcagggggaaggcatcaggaggctccagccaaggaggaggctgtgaaggaggcactcagcagcccatgctgactttccttataacttggaccccagaagtcactgctatttccagaaaattagagtcacaaatctgataatattatcaaccactaacagggcatccactatgggctagacattgtcctaagcacttcataaacactacccccatttaatcttcacaacaaccctataaagtaagattactacccccatttggtagagatcaagaactaggcccaaagaggttgactcacttgcccaaggcacacacctctacaaggggtggggctggacttgaacctgaggctccagagggcatgctctcctgaccactcagctgggttgccccaaagaccacaaaatgcctttcctgctccccagaaggtccagttcatcctctccactaggctgcaggcatctccagagcagggctgtgtcctctcctccttctattgagttcccctacctgagcctggcctttgtaaagaaatttgacaggcacatcatgacaggcagaatccaggggaagaaagcacttgtcacagtccagtttgggctgggaaccaacaatttgttgacttaatcaggcagatgcaaaaaggtgttgtcatggtggcaagctttctattccaggcggccaggccataattaaatgtcctgacctgcacacctccaattacagcacaagagctggtttcccaggcctgttaactagcaattatagaaccttccagtgaaattccaaatcacttagtaaaggtcaacttcctttatttatttttcagatttgggggtagaagtgaaatggaattattgcccaaattatgtgtgacatccattacttaaaataggtttattcaaacggcccatatggagcaagggatggagcctgcagttcttacaagttgttataagggatctcatttatggagcacctgctatgtggcaggcaaaaccacagtggctttaaatgtgttctatgatttaattcttataataaacttaagaggtaggaattactatttccattttgaaaaggagtaaactgaagatcagaaaagttaagtaaccttcccagggtcatacagctgatgcttcagaattcaggatttacagccaggtctgtctgcctctggacaccaggctcttcccattactaggtggtctcaagctaagtaacacaatttggggttcagagcacagctcctatgtgttgtgcaaggagtgctgagacctaaaatattcccttctcctggcctatccatgaaggcacagttgaggcacaggtctcttccagcctctgggatggttaccatgttagggttaataacccttcattgttgacggctcagacagctttttatattgataagagagacttggaacagtgtgaggacagtaggccttcagaacagaaacaggtggtaccaaagacacggtcttcatgccatcacttgccacgtgatgcccatggcaggtgccactaatcaacagtgaccccaggctccttctcaatacaggtgattcttccaatgcattgaactggcccaggagatgcaaattgttttctctctctgtcttagatatatggtgaccatattttctgcatgcaaaattctgacatgtaattcaactgaagattatttccctgatttatgaatttatttatgctttacaaaagctaaagtcaaatcacattcccccatatatttaacaaatcacttttaatgaaaagaataaatgccccttaatcagaattgtcccagatgatctaggccatatggttgttacagttgactgtgggtgcagatcctgggcctgtgcacaaaaagacactcagtaaacacatggggaacaagtgaatgggaggagggttcagatgaaagaaaaaggggaaggtccctgagaataaatctgctgacatcaccatctcgccgagtccatgcttgactggggactttcctgaagctataaattacttttcaatgtctcattccaggagagaaatatccaaacgacatgtccatctgatgaagagaacagtgtacatgcacacaccagatgcatgtgggtgcagctgcccaaattgcagccagtcaagttttatacctgactggcataaaacttaatcaggctccagtgttcagggccaaaagccacaacaaacatttcaaagtcaggcctcaccctccatctcacagatagtcccccagctgcccacaagacctggactgattgggtaattgtagaaatccacatccaagaggttgaaatggcagaactgctatgaagcttgtcccagtttttcgattctgccttcaggcagcaacaatcctttcagttgcttatctcaaataactaagtcacctccactgaagaagtgcgatcaaccacttgtaagaaagcaaaactccacaagcatcctagcatcagggcccactagttgactccaggatgagtgcaatgatctctcctgggtaccaagaagactccatccagagagagggcagataacaaatgtccatcttaggtcccttgccccccatccaccatctcctagtccctgggacctccatctaagaggagaagcaccagccttggcaatggaagcccacaccagtaggggctggccccacactgatcctggtaggttcatgcttatgcttctgcctcatgctgaactagtgcatgcctcagccctttggaaccccttggagctctccaaggtactgaccctcattcctggctgggcccctaaaaacagtgtcatggtgaaatgtggttattttgagtttatatatggttacagtcttttaaaaagaatcaattcaaaataaatttggcttcactgttgtacctcattttaagaagtagttttctaacttttcacctccaatttatagtgtggatctctttaagaagccaggtggcctatgtggcatgtggcttatggatttgcctgtaatggccctgaagcctttgacatcaccaagtcctcactcctttggatcttgcctgtcctatttcttggccttgtgcccttcccaatcccttcctatcaactgcagactcctaggatgcccttttccagcccttacagggcactatgattgtttattgaccagtttatttcccccattggcctgagtcctccaatgaccagattttttttttttttgtacctaatgcagggtttgtgtcacctgggtcctcagttggtgtttattgcccagtgggcagctagtgaatagtctcctgggtgtgacccaggagatcttccatctcttaagcccttggcttttcctactccccaaggcccactctggcagccagccaggtgtgctgtcctcccaatggtaggaacagtggtctgtgctagtctcctgctcataagaaacttcaggatccatgtcttctgcttgcttgtttgttgtatttcctagaggaaaacagtctggtgttaaccttgggttttactggctacctcaccccatagaaacacaacaataacaacgaatgcttctttgaacaccatttttcactattctaagcattttatatgcattaattatcagttacatttgctgttaggcaaatgctaccacatcctctttttacagataatgaggcagacagagaggttatgtgactcacttggggccgcccagctggttagtgacgggcccagagcaccctccagagacactgtcctgaaccatcgtgctgtgctgccacccactgagcttggagcaccacggggagggggtggggaaaggcgaaacgtcaggagagggtgagaaatgggaatttggaggcataaagtcaggaaaaggttgagtcctttttataataaattcctaaaagagggaatacgaaaatcgcagttgctgtagttgtacagatgagtccttatctaactccatacaattaatataaagaaccatataattaatttacaactggaaaaaaaaatactttattctaaagatgagcaagcagaggcccagagaagcccccgagtgcccaagttacaaagaagagtgtccagaggcactggcttaagaagacagaaggcactcagttgaaccatttttacaatggtataaagaacccccaaggtgatattttaataaacaaaatgacccaggtcattaatctctctgctgctttgagacatacacaggtgctcccagggctgaggctgtggaatcccagccagctatcctctagggggagctagaggcagtccttccctttaaacagggccttcattaagcaaacttaacaaacacgaggagcacaaacagaaacctctttctcagcttgcaacggacagatgtttaataagatgccatgggccgggtgcagtggctcatgcctgtaattccagcatttggggaggctgaggagggaggatcgcttagggccaggagttcaaggctgcagtgagctatgaccatgtcgctgcactccagcctggagaacagagcaagactgtcttaaaaacaaaacaaaacaacaacaaaaacaaaaaaataaataagatgtcatggatatggaataaatagaggataaagcccactgaggaaatgcctgaattctagacaatctcagcagctttcttgcattcctctggaatgactgggccacatctgtattgtgttcccatctggacacttcattttaagagtgatagtgacgcatttatcctgggaagggaaattagcaaataccaaggctggtagggggtggggggggacctgggctgctcaccccagagaagactggccagctgggctgcgaagccaccactccaacagttccctgtctgtgaaaaacagagtgtccccttccctgagggtgcactcctccttgggggtggggggacagataagttagaactgccaaggttctctgctccttaaatgcagcctagcaggatgggtggagggggtggggggcggtccttgcagcactcagagccaagcgctttctggacctggtaaagtgcctatgcactctggggcctctgagactcctacagcaagaaggaccttagctgtctccaggccctgatccaaccacttcatttcattttatctattttattttattttatttttgagatggagtcttgctctgaagcctaggctggagtgcagtggtgcgatcttggctcactgcaacctctgcctcccaagttcaagcgattcttctgcctcagcctcccaaacaaccccttcattttcgagatgagggctctgaggctctgggttccatggccagtaagaagcagaagtgggactggagtccagtcatgcagccccccatcaccctatctagtcctcttgccatttggcccacagcctccaccagcaggagcaacactaggcgccaatcttgccctgtctttctggtgatctggaaacagtcctatcatggcagctggaaaacagtggctcacactgctgccaggcaatgttcaccagctggtcctcctcccaaacacactggcaagacctagtgacacacagggtgcctgagagactgtgcacccacataccgccttgcaattgtccatccccagccattaacaggtgcgacttctctccgcaggaccacagtggatagaaatctctgtggaaatctcctcttggctgctagccatagaggacagatcttctacgccaaagggagaaggctgagaaccataaagccatcaagtaggagggaccatgcagtgctctctgatgcccaatatgtaaccataatacatgagagaccattaaaggagaagagctggggaaccccacccctgccccatgccatacaactcttcctaaacacagggtcttcacagccagcctcgacaagagacacatgtagaagggaaccatgactagccattccacagaccagaccagcacagcctgttgtggtggagacagtagcttcttccccaaccattcagcactgcggcctgggcttcctcacctacagatgtctagggctctgatgccttcctgtagttacccacagcagcccacagcactgccctttctcaatctcagcctcctccccacccctacacggtccatcctccagtggtgggggcttcatctcctgatggtcttgaccttgggcactcttatcttgctgtccaagggaaatccccagaagacactgagtaatgagagctgagagaatgggaccttgcttttaggccatgggtgaaattcaagccccagtacgtcatgtctgtgaggcttgtggaaagctggcttctgagtgagtgtccctcagccagcactcagcagacatttatctggcatgacctctgcgctcacactgccagggctggagtgcagagccacaggagagtggggtcacgtggggacagttcttcccctctccctaccctgtgctgtatgaactatatccatcacctcttttagctctcatgccaccatggtggttggtatgttcccattccacatatgagtaaatgtagacccatgagggttaagggaatggcccaaagtcacatggctaagatgcagaaccagaacttgaatgcaggcccggcttccctaaggctagtgcctgccaccagattatagccatgaatcttgcataacctgggtgaaacgcttttccaaactctatttcaaaattatgagttggcctaaaatatgactcccacagcatgctaatcttgtaattactattcatttatgaccactctccattgcatttgcaactgaaagctttattatgcattagtgtgtttcggttccacaaatatttatgtttccattccacaggtaagaataggtacccaagaaattcttttccccattttaaaatggagagttgctcctttatgaaagcattcctttcagtgaatccatttattcaactgcccattgattcaaaagcatttactgagtgtaaaaggcatacacgttatatgcatgatatgcaaaatcagcactgctctgggttttggagatacagcagtaatcaggacagataaggttcctgctaaaatcaaacttaggttctagcagaggagacagacagtaaataagtaaataaataaataagatggttcaggtaagaggtgctatgaagaaagtaaaacaggatggcctggggatgtaataagaggtaacatctgaactgatacctgttacctgctgactgaaaagaagtcagccatataaagattaggtgaaagaaagttctaggcagaagggggtcaggtgcagtggctcatgtctgtaattccagcattttgggaagctgaggtgggaggttacttgaagccaggagttcaagacctgcctgggcaacatagtgggaccctttctctacaaaaaataaaaattagctgggcatggtggtgcatgcctgcagccccagctattcaggaggctgaaacaagaggatggcttgagccaggagtttgaggctgcagtgagctatgatcacaccaccgcactccagcctgggtgatagagtgagaccctgtctcaaaaaaagaaagaaaaaaagagaaaagaaaagaaagttctagacagaaggaacaacaagtacaaagcccctgaggtaggaatgggaatggtcacagccagtgttaatgggacctagacagttcaaagggaagcaggggaagatagggaggctgacccataacaggcctcagaggcccatggaggaggcttagcttttatcctagtggcatgtggagaaccaggcatgaaaacacatatcatgaatcgccaacaagtgccgtaggaatcgatgcttttttattgttttttttttttttattgttgttgttgttttttgagacagaagtctctctctgttgcccaagccggagtgcagtggtgggatctcggcccactgcaacccctgcctcctgggttcaagcaatcctcctgtctcagcctcctgagtagctggagaaccacatccccaaaacttagaaatcagattgccttcagaattaaaccactgaagcccacgtgccgttgatgcaattagtcacctgttggttctggagtaagtccccaaagagctgtggagcatcctaaactaatcaaggtggccttggaagcagggccagtattagtatgtagaaagtggcagtaccagcatttgaacccagttcagcctgactccacaatcccaagtcttgtccactccagcctctcagtagcttccataaagcttagacacatagcacacataaagataacatggagaactgttgccagcattgaacagaaagcacattcttgtgtggcattttgcttatggcacaatcggggtgggtacatggaaggcagccatggagtaggccattcaaacctggtgaaacaagaagtttaagtgtttctcttatttcagatcaaacccagaaggcaaattttcattaactaacaactaaaggcatctgttacggctgggtgcagtggcacactcctgtaatcccagcactttgggaggtcgaggtgggtagattacttgaggtcaggagtttgagaccagcctggccaacatggtgaaaccccatctctaccaaaaatacaaaaattagccaggcatggtggcgtaatcccagctactcaggaggctgagacatgaggattgcttgaacccaggaggcaggagttgcagtgggctgagatcccaccactgcactccagcctgggcaacagaaggagacttcagcctcaaacaaaacaaaacaaaacaaaacaaaaacatagcatctattcttacagcatttgttggtgattcacgatatgtgtttttatgtgtggttctcctgcaagccccatgagaaagaagggctacaaacttgcattcctaacacaccacttgcttcatcttgccatgctcttgccctctgctagcactgtccacctggaaaactcgtccccacccttccagattcagctcaagtgtcagctcccataagatgtcttcctgaccatctctacccacttttaggccaaatcaatcacttctaagcacatctttttgatcaactcatcacactggatgcatctggtggcttaaatgtctgccccttcctaaagtgagcaaatgaagagcagggattacatcactcactgaggaattgctggtgcccatcatagcacttaacacatagtaggcatttactgaatgcttattgaggagcccgctgctggctgagtaaggttttcttgctactgctgataaatggcaaagctgagacccacatccaagccttagaccacatttttcggccatgagaaatggctatataaaagtagctaggtcaggacaaaggtgatggagacatcagacagacaataatttggggtggagggaagtgatgcagagaggaggatggatcaaaggagttgcaatgaaacctgacacagcagggaaaaaaggatggggccggatggggcaggacatggcagaaaacggggtggaagtgagccagaggtgaattacctgaggttccttacgtgggatgctggagaaatgaggacactgcctgctgcatggctaggctgagcaggggatgtgggcacactgaggaagttttcttcacatattcatcttgggttgtcagtgggatcccaggtcaccaggaggacctgtggttcaatgctccatttagaggtatgtttaacttctgataattacagccaggaaggtgacagttaccccttgctaaggtggacgaggagaaatgagagcttccaacagctccagaaaaggtcttttacaaatcacaaatcctcaccctttaggcatcaacatggcttctgaagcactactgggaggttaccttgtgcaatttctggagatgcactactccctctctttccaaatacccacaggctgccttgactgagtgcagaactgccctctttgaagaaagcaggtggggagggaggaacactatggaaagagcatgaactcctgagggagactggcctgggttccaatcctgattccaccctcttgagctgagtgactaggggccagctctactgtccagtcaaggacacctcagcaatgtcacaggcatatgaagactgggagaaggcatctgcgatgtctaaacacaacataccatcaatttctagaatatacaaggaactccagaaagccaatcagaaaaggacaggaaactcaatttaaaaaatggcaaagcatatgaataggcaattcatggaagggagaatccaagtgggtaacagcgtatgaagagaccttcaaatgtactagtaattcaaaaacccaaactaaacacaacaaaatactaataaactcccacaggtaaatattaataatgcctgtgttggtgagcagggtgcaaagattcctgtttcttcgtgtcctgctggtgggagttcaaatggattcagccgttctggaaaacagtctgcagtatatagtatttcttctttgtgacccagaaagctcactcccagatgtaaatccctgggggcgggggcattgatgaagaaatgtgttcaagtattgtttctcttagcaaggactgaaagcaacccaagtgctttagactaggggtgaggataagaagaggttatggggggatgtgaaacaccattgaaacaccacgcagtcattggaagcagtggcctgaaagtacaaggttgtggggacattggacataccataccgaatgaaaacgaacccagtcagtagcagatgatattattattcccgtctataggaggaaataggtattcacatttagcacactagcccatgcactgtggagatttaataaatgctggttctctcccccttgtgcattccaacctctgccccttcttcattccctccccacgcttcctgagtggcatcccaagctctccaggtagtttaagcattgctgtggaaggtgagggagaggtgttaagtaattctggggcaaccttaactagagaaagagttttaaaaatcagagtgaatgaatccttgtcctgaattcccagagcctcatgaaggaggcagtgtggaggtatgggccggaagctattatcacctccattttaaagagatgcatttaagtaacttgcccctaagatactcactaataaattgtagaatcgttgttaaaattcaggcagtttgaattcagagcccactctcccttttttttgtttatttgcagattttatttcatgtctgtgtgtgtatgtgtgtgttgaaatctttcaaatatacagaaatgtacagagactaataaaatgaatacacttcgcccatcacccagcactctccagtgctttgccatttaaccacaaatcagtttcattctcagtagtgtctaattgttccatttgtcttttttttttcttggtctgtcttgctaaagaattctttatcttttgttttctgatttagttgctcttttctattgtctctttattttctattttgttaatttcccttctgctactttctttgaatttactcttttgttctttttcttacttcttgatttgagttcttctttaccaatataaatatttacagctatacatttcctctcagaattgttttagccatttcccactcattttgaaattcattcaaatatataatttccgctaagatttcttctttgattaattatttcgaagaatttttaaaatttcagacttatgggggattagttatcttttaattattgatttctgattgaattgctttgcggtcagagacatatatgatattgggggtttttcttgtagttagagatgtttatgatattgggattttaaaaattagttgacatttgctacatgattaatttttgcaaatgttcacatgtacctgaaaagtatatgtactctttaaaaattgttaagagtcaggattttatataaatgctttagatcaggggttagcaaatgtgctatagtcaagactttcagctttgcaggccatacagtctctgtcatggctactcaacctgccattgtaaagcaaaagcagccatagacaatagccatagaaaataaggaaataaatgaatggggatgtatttcaataaaactttattgacaaaaacaggtggtgggctggaactggcccaccacctgttagatcaagctttttacttgtgttgataaaatattccatatcccccatacattttttgtctatttactctgtcagttgtagagagagttatgtttaaatccccctttataaaaacgtatctgtccatttctacttctcattctgccaatttttgctttatttattttgaagttatgttattaggtacaaacaaggtcagaattgttacgcttcatgaacccctcttatctctatgcagtgatctgttttatccccagaatgaccataggtccctgtttgcctgagatagtcctagttaacacatgctgttctcacaggtcttattaatagcacctcttatattaatacatgttgtccccatagactttactaatagcatctcttttaactctgaaaagagtcctcatttgaacaactgattacatggtcacttttaaaaaatatccttaatgttctctgttctccaaggataatgtagttatttcagctttcttttggtagtgtatgtctgagaaatagccatccatttaaatccaaatgttttaaataattgttttatatttacctgtcccttgaattttctactgtcttttaggtaacagtcctgtggtcactaagacacaacatacaatatcaattttaaagtgtctagtcctagatattaatccattaaaatgttagctccacgaaggaggatatttttatgtattttgctcacggctaaatccccagtgtcaaccaatacctagcacagagtaggaactcaaatatttattgcatgaatgaacacttgaatcttcaattcaaagtaagaaatcctttatctctacataggcaagttgcaagtggttcctaccctccctagctagcacctgtgacaggtgggaacttggggtcagggaaggaaggtacagtgtgctgattttcccctttcccctcttgccctcagattatgaagcagggctccaagctcctgaggggctggagcccagagaaggaaaggaagcagagccgtaaagctcttaggtggctgctgactgataggtgactccagcttcagagactccccagttgtggtctggctgcaaatcccctggggtagaggctgtattctatccctccagctttcccacctctcagccccagaggtcctcatcaccggtcctcactccgtcttctcaggcaggtcttagatattagggctcccatctgacttggcataatctgcctctcatcaatcaaatgtaggcatgcatcccttgtcttgctgtagtgggaatggaggcacttctcaaatgccatcctctatttcatcttccatgtgtcaaagaccactcgagctttttgggcctatgtcaagcatcggagcagatatctctcaactgcaggacacaaaaccaggctctctgagtcattctgctgaagggcttcccctactccaccccagccccaaacatactataagttgaactgagagatgaagcaccatctcacctctctccacaatccaaaagtcctcctcacaaaatcctctcttcaaaatactcacccagatccctttttacatattggaaagaagccctacttcccttagttcccaggcactgtctgaatccttcccttagaacaggaactagagagatgggtaatgggtattcatcatttgtccagtctggtcctttggctgcctgagcaaggtgagagaatggggctgggccttgggcagcctctgtctacatcctagtcttcagggtctcacttgctttaattgtgttgatcatgctgcaacaggacattcccttgggtcaggtatacatccagcctacgtggagtgctggcatcaggatgcacaggccattttgatgtgaaggtcctccttcatttatccattgctgcctaacaaaccactccgaaatgcagtgtcttaaaatcatccttttattgctcccaattctgtgggttaggaattaatgtagggctcagtgagggcagcttgtctctgctccatgtgttatggctagggcagtgtgactcaggttggagggtcccagcggggcactgaggctgttgtctgtgtggccactctctctcttcatgtgatctctcatcctccagggcctctctccctatgttgcctctctccagtaggaaaatctgggtttctttacattgaagttgggttctgaaagaacagtagtataagccacgaggtctcaaaaggtctgggcctagacctggcacagtgtcacttcctccaaatcctatggacaaagtgagtcaaaagccagcccaggttgaagggaatctgcttctggatggaggagcagcatatgcagagatggatgggggaactgttgactgccatccagaaggactgccactgtccttctttgattgatgctcatattccttgctaattgcttagaatttttttcccatccttttcacagggatgaagaaagaataagagtggttagaggttcttctggcctaggtctcaggatgcaagtatctgtcacggaagaagcttcaagaaggcagttctgcattttttcccagtccagctataccatgacagtccccagatttgggggttatcagtgtagtttctcaagctttcctatatttgctttgcatcacacaaaactgcttggtctgggaaggggacctctccatcaactccaagcgtcttcctaccatttgatctgcattgttctggatctgggaaatggctgttgacagctgcagaatgcggcagggacccatccttagtttcagcattcatgttctagtccttgttctttttactaccttttgattatattgtccaattccacccttcatgacgctatggactgaattgtctgccccacaaattcatatgttgaagtcctaactctcaatgtgactttatctagagaaaggctcttaaggaagtaactaagtttcagtgaggccataagggtggggccctaatctgaaagggctatggccttataaaaagaaggagagcaagaaggagatctctatctttttccaccatgtgagtacatagcaagaaggcaaccgtcagcaagccaggaagagagacctcatcagaacccaaccatgccagcgccttggtcttgggcttctggcctgcagaactgtgagaaaataaatttctgttgtttaaaccatgcagtctgtggcatgctgttatgacagcctgagcagactaatatacccaaagactgcattgtatgcttaatctcctcacaagaacaccaagatgcagatacaaaagtccccagctcacagatgaaagaaatgagacccagtcttagttagactgacttgccccaggttgcacagtgagtagcagataagaacccagttcatccagctccaaagcccatgttctgtgccacatgccaagaggctttttggccatctccttgtaatttgcagtttggaaagaaggcggagtccctgacttctccctggctgctggctgtttgctcctggctctgccctctacctcattctacactctccacaggcataagcgatcccagagtggtgacctcaaggggaggggcagggtgcagagaggaattctgcctgggctgcacattccttcccagcctctggggagggcaacaaagaaacccaattagcacaaagtgtgtaggtgggtggggagacagccgcttttgtccttccttctggtgtcactgggggtacacacagcttcgtttctaggcctggatcattccaggagggcactaggactctagcagactcctgtcaatgacacaaaagcactgaaaccaaatattttaaaaatccatttatttctgtcttggcacataaaagtctggttacttgctattttagagtaggcagcagaggcaaataagctggcttgtggactctgataacagaattaagctgtagtggaagcaccattgtgtaggacttttcagtgtttcaagcactttcatactaatctagctttatcttcatgtcagaagtcaggggagtgagtgcttgcatatcatattcccatttcataggtgaggaaatgaagacacagagaatgtaagaaactggtcccaggatacaccaagaatccccccaggccttctcattctgaatgctacactcttttcatccccaaaggctccgtcaccctggagatgcatattgtctttcccccaactgcttcaaatagtcatttccaccatttactttccacagttccttctcttgtttgatcaaaatttcaatctaacattttgaaacttaatacaatctaccattttgcaatttaataataacctagtctagtcagaaaggtaatgcctccttttcagttcaaaacaggatcacacagctaacgttgtaagtggtccggaccccagccctggcatttttccttgtgacccacacaacctcgctgtgcactgacaacctcaacaacccagttaccacttaagaaccctcaaacatccaagctgtttgaacaactggaaaaggtatgtttgtgtctgatctatactgtttttcgtgacaaggtagtccctcctaggaacacaaggaacattaactcacatgaacaggaatcagagttaacatttatatcaccagataccaagccctgttccaagttaaatatatatatatatatatatatatatatatatatatatatatagagagagagagagagagagagagagagagagagaaagagagagagagagagagagagtttatatatagagagagagacagagacagagagagaaagagagacagagagatggagttttgctcttgttgcacaggctggagggcaatggcacttctcagctcactgcaaactccacctcccaggttcaagtgattctcctgccttggcctcccgagtagatgggattacaggtgttacccatgtctgtataagagaccacctgaccaggcttagtgtgagcaacaaggctgtttattcacctgggtgcaggcgggctgagtctgagaaaggagtcagcgaagagtggtgggattatcattggttcttataggtttgggataggcgttggagttacgagcaatttttgcgggtagggggatggaagttacaaagtacattctcaaggcgggaggatgttacaaagtacattcacgagggcggggagggcatattgtcacaagggcagggaagaatgttacaaagtacattcacaaggaccaggaatatcacaaaatacattatcacaagggcgggggaatgtcaccatggcttgaccatggtagggccagcttagaggaccttacaacaggtgctcgccaccacgcccagctaatattttctattttcagtagagatggggtttctactgttggccaggctggtctcgaacccctgatctcaggtgatccacctgacttggcctcccaaagtgttaggattacaggcgtgagccactgcacctggccaaagtgagatatatatatatatattcatttaattctcactatatatattttttgaaacagggtctcactctgtcacccaggttggagtgcggtagtgtgatcacagctcactgtagccttgaccaccccagactcaggtgatccttccacctcaacctcccaagtacctgggactacaggcgtgtgccaccatgcctggctaagttttgtatttttttgtagagacggggtctctccatgttgcccaagctggtctcgaactgctgggctcaagtgatctgcccacttcggcctcccaaagtgctagaattataggggtgagccactgcgtctggggagtctcactatttttgacctgacctcctgggaccccttggccccatgagcaactccacatccctgtagccccaagagagtaatgagtaatgagccatgatgtgaagatgttgcccaaaactgtgcagtgcatgacctgtgcaactggacatggctgccctgctggaattgtcactgttactcccttgctctgacataggactatttgcagtctcctctctcataagtggggccaccctgcttcttttccagaacctgtgagccattagcatgtctattgctcattaaccgatattttgtaaaaggcttatttctcttgtatataggtcactgtcacagaggtaaggggctgagaactgcctgtcactgggagaggctgagtgaggaatttagggtctccaggaaatgggggatcctaaacagcatgcttgattttgcattagtagcagtactcactcagcgcttcaagtgtgcttgcatgggtgtgagatgccctgggtgttttgtttgtttgtttgtttttgagatggagtttttgctcttattgcccaggctggagtgcaatggcacaatctcagctcactgcaacctctgcctcccaggttcaagtgattctcctccctcagcctcccgatgtgaactggacagtctgacttccagtgggggccctcacagacagggcacggcttaggaggaatcccaggctgtgagcattccaaggcccagtggccaggcttttggcatttgaagcaaggaggaggttttgaaggagcccctgggaactgtggcttggatgttctgaaggttttgtatgctggagacgtggttgtgagttgtcttacagttcattcattctataatgaacctgtattgctttaataaaatcagggagaaatgttactgacttcaaaacctgcttgggcaatgtggactggactaatagtgactgagccctgccatgcacttggtacccagctggccaccttaactcactcattcttcaaaggaggacttattactgctgttttacagatgaagaaactgaagctcaaagaggcatggcctcttccccaggtcccatggagcccacattcatctgcttaactctaaagtcccagctctcttctctacctggagctctttgctgcctctatggtagctgaacaggagaaacacccaggaagatggtcaccacgctgccccagagcccaggggaccagggggctgctgacggccataatcagggtattcttcctgaaacaggtaagcgacatgaacctggcccaatggagaggcactttcttgttccaccacaaatctccattaaaatcgccttttccatagtcaccaacagtaccttattgatatccttctggcatcacctaaaacctaaaaacagcctgacagtttttgtgaatcagtttccattcctcatcctcttggctggcttggtgacacctcttccctgctgctgtttgccaactttaccaatttaccatcacctgcaagtgaatgaccctcttatgcctagttctagattagttggattttacattgtttcaaggtatcatagaggttccagggaagatgcctgaggcactgctggggagggggtgggctggggacagtgaggaatgggttgagtcaatcccactttcccctcccccatcctaaccaaagcagctgtttccatctttgggtgaatactgccctttatttgagaagggatccaagtctataggctgataggggggccacagatgtagatcattaataaatatattaaatgctccagtaattaaattattccagtagaaccacatcatagtgaagaacatgaagaagattttttttcaaggctgcacttacaaatcattgatccaaattcactgggcaatttcatcaggacctcccttttccacaggcttcttgggaaaaggatatgggcagggcttggggggcatggggtaaagtagggagagagagtcaatagaggaggaccccagagggacaggaggcagggaagggagggaagagggagaggagaggcagagaagtcagagtccttgtcactcctaggacagctctctggcttcttcacacactgacatcaaagaacacctttgaaaagtgaccattattttatttataatttcccaaccagtgaagaacaagcttctgccagcaggagttcctgggatgatgccgggcttcccctgcaaccccagtatggaagcagtcactctggaccctagtaaaggagctggtgtagttaagagtttagagggtccttgcaaggtcacagccctgggtggccacccagtgtccctgctggacagcaggactccccgctgcccctcacagctgcatcatcatgtctgcaattcgcagatgttcacaatgatctttggaagaaactgccttcctcagagccaagttctaaccacaccagggatttactctccttatttagaactcctaactcacttttttgggaaccgtccaaatggcattagctacttcagttgataaactttgccttttgactgtttccaaaatatgaccccctcctttaaaagatgaatggccttccctggggatttcttagacaagaggttctgaaggcatttctaagagatactttaagccagtggttctccactttggctgactgaatcactgggaccagaaatttatgtatttggtgctgcactcagatggtattaggtacttccctgcacattaggaaaatctgtaagagcttcattgtatagatgaagaaatggaggctgatagtgaacaggtgccttgcccgagaccttagggtgagaagtgccaactcaggctcctcaaatatcatttgtccagccccctgcaccctggccagtctcctaattctccatccagaatccctttcattgtgccagggcttgcacgtagtgcagctctttaaagtctagttcatggcatgttttatctggcatacacaatattttataaaagcccaagtgagtcagctaaaaatcagaatttacagtaaaaatctgtaattctggccaacattgcccaaccctcctgcaaggcagagttcacctgagctggctcaggggtggcctcccttgatggtccaggctctccaggagccacccctctcccaccccacccctatgacccactggcttggcctgcctggccaggccaggcactcacatcagtgacccggcactatatcatgaatggagtggaagcgtcacaggggtattattccatggaaacaatacccacttcgatatggcatgcttactaaaaaagtctttgcttttatctaaagacactgcaatcagacctgacacacatttatagaagtccagatgatgatgacacaccaaaaatatcacattgatgtagtgttttatcactttccaattactttcatgtatatcaatttatttgagttagaaaatccagagaattcatcctgaccttccctctctgtctccaccctacctctgttgcttatcccaggccctgaaaatggcccagatataaatccagaccagcggccattagacagacaaacagaaacctctgtgcatggaagtcattgttctattgcttctcagaaatgcagaattaaggggcggggggaatgtaaccccaacatataataaatacaattataaataaataaattaaataataataaatataacaaaacagcagatgtaaatgacagaagcaagcacatacaaacctagcacatacaaactgataaaaactatgaaatatattcatatacattgaacaaaggtcaaaagtaaatttgaagagtccatataattttagacttgttagccttttttaaaaaaaaatgttgccttcatgttcccagttaaaaaaaaaaagctcaagaattcttaactttctcttataatttcctcacctgtaaagcggaaagatctgtatgtaattttcagaacagtataagcattcaataagtattagttacttttattatcatttgcatgtacaaggcaatctttccaatttccctccttcattttcccagaaaaagctaatcaaatgggtttatcagcttccatgatctctgtgcattgaatgaaggtgaacatattcaggtgtgatgcacttcatgtcaaggtctcattgaccccgtagatttgaatgctgaagtgaccatcatatccatcacagaagaagtatttttgtacaattcatcagctggaagagctacatggaaatacatgtctaactatctctctgtctacttgtgtctccacaaagtcctgcaagctccaagatgggaaatttgcctaattcatttctgccccttcagtgcccatcccataagttggaagtcagtaaatgtcaacaagtatgtgaccaataaatgaatattcaaacaaggcaaaaataagacaggagaaaggtgtttttatgtccttcagtgggagaaacctgcaagcaatacatctttggtgccctgatgacaggctatggtggatgctgcggtactgcccaggtcccctccagcatggagccactcattcttctggctgctgggaatgttgtctgctgacagctcacacttgagtctctcccaggaattctgaagggagctgtgttaccaaggccatacacctttcccaaaagcagtctttatccactgactgatcactcgcacagggacaaagacctggctcctttgccgcaatgtgggacaactctaaagagccatttcagctccagaactctgtagcatggactcaggcccttgttggaattgcatcacagttcaacttttccctctcccccaccctgtgtccctcccaccccagtgaacttcctacacatagatccatcatctctgagtctgtttctgaggaagccaacctgtgacagtgggtaccaggagtaagagctgggaggtgggagtatgttggctcttgctggaagcttcttatccctacgcgttcgtgactcactttattcatggcttgtctcaaatgtactatctcagagatgacttctctggcagtgttgtccaactattcccaaatcattgctagcatatttccccattttgtctcctcctatgcagtcatccacatctgaagtcatcttgttctttttttcttattgttttttctcactctcacatgaggatgtgaactgcagaggacaaataccttgctatactgctcactactatctccagcttctaaacagcacccagcaccatgtaagctcctaagaaatatttattgaatgaatgaatgagaatctgcacacacattcatagtgggaagaactgggctgagagtgggaaaccctcatttccagctctgtttctgccattaaccatctgggtgacctcaggcaagccacctgacttctctgagcctcagttttctcatctgcggaatgagatggtagaatgtgatgatcactagaaattgtgacagctccagcatcctataattttacatggttattcagcttggaattgttctgtctataaactacattctatgggaatcatacagttttttatgctgaaacggagcttcccagagcatttcacaatatccaatgagtatcggctttcagatgccaatttcattattataccaatgctagaaaaactttcatgtgagacgctgcagttaaggatatgttcaacatggggttcatcaaagctttagagcactgtgaaataaccattctcctatttgcataaatatcatgagaactaagtctctttctcaagtcccacgaggtaatgaaaaagtgaacactggttgaggctgcctgtgcaccaggcatgagtctgtgctcatgggaggcagtgaacacctcacctggcctggagcaagcattcaaggaatgctggctcttaacatctgtctcatttaatccaaacaacagtcagtttgaggtgggactcttaaccccaccttggagttaaggacacagaagcactgagatttacctaatctacccaaagtcatcgaactaataagtaagtgatggagccagggttggaatctggacagtcagggtctagagcgttgccatttatccactacactagagctgtctcaattttcttaaaattcagattctgaatcagaatgtttggggtcagcctcgagatctgcatttctaactatttctaggtgatgttgatgcttctagcctatggctcaggctttcagttgtaaaagtacagaagaaggaactcctgctaaaagtcagaaactagcctctggtccagccctggcaaatgctggcaatgagaccatggctaagtgacctctcctcacaggctcactcatgcctgtgatcccagccctttgggaggccaaggtgggaggatcacataagcccaggagttcaagaccagcctgggcaatgtggcaagaccctgtctctacaaaaattttttaaaaaattagccaggcatggtggtgtgcccctatagtcccagctactcgggaggctgaggtgggaggatcacttgagcctagaacacagaggctgcagtgagccaagatcatgccactgcactccagcctggatgacacagtgagacccagtctcaaaaaaacaaaaattactgggtgtgtgtgaaagcactttataaaccagaaaactcaaaagcaaggggacagaaatttgcttatccactcgtctttttccctctaggatgtgagtctttgagccagcacaaagcagtggtgcctggcacatagtagatatttagtaagtgttcaaagtgccaagtactttaaatgttatgtaatttaatcttcacaacaatctctgattcacattttacagataaggaaactgagactgcctaatacaccctcaaactactaaagcagtaaatgctgaagcccagattttaaatgagatctgtctggttccaaaaccaatgctgattttaccctccactcccattattcctcccacataggggtctggctgaggtctaggaatggatccagattttgcttctgcacctgtcacatgggcactgggagtccaactccttcttagaacaaatgagggctctggtctagggacagatcctacaaatgcaagtagaagctcttcattttaggggtgggagaaggcacggaaataattcagctaaaataaacccttcaagtattctgcaatgagaagcaaagtcaaggtcttcctattatcagggcccccaaagccaatccagaatgtacaggttcaacaagttcaaaggagcaaatgcctggaacagtggctctaaaagtggggtccaccagggtctctggatggccctgctgaccaaagtattttgttcttgacattaatttatagctccagcattggtaggaaacttaggggtcatggagtgcagcttcccacacaatgcaaagccacatgagggggctggtttttgaggtcttgagtccactgaccaactcaatttgaggctcaatggcttagagaaggaaaaaaactaaagtaagaggttgatactgttcctatcctagaggcaaggaaacaatgctcagaaaggctaaggaatttagtccaaagcacaaaggcacgaatggtagagataaggcctgaacctagggacaactgactccaaagtctatgccctctcctctgcccctccaggattgtaattaccattataaaagcagcagaatctgagggctcaaggaggagctggacatggctccagagcctctcctgaactctgctggcatcaaacatcatgatggacacaagaagcacgcctgagcccacagtgataaggtccacacacagtggctcctcctttccccaagtcattctgtgggtggtacccagctcatctggataataactaaccacaagctgaccatggtggaaaatccaagatctgataaacacacaaaggaaaatccttcaaagaagctaccgagcctgctcagcgtgggagcctccagcttgtgaaatggcgagggggtagtattgtgacccagacttgaccacctggtgtgaccctagcaaggacctccctcctgctccctgagggctgctttcctacctgtaagaggtgtgaccaggaatccccagcatggtcacagaataagaaaggtcaagaggctggaaagggcctcctgagaccagtgagcccggctccctctgggcctggggctgggtctagcataacacaccctcatttaatcctcctcacaaatgggtcagagaagtatgaagtctttggggacaggaggggtgatggccatctgggtgtctcatcagctccatctctctgcagagaccacggacatcttcattgacacccccattcccccactgtgagtaaaccactctctcaggggaagggggaatatgtccatgccctccccaagaggaccttggcactggtgctgttctgtgggctctgtctggctgccccttaccttatgaaatacaggggtcacagttcagttttcttaacatctagtacattctccagcacaccaagtgttcagtaagtgttggctatgactggataatcatcctataaagggtctgactcaggcagaacactatagctgtaacagctccccaattcttattgaataagacagcgatgtggtggttcctccacaaagcagtgattagaattccaattgtgaggttcatcatttcatccagtatttattgagcacctactcagtgccaggcactatttggggattcagtgatggacaaaacagatataaatccctgacttcatagagcttattttctagtggaagagacagacaaacaaagacacaatacagtatcagttagtaataaatgctctgaaaaaataataaagaaagatgagagaatgaagtgttgggaacactatttgagatgcatggcatgaaaaggccttccaagcagagagaacagcaagtgcaatggccctgaggtgggaatgtgcttggggacaggagagcagtgaccaggaatgatgagctgagaatgaagctggagcagcaggcaggggtttgggccacagtggtcatggcaaggactctagattttattacaaattccacgaagccattgcagggttctgagcacagtggtgaggccatctggtttacatgatctggggaccagaaggactaattcttagcatgtaagctccaaggaaatgtaagtacattaaagaaaccctaagtacatggagagtaacttgtttgaaaatactattgtcttagcctactaggactgtcatcacaaaataccacagactaggtggcttaaacaacagaaatttatttttttcacagctctggaggctacaagtccaagatcaaagtcccagccaattaggtttctggtgagggctctcttcctggcttgcagacagccacctcctcactgcgtcccagcatggcctttcctccgtaagggcatgcaaaggagaaagtgagctctctggtgtctcttcacataaggacatcaatcctattagtgactcttataaccttatttaactcaatatccaaaaggtgctatttccaagtacactcacactgggagttagggcttcaacatattttaaagtaacacgattcagtccatagcgtctagattcctatcaaattagattttacaaaatctgctcttccatggttaacttcagacaaactgatggacaaaaccaatggtgaagtcagagttagtcaacgcagaggaaatggatgtagatcacgctaatattccttagggcagtagctctccgccctgggatgattctgattcagaagtgctgtggtagggcccagggaaagtgcattttaacaagccactttgacagactgatgaacagtggacaaatgcagtgctccctgggcccctctaagaagcagtaccaaagataaaagttaatttcaagtcactatagatagagtattatgcaaataaaagattattttttatgttcctcacactttcaccaaaagaaacagatacccctaacctgccatatgagctccttcttatccacctgatatttgtctttctagattatgtgatttttgtgaacaggacagtccatgaaccctgtggctgctatgtcttcagagattacaggcagctctcagcacctgagctttcgtgcatgttttgagtcccatgatcctctggccatgactaggccaagaatatgtgcacatgccaaagacaatgaccttcaggagagacgtcaaggactccagctgcctcagtcggggcctggctgagccctctgccccgcagacttgccctctggtgaaccagccaatccaagcagactgtccctgctgagcagctgggagtgtgagacccagagagagaagaacaagggaggcatggctgcaggagaaggacaggcagagagcacagctgggtcaggttcagcctgggttagtggctggcatgggaagatgcctggtctccagagctgctgagggtgacaagggacatgctgcagttctccttgggcgtcacagggcaacttccaggatgtttcagaacgtcctcatctccttgatctccttacgagtaatcccatcaacaagacaatctgagcatgttctcagttcccacagcaagagctaagaagcagatcaatgaaactggtcatgtggattcccacactactccaaacttactgggtctcagctcaattctcatttatttctcatgttttccccttgaaggaaattcacaagaatgcaaccagtcctttggagttagttgtggtaggatgcgactggcaaacctaagaggcatcctggcttttctcatttcacccacccatgtctaaacccctagtgagtctgcagtggctctacttccaaagcatccctataacccaacaactctctccatcccattgccaaaactcaaatcatacaactatcttcttgcatgaactattgaagtggcacatcatggtcttttttccactgttgctgctctaaaatccatcccctacacagcagatcatgtccctacttagaaccttctaggagcttcccaataccaatccttaccaaagcctacaagagcctataggattgggccttgcccttctcttcagcttcatctccctccaccctttcaataattcccgcccaatggccttcattttgttcctccaacacaacaagcttattcctgtctcaggaaatttgcacctgctcttcctactgctaggaatactcttcccgacacatctgcacagctgcttccatctcatttggggtttccctcaagggttacctcctcagtgaagccttccctgaatactccagcaaaggcagcccctcagtcaccctgtcctactttttgctctttttattatttttatttttattatttttttgagacagagtttcactcttgttgcccaggcttgagtgcaatggtgcaatctcagctcactgcaacctccgcctcctaggttcaagcgattctcctgcctcagcctcccgagtagctgggattacaggcatgcaccaccacaccccgctaattttatatttatagtaaagaagaggtttcttcatgttggtcaggctggtctccaactcccgacctcaggtgatctgcttgccttggcctcccaaagtgctgggattataagcaagagccaccacgcccggcctgctcttttgtcttcttcataacccctgttagcaccggacattgccctgttcacttacctgttccttgtttaattctatctcctattctaaaatacaagacttacaggcaagcacactggctttcttccccctgaatccctagccctggaacagtgcctggtacccagtaggtacttgatgagtgtcacctgcctgcctggccagtatttattccacatggcaccacctctggggattctggccatctctgtctctcccattgccttctatcttagcaacaatctcaggaaggtggttcctctcagccctgcaggggcccaggctaagcctcagtgcattgcatatggacatctgaatacacctttgctttggaataccatgttccagctctcctttcagtccatgaaaggaacaggaattctgcccctttgacacagatggcccggtgaattccttgtattctttttgtttttcaggacttatatatatattttaattgaacttgttgagataattgtagattcacacagagttgtaaaaaataatacaaagagatctcaggtacttttccctcattttcccccaacggtaacatcttgcaacactatattatatcacaatatcagaatccacataatgtcatcgacagaggcaagattcagagcatttccatcgcacaaggatccctcatactgtgcttttataaccactcccatccctctaggctccaccaggacaaccaaaaagctgtctgttcccccttcctataactgtgtcatttcttcactccttgccttctttccacactttcagaccacatggcattgctgtcaggatgcttggctgcctcatatccgcttgtggtcggcctcggatctggcctccccttccctcctgagccacattgtctcgtccttacccataaatggcaccctgattttttaggacctgctttctaattcatcaagaacatttcagatttatcaccatcctcctagggaggcagcatctccctgtgcaaagaacacaggctttgaatcctactctctacctctccgagcctcagttttctcatctatagaatggagtcaataataccagtatcagggatccatggagaataaatgacacagtgagaggaaggactctgcccagtgtctggcacatagcaggcacatgctaggaagggtaatatgcacaatttaggattacctacgaatctcagtcagtctgcgaaacaacaatagcaactaatcaaaacaccatttcctgatgggattaaaatcagaaagagcatctgatcagagagcagatatcccacagtgttaatagctgacaactggaccaaattatcttctttcaagaagggtgtcaaggatgtcagggggttgggggtccaggaatagatcctcaaaatcttccaattgacaatattcatcaatttgctgtgtgaccttgtcaagtttctctacctctctgaacctccagttcttggtctgccacagggatgccagccttgacctgtgatttcctcaccctatgctacagggtccacagaggagggaaggtggagccctgagaaggtctctggcctccttctcctcccacctccccatccaaagcagcacccacctctgttactggctctacatatcaagagtacaggtgatctttcctttgaagaagagcctctggtggtttcagaacttgcaagaccattgtcccgatgattgctggggttccttctggttctaaagacctgcagtcctaagttctcagctcactctcacgtactgaaaacagacaggactctgcagcagcaactggtctcagctcaagcatcacttcctccaggaagcattctttgacccaggagatgaaggtagggccacctgtgggcacccccaaggcacctcctttctaagttgcccataggaggattccagggatggaactaacaaatcgcagggcccagggcgtgagtactctggagtggggcatgggatgctctgtgtgtgtgactacacatgagtgaggtaaccactcacagcccagattaatggccacgcctggggtccagaggaccccaagtgaaatgcagcctggctggctgtatgtcacagaggatttttcctaatcaaggagggaaacagagtaacggtctaccttgcttagccttgtaagcccccggtgaccaccctggatgcaaatgaccttgcccaaactattaaacattcaaaccctccttctcttattttattctcaggagggtttagagcctcactgtctgccatggttgccactagtcctgtgtgactatttaaatgagatacaatttaaaacccaggtccttagccacactgggcatatttcaagtggcatagtgacagaactgtatcccatcatctcaggaagatcgactgcacagtgctgcctaaactgtttgggaatcctgagcctggctctcgtcgcgcctccttttatgaatcagtttgccaccgtccccgcctctttgtcacttgttcctgaaaaacccggactgggttgaatagtgtccccccaacgttcacatccacccagagcctcaaaatgtgaccttatttggaaatagagtctttgcagatatcattagttaagatgaagtcatattggaatagagtagaccccaaatccaacatgactgtgtcttataaggagaggagagacacatgcatggattcacagagggagaaggccatgtgatgacaacagaggccgagacctgatgacatctctacaagccaaggtcactaaggattgccagcaaccaccagaaattagaagaggcacagaaggatccttccctagagactttggaggaagcatggccctgctgacaccttgatttcagacttctggcctccagaaccatgaaagaataaatttctggtgttttaagccatcagtttgtgctaatttattatggcagccacgagaaattaatacaggaccccatcacgagaccctacattctcatccaactctctccctcaaagacagccaggaccttcaaatcccttggatattaacccctggccagtgacacccacggagcccatcagatcctggccgtgccagccagccagtcactggacgacataaccagaggaagcttggcactggaaggaggccaggcatgctgggctggtgaggctgcctaggaaggagccaggagactcaagtagagcactcaaattccataactttctctccttttaattttaaaacaatatcagaagggttcccagaaagcaacaagccccaggccatccagtcagtggttaaacagtggagcctgatcacttactttattaacttgctaaatcaaagggctgttaaagtctctgtccggtaataaaatgcaggaaggagctgaatcacccacctattagtggcagtattggtgcagttaatgactgtagcctggagggccgtgcagacaacaacaaagccagccctgcgtttccacctacaaaccccaccacttcctctgcccatcccagtgcccccagcacacctgcccacacacacctgtcttcaagaaggctgcatcagaatctgtggtggcttgatttttaaacacacccagaatttctcctgtcaaatacacttccatccaactcttccaggatcccacctccatgaccccaaacaaaaacaaagaaaccaaacatccagaaacgcggtgtttattaaatcaattctttaaacaggcagccaacaccaagttttgacaatgcattacaaacagtgcaaagcctccggagccgaatgctctgtgaatatcagtgcagcactgataagctggaccctgaaccagtatcaccctctgaccacacagagccaggaacagccctatttattttcttcattccaccttctcctgccactttaaaatgggggagaggggaacggcctgtgtgctgttcttccagaagctggtggaaagacatgcccaaaaccgctgacttcgtccatgtagcttatcagcagggccattttgaacaagttatctaagctcagggcctcaatgtcctcacgcgtaagtgatggctccagagggagtgttcttctaagacctggtgaggtaagtgtgcttatgagtttggtacatcataagtactgcattaatattcgttgttggctgggtggggtggctcactcctataatcccagcactttgggaagccgaggcaggtggatcacttgaggtcaggagttcaagaccagtctggccaacatggtgaaatccccccatctctactaaaaatacaaaacttagccaggcgtggtggtgtgcacctgtagtcctagctactcaggaggctgaggcaggagaattgcttgaacccaagaggtggaggttgcagtgagtcgagatcacagcactgcactcagcccgggcaacagagagagactccatctcaaaaaaaaaattcactgttaatgattatgatgaataatgcacctagtatatagtaagcactcaataataacagcaataaagtgctgttattatttctaaagtaacatctaacaaaaccaggctccaagtgccataaaaactcattattaaatctttataacagatgcaactctaaaactatccaaattaaacccttcagaatattcccaggacacccagaaaagattgagcctgaatcccccattggcactaaaaacaggacccacaaaggagcctcgaagtcatgtggagccaggtttggcaactcactccccactgtcccattactggcccctcataaaggcttcctgatttatcactgcagtaggactgaactcttccaccaggaggtttgctccattatgctccattactctggcctcatttgaaagcagcctctggggctttatccatgccaatcaggaggtcttggtggaaagagctccacgtgcccctgagataacagaatgctagcttcccacagctcagacccactgagaatcctgaagaaggagcccagcatgagttcattctccttcccaagagaaaagagagcagaaagaaagaaaaggaagcagcattctttctcatccctcgagatggtgaagctccttttcatttgcttctgagatctgcaaatcaggtggcaattttagctctttttgccccccgcttcttgctagagtatcagaaaggcactaaggccagcagcctctttcttcatcagcaattagatctatggctaggatctgtctacctggcactgacctggggtaacctcagttccaatctctgcagctttccagaaatgaggcttcagtgtggagaaagatttttgtttcaaataaaggcttttcttacgctcaaaagcaatgtaccctggaaattgttgctgggaggacaggaatgcaggatgcaggccctcagctgtgaagtcctcccctccgttccccgttaccaagcacctctacttcctccctaagacctgaggaaacgctaaaagcaggcacaagcagtacacagcaaatccccacatttcacggcatatgcgccttcccagatgactgcatggatacactccataacacattgttaaagtgataattagcgatagacttgttatgaatattccaaatacagtttctctctacaacagttgatggagacaaaggacatcacacgaaatgtaagaagtaacagagggatttttgtgcatatatttttaaaaggtcctgggaaaatagcataaatcagaagttgatttcaacaaattaaacatttcaggacccatttccaatgaaagatgcatgggcatcagtatttcctccgcaatgcttagggaacacgccatcctcccacaaactccagtaaagaatgtgaaacccaattccagaagccactcttctgttgccctgtttcacagcagctaggagtgctaaagacgggtagtttaagaaaaaaaaaaaacagaggaaatgctgaggaataaggaagaaagtaactacagccaacgtgactcaccctttaaaagtaaaagagaaaaggcttctattcatgtttaacatttctccctctaaatgaaatttctggaggccccaactctgcccccacacctttacacacattctgattttttttattatactttaagttttagggtacatgtgcacaatgtgcaggttagttacatatgtatacatgtgccatgttggtgtgctgcacccagtaactcgtcatttaacattaggtatgtctccaaatgctatccctcccccctccgtgtgtggggcctccacaacaggccccagtgtgtgatgttccccttcctgtgtccatgtgttctcattgttcaattccctgatttttaaattcacagtgattttgctccacatgggacaatgttgataccaatgacacactccctcctctcattgcctgcttcaccagggtggatgaaagacttcaggcagccaaactgaggatagtaaagaggggagggagcctctgacaccaaggaacaaaagaaggagacccagccccaccaagtccacctccactgcaaactgagaatcagttcagccaaggggcatggaaaacaacaaccccttcagggctgaaagggagcagcacactaaactaacaaggagaagaacgcaatgaacagtgctgctgcatctcctctgtgaacatcagggattctggacttactcagatagaatgttctattttaaggatgaacctgagctcttctagtccaagagggagacacaagtagcaacacacgttatcatgcacacagagtcctctgcaggcaaaggcgcccttctcctccccagcagtatcgctagacgtcatccgatgccgcttcttaccttaactgctcgcagggtcacagggcttgaaaaccacagtgttggggacagccctagagccatttaagtacacccctttcattttctaagtggggaaactacaaaccatagaggctgaataatgtgctcaattcaaaaggcttgaaaacaagtgccaaggttggtgtaaaatctaggaccttcaagtctcaatcttagtccaccctctacaacaatgttccccgcttttccccttattcagactaaactaacatccaaagcatagaattatcttgaaggagtaacattaaacatcaggatcaaaatataaagaaaggaaaatctaacatctcatatagaataatctcagcactatacctagaacacaccagctgacctgggcttctttgggtcctgagggaggccagccaggggcagaggtcaccaggaacagcctggagaggggagaagagggccgctggaggccttcagggctcaagcttctgccacagggcctttgcactgcctcttccctctgtgggagctccatccctgggcatccacagggctcactccctcacctccttcgcatctatgctcataggccccattctctatgtagcctcccctgacaactcacttgaaaatttcccttgatagtccccatctcttgcaccctacttaagtttttccatggtatttatcactttctaagagactacaatatgtttattctctaccaccttccattttaaataatatccatgaggacaaagagttttggttcactcctctatctcctgggtctacaatagtgtctgacacataataggtgctcagtaaataaatactagtagaatggataaatgagtgctcattccttcactgtctccatcagcaacaaccacctacacacctcctatacacacacacacacgcacacacacacacacacacacacacacacacacacacacgcctctttctgcccttttctctcttcttcacctataccccaggcctgccactaggaacaacagggatagtttaggttaaacttagaacattcagtaataatattgccaagccttccattaaaaactcatgttttatatacatatatggttttataggcacaaaaactctagaaggatacacattaaactgatatcactaggtgtcccagggaactagatggctgggcatgtaaacttttcactctatatgcttttatactatttgaattttgaactatatgaatgtaattacctgtcaagtatgtttaattaaaaataaaattggaggctgggtatggtggctcatacctgtaatcccagcactttgggaggccgaggcaggtggatcacctgaggtcaggagttcaagaccagcctggccaacatggtgaaaccccatctctatgaaaaatacaaaaattagccaggcatggtggttggtgcctgtagtcccaactactctggaggctgaggcaggagaattgcttgaacccgggagacagttgcagtgagccaagattgcgccgctgcattccagcctgggcaacagagtgagactccatctcaaaaagaaataataaataaaaagtaaactggaaaaaccaacgcacgaataacattcattcctcagctctcgtcctcacatcatcttaatacaaatttttcagggtgacggtcactagaatgctgtcagccctggattagatagtgaaatatggtaacattctccttttctctcatcccccaattttctgaaatgtgcatgttacttttacaatgaaatatttgaaaaagtttccattgtgcagaaggatatgaattaatgcaaatttccctacatacataaaacatggagactttgtttcaactcatgaatccatttacctttcattctgttaactcctgttggatttttcatttaatagatttcagaggaagttgtctaagatggtgccaggtcaccagaggtgccaatgcaggacacaggcaatgccgtcaaggttgtatccggtgaggatgaccacaagcaagccaggctcatagcctaaaggatacacctgaacgtgttcgctgtgaggaatgggccagaggattatgtgatgtttcatattttttccttgggactttcagatttttccaagttttctgccctgagatgcattactgaacttctgtttttcctcttactacactgtgaagtaaatgtgtgtgatgagtcactggcctttgccaggctgtgatcttcccaagaatgaagtccctatttaattcatctttgtcttctcagcctcttgcctggtgccttgcaacagcggctcctccatagatgggtaatgaaagaatgaacaaatgactgtttctcagcatccaatgagcactcatgggatatagccacatactaaccccaaagagacaacaccactccctcattcactgcctgctcacctcagtcatcattcatgggtattccctgttccaggcaaggcaacggaagccagagccacccaagtgtggctatataaaggcatccaggaaagggcatatgtggccttcccagcaacctagtctctcatgcatttgggttctgagcagttaatgctggctccatactttgacatctttgtaacttttgcaaattttcttttgattcttttctggggattcatcttaaggaaataattagtcataggaagaggaaactaaaaccacatttattaatgctgtttaggtggagaaaagttggaaacaacctaaacatcaaaccataagagatgaggtaaacaaaggatgctgtagctatgtaaatgagtactcttacattacaattgctgtaaactaagcttgttgctctagaaagttgttcatataagatattaagtgccaacgtgttttatgaaagactatacatgatattgtgacactacacttacattaaaatatatgtgtacatattatatatgtatgatactatatgactaaatgatcatcttgtctttggggtaagtaggatttggaagtagctttttcttctttttatttgtctacacttccaaagtttttgtaacaagcatgtgctgctttgcaataatgaaaaatagcaatgctaacatttaactgaaaaaagaaaagcacaattatcctggagtagggcaggcactaaaaaggcgggagtaagagcgatgagagtagaacgctgagctgaggctggcctccttcacggccaccttcctccaggggtggatccgtgttccagtcacctccaaacacacaaagatgtcagtgccacagaccatactttctctcacacatccagtcaaagcaccaggaggggacagagtcaccacagtgcaagtctcagctgggattgggcaggggagaggagaagggcatcaaggagctgaccaggagacacactgatctggccaggcagcctcttgcagaagtggatcccgttaacaatgaaacagatatgacatgaacttggcaacttctgagaacaggaatgtctagtggtgcttctagcctaaagtgacccagtttcagataagacagtttaatccagaactcagagggagaaaagattaatattttctcctagggaaggatacccagagctaccacagctgaaatgggaataacatgcttaaaggtggatatgagatggccaaagtcccatgaggaatggcctccaggtatgatgatgaaatccagtgcaggagggaaggtctcttctcatagtatccaattgcaaaactggtcaaaattcaaccattttctcagggttattctaaaagctgttggacttgtactgcttctttggcttctctggctcttgttccagcttttgcagttacaaaatgagaaagacctcgctgtgctgtcctccattcagtgggttctggatggattgccagatgatgtgaagggctcttggtcatggctggtacctgcaaacacggagagtgcttatcaccattggactctactgtgccatttccatcatgtcaatcatggatagacatgagataaggaggatggaatcggcagtgggcaggacacaataggaagcgagggaggggagagggcaacagggtggaagggtagagagaattgcaggaagaaggagggacccaggaatggcccaacatcctcagagatgaaagattacagaaagagggcagaaggcgagagcagagaggccatgccagcttgggctggagcagtcagattcctcaccacacccttgtccctgctgtgcccatctgctgccctttctttgccttctggccctgtaggagccatcccagccccacatcccaagccctacctgtgactacccctcccctaagccctaccagagaaatgaacttacttctacccttcgtgggccgcatgcctccagctccagctcttcttggggctccagagtgtgccagtttcccttcaagcaccagtgtcctcaacctctggcatggtattggaatctgtgccttcagaacctcctttcttcccattcttcaggacgtttgtccctcgactggacaagatccagcaggagtgggcaacacaggaacaaatccgagacaccagactgagagggacaggaaggggaaacacggggcagtcctgggtgatctggaccatctggtcacctcattctagttcacgagtggacatttagataagggaaaccaaactgaatcagaactctaaactcagtgtgcagcagggtcaccagattgcttattctatggcacctgagacctttcatcaccactgatcttcacgacagatgcacgcagatatatctaccaaggacttagaaacccaagacagtttcatactttaaaaatgtgtggaaactaaccatgcacaaacttctccaattacatcagtctccccagaagcacatccaacagcactctgtcacaacttctggaagcagcctgcctccttgctaacccctcctccatgcagatgctcacctagaggagtggatgggacataataccaaggaggagagtgtgggtccagtcctagcacaggccaggaacattttctgctttagagtcacaggactgttcaccaagccaagctgaataaacatcttattgcaatatttgcacagacatgcaactacttgctgtgaccatgacagtgactggaatgtaaggatccatcagtggtagacccaaatcttttttttttttttttccaagtcttgccctgtcgcccaggctggagtgcaatggcgcaatctcggctcactgcaacctctgcctcctgggttcaagcaattctcctgcctcaccctcccgagtatctgggactacaggcatgcaccaccatgcccagctaatttttgtatttttagtagacatggggtttcaccatgttggccaggctggtctcaaactcctgaccttgggatccacccaccttggcctcctaaagtgctgggattacaggcatgagacaccacgcctggccggtagacccaaatcttaaagcacatactctactctagtggttcctaaactttagcatgcatcagaatcatttgtagactttgttaaaacacagagttttggttacactcctacggttttttaatcagtaggtctggggtggaggctgacagctagagtttctaacaagttcccaagcccagctattgctggtccagagaccacactttgagaaccactggtctaccaccaacagtgttcaatagtatcacctgtcttatatcaaaggaaccactaatgactcactcgcactcagccctgtaacctcatccaaagcagaggcacagaaaaggccaccacacacacaaagaaaaactgtttacaaaatgtttttattttaaggttaagaataaaaggagccttagggttcatataatctaactacctcacttaatataatattaattaaactaagcttagagagggtaacttgcacacagaaacaatgaaacaatcaatagaacccaaaccaggaaccccagcagcactactctcaaaatcgcaaacgtggagtcctagaaaatctcctaatttttgtcgtcattagagtcacaaggctcaagagtctgcaactggcaaattagggcttccccttctggtcctccatgccgaagcactcaggccatgccatggtcatttcttagtaaggctatgatggaagcaattcttggttccctccaagttcaactgtgagtccactgcctagaactcagaactggttttctcagaaatcccatagcacacgtggagggttcctgggagaactcttcctactaggcaccacattgttgaactgcagtgatgatagcccacaggatctaaccatcatgaagaatataatttcctaaaattccattctgagtttcaacttggacctgtgctggtccctcttcctggaaaactgctgccccagttttctcatgtcaggctccttctgtatgtttcctcttgcagagtatctcctgatcatctacccaagtagttctcactcccctcctgccagttacactgcatctcatcagccttctctacactccttatagccctagaactatataaaacatttgttcatcatctacttgctcattaccccctgaaagtaggatgtgagcttcgagagggcaggaactttacctttctgtctaccactataaccgcagcacctagaacagtgcttgggacacagcagattctctatacatatctgtctaatgaacaaatgaatgtacagaagaatgatgagagagcaccttcttcttcttcttttttttttttttttttttttttttttttttgagacagagtcttgctctgttgccaggctggcgtgtagtggcatgatgttggctcactgcaacatctgcctcctggattcaagcaattctcctgcctcagactcccaagtagctgggtctacaggcacgtgccaccacacctggctaatttttgtatttttagtagagacaaggtttcaccatgttagccaggatggtctcaatctcttgacctcgtgatctgccagcctcggcctcccaaagtgctgggattacaggcgtgaaccatcatgtccagatgagagcaccttctttcaacgtggtttccaaagttggaatttgagactttccttcctgtttctctcattttcaatagtaggagttagactactgagctttaatagaacgtggaaggagaaaaacgtgcccttaggctggtgttctcaatgacaggacagagaagaggaagttgcagggattgggggtggtgtcgatttacttctcagctctggtgtcctttcgcacagaaagcatgctggtgagtcaggtcttcctggatacagggcttgggaggcaatgaggtgtactggaatgagatgtttttgagaccaaagagttgggttcaaaccctcaaaaagtcatgtaaatctctctgagcctcatggggctggtagaaaatacccaagggatagggtgtttgtgaggatcaaggaagttaacatatgtggacactctctgtaaatagtaaaataatataagttgctattaaatgattattgataagaccacataggctctggagagatccaaataggtgaaatttctcggcatgcatctccattcagtcttgctgttttgccttccttagttctaccagcactctcagaccccaggctgctgcgtgggagccccggctcaagagcagaagccctaaggtgctggcatgggctcctcagagccccgtggggctgccagcagccacagcacagccatgagcagggcagccaacaggaagcccaggagaagaccactgtgagaggccacagagggacacagggacaccgtcatcggccctgagccaggggcaggtgtaagaaacaagccggaagccctcacttttggcccaaatgctttggataggccagaatcccagagacaggaatatcagagaagccagcttccctcttatgaccaggccctggcttcttcatgtccttagggtgggttctacactccactcccaaaagcagggcctatacttcttcccttgccaagaaggtggggtggatggtattgggatctttggatggattcccaagattggagaaggtctcctttctcagtcttcatgggctgcactgccaatttctcattgaccaaactttaatgttccaggcaacgaggctcttggctataaggtgtcctcatgttacagaaatcacctcctctgacccagttactcccaaactgtttccactcttccttaagtgataaccttaatgacaagtctcatgcaaacagtaatttcttatcctttcttccaagagttcagttcactccagcaactggctactaactacttacagctgagcacagatttcacgcagaactgtgtaaagttgtccttgggaagacaaacacagcagccagttcctgccaccaagcagcacacagtctgggtgggaacagagacttcacgtccccaccacgaatggctgtgttttagagttcattacctgaaaagaaacagggtgggaggcatgtggggaataaagtgagcaggctggaggaggtcttcttcaagaaaacagagactggcccagctctcttctggctccaaaatgctgtgtttattgggttgtctggatcagaggcaaattcttggatttctgacaatgttgctatgatgtaatgagggctagaatcttcttgaatcaggaaagtttcagggaggttctattagtctgttctcacacggctataaggacatactgagactgggtgatttataaaggaaagaggtttaattgactcgtagttctgcatggctggggaggcctcaggacatttacaatcatggtgaaaggtgaaggggaagcaaggcaccctcttcacaaggtggcaggaaggagaatgaaagcaggaggaactaccaaacaattataaaaccatcagatatttcgagaactcactatcatgagaacagcatgggggaaactgcccccacgattcaatcacctccacctgctctctcctttgacatgtggggattatggggattacaattcaagtgagattttgggtggggacacaggcaaaccatatcagaggtgttatatagtaaggagcttaaaaaacagaaggatttcaacgtgtagaaagggagaggaagggagttccaggctgagaggagtgagtgagggaaagtaggagtgaagagggtacccagaaactggatgatccagcagctttagttcagtggggtttgaggcacttgggaactcaccaaggcgaacctgccacaagctacccagggtctccacctgccaaccttcagcagcggctctaggctgctgatgccagctagagaagcctgtctgtaaatgatgatgaatgtgtgagctcaccaagggagaaggccagaggagctcacacatcgaggagctggctttcaagggatggggaaagaaaggcaccagagaagcagagcgaagacgtggaaaccatagagccttactaagtgtgttcactcacccggctgtacctagggccacctgttgtcctcttggatggaggcagatcggctttctctctccctctctctctccctctctctgtcccacctcctctctctctctctctctcagttctgggctgggacagggaagaacagcaggactctattacttcaggcaaattttgacagatgggccaggacctgcatacagggccacccagcaggcgctggggaagggagcctgctaaggggctgactgcagagccaggcccaggtctgaagggccacgggtgcctggtttcaggttggaaagggtttcaagttgggcagggttggcaatggagcatcccactgaaaacagaagagcctcacccccaccccactgactcctgttcgctcacccctctgagcttctgcccatgccgatccctgtgtctggagcactgctcagggctccctcttggcatattcttgctgcacttttttttttttttttttttttatactctaagttttagggtacatgtgcacattgtgcaggttagttacatatgtatacatgtgccatgctggtgcgctgcacccactaatgtgtcatctagcattaggtatatctcccaatgttatccctcccccctcccccgaccccaccacagtccccagagtgtgatattccccttcctgtgtccacgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaaccgtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttcttgctgcacttttaaaacctgcttccaaactcaccttctccatgaattccctaactcttgaagtcaaaaatcgatcttttcctcccctatacactattctcacaacacttttcatacacaaaaatcagatatggctctatctcccccactggaccatagaactcctcagattagaaacggcactagggtcacaaattcaaatgctcacagagccaggcagataacataaatgggtgaagctgctggtttaggtgacatgggtggtaattgtcttggtgatggccagacaataggagtcactggaagctgtgatgaatcagaggggctggaatgattgattgattgagacagagtcttgctctgtcatacaggctggagtgcagtgatgcaatctcagctcactgcaacctttgcctctcgggttcaagtgatcctcctgcctcaccctcccaagtagctgggactacaggtgcatgccaccaaaggggcctgctgcccctcctgcccatatggagaataccagagcatgggaatgtgacctgtattaccagaactgcaattttcagggagaggccaggtatctgcattcttatatgaaattaccccatctttatgtgtcagcagcaaatccaaatttaagacaccatgttgcaagccaaataaaatgcatctgcagccagatgcaatgaaagcttgttgattgaaaagcaaatgaacaaatgaatgaaggaatagaaaagaaggagcagatgggtgggagggggaaacaggatgggtgcccaagtgtcaagatgccaagcggtgggctgggcacgctcaaggtgaccccgttgccaagctgtcagtgtgaacatcagcacggtcttgcttgttggctaaggggaagagaaaagcctatggccctgtgaacttagcaaccagcttctccaaaaacattacaatcagaagctcttgttgcagccaaaacacaggtgcagaaaacaagcgggcgttcgcacatgcacgtgcacaaggtgtgcagaagttgaaggctcagcatgccacaaattccgcactccctccaagcacaccttatgcctcatgttacagatgtcttgagggaggaagggagggacaatttagcaaattgggaggtgcagcaggggaaaaggagtcatccagccagaattctccccatctctacccagaaactccctctccttgctttgttgacggcgctgaagcttgggggaggcataagtgagcctggtgtgggactgaccctcagcctccaggaacactatcggcaggaacacagcccgtgtgggatgcctggggttgcaaaagaaaagttatttcaggttcaactgagttataatttattttttctaactgatcattactgctgcggctctataaataaccacctagggagtctgcttttctgctcccaaatcctcaaaaagcattgccaggttctctgtggtttctggcctgccaagcacacagcacatttcttttctgtgcagcccttcagggaatccttctgcagtgcatgccaaggaatctgctgagttctgcccaactcagtcctccccttcctgatccaattcctctcctccaaactggccatccagccctcctcccccattccacaagaggcccctctccctggacacaggtggttcccaagccaaggtcccggcttctctctgtttactctgcttccatccaactgcaaccctccatgcttagaagacaagagttatttgtactacagaaatccagctgtggcatcatttgaggtcaagcccaggaagaaaagagggttggtctgatggtatcaccagtaaaatatcaagggtcaataccaccccaggaagggtggctgtggtttacatgaaatcaatttaagtgatttaaagaagaatgtatttcaagtacaactcagtttaaccaagtatagaaaaaaaaaaatcatgttcctgatgatgttctaaaggatgtacgtttaggccctttctaaataacatggggttttctccttaaacagaggaactagacgggaactaatattcatcaagacccactccacaccaagcaattttgtttcattttcacaacatgatgcctatgaggtatgcatcctcatgcccatcttgtagatgggagtcctgagaaaaggacttgctcaaagtcatgcagaaggaaagaggtaggggtgagactcaagcccaagtttttcccctgctacctcctattacctctctaagctagaagactggagtttcaatgtatgtttatttttctaactttcagattacttttgcagctcagaaagcaaggacaacctggatatttcaccacagttccttaacagccatataactctttggagttagcctctccaactagttaactgtgaaatctcaatcaatcaatcaatctctctctctctctctctcaccatttattacgacaatgaccataaaggctatggtcattcaggttgctttaatggtctaaaaatgagagcttatgtatttttgaatagttttaaaaatgatcattcctaacatttacaaaataatggaaaacataagttttacccagtaatcaatgctccacggaaggttaggtggccctgcagatgctaccacagcactctgctctgttgggacaccttttccaccatattggaatggactgtttccttgtctgactctccttctaggccggtgatccccaaagctttttggtcatatgccctaacaataaacatttgagtgtacctgcctatgtgcacatttgtttatttataaattatattcatgccctgtcattcacaaaaatgggaaaaaggatgagatgtgtgtgggtcatcttcctatgtgtctatctacttctcaatcataatttcttcctgccccacaatggaccatctcaccttccatggtctccaacaccgacatcccactttggagaccactctcctaggatatgtgctcatcatccctcatttattcatttcccactgtctccagtaacacctaccctatgctgggtactatgctaggtgctggggatagtgggtgaaccacatggacaaggatcatgttttccatagagcttacaatccagcgggtgaaacagtgtcagataatgtcagagagagaaaacagccacaagaaagtaaaacaagatgatgtgatgttaagtgatggagaatgtctacaggggtaagagggaagtcacgatggaccagaccagcagctcagcaaaggcctctgtgacctgcatgaggagggggtctagtgggagagggggtgcctgggcagacagaatgtcaagtgcaaagcttccgaggcaggaaagaaggccattgtggctggattataatacatcagtaagaagagaggctggagaagctggagaggttggcagctcaggctggagagtcctgaccccactgcttactggctgggtggccttgggtattaatgctatatgctgcccagggttattaaaggaattatgtaaaggattgaaagagtaaatctatgaaacatcaacatcagttagaagaatgcccagcacacagttggcatcaacaaatgactgcccctagggtctgtttacttatttatcattagtctcccctgtggcatggaagctgggcctggccagttttctaccctgccgaaccagagtagctggcaccatgcccagcctatagaaagaactcaatgaaaatttggtaaatgaatgggttttaaaaatgggtaatggctaaggaaaatcagaatttggctaaatattaaaaaatagattttcgtaaacaattttttctaattataaaagtaatgtcatgtcttcaatattttaaacaaaaatggggtcatattctacataccgcttagtacctattttccactccacatgtctgttacaagaggcaggagaatgtaagggtagggatgtgggctctggagacagattgcctggattcacatcctacctccaccactggccacctagagcatctctctgaagttaccaagccaaaggacatttgggatttttaaggctttttaacacatattgccaaatagtctttaagaaataggtgtgagcccatctcctcaaaccttcatctacgctgactgctaacctttagacaatctttgccaatttgttaggggaaagaacaacctttcattgttctaatttgcctttctttaattaccagggatgactaacagtttttcatttgccttgttcctcttgcgaattgcctgttcatgtttaaaaaggaagcccgttttcataattagatgcagcagagtaggtggcctcaaagtgaactccctaccgctgggaagggttgagcagggccaggtggttgcccatcagggaactgggcatctctgtgccttgtggacagcagaactggatgagctctgaagtcctttattacactgggatcatttcactcttgtccagaccagcaaaggtagcaggcaaacctcaaagaaaagatggcttgcggatcaacaactggattctgaagacctccaccaggatttcccaaggtggatttgatgcctaaacatctctcataagcttctgcataaagacaccccagttatatcggagagaagagtcaaatcgacatggttatgcctctagtagctacagcatgccacagtgggggaattccttaaatctcccccttgacaagatggaaaaccttcgtggtcatagatcaaatcctaccacaacaaacatgttcataatcaaggtcagcatagcacaaagactcctaaggtggggccagtggtctgtttatctcaagctataacttttttccctgctttgcatttggctttggtacaagaatttgacataaacaccctcctaaccccactcccctacaggtatttacatagcaattttctcctgagctggtcaaaaccctgctaggacttggagaattccattgtgtttgtagtaagcagacacctggagccagatagctcttagagaataaactattcttggattggaaagggatctgaatgtatctgacgccctccttttgcaaaaattttgcagtgttttcagaggaccttctacattttcactaaggggatatttccccctaatatctccaccattgccattgttggagtttcctgctgggtctggcccccacaggtataatgccagctggaaacagaacactcacatctcttaaattactccactaacgaagaagtcacacgtggaattagaattctggctaattttcctgtgggcacaccttaagcacacaaacctgaaagcagcagagcagcgaaactggcagccaaaataaagcaaaaagaagaacatcttccaggagggaggtggaatcagattgaggcaaagccaggactaggttcttggcaacgtgattaaaatcccgaactacgagggaggagaggccttgctgccagcccctcagcacactcgagccagggcactggaggtgggtggtggttaaaagctgtgtgccattcacagcctatagcactgcctgtgtccgtcagtatgggcagaatggctaatgactccaaataaaactcctacaccatgctccatctggggaccatgttatagctgaatacacaaagtcactttgtagcttgcccgataagtccactttaattcctccaaaataattcatggaggcctgtgagcacactgcaccaggccaagcactagggttataaaaaagaaatgaaaaaagaaaaacctagttgctctactctaagggcttatgatttaaccaaggagatgagattcacaatggtagctggcaatacggtaaatcaaggcacaaagaatccaggagtgtgttctgctagaggcccaagagggcagctggcattttcaggaggatgcaggtcagcctttatgggaaaatggattgagtttaccttgaagggtggggaaattttaggcaggtggctaagaagtgagctggcctctggggatgtggggagactgtgagcgccgcatgagacaggctctgcatcctgcacatgctgcctgcatttccagccctgggaggaggatttgtgcaagggaggcagagatgagagcgttgataggaaggaaggaggccagatttcagagaggtctgaatcccacacagagaagcttgggctttctccaataagctgcagggagcagttggagacttgtgaacagcagattaacataattaaataaaaacttcaagactttagctttttgtggggatgcagactagacgagaggtgatgagaacattagaaagcttttacagtgtagaccaggctggccacggtgttggcaacgggagagaaagaaatagatctggaagataccacaaagcaaatatctaaagggcttggaaacaaatttggccggggggcggatgaaggatgagtcaggggcagttctgaattttaaaacttgggggatgtgaggtggaggtggcatcgtcagacataaagacacaggttcgagcagctttacaagaacttaaaaaggccagaccacccaaaggtggcactgactggaagcacgaggctacggacaatgcttcctcatttcaaaggggagttaacaagttaagtgaagttttatccaccaatgaaatggctgtctgtccaaacaaataagcaacaagtgtgggctctgcactcctctccacctctcttgctccttccgttgatgctcccctaacatttatctgaccataagctaagagcagtcatgagaacaagatagaaatcctcagaaatccagaactctaatccttccttctgctgaaatactgtagggcttagttattttcacacttatgcatatgcttcagtgtgtaagaactgagtcattgttttcttttctcctcccctctcccctctctttccctcctctttgccacccagcacctcctctgcctccacccccaagccactgcaaacatcctggcatgcatctctccccatccatttctgcatggctgtcaacatttcccattccctccaagcttgcctcctgcctcctatttctttagacacactgggagtctaagaaatgaactacagattcaacaggactgtggaccacagatcttgacaaagacaggcagcttgttgtgaaaagagaattggagggcaggtcagagacttaggttttaggagtcaggcaagggaatcagataaagatccctgaaaacaagggatatcatcactgcccagctttactgacgtagagacaagttttctcacttggcagatatagacggaagataagcaggttccctttcagatggtaaccccaagtgcagtggctcacagctgcagttattctgaatggcagcgggagggaaggaaacaatgaatgcacacacacacaagagcaatgcttaaggtgaaatggacttgaacagtctcaaatgcacacctcctccagttcctggaaggcaaggatgagtcaaacagaagttgaatttcacaggcgttcctcctccactgtcacatacgttcccagacgcagagtcatctgtgcacatgtcacccagcatcgactgctaccagcaactgcctcctgggaagttaagctgcagggtcagatctgcttctgctggggagctgaaagtaaactgcgtaaggtgggggtgatcccagtaatgtgagggcaggaaaaagcagagaacgctggaaaaggatggcaggaattaacatggctctgaagagaggagccaaggatcacctgatctgtagagcctggaatctgcagttatttctagtttcctagacaaccctgactaaactaggaagacatctgaactccggctcaaaaataatataggttcttggaatgggacaaaagaagaaaggaaaggggaggtgataccatgtgccagttcagggagtggggaccagaccttcagagaaaggaaggtcttcccaaatggaagctgaaatcccagtgggcattatgctttctgtacttttgcatttgtagccaagagcatgattctaattctggttctccagcggaggtgcgggcagcacatgtgcatgagttcgtcaaaattgatctaacggcacacataagatctgtacatttcactgtatgtaaattagatcctagtaattctacctctctcaattagttggttgtgtgaccttggacaagtcatttaaatttttgtagtccaggattctccatctgtcaagctgaagctaagaagctggcctctaagtttctccctggctctaaaatttacgattgtgagagctgattattgcaggaaatgagcaaatacatccagattaagaagggccgcaactattgatagaagctaagaagaatttctgaatgggattagccatctgcagaaaattccccctaaatcatccatcctggaatcagacgtggagagaggtgaagattccatcctctgcaccaaaaggaagtggcagcccctcctggctctgcattttcccctccttcccatccgctctcccctacagactctctaaattcttccactggagattccccaagggctcaggattgggacaggccttttcttcccttccttccaaatttcctttgggtttatagcaccctggtcgggttcacaggaagggaaaggagagggaagaaaccattcacatttgggtgtgcgtagcaagcagagagctggagggttacagaaacttagaggaggtcagagccagacaatcatctccccatcctatgtcttatggataagaaaatgaagatgcagaaaactagtgtgacttctcaccatttctaaagccccggaaagaacagatcaaggaggcagctgtggccatcttcaggctggttctttcacatagagatgctcctacttactccataaatagtttgtcatgggcaactttcagacagaggagctggaactaccctaaccgggcactggaacatgtgtaagtagaccacctggctcacctgtttctcttctcagaggggctctgagtcatgaggagaacctctggatatgcagaatggataaactgcttctgtcaggatggaaaggaattcacagatgtcttgccagcagctaaccagtgacacagctgaatggtagcaggcccatggaaacactctggataagaaagactatcaaaggagcatcaggtccagattgcaaattgctttagcagctaacataggcataaagacagaacgacccactctaatccaagggggttacgcttcagcgctggctgcctctgactctcacccttgacccagcccattcatcagtatgttgataagcagattctcttcacagagctccttaatctggtttcccagggaggtcttgcagagattaatgagagcactgtgcttcctgccagtttttgaggctgggacagttaaacagcaagggtgaaggagcttgtcataaagtacacaaaccatcccatcattggacttgaccccattaggtggttaactcaaacatcttctcaatgtagacacttggatctattttttttattcactctctccttggtagccagcaaaattaaagcccttcctcatatcatcgttcacgccatcttttataatagtcacagccacaacagcagctggggctaaacaaagattaggagcaataaggatcagatgggacagacaggagatctggtcctaccaaggggcatcaccaatgagctggacccactgtgcagcccacctgtcaaatgccatttgccacctctggcggtgatagcaggggcagctggggctgaatccatgaatcctgaggtctcacagaagtacagccacccctgtcatctagcccctcccctcagaatatgctctggggagctgtcacatcccacactgcaggctgatggaagacacagacacactcttgggtcctggcattatcgctgtttcctctggttacctttaaagaagggcgtctctgagtgctgggtcctccactggaaataatgtggggaaactggatgagctctgcagagatgagaattattttgaagcaaagtaagaaatgaccagggaactctagattggaatacagcttgtgaattcctaggtaggtgtagactcaagagtttataggaacttatatttgctgttattttttaaaagtcttaaaagttaaaatttacagcaatagcaagaaggaggacaaagtgcaacagctttaactatgagctaataccaaggttaacactatctgtccattacacgtagctttgggatttggcaaaaaggaaaaaaaaccacataacacggagctttgagctcataaataggtcccaaagacttgacaaataaactaacaaggcttttatggtagaagggagcatcgaaatctgaggccttctgtgccttctctccccgctgctgtgatggcagctggcaactgggccctactgtccattaacaaaacagagagacggataactatccagccgaggccagcttcctcacaccaggcagatccacagtggactctcaggaatcttcagcaccctttacaccagcagtggtcaaagtggggggtgcagctgccttgggactgagagatggggatggacacatctgcagggaggggtcaggctctagcccctttccccaggccaccactcctcagaggctggtcctccaccccagcttcagggacaggggatgcatggtggaaaccactgcagctgctgcattagcaaccttcaagagccaaagattctcttctctctagccagagagggaaggcaaacaggttagggtgacctgcagctcagggtcggccccaggccaggccactgcctgtactgactcctgggcctctatgcagtgcactccactttctagggcaggctgcttgccaaggattcacagtggacctggctgctccctgtgggactcactggatctggacccaggaccaagcctgcttgccaggagcagaaggtcaggttggtttaaaaaggtaacctctgtcctttcccagttccgttcctttctcttccccagctacctcctcctcttctccaaatcagccttctcttggctcagtttctgaccttgggtattttccccaaggaacacatccgaccatcaggcactcaaaggagcatgagcctagtcttttcctcaagcaaatcaccccggtacagtcagcagctgcagagcacagggagctcctggcatgctaaaggtcatttacagatcactgaaaaatctggacaagatgctaatgtcccagctcaatgcccatgtcctgacttaaaccttgactgtgtcttaaggacactcaacgtcaggatacctatgacagaaagagggacttctgagtatttcaggcataacaggcaaaacagacatctttaaagcttgcaaaatatatgattctgtcattcctctgcatcctcaccaccaccatgatggagagccagggccagtctttccaatcatcactcaagcttccagtggctattgggcactctccctcttagagaggggacactccagcaggaactccaggtagagagctgttctgcagtgggcatttctagctcagggccagcctccgagactctccaggagtggcatgaaatgaggtggatggggcttccttgtcctggccatcatgtgcctacagcaggcattggcaagctttttctataaagggccagaaagggttatggaccatcttctttgatgtttttattttacaactctttagaaatgtaagaatcatccttagtttgaggtgccatataaaaacaggcggcaggcaaatttggctcacaagcaggctgcagtttgcagaccccctcctagaggaagatgctgaggcctcaccaagcagcccctccccaccttccctctctagcctgactcctccagactcattccagctgcacgtggcacctgtactaggccgcaggatggccttcttgctgcaggcatttcaatgagaaaatatgctgcatggatcatgagtgattctgtctccctcgtgcttaaccttggaagcacaaggccctgctggcctcacctcaaggtctcacctgcccatactcatgcgaccttgtccaccatctctccactacgaggtgccatctggtaaatggcctaacttgggttcttcctcccacgcctcctgtgtaggttcagggcagggagaccaaggtaaatcctgtcagttctatctgaaggcagagcctggatccaatcacttcccacccctccaatgctatcacctagaacacagccacagcctcccatctggactccctgcttcgatctctgccctcccccctccccttccaaaagctcccagaggctttccatctcactcaaaataaaagccaatgtctctgagcagtgaaagccacccaccatggtcatccaggtcctatcactgacctgctgagccccaactggcccgcatggccacctggctggcctcagtgcctcctctttcccctagctgatactaactccagccacactggcctccttcctaccctgcttttcctcttagccatgaacaccatcagtagttatataatagtttgtgggggtttttttttttttggtcttgtttttctcactcaaatataagctctgtcaaatagagtctgacttcagtgttacactccagggcccagtgtcagccttgggtaggtgctctacaaatatacaaatatttggagaatgcatggggacaggatgccctgctgatgggtgagagatggtggcactgtcatgacactgtgtatcaatttgcacttggatacttttatgcaaataagtctcttgctcttaagtcccctcctcccccgccttagtagccagatgaaccgataagacactgaaaacagatacacccctggagacactagtctccaattttttgtttatattcaaccctaaagcaataacaacaaactcatattccaactgaactagtcaattatctcaggggaaaacaacaaacgattgctttatggtttagagcacacctgtgcgtggctctcccgcactcaccacaaccaccctcccatgagcacagcaaggaaagagaaagcatgggcttgctcagcagaggtctgggtttcaaatcctgacactgccatctataggtggtctgattctggacatggtaccaagtacactaggccttagctttaccatctgttaattggggatactaacacttatttcgtaagactgttgtaaggcttaagtgaacaattaaaacaaaacagacacctaaagcataatgactgtgcacattaattgctcaataaataggaatttctccccttttgtaagtgaggaagcaacagttcagaatgtgaaatgatttgcctgagatcagaaggcttgttcccagcaaaggtggggttcaaagcaatggtttctgtggatgtattttttccctagcatccagcctccttcctgttcatgtctacaccctataggctacttatgtcagtagaataaaacaggtgatggctctcccatcgacctgcttgttgaggattttgggacagttccattctaggctaatgctcattactaaagacaatgctcattaataaagacaacgctcttaaggaggtcaccccctcacacggagaaatctgtgtgtcacaagcaagggatcaaaaaagctaagagaattcacctgccctggatatcaactgcccttaagagatgcaaactaaaggtgactgccttcctttccccaagagacaaacggaaaccccactcagtgtgagaagagcacatgccatggaggccccagaccagtcagtgcccagtgaggagatgacagagcctgacgcagctacatctgagatcagatgccaaggacacagcaaagactgatgaagccatacgtgagacaccaaagtacgaaactcacattcaactcaaaggtttccatgtttgatgactgttatctccctgcacagtgtttttctttaaggagcacatgtgttctataatcctataaagtaaatttttgaaaaaaacaaaatgagaaacaaagggacacacagaaactcttgcaggtgacggatatgtgtattaccttgcctgtggtgacagcatcatgggtgtaagcatatgtcccaactcattagactgtacacattaaatctgtacagttttttaatatcaattataacctcaataaagttgaaaaaataaagaaaatttttgtagaacaaaagccttctcccattagctttcatcatgacattgaaatgtgttcctcttgaaacatattggcccctgacattataaaaatataaattattaaggaacaaatcttacaagtaacacgtttggaggacaaacaataaagagatggcctaaacaatgtctaaacagatttgaaacggagcagaatgtgagtgcgtctgactaaaagaggaggcttttctcaagtgtcagtcctgagacaaggaccctgggactgctgacatcccaaacatagtgcccctatgactccaagaagggaaggtgctgcaggggtgacggtccctccccaccccaccatcctcatctggctgatccctgctcatgcctcagaccttagctgaaatatcacttccccaaaaaaagccccccagcactagattgggtgactcattcactcattcactgagtcatccattcaacaagtgattactgaccccctagtatgagtcacattcgacttatcactctctcttttcaacgttgcaattaaataatcacacacacaatactgatttactgtctgtcaccctccctaaactgtcagttccaaaaggacagagattgtatctgatttgtcatttcattcccagcgcctgacacagtacgtgcaacatggtaggcatcctgtccatactggccgggtgaacgtacaaatgaatgaattaaagcatttgaaagctccattcatattctaaaattccaaaatgcaccctgctgtctactttacacagggataattgatgttacaatcaatatgacttttaaatttaacaaacgaaattgttttatttattaatctactagtaagtgaaaacaataagatgtaagacaacaggaagaaagttactctccctgagaggacagaacctgcaggtgttatcctgggactggcagaagcagcatagggtcatcgctgaggggagtgtggatagagtcaggctatctgggttagggtcttgacccctccactgaccagctatgtgactctgggcaagcaacttaacctctctgtcttccagttttcaaatctgtaaattgagaataagaatatcagcttcagataatttcattaacaagtaaatggattacgacacgtgaactgcttagaacagtgcctggcacgtgctaagtactcactaaatgtcagttgtttttattttctggaagaatgggaacaagatgggttaaaaccaaggacttggacatactgtcactaaattcacaaaccactcagaccaaatctccaagatttcctattacaaaatgaagtaattcaaaggcaggtggctggatgggttatctactccaacttccagacttactgctttacctatagaggtgatgatgccttatccatctgaaattaagggccaggtcaaacaaaccctcaaggtttctccaggactggagtctgggatttgattttatacaccccacagtgcccagcacaatgacgaacatgcatttaaagcttagaaaatgttcactgtgttaatttacaatgaataccatttaaagctaaaaaaaaaaaaacccctgcatattctaaagtatattatctagcatatgtgctagccccagaagaataaaatgcagaagtgaacaggagttgcttcatggaactgaaattaattatacacaattatctctgagatctttaaacagtaagtgaacaatgaaaatgtagattcagaattctcctggtaatgaataagatgatgaacatgtttccacagagggtgggatcaggttgatctgctgaaataaccagatagcaggataatttcactatctacgtgaaacattatccaagaatctgtgcgttactcgacaattaaatcagttcaaatgtcttatcaatgatttcatagaacaaccttcaatgagttaacaggaacccgtagataaaagacaagaatagggctacgtcaagaagctcaaaatcctcagctgctgataatgcaaaaccttggccacattgatgagcccaagaccaccagatctctttatactgagtcattttttaaagaaaacttttattttatatgttagttttccttataaaaataagttgtattgaggtataatttatatacagtaaaatgcaaccatttcaagtgaacagtgggttttgacaaatgtatatacccaagtaaccactaccctaatcaagatataaaaacttccataatgccagaaagttccctcatccttgataaaagaaaaacttcagccgaattaaatttaaaggagtttaattgagaaatgaatgactcgcaaatcaggcagcccccagaatcacagcaggttcacaaagactccaatgcagccatgtggtggaagaagatttacagacaaaagaaagggaaatgacatagtacagaaaacggaagtgaggtacagagtggcgggattggttacaagttggcatttgccttatttgaacacagtttgaacacttagcagtttataaatggttgaagtatggccacagggattggccaagacccagctattgttacaggcacatactcctaaatcttgtctacctattaagctaggttgcaattcatccacaagaactcaaatatagaagtacggagtccttctcaggccatatgcagtttgctttaacacactctttctcggttaatccctgctcttatctccctctatcccaccccaaggcaaccatagttttgacattccccctatagattagttttgcctattctaggatttcatgtaaatggaattgtacaatatatatatacttgttgatatctggcttctttcagtctaatgctttgaaaatccatgcatgtttttgcatgtgtcggtagtttgttcctttttattactgaataatatctatttgggtggactgcaagttgcttatccattccccagttgatgggtatttgggctgcttttagtcttggactgttttgaataaagctcttatgaacatccacgtacaagtcttccaccaacatatgtgttcacttctcttgagtaaatacctaggagtaaaatcactgggtcatatgctgtgcatgtttaactttctaggaaaatgccagatttatcctgaataacagaaatgatcaactgatttactattaaaggacttactggattttataaggaaaagaggaaacgagacgaaagaaaatgtagtgcatctgaaagcacatgggggctgctttgctgaaggggctggcaggcggcttcccaggcagggtctgctcaggactgctctagccagatgcctcccctggtgtttacttcacccacaggaaaatggccaccttcaccccaccttcagtggacgtgcagccccttcggtgctcctctcttcatctgccttcagaggtagtcctgattaacctgttgccagcagaattttctaggagagacaggacttgggggtaccactaggccccggggacatgcactcagctggcccaggcaccgataacctagcatgtccttttagaatttgggggatcccggcacccactgttctcagctttgggcctcagctaaggccaggacaagcatcatttaatgtcatgtcatataattagtatggaaactacaaaaacctatatgtttacaaaacaaccactgatctacattatttcagaggtaatgatacttttacatgagataacttcccaagacactaagctgaaattagataaatttaggttttctgtattctcgctgacttgtgtttttcacactggctttatcttggtttctgagggagaatcaattctctttaactctcttccagaatacctcactaccttcagaaaggaagaaggagggaaaaaaggacagagggaaggaggaggattagaattcctcatatcagagaatcccagagctttgaagctttaaagtgaattcaagagtgggattcaagagaccaaaccatggggtctaggggaaataaggaacccctctcccagaaggtggagaagcttctcaaagcaactggcccaggcagccttgtacttgcttcattctggggtcaggaagaagctgcaggccctccttcccaccctcgcttcccttctcctccacactgtcaactctgctccaggaaggggcagtatccccagtgtctgctgggccagcacagccatctctcacccacctgagttcataatgactcctgtgtagagcagacttcccttggcttcactgaaaccattccttcttgtcttagaaagcaatcagaaatatagttaactgccttaaagttcccttatcattgaaatgaactagatcacagaagtgcctatttgcattttttattcttattcactgggtttttaaaaggagccaagagaggggagaggaaatgcatttacttgctgggatttcacttgggatgttcatgttcgtctggaaagcaaaataaaggcatgaagattgcccactgatttcctttcatttggagaattctgcttgagttaggcttagctggctagcacataaacctgtcaagagaaaagtcttcctcttcctgggcctggtatgtctaccacctggggcttcagagacagtattctaggagattcacagtgtctaaggttcgaaatgtggacttcagcagcagggcagctgccaaacgctttcctgcccttgcagaaagccaccaccaaactcaccaccacctccctcaccgtggcctctctgtttcagtatctgagcagcgggtgaggaggactggattctagaagataaagagagactccacggtacagaaagtaagccctcaataggattctattagaaaacagctggaaggaactgtggagtcactcagtcccatggctgattttacagacaataagcaaacaaacaaacagaggccctgagggatttagttagcggtctccaagtgccagtccctgaggaaaggattctcctccccagctacctttcccttctccagtgtgtccacctcaggaaaagggcttgcatcctcccagctgctcacacacaacttgggctggccttggtgctggctctgtcctttctcccaccagatctgccttccgccctcgccacttgtctctgcccagggctcacttggaaggaccacatcaatgaacaaccttggcaggtcacagggagggatggagcgggggagagaacagcaaataggcttctgccctgcaagagagggagagccagaataccagcctggcttgggctgctcccgaaggtcctggctgctgcctgcaatgcagcgccttccttcagggctccagcaccatcccctgtcctcagcctttaaggctctactgctctcagccccagccctgcccttgaggctcccctgtaccctgtctttgtagatggtgcctgggaactgtcccgcttggagagtgctgtttgctaggatacacactgactcccatggctcccctccagctccccatccatcctgctcctggccacggcctctggcctgaagggctgcaaaacagccttccaactgggttcctggcttcccttctggcccctcttcatctgctgtccccagcagcatacagagctatcccatgaaatataagtcagaccatgtcatgccctggcttaaaacctctcaatggtttcctctggcatctccagtaaaaatcagaactccttgctgacttttgagagctgctctagacagggctgctctctgcagcctcctcttgtgccccgagcttcaggacactccagcagctgtggggcctcctttcccttactcatgaccccaggctctgccctgtctctgggcctcacacatgctgtccctgtgcctggcaggtgccccgtcactggtacaggctgtccccacccctctaggagagccttgccttagcagggtacatgccctgcaccttcttctctccacgaatttttattctctatccctggactgtgctcatttctttccaaacacctaacaaatttgtaattatgtgattttttgtttactttttaaatgactctctcccccaccgggatgcaagttccacatgggtacgaactaggtctgtcttgttctccacctgacatacaacagctactctagtcacatctacaaaacagcaactgggtttgggttcctataaagtggacaactctcctttctggggaaggattgcttcataatctgagattatgttccttctactttgttggggagagtgttaagttttttttttttttcttttatgaaaggatagtaagaataaggggtattcatcaaaaatttttaaatgataacctgatataattctccaaaatgtttttaaaatttttgagtctatgatatcccagattaagcaatgttttgggagtcacagtgttgggtcctagagaggcaaagagataggtgaagatagtgacagagaagagaccggctttgcagtcagactgcagggcctgggttcaagtcccaactctgctgcttggtagctgtcaaactctgagcgagttgcttaaactctctgtgccttagtttcctcatctgtaaaataaagataataatagaacctgtttcagaggactttataagaattaagtgaattaatacttgtaaagttaataaaacagtgcctggcctatagacaatgcttgacaaacattactgctatcattattatctattattattattattgctattgttattattactaaacccaggtctcctaaatccccaaccaggactcttttccctttaaaatgttatctcccagcattgtctctttaaatgttatctggccactcttaaatgtaagactgaaattcagcacttggaaaactatcccactccagccaagcacattttttgaatagctaaacactaaccctgataaaatgtatccatttaggatagaaatgtttctacaatatgttacatcttgtctactttctaactgggttttttgagatgagtatcattacagaaattatctgctgtgcagcctggaaacagcaaaaggaaaactcagcacgttctacagacgtgggttcaaagccctgctctgtcctccctccaagccctaaacccctcctgagtttcagtttccttactgaagaagtgggaaggccatgtgcattgagaggttactgtggttttgagtccagtgaatacacacactgctaaatcctaaaactcttctttcttttttggttaataatattaaactcatccaggagaataccttaatttaagactccaggcagaattctcctttccccaagctctgccaacacccaaacccctccccagaagacagcctggttcacacaacagaggaacagacccctcacgactctgcagggggaattcctttctgggagagaacacatgtccaatagggccagtccccactcaggctgctgctgtcactcagccagaaggcaggacaggcttttgaagctgtgatatttctgagtttggttttggacaaaaacaccattcttcctcatagcctttcacaccctgattcaagcaattttaactgaattctatttcccttcaatagaaggctatttgaagatacaaaaaccatatttgtgaatgaattctaggattgtatttgcagagtcactcctgttggatttcgtgctctataccaagtgtatttctacctctgggcctcagaaccatttctcacaccccccaacaatatctcatgccctcatatcccaaatatgcaattacctatcagttgtgaaaggtaaaaataaaattcatatgggtttcataggtcaatggttcatgttaaaggagacccatattaaataatattattaagtagatatttataaggctaagaataaaaggtggggaaatgggtgggattcatcttatctttctaatgttcattacctagaacctggaaaccaaatcaatgaattttctgactacagactcaacaaatatcatttgtttttaatgataatcagataatttaaatcagataatctaaatcaggtaatttagaaatatctgatttctaaactagtcctggactacacttacaaagaaacagcactgctatagagaaaggatgaagacataaattggagacaggaaacaggaccagattcagaacactattcctgcatatgagatttaaagaaatatacatacataattttacaactcctacaaagcctaattttatttgtaaaatataccagggtatcttagcaagtttctttggaaccacgcaactaagagtgctttttaattaattgcacatctagcaatccacaaatacgaattaagcaccatgagttggcactgaggagaatttaggtctgttctcccacagagcaagcaatttgcgaaactttgctctaaaacacataaaaaccctggccttagctaccaattttaaggatgttctattctgcaagggttcatcttcattctctccaaaaggatatgagggtcctgctgtatttcaatggaaccagacccccaaggctcagaaatcaatcatttcacaagaaaaaaagggtaagattatatctaaacatttcattagcataaatctgaatgtgtgatatttggtcattttgtcttagtttacaaccacctttgcaagtgataaaatatagattgatggtggggagagggtaggagaagaaaacaccacactcacatcacgggatctaaattccaccagcaggggtgggagctgaactggcctaacctgaatgtatgtacaaaagaattccttccttcctctctccctcccttccctcctccctcctcctccctctctttctaactccctcccttccttcctctccttcccccctccctccctctcttcctccctcctcctccctctcttcctaactccctacctttcttcctccccttccctctcttcttccctcccttccttcctccccatctcctgccctctcttcttccctccctccctccctcccctccttccttttttttcctacctttcctttccatcaacaagcccaggtgatggcagggataccgcatactccacttgtctcttccacggctggggatggctctatcagcacttgccccatttttaggttttacttcccaggtcatcccagatttataatccatgcataatgcaggcacctaagcacttctgggcccctactagaaatccagaggcgaacaaggcccagtgcctgcctgttctcaagtctccatgcaatgggcaccctagcggaaagaacacactctgagattaatctggcattgcaggggacttgcaggacctgttccaggtgcctgacattatctatctagaagaggtctccctttcagcacagttattgcctacatgaaggtggcctctctcaactgcacaggatgtgccattcgccaaggaatactaggcatccctccatcgtccagacagatctcaagtgagatgctcaatccctataagggttggtttcccctcagtggattacaacactcagatcccaactttccactgcacaggataccttgcagccatttggttttgaatgaccttctcttcccctcttcctgaaaatataagtttccttattgaagccaattaaagccaattctgctttaacatattctggagcacttcacagcatgctttaaattaagcaggaacaccctggtctagtggtactgcctccaaggcagtcctcccttcatctccctgcctccagccaataccctgcttctctgtctcctcagtccacctctgcctgctctgtccctggtttcctccacctagaaaagtgcatccaactgattttaagtacctctgacttaggggtaccacactgtgaaacctctgcttctatttcctcttctataccttgcattgcaagaaaatctaggctttttattcattttttagaaaaattagggaagtcacagcctaggtagttactagaagaaacaggcaaggccaagaaaaatagccaactcacatagagctcttcttaggtgcctagcatggtcttaagtgctttatagatactgaccattaaacctcaccacagtcctatgatgtagatattattagtgtgcccattttacagatcatgagcatgaagcccaaagaggctaattagcttgcctgggatcatcctctcttttttcttttttctgagatgggtctcactctgttgctcaagctggagtgtagtggcgtgatcatagcccactgtagccttcacctctcagtctcaagcgatcctcctacctcagcctcttgagtagctgggaccataggcatgccaccatgcccaagtagagatgggggtctccctatgttgcccaggctggtcccgaactcctaggctcaagcaatgcccccacctcagcctcccgaagtgctgggagattacaggagtgagccaccatgcctggcccatcctcttaataaatggtagggctgagatttgaacctaggggcctgactcaggagtgagtactgcttaccaggaagggaatgtggtcagcatgacaacaaaggcatctctgtcctccttaaatgcagcaccaactctgtaaacacacagcaggagctctagatacaccacgtttgtacacatttactgagtctacatttccatgtcaccttcaggaagagtggattggcttgggtgaggagaaggaagaagagcggagacttccgcccttgagagattctattttaatttttaagaaaacactgaacagaccaagccctggatttcaagatcagttttcgaggtctccagacatgaggcagtcatctgaaaaggaagacatgacagaggagtctgacctctgtgtggcctccttgctctccctgcactgccttcagatctcccagtgaataggaaaggaggggagacctgcatctgtggggcgagcatcccctaatcctgataggcttcaaaaggttgcgaaaggggccacattctctagtactaagacaatggcattaaatctaaatttcttgataaccaaactaaggcataaaggccagttaactatgtctagttctaatataacactctggaacatgccctgtgttatcttagcctagcttcctagaaatactgaatcgcaatattccacaatgcaagttcctcccactaaaggcctctttggagaaaggagttggctgtgacaaaggctgtagtatatagaggatgatcgttatggtggtgatgacaacagtgctgatagattagacaatagcaacaatgaccatgagggcaacgaagaccatgagttgtgcaacatctaatacaggtcaggggtgaatacttttgtgctgactgcttttcaagcattattatgttatatcttcacaacaatgatgagaggtgggtatcagcacaatgccccctttgaagatgaggaggagttagatgagaaaggccaagtctctggggcaagttgccataatttgggtcataacatgaacccaggccaatctgactccaaaatttcacattcttatccactgctcatctctctcttcctattagaaaaccttattatagaaagttctaaaaacgatatgctgattagtcaaattttctggtaaatacatagtaatcagttccaaatactcaattgaaaaaaattgccaaaatgttcatggtccccagtcctgccttagtaaatatagcacactaaatataaatctagttctactttattaatagacacatgatggactatctcccagctatttgccagaacaatctgttcttattgtagagtatttcagatgtaggtacagcattgagaaggaccatacactcagcccagggcatgctctgaaactacggtattaaacattaaaatctttttaaaaatgtgttttattatttgcctttttcttacaaaacttcagtccaaattatttgggttgataagtagaagtttcactgtagtaaactgtaccaatggctgcctgtggtatgtccagagtgtaagagagttgatgagaaacaacaaaagaaacaaacaaaaacttgaaaatataacaaaacttggcataaaaattaaaatgaccagccccctgatcctaaggaaagtccattttctcataggggcagtcagtatatttttatcttgtggcttaatgtttttgtagacacattaaatcataaaaatccaagaaaccatatctcactcccaaaccacacaatgtattttaaggaatatgtcccttttctaagaaactgcttgattttcaggaagtggtaaagtggcaggtgtgttcccatgatcagccagagaaaccaaataaacgttccactgggcaaacctgtttctcacagataaacagctgcgagctgcacgcgggagggaaaaggatcgtaaagactgcccctatgtctgcctgacactttctggttttctgtttcaattgaaaaggaagatggcagcctacaactgagcagaccctactgtggccaggccaatcccagcccctgcatgggacaggagtttcaaaatcccagcactagacagaaggctgtggtcatctctcctctaggtagacctgggaagggataattaaactaggagttgcaggagaagcagatttcccatgaaaaagacatcatcacacaattaatagctaggcttgataggaaggggaaggaatgtccctttttacttacttccaaggcagcctccaccttgcttctcataccacccatcacattggaaacaatcaccagtctgtatcctcagcagactgtgagctcctggaagtcccctgggcacataacaagcactcaatcaatgagaattattgttattacagtgtgtgttcaagaaatatctgttgagtgagtggaacagaggaaggaatgaaataacttgactttccatttggaaagtgtcttgctaaatccttgctgttagagttcaggagttgggataggatttcctatactgccactttggtttgtcatgttgtaagcagggttaaaggcaaatttttaaaaatatgagacagggctgaactggctttctgtctagaaattctagattaaaataagggtctgtctaggagcggggagccagctggctatttaggaggcttggaggttaaagcgaagtctaaatggagtaagagacactattccaaggggtcccctggtcacacagaaaatacaggggcagcattcagactacccaggagtctgcaggacttggtatgaaagagcaaaaagaaaaaaatatatagacaacctaggaggtctgaggactcacagacactgactggctggggtgggactggcaggagctgctgggaaggctggggcagcttctcagtggtcctggcagtaaatactatccaggaaaagtgtgccttgcagtgagagagctgctgggaaaacggcctggacaatcagactgcagtgctgtgagctagattgcccttcccctagccaagaggtgtctcccaccacccttcccctaagcagcataagagtgaaacggggtggacagctaatgcccactgacctcctgctatggaccacaggcactctcctgcgaaatgcttgtgaggttggtgacatcaacattacactaatgacaaaactgagcctgagaactgcaactcacctgcaatggtacacctgacagcagaaccagaactttcactgaaggcttacctctccagggccaaaagagaacctgtgaccccacaggatcgagcctgccccctcaatgcctgtcagaggcagcctggtgggtgcagaatgtgatagcaagttgctgttggcacggcctgctcttctgacagctctgcaggttatttctcacaactttgctgccagcttctccctgcctgtcgctgacccctgtcccagagccacctccatctggaaacacccaccccccaactctaaagttgtaaccatacatacttaagctagaaaatttaaaaggacaaagcagaaaggaattaagaaaaaaatggagtaacctattattttacagagaaataattttaacattttggattaattccttcacatacttttcttttgagatggagtctcactctgtcacccaggctagagcagtgcagtggcgaaatcttggctcactgcaacctctgtctcctgggttcaggtgattctcgtgcctcagcctccctggtagctgggattacaggagcacaccaccatgcctggctaacttttgtatttttagtagagatggggtttcatcacgttggccaggctggtctcgaacacctggtctcaagtgatccacccaccttgacctcccaaagtcttgagattacaggtgtgagccaccacgtcatgagccccctccagtaattttctatgcatttagatgcagatactgtttgcctgtctttaaaatggtgttgcaccagactaactgtttagaggtccacttccctgctcagctgagcactgacacatgcaacctgccacctgggaggatgggcaggcattcccgaaatgccatcatggctgctgctaaccatcccgggattgcaggcaagtgcggctgatgcagaaggacgttggggaatgcggacatcaggggtttgcaaacttgtgtttctccctccactgcccatcctgccagcctcagaaggttagccatggagggtgggccaatcccaacatactcaaaaatttaaaatcctgaagggttagcattggaagggattttagaggctatccagcccaatcccctcacttgcaaatgaggaaagcagagctgagagagatttagcttgtgctgggttctaacagtggctccttgccaacctcaggctcctcctggtctaccgtctgtgcctggactctgctccagcacccccacccacccacccacctgccccacttggcagagggcagcagccagagaaggcaggcccaggtgggggacaagagtctcaggactcacctttcaaatttaaagaatctctcgttaccatcaccataactcttagcccaaccattcctcttcagatccaaggatatctaagtctgactgtggaattttgttgcggaggattggatacagctgtcaaattccaaaggcatccagtacccatgctctccacagagcagtcccttattatacaagctctgcaccagctgagaaccatgttccagtctcatattgctcagaatctcctctgagcttcacataactcaggcacaatctccctgaatcatatggcataggaaagtcatgagcagtaagacttggttcaagaaaaaataccaagttctgaccactcaaagtacccttaggtgctctcattcatgtgagctttccgtttcctgctctccagccccatttcttatttgggttagggatcccctagggctgctcagtggtagggggccactgaattcaaagcaggccactgtactcgaagtagatggctaggaaaaaaaaaagggccagtcacagtggttcatgcctataatcccagcactttgggaggctgaggcaggcagatcacttgaggtcaggagtttgagaccagcctggccaacatggggaaaccctgtctgtactaaaaatataaaaattaactgggcatggtggtgcatgcctgtagttccagctacgcggaggctgaggcatgagaatcacttgaacccaagaggcagggggtgcagtgagctgagatcacctctgcactccagcctgagtgacagagtgagactccgtcaaaaaataaaataaaatccttccttccttcctccttcccttcctccttcccttcctccttcccttccccctcctcttcccctttcccttcccccttcccttccattcccttcctttcctttcattccctccctccctcccttcttccctccttccttcctatttctgagcacttctttcccaggcacaaggtaaacgagctttcaaatatagcacactgaatacccatgataattctataaaatggatcctattcttcccattttaaagatgaagaccccaaggctcagagcagtgaggtgcagatttactgtgatgctaaggaagaaagtttcagggccctgccagcatggacccctttcaaggccctagcaatatattcttagaatcatgtaatttttaaatgaaatttgcagtagtaagatattttaactgcaattgatgaagagcactgtatctttcaactctgatgtctcctcctgatacatttcccctcatgttcatattgaatggtgttacagtagctataggtgttttgggatccagcataagggaaagttaatttggggataaatttagtttgggtgtagtgggatttatgtctattgttcacagtcacgttaatgcaaagtcaagtgattgttagctgtccccatggcttccagtgctaagctttccacaactcaatggctttgagactcaaaggtgcaatacctggcacctgagacataaaaataggggagaaaaaataggattgaaatatacagagcggtccgggtgcggtggctcacacctgtcatcccagcattttgtgacaccgaggcaggcggatcctctgaggtcgggagttcaagaccagcctgaccaacatggagaaaccctgtctctactaaaaatacaacattagttgggtgtggtggcacatgcctgtaatcctagctactcgagaggctgaagcaggagaattgcttgaacctgggaggcggaggttgtggtgagctgagatcgcgccattgcactccagcctgggcaacaagagtgaaactccatttcaaaaaaaaaaaaaaaaaaaaaaaaaagaaggaaaagaaaagaaaaaagaactatacagagccagaagctagagcatagaactttcttccagtctttggacatgtggaattgaaggaaaatttagttttcactgatgcctattcgaaaaagaaagttttctcctatcagaaatgtatttgataatataatgaatacagttataaatataccagacattttccccctttttggtgggaattacacaaaatatattttatcaaaattcctgtattgtaggacccaaacctatggcagtaaaacaaaaaaaagtggatgtctgtgtctgaagccatgttttatgcaatgtaactatcaataataaaaaataaatattgtcagtcatgctagaagaaaagctaaattttctttgcaacctccctttagaaaaattacaaaatcactatcatatgaagaggtgatcaaagtgtattcagccaaaatatattcagggaaaaaagtattatggaggtttcacaggcaaataataaaaatattttgttatttttctggattttataaagtttgtgatacatgtcaggttttaaaaacgtatattgaatgtgatttattttcttattctaaataaatattcaccatggtacctaattttgtatttgtaattttatattctttttcttaaagaggtcccccagttgcttaaacttcaagccctacaaaatctcaacccatccctggaggtgaaataactttcccagccaggaagtggcagacccaggactagagaacttggtccctgactttgggatcccctgaacttcacacatttgtgcccagtcatccatagggcagcctgggctacaagggtcagggtgctagtggagaaggtcaaaggatgatgaatttgtaaactggataccatcactgcagccagcacatgtggcttctacctcacctgagcagacagcaagaggttttctgaagacctgagtatgcaactgacaaatcccgactctgttaaaaccaagtgcccagattaaagataaatagccccaaatccccaaacaatataattgaatctggtttgattcttctgggtgtcacattccctaaacttgcactgtccaaaatggtggtcctggccacatgcggctatttaaattaataaaaatgaaatgaaataaaaaatccagtccttcagttgcagtaaccacgttttaaatacttaatagccacatgtggccagtggtttctgagtcagacagtggagatatagaatgctcccatcacacccccaccccaggctctactgttaagcccagctgaacttttttttttttttttttttgagactgagtctctgtcgcccaggctggagtgcagtggcgtgatctcagctcactgcaagctccgcctcctgggttcacgccattctcctgcctcagcctctcaagtagctgggactacaggcacccaccaccacgcccggctaatttttttttttttttttttttttgtatttttagtagagatggggtttcaacatgttagccaggatggtctcaatctcctgacttcgtaatctgcccaccttggcctcccaaagtgctcggattacaggcatgagccaccacgcccggcctagcccagctgattttaaacagtctttactaagacatatctaagcccttcttctcaagaagagtgtttgcaggtgagtgtggccgatatgtgaggagagaggagaaggaggagaaaggaaggcctatccagagagaagagagggacagcccagctgagaaggggccaaagagggggaaaaaggaaatagaacctaaagtgactgaggtgttaggccttgtagagaataagggcatcatcagatgtgagccaaggaaatgattcagatcacacctgacagaataaggaggataaattagctccagaatcagttatcacatacctcatgtaccccccaacatacacaccatatacctcacaccccccacacacataccacacacacacatgccccccacaccacatacctcacacatgcgcacccccacatacctcatacacataccaaacacacacacaccacatacctcacacatataccacacacacatgcccccataccacatacctcacacacacaccacatacctcacacacataccccacacacgtacaccatatacctcacacaccacatgccacatacacacacaaagaccacacatgccacacacacacacaaagaccacacatgccacacacacaccacataccacatacacacaccacatacctcacacgctacacacacacacacacaccacacaacacatacaccacacacaccacacatacgccacatacctcacacaccaaacacacacaagcaccacacacacaccccccacatacctcacacatcacacacacctccatatacctcacaaacacacatatctcacacacacacacaccacatacaccacacaccccacacctcacacagtcccaccccacatcccctgctacacacaaactcacacactttaaagtgtgctttgcattccaagtctttgctgggaaaccttagttgcagctttacgtggctggaatatcaaaaggcaggagttgtggagtcactgacaataacatcatccaccttctcaatgtccccgacactgccacctcattacccaaaagccactgccattccagacctacgcagagtctgaagggcagcacccccttctccttgggactggagggacaccttgcctcaactctcctgcagggcctgaggttaaactctcctgtattccaccatcaaaggacagcatgggggactctagcccttttaatgggctgccaagagcaaaaattcacgcattctagagtatgaaagcccggcagggtgggccttcatttcccatatgttagtgtgtatcgatggagagggtagggagccctgtggggaatgagggcacccattgtcccctgcagagcagttgtggatggagctcctgtaggaataacggactctgattaccacggtgacactcccaaggtgatggctctggatagggtttgcagtctcctttatactcatcactcccatctaatcctcacaagaaccctgctccccacttaatgaacaaagaagcaggcctagaaaggcaagtggcttgcccggaattaacaataatagtttaaccataataacattgccccatctgctcaccatccaatgaacaactcaagtgacagcacagtggttaagagaacagattctgaaacagatgtacctggttcaaatcctggctcggccaatgactagctttgtgccactgggcatgtgattcaattaccctgtgcctcagtttccttgtctgtaaaatggggatgatgatagtccctacctcatgggttgctgtgtggtttaaataaattttcacatgtaaattacttagaaccaagcctggaatgctcagtcagcactccttaagtgctggctgctttggtgcaggctctgagcacagagacaaccaaacatagcacctgcctccaaggtacttacagcctaaagggagaaacagaaaagtgaacaagagctagggtagaaaagatgctcggggcacaaatgagggacctggaatccaggaagggcctgattcctgggccaagtgacaactgggttgagttctgaagagccacagtacaggcactgtgacagcccttatttatgttttccagcttttattgtagattcatgtgcaggtttgttacctgggattattgtgtgatgctgaggtttgggagatgaatgatccatggccctttttatatagtttgtcatttaatccttggaccattttacaaatgaggagcctgaggctcagagaagttaagcagcttcccccggaaaaccaacttggtaagtggtggagctgggattcaagcccacatttgtctgattccagaatcttactccaagtctgggcaaggcgtgggctggccaggcagctgcctgaagggcaattgtctataaccctggggtcagggggatgagaaatgtgaggcctgttaacccaggtctctgggcaagcttccttatataacctgcacattgtcaacgctccactcaggcagctctcccattccttactacataattattagataatgcataagggagaggtttgaatgactagcctgcctgggaggctgcctctctacggtcctgcttccaccacacgggagccctgaaacgagcaggccagctggagaggtggccaacacattcctcacccagaggctccgggctccccagatggccactgccacctgaccacacagagtcactttgccagaaggactgccctgctttaggcctgatctgatctttttccaggaaactcgtctggtgtaagatttatgtgtccaaacttgccagccttcccctttcaccctggactaacagggacaagaattctaatcaatgtgcaggaacacagaaaaaaaacagggaaacagcaggcaggcccaaccccaaaagccccaaacttatttcccaattttgggttgcacatgtatttctactcacataagacagtttgcatccaactggggggaattttgagtttcaattaaactttgctaaaatacaaaactcatttccccttaactgtgcttcctgacaatgaagtggtggtgtcacggggcagaagggctgatggtgtgggttaccacagcaaggtccatgctgcaaagacgggctgcccctcctgctctgggagtcaacgcttcctgggtccaccaggcccagcatttccacaggctgtcatcggtgtgtccccagcacagcacctagctagatctcagcaaatgatttgaatgtgtggggctccctccaggtaagaaaggaacccctgctcacggcactccccagaagtccttggtaactcactttctctttctgttctgaacatccattcgggctggtttaaagcacagctcgctcaagaggcagccctccagaggagatcggggttaattacgtttactgacagctgtcttctttctcctacagtcacttcttcccatgtcctgatttcattgcttgtgaaaagagatggccttccaatgggaaaaggcaaggagtaaaactcacgagagaaagcgtcctggagattttaaggagaaaggcacatcggttctgccagcacaagagctgcctgtttccctatcagatatcaacactcatttagtgcaagggtgaatatcacctttctattgaaaagaaatagagtaccctaggaaaatagcttgcatcaaaacaagagaaaagtaggttctgaaccagaactaaaatatttggacaccgaagctgtgactactgatgcaaagccattaacccataaaaacaaacattcaaacaagacactgcatagctctctttaaatgagtccaaacaccagagctttatcttaaaacaaataaacaacaacaacaaaaaattcctttccccatcccatctccacccacccactaggagtaaaacatattgctagctctgagacttttctaagaacttggtcagagacactgagcggctggtcaatatatttcttacaaatggggctttgagagcggaactagcagctgggtgccaagaacacagtggctctgctcacatctcacatatgcccagacgctctgaaccacagcctaccactgctgccacaggttcaagttctgaaacccaaagagagcacagagaaggcaggaagagaagaaaaaaagacccagatgttgcaaatcagaataagtgctgagtgaggcagtatcatgacatggcaacgataaatgttgaacgttggctctcctcttgtcagctgacccctctgctctgggacccttcacactgtgactccagttaaatcaaccagctgtgcctccaagaaaggcagcatgggtcagtgtggctgcctggactctgctgctgacagctgcagagagaaactcaaaccagccacatagcctggcccaccttatagtctgaacgtgcccagccaaaaagaagaaaagaaaacagctcaaaaaacagcaaaggctgggtacggtggctcatgcctgtaatcccagaactttgggaggttgaggcgagcagattgcttgagctcaggagttcaagaccagccagggcaacatggtgaaaccctatctctaaaaaaaaaaatgcaaaaattagctaggggtggtggcacacatctgtagtcccagctactcgggaggctgaggcaggaggacagctagtgcccgcaaggttgaggctgtagcgagccatgttcgtgcaactgcactctagcgtgggtgacaaagcaagatctcgtctcaaaaaaaaaaaaaaaaaaaacagaaaagcaaaaaacccacagctgagaagcctctggctcaaacccacatacagaagcttgtcggctgctgtgtgtacacataccagccaccatgatcctggccttctctgaccattggtctgtaaggaaataaggtgataagtgggaactgggctctgaaccctggaactgagaagtcaggctgctgcaaaactctccaggatattaatccctctctctgcccagtggttttcaactgggggcagtttagcccccctagggaacactcatcaatgtctgaagacatttttggttgtcacatctgggggtcagggggttgctatcgctacctagtgggccctggtagaggccaggtttgctactatacctcctacaatgcccaggacagctctcacaacaaggaatcatctggcccaaaatgtcaatggtgccaaggctgagaaaccctgctctagagcctaagagtgctgggctcaaattctaacatcactgctgactagcccaggggcctttgtataacttacttcacctgtcagagcctcaggtttatatatatgtgtgtgtgtatgtgtttgtgtgtgtgtatatagatatacatatatatttatattcatatatacatatttttatatattatatatttatatattaaatatgcatatttatatataatacattatataacatataatatatattatatatgaatatgaaaaaattatatattatatattatatatgaatatgcatatataatatttattttttatatatatatatataaattgtctttctgagacgaagtctcactctgttgcacaggccagagtgcagtggcatgatctcagctcactgcaacctccacctactgggttcaagtgattctcctgcctcaacctcctgagtagctaggattacagacactcgccaccacaccaagtgcagggattacaggcatgagccaccatgcccagcctattttatatatttaacaaaacttatgtagcagtttctaagtaccaggcactattcaaagcagttcatacatattaactcatttaatcttcctaatcaccctatgctgtagtgttaacctgacctccccactttacagatgagaaaactgaggtgaagggaaattaagtaaattgtccaagatgacccagctagtaagaggaggacacaggattcacattcagcaatctggagccacaacctacactcttccattagctcactcacagggctgccttacagatcaaagtttacatttattatctaccttagtctctcctatcaaggtgtgcagcaaatgtggcttctcaaccttcattccatgttaaccttatactgtttacattacccttgaacactgagaccaaggatctcaccacttgctttttctattttccttccatcacccagaatggcaaacattcaaacatttccactcccgaaacatgcagcaacgccagaatgtttatccagaaattcaaaatgagctctagtgaggctggcatgaatatactctaacacaatgttttcaaatatcgtggctcaacaacaatgaccagtgctaaggttgctgcgaatgacatcttaggcctgaaattgctctctgctgtaacccagcactgaaggtgactctggcctttgcatgctggctttgaaaggtcccaagtctgtctacttggaaataaattaaaatgttgtctatatttaacagataaccaggccttactaagcaatctaaaacacatactctagaagcacgctgcaagagctcccttcctggccactttgcagaagagaaactaaccttgcgcagcaagtcaggaccctcccccacaaccaccccccagaaaacacaacagtctcacaagttttagtatggtcgcgtctgtaagcaaaagtaaggaagtcataagataagccccacgctggaaaacttgatccttttatgaaaggatggacaggctcactgattcaggtgagaaagaagcccaagtcctgagaggtgcagctgctgaagaccagggtggccccaagcaggctatgtgcaggctcccctgtcctctacctctcagtgaaggatgtccaggagatcccactcctttccccatgaacccagttcccttccatctgcccactttggtctccctgcacataaactcatctccccctacacactccacgtggtctggccccagccttcattccacccattttagtagactgcttccacaatgggctgttcagatccagggggtccaatgttcatatcagggcttcaaatgacctaacattaccagaggcaaaggtgcttaggttaaccaaaaagcaggaccagactgttggcaacccagtgtgctaatgcaggccacccaggccaatcagaagtactgaccagagaaaggcacatttcagactaaataaatatttatcttttttgaaattacttaaagattgcaatttgtttagaggtgtaactggaccccccgcaggcccaagggaaggctgttctagctaacggtaaggagaggagtagaaggcaaggtggaggagggccttctgaggcaggaagtgaggcatcaggacagggtgtggctgggaacatcccccaggaacacatcaagtgactgataaacatttatttgctttatattaggagaatgagaacacggcctatagaaaactgggagtgctaagggcaaagaaacggcttaaagacagagagactatgtttgagcaaagtgagaaaggccattcattggtaccctcagttattaaaataatatataattcaccgctaatcacggcactgcccggatgaatattaattgaatattatatacaacatattacacactgagtgactcatagttacttctaatgaatatcaatatattttgacacatttaacaacgtggagtggtggagggggtacttctagagccaggcttcctaggtgcgattcccagctctgccacttactagctctgtgacatgtggcgaatccctggacctttctatgcagcagttttccactctgtaaaatgggaataaaaacaatgtctaccacaaagtaaaactctcaatacatagtagcttttgttttttaaaaagcttcaggattcaagttgatgagtgaaatgtatgggcatcaaccagattatgagcattcctcttcttcagaagttagtgctgaattatctggtccttccttaaccactgtgaacttgcgtggtgtccaaagacagaacctttcctgtcaacacatgtggaggcaactgcattaggtgcccggcccactgcttttctgactgccacttggccagagctgaaattctactcaagtctgtgagtgaggcccagctcctttccaagttccttgtaatcccactcaaaaaggcatgctttttacttttcttttctttttttttttttttgagacggagtgtcactctgtggcccaggctagagtgcaatggtgcgatctcgggtcaccgcaacctctgcctcccgggttcaagcgattctcctgcctcagcctcctgagtagctgagaccacaagtgcgtgccaccacacccggctaattttttgtatttttagtagagatagggtttcaccatggtagccaggatagtctcaatctcctgacctcgtgatctgccttccttggtctcccaaagtgctaggattacagttgtgagccactgcgcctggccaaggcatgctttttaatgaactccagttctcctgtctcaaagaggtctatcacatggtctttggaaagaagtggtccctgctgtgacagaggatcctgacagcagtcatggagcgctcgttaaagaaaaaaatgattcaatggcgcttgctaacgaactatagggcaagctttatttagggaaaccaccaagattggtgtagggaccaccacagtggtgttttgcagtcagggagagagattgggatcaactccaaatacaaggaaaagtgggaatgcatagccaacgagaatggtgaaggtcagtggatggaaaattactgcagaaacatcagaggtaaggggggattctggctaaattggcctaacaggattcttgctgaaggcaggcaggttgaacagacatcacctggggcacggtagaggatgatgctatggtctgaatgttggtgtccccctaaaattcttatgttggaacctaataccagtgtgatagaatgaagaggtggagcctataggaagtgatgaggtcatgagggctgggattagtgtcctcataaaaaaggttgaagaaagcgtccctacccctccaccatctgaggacacgtagaaggcatcttttctgaagaacaggccctcgtcaacactgaatctgctggtgccttgaccttggactgcccagccgccagaatagtgagcagtacataaattacccattctaaggtattttgctatagcagcaggaacagcgtaagacagatgaggaacccaatcagatatcaagggtgatcagatattgaggatggaggattctgtctaaactggattcgtgctacagttggacagagacaaacacagaagctcaaaagttgacccctagttgaaaaaaatctcagaagagcctaacgtgtggtcatggagagaatctttgtcaggccccagatcaaggacagcatgtggtgggtgagatccacactcttagggagaggagatgctttgaatgacctaattctttattgctgggagaaggaggacccagggtagaaggaaagacctgagagagagggagagagagagagagagagagagagagagagagagagagagaggtgctgggagaaggaggacccagggtggagggaaagggcagaccagagcctcagagcctgccatccccactggcatcattttgctctcacagggcccctgcactctgcacaataaaggagttgtttaacctcccagcatcctgggggcaggaaatattggtttcatctatttgttgtttgtttcagtcttggtgcatcttggaaccaaagttctcactgtatggacacaaaactaatttaggttcttttaatccaacataagaaaaacttagtttcctctagccaccatcaatcaacacaaagccaacagggcggaagggagggcccttgcttcctggcagtctccctggagggggagggggcaggaagtgatctagaatccagtctcagaagaactgctgacaacaccctcaccaaaacgcatcatcatcttgcactcatctctaagtagtgcctcccacagcctaagagcaaaggctcataacttctatccacagggtttctgccatttaccattacctccctgtcctggctcaggcaaggaccctcagggctgagatgcatcttcaggtcagcctgcccacatgtaaacagatgatacatgcacacgtgcgtgcacacacacccacctctgcatgctggagatacacaggacgtggaataagtcctctctgagaatttacgaaggcacctggctgccatcagcacagagtcatcctctgtctgagttctgaaggtagcagtgtctctgcaggtaggaagagagacaaatggagcttccttccagctgaagcaagtagaggctttgttttctctctagagggttgtaagaatttattgttttggagaaataacataaaatctaagagcgctggttcccaggctagaagacagaccagatctattcattcagcaagcattaaaaattcactgcttaattaatacaccaattgctccctccttgcaaagaggaagaacagttcagccccatgggctggcatctttgccactgaggtctgcacaagatgcggatggtgaacacatgctacggccattttggatgtttccttgtagcatcaatgaggaaagaaaacaaaactgttaaaaataaaacctctgccactatatcctgaattatatcagcaagctcctttttaacaagatgttatgtccaggaaatgtatccatttactgattgttcctgaagaaataacttgttcactaggaaataacttaaaccagaaatgtgggctctcatctgatgtggtttatgcatctctaggtgttttcagtgtctcttgtctatttaatggactcccagaagagtaggatgtctacctaaaaagaaaaattaacgtttatactctcctgatgatgtttatgtggaagaaaacaaacatttgtcaaatgtctgttttttattttatttatttatttatttagagatggagtttcgttcttgttgcccaggctggagtgcaatggtgcaatctcggctcactgcagcctctgctgcccgggtttaagcaattctcctgcctcagcctcccgagtagctgggattacaagtgcccgccactaggtccagctaattttttgtgtttttagtagagacggggtttcaccacgttggccgggctggtcttgaactcctgatgtcagctgattgtcactcatccattatacatcatttaatctgccatgagcttaataagcattatagagtctaatcacctaatgagcacgctcatgaaagtgtcaccttcattgaatcatttaactctcctagtagctctatgaagtactattattaccccccagcttataagataggaaactgaggctctgagaataatctgcccaagatcctgtaagtagtaggtctagaattcaagcccagcctgatctttctccaaatctacattattgtccctgaaccaaaacattctcaggccatgatcttctcccctgtcagcagaatctggagcatctcagggttcatgttgaattacaaagccctgccctaaagcagatttattggaagtccagtgcttgtgagagttattctgaagggaaaaaaaaataaaatacatatatatatctcagaaagccttctctgcccaggccaatgcagccagctccctgcttaagaatagctgcccatgggcagggtttcctggccagcaattcaagatgtgcctgtgccggctttactctttaatctcagtttcctcacctttaaagtgggtcccacaagccctgtcctacagggctgctataaggatttaatgtgatgagaatcctaacatagctaacaaagtgcctggtactgggtggtcagtaaatgacagttattgctgctattacttggtagactcccaaaagttattctcacatccagtggagggaagaggagggagcaatcctcccttgggggtagagtattttgcatcaacaggttttagaatttttggtgcaaggtgagagtcaaaatctaacagacttcgtttattatattattgcttttacgttctcttcagacaacgtacccccttattgcctctccctgggctgggcctctctatcccttccctctccccactccctgtgctcccacctagatctcttccaaatttcccagtagagagggaatagagaggcagtggtggtatctttcaccccacatcccagtggtgatcacagcacttcagggaaaaagaaagcagccttcacacatatgggcctccctaaaaagcttcccaggaaaaaggaaatgtgtgtggaaaggccataactgggaatgaatcatctgttaggaaggctgaaggagagggagaaaggggagtggccggaggtgaggctggagaagtaggcagggcccatcgcctggggtggtgcataccttgggaagaattttcaattatctttagttcagcaagaaattacagacatgattagggcccatgcaaacattctggaagggtcaaggcaggatgtgggggaccggtgaggaatctcctgcagcagtcaagcaatggtggcctggagagggagtggacgtcaggatggataagtggatggattcatgcactcgtccttaggaggaggaatgcacaggacttggtgacagcttaagtgtaacaggtggtggagaggagagggtgaagtccggcttctggcccaagcagcttgggggacagtggtgccccttcctaagacagggtgcatctgaagaggagagactcacaggctgaggaaggggctggggtgtgggttggtcatgcatgtgggaaggtgctgagccgagttatgcgtgtgttgagtcatctaagtggagatgctaagaagggggctgcatttacaatcagttcttccaaagaggggtccagatgagatgcatggaaactaacaccaggggacgtgacaccttcacctaggggaagactacattgtaagaagagaaatcctcagacagagtctagggagctgcgatcctcaatagccaagcagaggggtggtggaggcagcagagaaggctatgcaggagaagcctgaaaagcagagagaaaaccaggagaggctggtgcctcagaagcccagggaagaaaacaagatgcagagttttaaacttcacaaaatgccactcagagggcaagaaagacaaagttaggacaatgtcactggcatttattaagacgcaggtcagaggtgctcttttcaggagcaggtgtggctgggcatgcaagggctgaagcggaggagggaggtgacaccatgcacacagcccaggaggctgcctcactcacaccccacttgcttagccccactcacttagcctatttccttcacagccattatcttaatgtgtgctgtcttgcttctttgtttacttgtgaattgccttcttcccttaaggtctgttagggcgagctccttgtctgctctattcacagctgtaccccagcacctaggaggatgcttgacacagaacagggattcaatacctgttgggtattgaatgaatgaaacagaagcagagtaaagtctggctaagaagtgaggagggggagagctgcaaagcccagaaactacccacaagaatgagccagtggtgaggaggaggggtgggttactgtccctgggaagtgggacccccagtttaagtggaggcttagggcagaatcctggacactaaaaggaatgcttaaaagggaatttgaggcattttctggtctgaaagacatccggcccacattgctttcacttaggtcatgttcccccaaaggaaatcctgagataaggattcctagatgagtgattcattgaagaaatgtccccagagtggtcggtaggagagtggagaagcaggacagaaaggggagaggccaagccaagcatgacctcaggccacatcccagcctcagcctgaccccagggagggtcctggaatgtaaaccgaacctcctgcaagtttgtacacccccaccccccactgccagggcaaggtggctgacctttcatattcccaccctaattaatattggctacagactgtcatggccaggacagaaactcccagccactccaactctcttggcaagagggtaatcctttgaagaaggcgatggggcaaagctttagaaacagaggctacagaagctgcaggatgggcacacagaagtggccgaagtgatccaacgccatctgagcagagcgccggcaatgtctgctactaaattgggatagagttttttatggattaccctggaagagcacaccaaacaaaccacttcattctgagggcctggacggtgcagggatagctaccatttagaatcgtttcagtttctattccggtaaagaatccttcaaagaaagacatcgaggctcttacagtgcagagaggtgctcttcttggacaactatagggtgtgaacgtagcacagctactaaaagtgaatgtgacacaacaattaagagagtatggtgagtatttagaaatacttagaagtcaaagcataaaaaactggataacttgggttacattcctgagacatgtttattattatcacagtactgtgatattgtagaatctggagaaataaaatcaattgaaataaaataaaatacatctaccaactaccatttactgaacacctgctatggatccaactctgtgctagaaatgaagcagcatctcccttgctcaaagctgattttcaggctgggaactagatggggctcctgaagcaattcaagaacaaggcaaaaacagatctatggaggtcacataggatgatgattaagagttgagccaggctcagcaactgcctaggatcactcccatttctgctgccagactctctgtgcctcagtttccccatctgaaaaattgagatactaagagtctttacttcacaagattcctgtgaaggtaacaggaggtgatgtgtgcaaggtccttagtatggtgctgatgaatgcagtgagcactgaggccttgttattctgcaattattactggaggtgaggctagaaaagaccacacttgcccgacttgtcctacctttctctcctcaggagggaccaagacatttatgcctggttatgaggtgacattagaaaagaaatcaaaaagcatctgtccttgtttcttgaagccagatgcaaccaagctaagcctgaaccaagagttgatgggcagctgggtggtgtgctcctctgttgagctggccaggagctaaggctgatggctttctgtccagggagccgtttagactcagagtacacacatgcttgcctcttaaaagagtattgggtcagcaaggatgcactgggaaagccatcagcatctttgcatccctactgaccatttcctgcccagcacactggagccagtgctgaccattttcctttttttttctttttttttttttttgagacagtctctttctgtcacccaggctagagtgcagtgatacaatcttggctcactgcagccacctcctgggttcaagtgactctcatgcctcagcctcctgagtagctgggattacaggcatgtgccaccatgcccagctaatttttacatttttagtagagatggggtattgctacgttgcccaggctaatctcgaactcatggcctcaagtgatctgcctacctcggcctcccaaagtcttgggattacaggcctgagccaccgtgcctggtcctgaccattttctgattggcagcagcaggagggccccagggtcaaacaatgcagtcacacaggcctgtgctttaactgtgcctccccacacagcttggtgaccccgggccagtgactttgacctctgaagcctcaattcccttgactgtaaaagaggtcctgaccttggctgcacattaaaatcactgggggagtgtttaaaagtccaaatacccagggcttgcccagaccaacaaaatcagaaccccctgatgagacctactgctgtaaggtaaaatggtcatcttctactcccagaagtggaattaagggagactatccatggaaggtgcttaccgccatgctttacacagagtgcgccgtaaaaggaggccgtgatatggtaccatttggagttcccagactctagaaacacctcccacaggcccacagaggattgtacttgaaacttcattcattgtactttatgccccactttggtgagtatcaaagatcaattgtgcattttgatttctctagttcttttgatcaccctggtccacaatcatgttattcttcaagagagaaaatggccagacccaggaagtgcttctctggattaagggctgtgaggttaaatctttgtttccatctctgccctcaaggacctccaatcccccatcctaataagagagctgccatccacaagggtccttggcccttggcttgcagaagcgggatgagcatctacaaccctggctgtgatgaaggctgccctgacagttacattcttgatagagttgcaggacaaatatttctgaacctgtggttcctttgccgtgtctctagtcaacatagggcttttagccctgtggaacatgaagatttttgtgaactagggtataaggatttaagagtgtaggtggggcctctctaggccctgcttcctacatagttgatgtgtctggacccacaactgagagaaggaacaaagcaaacaggtgggatcccttatagtttatagttatgtttttcagagtaacagacattcagggaaacagaaacagaactttagctcaagcagcaggagggggcagccagcatctgagctggaagaagagctagcaggtgacaaaggaaacaagcactctccatgcagtgttaaggcagtgcttatcatccagtgggaactggggtgccagggtgccaggcaacagagcagttgatggagacagttccagtgccattatgagctgttaaaaggggatctgacgtgtgcattccagaccctgatactacttcttgtccagtcattcaacaacatagtattccctataggcccagcatgtctgtctatgtatctgatttcacaatcccatgacataggtactgttatcctcactttgcagctgaggagactgaggcacatagaggttaagtaacttgtccaagatcacacagttagtatatgacagagttgggatttgaaccctgtgctcttaatttctatgccaaattgtctctagcttagtgagggtgtcaaacaggtcaacagacaattagaatatagtacagtctaagtgactgctagggactagcacaggtggtggcatccaaaatcccattcttatctgatgctcactcataggaagaaaaacagaagtacccacctggtgacaggctagcaggcacaaggatagacagaatgtgcacctgaaggagttcacctaggagagctgaggaggcacaaagacctgcatgtgagtgttcgtggcagcttcatttacaatagcccaaatctggaaacaatccaaatttctatcaacaggtggatggataaaaaatctgtggtggccaggcgcggtggctcacgcctgtaatcccagcactttaggaggccaaggcaggtggatcatgaggtcaggagtttgagaccagcctgaccaacatggtgaaaccccgtctctactaaaaataggaaaaatcagccaagcgtggtggcatgcacctgtagtccctgtaactcaggaggctgagacaggagaatcacttgaacctgggaggtggaggttgcagtgagctgagatcgcaccactgcactccagcctgggcaacacagcaagactctgtctgaaaaaaaaaaaatcctgtggcatatccagacaatggaataccattcagccacacaaataatgaattgctgatctacacaacatggatgaatctcaaaagcaccatgctaagagaaagaagccagaagcaaaaagggtgcatattttatgattttagctatatgaaattctaggaaaggcaaaactctggttttagaaaacagagttttgcaaggggatgggggtaggagggacgaactaagtgtgacaggcatgaagaaactttacgggatgacgggaatgttctatattttgatggtggtgatggctacactggtgcagatacttgtcaaactcattaaattgtacacttcaaaaggtgaattttattacatgtaaattatactcaatttagaaaatattttaacaagagacttgatgtcatgcagtcaaaagtgaactgtgctatgctctgaagctaacggtgagagttacatacgttctgcttcctttgttttttgttccttgttctttctttccccctttccttttttttttttttctctctctctctctccctcctttctgtctctcctcaaagtctaccacctccttttccaagccaagcctaggtgacaggcccctgagctgcaagtgtttccagcactgccattacaaattagtggaaatgatcagacccccaggcagactggttctcagcctgcttcagaggggcagatgttctgcaaaaccagccagtgacccacagagaagactggcaagcccgcaaggctctcattggacccctctgtggcttctgcctcccaggtagaaagcatgcatatattagatttaaaaagaggaagtgcctttccaaaaactactcggctttgggagggatagaggtcatttgtctttgtccaagaaaaacatgttccttccttgtaatccttgataacccctgaattgttttctccaagatagttagggacaggggtaggggagaggggctacagtaaaagagaaaaggaggtagagaggacagaggaagccaatgccctactactctgcggtagcagcaaggtgagctcttaccaccttgaactctgggaaagatggtaaaagagggaacccttcaccaaccagtgcccacatgactacctaagacagcacccatatgaggtgcaaccatatgaaggttcacttctcgctggatgagaagtgaacagagaggttaacagggcaaagaagcagcagtaatgggaaaagaacgtgagactggcacggttccctcccctgggcctgcgggaggcccatggcagccagaatgtccatctgctgtgccccaccactagtaggctcacaggaagggaagagaacaatgacaacccaactgtcccttgcgcagaagttacaccaagaagtgagcagcaggacccgctggcctggcagtaaaccacatcagagttatcagtcggaaacctcttggacaaagagagtttataaagtcccttggccaagaggcatggaagttgagttcagccaagcgcaactcagacacatgggcaatggaaggggagctggggatgccagctgccatccaagtcctgtttgttggaaattgagagagatagtattggagaactagatgctttcactttatttctccaaaagagagctggtctccaggtggtgaagcctataattctataaaaactggagattggagagataggagggtacaactctggcccaagacagaaataagcaaaaacaaaacaaaacaaaacaaaaaaataggcatccataagagaaaaaagtgagtggttctgggcatctagtaagtggaagaggaaagagaccatctctaatcctaactcactctgttccaggtttggaataaaagctgtatcgggagaaataacctgttaaagtagaattgtcaatgtgtagaactgaaaatcggccaaaaatccatcagctttctcaatttactaagaaagaataattaactccctagtacctgatatacttttgcatttaaaggctaaactacctatatctactcaatatcattcacttctagtaagactcttattggcaggtttaaagcacccctacccaacccactagcaccaacttgtcttttatcttagcctggaaagaacatgtatgggttacattactaagaacatagtatcattgaatgaatcattaaatagaccagtcactgtaataaatacatgtggatatatacattctgttaatagacttggcatagtctttcatggtttcaagtgttaaggtttattgtggtattaaagaaaaccttatagactttcattttctgaacgatagtggattcaatatatagccaactctactgaaaacactaagcaaactggatactatagaaaaactcttttgaaatgactgatgagctggcaagttagtaagacgtattcagtgagcaaaaactaagcaaaatctgaagcctagtataagagccaatccctgaagctagcttgaagacaatagccaacaaagtgaccttcacttttatcttttgtggcctcacgggaagaggagacaggataagaatttcccataacataaaggatactatcacatggatccaggaactccaatgaataccaagtatgagaaataaaaataaatatatacctagatacgctttgtgaaactatagaacaccaaacaatttaaaggaaccagaaggaaaacacagattattctcaaaggagacactcttgtctgtagacaagacagtagattttagaggcaacaatggaaacagaggacagttgaataatatcttcattgtgttggagagaaaataactggcaacctagaattctaccctaattctacccagtaaaaacctctctcaaaaacaaggggaaaaatagtgtatttgcaagcaaacaaaatcaagaagttgtcaccaacagaccctcaataaagaaaattctaaaagctgtacttcaggctctattggaaaataccaaaatgaagttggtagacctacattaatattaatcagaatagacttaaagactaaaagaattactaaggaaacaagttttgcttaattataaaagattcaattcaccagaaagataaaacaattcaaacctataggtacctaataacaaaggctcaaaatatataaaacacaaactgacagaccataagaagaaacagaaaaatctacgatcatagtgggagattataatacttctctcagtaactgattgaacaagcatacaaacatcagtaatgatataaaagacttggacaacacagtgaagaagcttgatctgatagagttacatagaacactgcatctaacaatggtaggatccacagaacattatgaaaagtgaccacataccaagccttacagtaagcttcaataaatttaaaaggctgggtagcactcaaacaatatttgacaaccatgaggcaattaagttagaaattagtaacaaaaagataataagaaaaataaacaaacattcagaggattaaaaagaaacacagctttaagtcataagtcaaagaataaatcatagtgaaaattataaagtactcagaaccaaattatatacaaatattacatatcaaaatttatgaagttagagtaaatattgtatagcttacaatgctcataatggggaaaaaagcctgaaaattaaaaagccaaacacttaccttaaaaagctaagaaagaaaaatagctcaaatgtaaataagttagatggaagaaaataataaaaattagtatagacattcataaactagaaaacaaaagatggagaggatcacaaagtcaaggattagagatagtctctaataacattgagaaaattcttaaaagaccatttaacaaaattatagaaggtattacaaatgaaaagtggacataaccacagatcccacagaacattaaaaaataacagcatcttataagtagcttcaaggtaaaaattttgaaaactcagataatatggataaatttctagaaaaatctaatttaccaatattgatttaagaaaaaaattaaaacctgaatacccatgatctattgaagaaattgaatcagaggttaaaaatcttcaggaaagaaagaactccagcctcacagaatctttttttgagaacagataaagaggaaatattctataacttactttacaaattcagcaaaaccatgatacaaaaccctgccaaggataagataagaagtgcaaattacagtacaacacactcatgaagatagatataaaacttctaaattttattagcaaaaaaacctagcaatgtataagaaatgaacccattacaaccaagtcaggtttattctaggaaagcaaggttaagttaacattggaaaattagtttaccagatattaacaaattaaagaaaaaaattatataaatctcaataaatgcagaggaagtatttaataaacatccatgtatataatttgaaagaaaaaaagctctttgcaaactacagaacaggagtagttccttatcctaataaggaatatcaaatccataaaaactctcattctcaagggaaaacgttgaacatgaaaggcaaagcttaaacgtttagaagaccatacaagaactgtccttaaggatgtcctttaaaagacacaaaatgttcaatgataaaggaaagattgataaattttattacattgaaattaagaatttctgccactgtaaagatactaaaaaagatggtgagaaaaaataacacaaataaggagaaggtattttggcaacacagagaaatagtctcctgcatatataaagaactcctacaaataaataagagagatgtaaactacccaattttcaaataaatgggcaaaaggcttaaagaggtacttcacaaaaaaagaaaatccaaaaggtcaacagcgtatgaaaagatactgaccctctttagtaatcaaatgtatataaattgaaagcagattagatactgttacacatccacaagatgggcaaaagtttttgacaatatcctacaaaatataaagtttttgcaagattagagagcagtaggagaaattgcagctggatatagaaattggttaaacacattggaaattaatttttgattaaagtgaaactcatatgacaccatagaattctgaactatcctagcagcactgaaaatgcccatagtctgtggccagtaattttattactatgtgtattccctaagtaaacttacacacatacttagcagggaacttgaaaaaaaatgtttacagcagcactatttataatagcaaaatactggaaataagctaagtgttcattaataatagaatagacatataaactgccatatattcattcaatggaatattatggttcagcaaaatgaaaaaatttcagctacacccaacaatgtgaatgaatccaggacgaaacatttaacaaccagttggtacagagtccaatcaaatgaagtcccagccctagtgccagagctggtacccaagaccccctgccatgccaggtgtaatccctttagaaaggagtggacttggagaagtaccataggagcacctgggaaagacccaggtaagcagcaatttaccaactgatatggaaatattcccattgtttgtcaaccagtgagccttactggtgtggtgtgcatggactaaacgtgagcattaagaacaaaagaataaaacagtgtgattccatttatatgaagttcacaaacacgcataactagacaatatattgtttagggatacaaatgcaagaggataagacaataaagaaaagcataggggaataaaaggtacagaaatgtccagaagatggtaatccctgagaagagaaggaatgggatagggtggagggaggtacacaggggatgtcaaaggttcaagtaacattctttttctcaaattgactggtgagtacataagtgttagtcataatgttattctttagacctttctacacagtttgtaagcattcgtttgcatctaggggctatttcattaaagttatttcaaaagatggtcacaacacaaatttaataagaaactctcatatcaaattgctgcagttcctgccatatcttttctagttgctgggcaaagatgctctcctcaattgtaattggtgtgctcttaaacccacttaaaattctaagagcttctccccagaccactccaaaacattcttgtgagaatctttccagtgaggtacagcaaggcccaacctccagggcacattatgctctggctcatttatttgatacaatcataatcatagtgggtttttttctcaaactttgaaatcttcaaaatgagggcatggagcaaatgactacattctgcttctcttgctaagatttcaatggtgatgctctcattttaagttctttaccagacgcttcagctgtgctatgcccaattcccctcatcaagatttgctgacagtcaggggaagtttctaacactgtattaagtgtatactgagggccagggaattggggggagtttgaggggctgcacacatgtgcaattttttagcaaacccagcagatgcttgtagattcaacactttttcagttatttgtgaacaacccctaatagccacaccacatggcaatttgtcttttctctggagcacaaatgtgaactgtatgttgcaaagccacagcaaagaacaagtcacttagctagagagggagtcttctcaaagacccagtaaccccatcccaagatgccaccagggaaacagaaactctctggaggtgaaagaaacttaatttccttgagtgcaaattgaaaaggcaaataattggtagcctgtgaatagtcataggaacctcttcactctggaatggaacctgattcaggaggaagtcaagagcctatgcaaatatttctgcatttgcaaacttggggatttgccaagggcttgagatgtatccactgaaaatgtcaagcgtctactgtgtagaattttgatggaggaggatttcaaaattcttcttctatttaaatccaatcaattcatgtttatcagggcatctctgatctttttgtttttaagagacatatttgctctattgtccaggctggagtacagtgatgtgatcatagcccatggcaggctcaaactcctggactcaagagatcctcccgcctctgtctcctgagtagttagaattacaggtgtgagccaccatgtccataattttatttttattttttttaagacagggtcttgctatgtcgcccaggctgatctcaaactcctgggctcaagtgatcctcctgtgtcagcctcctgagcagctggcattacaggcatgagccactgtatccagctcctctgatcttaagatagtttcaacatctaatgctaagcctggaagtccaatgaaagactcaatagactaaaattggtgactgagattcggaggagcatatcgtgtgtttataacactgcttttattttttccatatctttctactatttgtttattagcttttctttggatctcagttattcatacataacacatgtttaaaaagttgatcctaaaccccaattcaagggtccaccgatgctcagagatctcaagatttctgagactagcttccctatacttctccctggctttgctccccaaatctgaaaggcattttcagatcacccctacttcatatttagatataaagcttccccctttatccacaagaattccagctgcacctggcatttcaaaaacacttagtaatgaggaggggagacccatcagtcatgtactcaccacttccattgttgtcctgcctcccaagcacatatttccaactgtgaaacctcccaacagggcagtcctctggatagtgtggttcagtcacttcccaccaccatgcctcacctcctctgccttccaagccctctgggacttcagggaataccttttctccatcatattacaattagatacagggaacctttggagagttctgagtatttgtgattatattcaataacctgttactgacagtttcttttagttaaagaattttttcaagtaagttaccaaaacaatgaatgtatgtacatctagaaactgagaaatactcttccatgacttttagttaggtcctcacgttttccacatatgtattgaatttttaaaatactattttaaaagggtctacatttattttcctctacttttgtttttcctcttgcctttgttttggagcaaattttaactgaacacattgtcagagggtcaggccaagtttggcactgctcgtgtatctcagccaccttccagttttcagcacgatgtctgaactgaaaaaacaccattgcttaccataagggtgtggccatgacagcttgaacaacatccgggtagtggtaagtctacatttgctacacagatgtaagaaacagatagcagtagggtctacctctcctgctccatcttttccatcaccaggtctcttccaactccagaattaaagtcatcaagttggaacaactctaagtgtgtttcctgatcataacaagacaggttgaggttcatgaatattttctttagtattaaatgttagaacataaccactaataataacagtagcatagtagttccctgataaattttgacaaaagatcataaagttctcaatttcaacagcagggctttatagttgtaatataattttgaccagtaagccaccggctatccagaaacctcacaggtgccattatcatggatagttgcagttttttctctaagaatcatgcaaaaaaaaaaaatcttttggggatacttcagaactctgtctttttaaattggatgaacaaaatataattttaacttctatggatacatgtgggtcattgtgagcatcagttactatgttataaaacagagtaccaaagatccatcaaaatacataaaatttcactgaattgcttacattaaatgctcatatcagctttagaattccatgccttgaattcttgtgccttttaaatttttttttagtttttctgttttttactcttacttcttactgatacttgataaaagagctttaataatccttgcacagtacagtatcagttgcttccaatttgctaggtgcatttgacaaactaataaccaagcctcttaaaacttgaagtaaatgcagaggcctgaaagagggtataaaatttcctccaatgatcaaaattcataaactgtagctcatggacttatgacctttctcttgatttgccatctaggtcccaactggataagtgaaattatgtaaatgtgagttccagattgttgtggtattatcctaatacctatcaactacatagcatgttactaaacgtatctcatttttcttctcaagatagttcagtggtcttggtaaggttatgatggttacacctactttacagataaggaagaaaattggtcacgggctttggccaagtctgacccagaatgctagtgctgcctgttgatacagccagtgttttccagccctgcccgcctagtgcatctgcagatttgtaaatacactttgactccacaggaaacaggatggagaacagcatgtcagggactccttgatgggcaggatggagggcaaaaaagagccttaaagacattagggaattcacagagtagggagtgagagacaagttaaatgctatccagttgtcacacagctttcttaatgttatctttcatcaaatcatgtcctagaacctgccaggacttcagactaaatgcatcttcttcttgcctgtacctttcacacactaaatgtctcaacagctcacttggcaaggacccaaaggcagcacacacttctccactccaaggagggtggctgccactaaacacaatgggcggagacagctcaacaatagtgccagttgagcacatcttgatccactgccacagagttcacagtagtagttggccctcaaagcaaacccactggggtgttgagggcaaaaaaacaatcttagccttaaggggccagactttgccatcaaattaacaaatctgcccaacagccccaggctgaggcgctcaggggtgtgacaggagggcccctgttaacaattctgtatcctgtgggtgccttaactagatggagtggagaggaagcagagagctaagtgtcacaccaccctctcctcctgcctgcaggtgtcttagttggacagctgtccaccttccttgcaaaaaactcccacaatctttaaatgcaactatgtaaagggcctccagcctctgcaagccatcacaactttaaagagcatatgtcaaacagctcagacggcatctgaggtctattcttcagccccacagtatagcccaaccccagagcacaagtgacaccctagtggacaggaactcctccctacactggctgctcagcaggaccatgaagaacagctgggacctggcctattaccttggcttcaggattcattttctgcctggaattgggaaactggaggccctgcaggggtccttctcctgggtccaactgtctccagggtgcaagaggggtgaaattaccaaatgaaagttcagataagcaattactggctgaaagagacacaggagggtcttcagatcaacactgacccagagctaataccacactgtcctcagagggacacacgatcactgacctgtattcttcacatttaagttgctagaattattcctccttgcccccactctctccctgcccccagcatacacataattacataaagacgtcttaaacaactgtagcacccaacttcttcagtctgggggagagccaggagatggtggggagctgtttgggcacacgtctgatcattacataatcacacaaacatgggctggagaacactgccatgcagatcagttcagcaaacacctcattctccctctttcctcttccctccccccgtaacacccaaaatgcacaccagagttaacaaaaccgaagcactccaggtagccagtgggcacctggctgctgtggttacaatgccaagggctaccagaaacgtcagcgtataccagaaagagggccagggtgctgctcacccagcgaccagatctgcagaccctcttcctgcaaccactgcccccgaagttcaaggaagggcctagccacagaaatattcctgacctgcaacagaaaccaaaccagctacgttaaaggaaaccaatgccgagcctccaagttcctctgcaccactgccacactcaggagtcctcagcagcctggacaatatcattagggaccattcggcaccatcagtgtttccatttaaaagatagtaaaatgtggggcataacttggaggggacactctctctgctagcagggaggcaagaatcccctatagaataggagtttggtttgggtttggttgggtcaggttgggggttgggaaatgattttgctttaggaatattttcagggggctaggattaagggggaaaaagaaagctatcccctctgtctcagcagccagcatcatacgaatctcactctcaaccaagcaggctactgcagtccgcctaaacaatccggagcagcagccaaggcagcacaagaaaacgccggtgccacggaacgcgatgcctaagccccccagccgaggctcctatggagccggccgccagtgcgcgggtgcagagcccagcagagcctgctgcaagcagcgctggagcgcacggcgcgcatagggttacagccccgccgccgccgccgccgccgccgcctgtgattgacgcgcgggggtcacttgaggctcgcgccgctccccagcaccaggccgagcagcgcgctcagcccaccgggggcactggccgccacgcgcagcccacccggccggcccctgcgtctcggcagccggacaccttgcctaagaaaggcatacacaaaatggaatcgcagctcgctattctgcttcgcggtgcggcctcaggcaaaaacacaatcacaaggtaaaatacagcgcaaggaatccatccgccgaataaaaacccagagtcccctaccttcggccttgggatggcaaactggtcctgtgttctctgacccacggatccagccccttcttcatgaattattccggccaggcaggattttgtgcatttttttcatgaacacctgtttcaagtaaggggtaaagaccttattgaaagaattgtccttaaaaaataacctgtgcatacgtatgtccatccaggcatgcatgcgtgtttgtatacacacatatgcacacggaatagccatgtacattgaagcaccaaactaggcagctggataatgggagagtcggctggttgtgagcatgctcgcgccgggaacagatccaccctctgttattcctctgaataaatataaatcacgatcagaaacccaaacagaagcatccctcttgaattcgtgctgctgaaaaacacggaataaattcagcctgcagacacagaatctaatcagcagctgttttctgaatccagagccaacccatgcctcgcttgtcttttccactaggagtccagaccttttttgaaagggggtttaaccttttaaagacacagtacaccaattatcacttcggaatagctgtcactcccagcgcaggaagccagtcccatgcctaaaggcacagtaggcttgcacacagtgataaggatttcatttattggtgctttttaaaaaacaacatatatgtataatatatgtgcatatatatgcacatatatatgcacacatattatatatatatacgtggagagaaaaaatgcaaatgcaagtcataaatatttattgcactgatgagcttctcagtactaattggcacgttatgtaaacactatgatccttcacttctgaacacccatgttcacgggtcagacgagacagggcactcttgtcagcaagcgtgtcacacctcaccagcctctggctgcagatcaggggccggggagcctcaacagtgcctgaagggagtggggtctctgcacctgagagctcaacacgggcactccttgccctgccctgccttgctctgcagtctcagggtccatgtccacaaatcaaagaatagttctggcactatttctaaagtcgaacataatccagagccacatcgcattccaagacatactttctttcaaccagaatcaggaatcagaactaccacctgaaccttagttagagtctttacgattcagacttaggcccttcttcaagattttgttattgagttctgttgttttgtttttcacttttcttttaagggtcagcatggaggtatggaggtagaaaaacagggtagggggagagacaacctccagcctaaatttttttgaaaaaaattattcttcgagtacttcagccacccagatggtgtttactgcagttttgttctggcttttaaagaggtagcgctgagaagaaacaagagtcctaaccttgctcacgtgtgttaagaaggcaaatgtctttgacagtttctttttcaccccagccccagagctccagcatggcgctgtctgctcctccgctggttcccgcctaagagcagcggcagtggctcacctcgggagctacaggggcgctcctacagccgctccagcatcacagcccattccctcccttgcctagtcctgccaggcaaaccgtgaaaacaagtgcactgtcaccctcccacctcatcacaggcgctcctgtgtggacccctcccagcgacacacacacactctcttccttcccctcttccagggccctttggcagaaaattatcatatttcatgtgtcatcgcccaagcaagctgggtccatcactgattggctgggccctggcagccggaaatgtcaccagccacacagcgtggagctggctctcccgcggccaccacagacctgagcccaggaggctctgtgacaaggcacagacctaccacagagagcctgtcactctctccctggtccagcccctgccccctgcttctccatctacccagccccccggggaataggggctgcgaggggatggtgaaggagtctcagtgacattcctattttcccagcatgtttgagaagaaactaaagatgtctccaatcaggtttataaatttggagaacttgtttttgacaaaaacattctgtcttcacactaaaaaaaaatcagtaagactgggtgaaaacaagatggtttttttttttttgttttgttttttaccccaggagagtttactagatgctgctgtttatttcccatctaacatctcaggcaccaaggtataatcatgtcacagggctgtccgataattcagaaggtgattcgagtccatcctcttacctttaaagagaacagctccagaaaatgaggctttgtaacttggctttgcaatgtatcatgatgccacacaactttttaagggttaaatgatctttgtagtgaccaacatgaatcacttcagctgtaatttaatcttagtccctcctgctgtatcttcagcaggcttagtgtgactcaccatttaagtctcaccttattctgttctcctgagtaaactaaactctatctctctgtccttttcagtaaaagtttttctcaaccctttaattatgctgctttaaagaaaaagcctcccagagttacatgagtctggaaggtcatttggtccatctatccatatgatgtgtcagaactctccactatttccatacgggggcttttggtttggggaatggtaaattcactggcaatgctgggaaccagggaaagatgccatcaataaagcagacattttgaataatatgggaagatacaaagtagatgggacatgggaggaaaaactaattagtactgataaactcatgattctgcaaagaccctgatatggtttggctgtgtccccacccaaatctcatcttgaattgtagttcccataatccccacatgtcatgggaaggacctggtgggaggtaattgaatcatggaggcaggtttttctcatgctgttcttgtgatagtgaataagtctcatgagatctgatggttttataaagggtagttcccttgcacacgctctcttgcctgccaccatgtaagatgtgcctctgctcctccttcacctctgccatgattgtgtggcttctccagccatgtggaactgtgagtccattaaacctctttttctttataaattgcctggtctcaggtatgtctttattagcagtgtgagaaccgactaatacagacccctaagaagtaactgtacaggtttccagaaaacagtcttggaaaatcccaaactcagagaatcaggattggaggagaatcataggcagcagtttaaaggcaaattaagggacatcaggaacatggtcagtttctccacacagaatggctggacacagaaataggtccacagcttctttggaaagtgagaggtttgttccaaatataatagaagccaaaggttgaataggggcaggatatcagctccttttgaaatgccactgctcttccccaaaaagtgcgcacacacacacaccacacacacacacaccacatgcacacaaaagagatttaaaaaatcagataaaatataagatataacagagagatccagaatatccaatcaatattagcctaataggagttccagatggaggcatcattaatgaagaagaaatcaataatcaaggaaataacagaagaacatttccttaacctgaagaaagtctttaggccttagatcaaatgctgtgctaggcagcaggactactgaaagaatacacacttccagatgtactctgatactccaagagcaaagacaaacaatgacaagcttcctcataaaggagaaaaatcaggttgcttaaaaggaaagaaaatcagactaataccatacttctcatctgtaacactatgctaaaagacactggtataatttctgtagaattctaagggaacattattacaatttaagaattctaccagctgccaaactataatttctcttatgcaatgaaaaagaaaggtatgttcaaagacacagaaattatatcacccaaacaccctttattaaaaaaaatttaaggttacttgaagatctcttccagctgaggaacaaataaggcaggataacaaattcaagaaaggagaagatatgttatataaaaaatgtaatgaataaagccaacaaaatatgtggtcaaatataaaaataattgagaatatagttgtaaaatttaattgttagaagtcttgaaagataagagtataagtacatttattccagatttgaattcacatctatatctatctcttacatatatgtgtctggaattaaacttccatataattataacaaaaaaatagaaaatctcaatggaaacaggtaaaaatcactaaaaaaggaagaaggaaggagggagggaaggaaggaaggaaggaaaggaaggaagggaagagagagataaagaaaaggaaagaaagagaggattgttatggcaggccaataattccatctgtttcctcttcttcccaagaccacattaaaatgaaaataaggattttttttaggttgaaatagatgatgacaaaacaaaaacagtaaaagagtcattgatcaaaaaaattcacaaagaataataaaggaggacaattcatcagttagaaatatatactttaatgctacagtaaacaaaatggtatagtacaaataaagaagcctacaaagtggattgatggaagtcaagaaacaaatttagctataatggttactacatggtagttaagtaataaaaactgaattttaaatcagtggaggaaagaatgtgttattcaataaatagtgttggactgtggctatgtatttgaaaaaatataagttttacctctaactgatatcttgttaaaaatatattctattttcatataggaaattctgccatttgtgaaaacacggataaacctagaggacattatgttaagtgaattaagccaggcacagagaaacaaatactgtgtgagcttacttataagtgggatcttaaaaagtcaaactcataggagtagagagtagaatggtggtaccagaggctggaggaggtggcggggggaagggaaaggagcaacattggccaatgggaacaaagtttcagttatataggaggaataagttctggtgccctactgtacagcatggtgactacagttaataataataatgtcctgtatatttcaaaatagctaaaagagaagattttaaacgttctcaccacaaagaaagggtaaatatgaggtgattaatatgctaattagcctgatttggtcattccataatgtacactatgcatatattgatacatcacattgtacccataaatatatacaagtgttatctgtcaattaaaaataaaataaggctttaaaaatattctattttcacatacacaaaaattccacaagggaaagataggtgttatgattgaccaatactgtaaatcatagaattctatgaagtttttttttctaatagtggaaagaaaagcatgtggtcatccagtctatgcttagataccattgtgataggctaattactggcccccaaagatatctaccccctaatccctagaaactgaatttcaccttatatggcaaaagatgtgactacgttaatgatcttgagatgaggagagatcctggattatccaggagggccctaaatgaaatcacaagtatccttataggactgacgtaggagacgggctagagggcaacgtgactacagcggctgagattggagtgatgcagccacaagccaaggaatgccagaggccaccaggagcagaaagaggtaggaatggattctcccctgagcctccggagggagcatagccctatcaataccttgattttggatttctggcctctaaaactgtaagcagagaaatgggttattttaaataactgagtttgtggtcatttgttatggcagccatagaaaactacaaccaccatgatgagaaacatagtacttcctagggactatcattattattattgccaacaacaatacttactatgtacctggtgctgctaaattatttatatatcttacctcacaagtcacatgcaaggagatggtagagagttggagttgttacggccctaccacttagtagcaaaatgtccttgggcaagttatataacctcctaacactgactttttctcatctattaagtagaggtaagaaaggtacctacccactggggttgttgacgataaagtgagaccatctatgtagagtgcttagaacaatgcctgggaataaaggttccataaatgataagtgatcatgagaatgtccttatgcagctgtagtctctgttccagagctttttctcactgatttttgttcttctctttgggtacatacaaaacaagggtatctccaaaccacctgaatgtccttcaaatatctgaagccattgatcaggtcattaagagtctgagcttctctaggctaaaagtaaccaatgcctccaatcattattgttcttagaaattcacctggagtcccttccctaacttggtcacctcccctgaacacattcttgtgcatcataagatgtgactccagactcaccaccatgcttgttctagaacagaggtctgcaaactacagcccttcgtgcaggctaatttttacagcccataagccaagaatggatctgacatttttaaaggattgtaaaaacaaaacaaaacaaacaaaaaacagaaaagaatgtatgacagagactatacgtggcttgcaaagcctaaaatacaactgaccctgaacaactcaggggttggggctctgacttttcatgcagtcaaaaattcatgtataacttttgactcccccaaaacttaactgctaatagcctattgctactggaagccttagtgataccataaacagtcaacacatattttgtacattatatgtattatatattgtatactgacaagtaagctagagcaaagaaaatattaagaaaaatcataagagaaaacatatttaatgtttattaagtggaagtgaatcatcataaaggtcttcatccttgtggtcttcacattgagtaggctgaggaggaggaagaagaggaagagttggtcttggtatctcaggggtggcagaggcataagaaaatctgcatatagtggacccgtacagttcaagctcatgttgttcaagggtcaagtgtattcactatctggtcctttcagcaaaagcttgccaactcctgttctggcagatactgttcttttatcaatgcaatagaatattgcccaaaactttttggcaatcaaattgcatgactgtacatactgtcttaactgtaaggctgcaaatgtttctgtcagtatctattcccctctccccttcttagtaataaaattcttagctaggaacatggctacccagccaaagactacatttcccagcctgtcttataggaaggtgtggccagaagaacaggttctagccaatgggatgtaaacagatgtgaaatgtataatttcccagccatactcttaaagggaaggatcatgcttcccttcctttttccttttgccattggctgaaatgtggacctgatagccatgtggatgagtggtgcagagcaacgagatagaaggatcctatccctggtgctgccatttcaccctatactgtttattctcaatctgtgagagggaaataattgtttagcttattgaagtcattgttctattaggtctttgtgacagcaactgtatctgtgccctaagccatacaactatcattttcaactccctcgtactttttatatttgcagctaccaagccacacacctcccctgacctgcactcacacagttaatttcctggaccccactacaagaccttacatttagccctattatgtttcatattattcgaatcagcccatcattttgccctgacatctgggatctaattctgtcactcaaactagcttctatcctttgtaatttcacatcattcttcaaaaggcactttatttgtggcactcaagctaaacacagtgctcatcaaaacacctgatcaatattaagtataatgcagtggggaggctatgacctcagtttgtaggggaaggaaatagcagatcaaaataaggtccaaatgaagtagaaggaggaaaggaaggagatgagcagttatggagagcttactatgttccagtcactgtgctgggaacttcccccatcgtgaagttttagtgccttaagtacccctattagtgccttaagtggaatagtcataaatttgtgaacaaagaaaggaatattaagagaaatttttaaagtatgttagctaaagtttcttgcagcctgaaggtcctacttgaggttgtgtatcaaaaaccctatggagttttagggaaaatatggatgcttccaagttgctacaggagggtcttggcatatgtatatctttaaggctccatggctaactctgacaaccctgataagccactgtgagtttcagctttctagcacactagaaagtttgaggcagagactctgctcagctaccagctcctggagtctgactcagctttctgtctcaggcgaggatgtagccttgtcaggctgtttgggttcaagaaccaggagagtctgatgttggtaagaattcccttctaggaagtattaagcaaagtgattggagtatttccctgagtcttgtaagcttctagtacaaaaggagtgtggtgtagcacaaatgagtttctctgatctggtgagatcctcctttgggtacccatttgacatctcccaattgggcacccttgggagccacccaatcctgcactgagacaggccacctggctcctggtcagtttgtgtactctggctaaacaaactctgtatgtgtgttttgggggtggggtggagttctcttgtggcaacccatagactacccaaaaatgctgcaagacaaacataccaaagtcatcaaaaagtcattaaagtcatgactagagaatagtgaataaacaccccaaatcacatgtaatttattacattcacctagggtaaaaaacttatgtgccttcagggccaatcaaataacgtaagtgtgcaaagtagcttggcataagcaaaagagaactggagtgttcatgcctctctacatatctaccttttaaaaatgaaaaagctgaaagctgtgtagctaaaaacaattggaatcagaagatggaccaccagtttgcaacccttctccccgataatcacagtccacaaaagcaaggagaaaaaaaacttcatacctctcttagaaggataaaagaattatcttttaaaaacggcttgtaggcagggcacagtggctcacgcctatagtcccagcactttgggaggcagaggtgggcagatcacgaagtcaggagttcaagactagcctggccaacatggtgaaaccccgtctctactaaagatacaaaaaattagccaggcgtggtgacgtgtgcctataatcccagctactcgggaggctgaggcaggagaatcgcttgaacccaggaggcggaggttgcagtcagccgagattgcagcattacactcctgcctgggtgacagggcgagactccatctcaaaaaaaaaaaaaaaaaaaaggcttgtaaaagcatgtattgctttttaaagcaatttttaagaaacagttaaataatatccctaaaaataggatgtctttaaatgagttgggtcagatgaccctattacagtaattctcaaattatagtccaaagactacagtgggttacaggagtgcccaggtggtatgcaaaatgttcttccacaagtctcactcacagtctaaagtgtcccttatagcacagaggattcttcatttatttctttcagggctacttcatcagatgctctccctactttttttctttttattttgaaataattttagacttatagaggaattgtaaagattgtacaagttcccatacaccctttacccagttttcactaacagaaacatcttacataaccatagtacaattattaaaactaggaaat

SEQ ID NO: 285 - DNA, 78517 bp, Homo sapiens
ggagcagtcagggagatggacatgaaagcaaaagtgttttgctttgtgctcctgagagcacaaaggaggactaactttttctgggggcatcaggaagatttcaccaaggaaggcagctgagcggagccctgaagattgaaacagccattcatctgaccaggacaggaaagctagcatgaagcatgagagcacgccaactcatatttattgagcttgtcctttgtgccaggcactagtctaagttttccctaggtattaatgcatctaatcctcatctgtgagcttggtacaattattctgctcacttcacagttgggaaaactgaagcacccagaagctcagtgacttacccaaagtcacccacccagctaattcatggtggaaccagcattgagctccagtggtcttgttccagagctcctttttgagaaccactgagatagacttagactgaattttagtttctgctccttactagctgtgtgacctcaacatgttactcaacctctcaaagcttcaatatcctcatctacaaaatgaagaattcagtgggcatatgtacttctgtctgcctggggttcgttcctcttggaaattgctcctcctttccctctaaccatcagtgccagttggaatggtcatgttcttaacagccccattactaattaatccaagaatagacagctgatctaagctgggcctatctaaactcttctctgagaattttttttctcctaggctgaagtgcagtggtgcaatcttggctcactgcaacctccgcctcccaggttcaagcgattctcgtgccttagcctcctgagtagctgggattacaggtgcgaaccattacagttggataattttggtattttcagtagagacaggagtttgccatgttggccagactggtctcaaactgggcctcaagtgatctgcccacttcggcctcccaaagtgctgggattacaggtgtcagtcaccgtgcctggcctctctgggattttttaaactaaaactgagaaagaaaattagtccctctctggtggaggaaaggcaaatatgtaaaactcctgagctactggaagtcacatgctccagtgtgtggtagaggttaagtttgcagagaataaaaacaacacaaaaagagaaggaagagactgaaaaggctttcaaaactcctgcatttgcctaagccagttcgacttgggtttatgacataggaaagaattttcatcagtaagaaatagtagtacctgtttcctagggttgttttaaagatgggttaccatgatgcatgcaaagaatttagcacagtgcctagcccagtcagtagtcagcaaataatagttcttactgttacaataatcagtggcattcttcctctagtaagctttgcattccagaaaactggacagcttgtattcagactgtggtattcctgcctgtgtagaccgtactggcattcctcgcccactccctgcctccctgatgtactcttattctgtctacagaaccttacttgaagctcatctataaagacttctttgagcccttcggacagagttaatcactttcccactcatactccctttttccttatttatcaatgatacctatcacactgagataggtatttggttaagttgctatatccccacctgactgtaaggcctttgtgaccatatttctcctccttgctttagtcctcagtgcccagcacagtgcctggcctaagaaagccctcccatcagtgttgtgtgcattgaggagcagaggactaagttgtcgtctcaggaaagcagacctgctgaaagctcatcaatcttaatgttccctgcctgacaccaaaaatgcattaacagatggggaatggtgtgcttggaacctagtaaaagtgaagtcgaaagagtcaggaatgctgcctccagtgctgtacaaagaccagcagatgcaatgcctttgaggcaataataagtaggaagaaagtaaccctagaatgtgtctattgatgtgtaagatctaaaaccacagcgggccaagcaagacccttcaggatgcttcctcctgcttctctcaccctggctgcaagtccctgggatggaaacattcacatccacatgctcaattggaaagaagtactcggcaaggctatgcgcacccggctggcactgcctgatgtcattaaagtcatgcgattcactccccttgctctgattccacgctcagcaagaaagctcccatggagagtatccctacagggcagggaacacattgtccagctgacacaaatttttaagtattgcttgaagttcaacacgcctggcatgctccttagaaagacctcctttttaaaggaaagctatgccgggctaatctggttgcacatggtacatgccagtgtctgagtcaaaccagttgccttgggctctataattggatcaattaccaatgttccaacaaagatactcatttacaggtataaggttagccaatcacttatgagatggctcctgtgagactccacccaatgcagaaacttcaaagaaaatggtgacaatgtctatgaatcagaacctttgttttgggattaagacacaataaagggagggaagttggtcctgatgccctacatgatgacaggccattgttcaagttctccccaggttttcaggatgcattggtcatgaaaatacttggtccaccagagcatgcatataccctcagcatggttttgtggtcttgctctccacttgcttagcttaaaaataaactctgatcacctgaggatacctggtcttatatttcccatgcacataaaagagcctgaagtgcagcttagaaattatatataatttttaattttgattttcaagttatattttagaatgtggttgatgtcagtcagtttcactcagcctaattgacattggatcctaagcaaattaaagactagattctgagtcatggtgattttctgcctctacagctcaactgtctctaccttcagttgcatttactagacttgaaataattttaaagtgttagttaatccacaaacttctattccttcaccctttatgaagatataggaaatatctattctttcctgactctggctgagtggctatttggaatctgctatatttgattttttttattgaacttcaaacttgtgttttttggttttttttaaattatactttaagttttagggtacatgtgcacaacgtgcaggttagttacatatgtatacatgtgccatgttggtgtgctgcacccagtaactcgtcatttaacattaggtatatctccaaatgctatccctcccccctccccccaccccgcaacaggccccggtgtgtgatgttccccttcctgtgtccatgtgttctcattgttcaattccccttttggagactgggagcaatagaatgtagctgcccctggtgagagaaaatggtgagaagaaaaaaggatgtgtgtttggatgaaaagtagcttctaatatcatggactacatcaacagttttgcagattcataagtgggagcatctctgcaaaggagcagagaaaccagaaaatgcaaaaaagccccaaatagcaagccctcacatttgtttagcgcttcacaatgtaccaagcacctccacatgagttatctcatttaatcctcctagcaactctgcaagctgggaagcacaggcattagtttatatttcacacaaagaaacttgagatcagagaggttatccaaggtcacgggacagaagcaggatttgaaccagttacaaacggtgtaagcttattgaatgaatgtttgtccttcatttactggagcaaggttaagagtgcaagcactggagtcaagcagacctgttttcaactcatagcttctccatgtattagctagccataggatcatgacaagtcactaatttctctgggcctcactgtcctcatctgaaaaatgggaataatgaaatataccctatatcattgtcccaagtaatacataagataatatatttaacaggtctaatgttgctccagaacacagttaaacacacaataatttatgccttcttcatgctgttgttggcatttgttgtagtagtagaagtagtaatagtggcaggtgtcaatgtatatctggccccaaatcctgcgttcattctatgcaacacactgcactgatttttttttcttctccttttgccacgcgtattttttctttctcttttatacagttttctttcatcctccttcctatcacatgtatagaaatcctaccatcctctgatttgaaacacacatacagacacatgcctgatttagtacctcttctaccgatctacctgtcttagtctttcccactcatttacccaaacaatacagggctcagggaaaggacggggaagcctcaaggaaagcacagggaaggactcatgctcctttacataagtcagtctcagaggagggcttggcattcccaacaaatgttttattgttttggtttccatgatcctacaccaagtgaagagatttgagggtctccagtagttaagctaattagatataattttcctttttggtgctttagctgagttagaggtttcaggaaggagagaaggaagaagcctgggttaggcatatctagcctaactcccacgtgatgcctttcacttctgaattaattccctggataaagtaccctttctgacaacgagataaacaggttcatccagaggtttggctcactagactataaagcccttcataaccacagtgctcgtctccatccaccccaggctcctagccccaagtaggctacagtggcaggcattgtgtgctcaacaaggcttcacacccactgggaatctgaaacataaacactgcttacactgcaaagttctctctgcagacctgcaaggctggtgccaaaatggctgcctcacgtctgcccccaccgggctgcacaaaggactccccacccaatctcactatcaaaacctctgaaatgacaggacaggtggcaaccactggctgggcaaaaggctgatttccagaacttcagaggagagctgtgctggcatcctttaagaagttgattctggggaacgtttcttctatggtcattcctatttttaggacagttttaaacctccagagcttctgctattcctttctccttgaagggccaactgaagggtttttcagtggcttgtcaaatgttctttatctagtatttgtttgttcgaatttctctaacaaagaggtttagttttgacttactgtttaagcacatgcaggttaagacaggagcactgaggcattactagttgtaaccaaagacatccaataggcttaattatttgctcatacacaaaaaagcaaattggataatgcctctgcttttggctcttatctaacttaatgtggacaactttgtagaggtcttgtcaacaaactgaatgagccactgaaagtgaggcattcattttagccgtaaactttggtgaacttttttctgttgctggatatgaatcagatcccaggaaacttagaaagaacatagaaatagcattattctgtccttagtgataaaatacccatttttcctcgggatcaaaagtttgggtcacccacaaatacacagtcaaataattgtcagcaataacatcaaaagaattcaagggggggccgggcgcggtggctcacgcctgtaatcccagcactctgggaagccaaggtccacggatcacctgaggtcgggagttcgagaccagcctggccaacatggagaaccccgtcgctactaaaaatattaatactaaatactaataccccatcgctactaaaaatactaataaaaattgccggatgtggcggctggtgcctgtaatcccagctactcaggaggctgaggcaggagaattgcttgaacctaggaggcggaggttgcggtgagctgagatcacgccattgcactccagtctgggcaacaagagcgagactccatctcaaaacaaaacaaaacaaacaacaacaacaaacaattcaagggggaaatgaaagtctaaaacaattggatatccccatgagtaaaaccaaccttaatccttacctcatagtatacacaaaaattaatttgaaatgggtcataaggctaaatgaaaaagcttaaactatgaaagttataaaggaaagtataggagaatatctccagaactcaggagtagtcaaaagtttcctagttcatagcaagcaataatcatgaaaaacaaattgataaattgaactttgtcaaaattaaaaactgctcatggaaagacgttattataaaaactaatcagcaagccacagattggaagaaaatattcacaacacacaaacatctgacaaagagactatccaaagtatataaaagaactcctaaaattcagtaatcaaaagataaccaaattcaaaaatgggcaagagacttgaacaggaagatgtacaagctactaagaagcacatgaagtagcacatgccatcatttttcatcaggaaaattcagatgaaaggtccattgagaactgactatccacccactagaatggctacaagttttaagagaaactgacaccactaaatattggtgaggcgctagaacaaccagaactctcatatactgctgctggaaatgcaggacaatttacctgcttcagaagactatagaagagcttcttctaaagtaaaacacacatcttttctatgatccagtaatcctactcctatttgtttatccaagagaaaggaaagcatgtgttcacaaaagaactcagacaagaattctcataaacattttattcatgcctaaaaactggaaacaacccaaatgtccaccaatacaacagataaacttttgtatattcatagagcggaatactactcactaatataaagaaatgaactatatgcaacattggtgaatgtctaaaatactgtgcagagtgaaagaagctacacacaagagagtatatacagtatgatttcacttgtatgaaattataaaacaagcaaaatgaatctatggtgtaaggaggccatgtaaagagaaagagaaggccagccagcccagtatcccagctgagcctaacctagattgcagaataatgagaaataataaaatgattgttgttttaagccactaggttttggagtgatctgttacacagcaatcaataatcagcatcattgctttcctcatggaattgtcagaagtatgtgatatgacacatatggaagggctctgtaagtggacaagtgctaagcacttgtgagcggcagttatctctgggcatatgtgcagattggggttagtgctcattagggatatgtccatttgagaattaacctgtggaattcagagggtcttactacccaaccaatataacctttggtttcttctatccctctccttcctcttgagcagccatccacaactgcttctggggaagagagagagagaaagagaaagaaagatgttcatggtttgttaaaaaaataaaagaaaataacatttacaaatggccagagtagaaaagatgtaccaatttcatttatcttgttaaggaatggggctagattgaagattagccaatgcttataatttttgaggctctaagaaatacctttgaagttagagaaggatggagagaagtgagagggagtcaccatggtctaaggggctggtcctcaatctggtccgtgacatgttgatcaggctcagggaaattaaattaaatgaaccaaattcccaagaaactgcttgatcaaccagaacgccagtttatccacttgcaatgagaaatgcaatttccaagccacagtatttggttctgtcaggtggtaaggagaagattaccctgggaaaccagattacttgacctggtaagagtttcatgtctggaaacatggggaagtgaggacatgcggagaatcatgagcaggtggagcactttgggcgtgctgagtaatgtcagtggactgttacacaaagcttaggtaacgcatctttcatgcacctggaatctgcaatctaacagatttctaaccaggctgagaggatgctctcagtcctgccagtttatggacttacagggatgtaaggaactcaagacagggaaatagcctctgtctccaaaaggatagcggagatgaggtcccttttttattttttaaaaaaacaatataatataattgatggattcagaccgttcacgagagactattacctccacgcccagctcaggcaccttctctagaatccctttcctaataatgtaagtgcccctgtcacctccatctatccatttttgttcttttaagcctattttatattatttgcttatatgccaaaccctaaacgatgagttcttgaaggttaaaattatgttttattcatcttttttcactagcccccgcatagtcgctggcatacataccgtggtgctcaataaatgcatgtggcattaactaaaagtttgctgtttctggaattcgtctgaaacctgaaacactgcaacaacatctcacttagaatgttgccttacccttttgccataattttagagtgaggaagtagaggtcactagattacgtgtccttttatgaagaacctacagctcagggcagaaaggcacttgccggaatcaccctgccagggaactctgaaccccgctgcgccgccgctcctgatctctggggtttcaggcgcctcctctcttacaaccctctcctggggaagtaaaccccatcaagacaccaccacatccttccccagcgactcagcctggggtcacaaaggcctttacgtcccactgaaaaacggttttctttcatttgtgcccattcgttcttgcagccccttccccagatcgaagactagggtcttagtaaggagaggtaaggagggaggggaagaacctgcctggccccccgcggagctctgcagggggcgtcgcggctgcacgccagcgcccgcaccaccccaggcgggaagggagttatcacacagggggtcgcacgcagatctcggggaccgtgggtgccacgaggtcaaactggcagagggagacgctgcagctgctgtaacagcaaggaaagccgaagcccccttaggggatactttacaaaattattttaatcaccgtgcaaacctaataacttgacccaagcgcaatcacctgtattcacccagagtaaatattcctaaaatcccgttcagtgtgtctgtgtctctcccgcctctttccgtttcaggcaaatgtctaccccccctctccccccaccgttaacacctctctgcagcgtgggaaacagtgcccagcagctcagtcctccgcttcccgctctgctttttgcatcccattcggacttataggaagtagttattttttggtggtggtggaaactgggcaagaaagaagacgctaagcttggccggggccaggagaaatattgagaagggtcgttaccttccatccgatctaaaccaatcatctcaaacttggctactctttggaaccacctggggagctttaaaaattatggacgccctgatagcaccgcagaggttctgatctaattgatctgggatgcggcctgggtatcgcgatttttttaaaactcctcaggttattcccagcttgaaaactatggatataaatttctcattcctcttcccacccagaccaaaaaaaaaaaaaaaaatctaagcctaagttgatggcccagggaatctggcacctgctcccctgcaaccagccagtgctgcaaggtccccgaaaatcggcgcgagcggcgacgctaaacacgcggcggcggggcgagcgggccaggcgggcggtgccgcgcgtggccccgcccccgcacgcctatgggcgcgaggtgcgggccctgacgtcactcttgtcagggccgcggcacatgggcggccggatgcgctgagcccggcgctgcggggccgcggagcgctggggagcagcggccgccggcgcggggaggggggtggggtgggacggcgcaccgcctccggtgctggcactaggggctggggtcggcgcggtgtcttctgcccttctgcagccgtcgacatttttttttctttctttttttcaattttgaacattttgcaaaacgaggggttcgaggcaggtgagagcatcctgcacgtcgccggggagcccgcgggcacttggcgcgctctcctgggaccgtctgcactggaaacccgaaagtttttttttaatatatatttttatgcagatgtatttataaagatataagtaatttttttcttcccttttctccaccgccttgagagcgagtacttttggcaaaggacggaggaaaagctcagcaacattttagggggcggttgtttctttcttatttctttttttaaggggaaaaaatttgagtgcatcgcgatggagaaaatgtcccgaccgctccccctgaatcccacctttatcccgcctccctacggcgtgctcaggtccctgctggagaacccgctgaagctcccccttcaccacgaagacggtgagcgctgccgcggccccgctccgggaagggacgacgctccgggggtccccctccgcggccgggcacgcccgctggagcatcccccaaccccgctcccgccctgtcccgcggcgccccggccccgcgctgatgaaattgaggagctcacccagcacccttcctccccttcctcctcctccatgaaaggggagggacccctcctgagctacatttaaaagagcttcgggcacccggcctccctgggtcccgctcctgcggcgcgggtgggaggtgtaacttgacaggtcaggatcgttccctagaacgaggcacacccgcacgcagagcgagcccgcctgcggagggcagagcctcccgggctggggaggagaaaccctggggcctggttctgtgcggggcagggggcgggggtcggcttgagggagggggtttcactgcgtagcctgggttttggggttgtgttacagcttctgttactggttagtatttggaactcacgaggtgtgagagaagactcgttttcttctggtgaagggtagctgagaaagcggggtgggggctggggccggtggggggagtggtctctcggcgggaagccgtgcacgcctccagcgttgacactttcccggtgcactttttctggtgggaggggagagcggagcaggctcacgtgtaaccgcgcaggagcctcctctggcttgagccctttcttggtaagtcccaaaccttcccaagacaaccttggccttagcagtagaggaggggtacgtgtgatgaggccccaaacccggctaagtgatgccacggatttgggttgatgcgatttcatgccttcggtatcacagtagcaaatgcgaaccgtgcggctcacagtgtaaagttctgaaaggttatttggctacaaatagcttgggagtacttgcaccttcttttctaggagaggacaacctgttgcattgcaagagtttgcaatctgcagatgatagccagggacccctccctaactatcctttaaggaagagcatttgggaggaaggggctgcctgcaggcttttgcatctgtgggtgttttaagtcagattttcagatgagatggtagagggttagaatggatggcagtggaggctgtgtttctctgaagatgaaactcagaagcaaattccttaatcccagattccacccacgactgaatactagaattggcaagatccggaatgcttgttaaagacctaatgggcgagcagtacttccaggtagcaaatagctgcatacttccaacataaatgtatagaataactcaccttttccaatagctctgcttttgaaaggttttgtaaatgcatactctttgtaaattggatcatactcaaatgtttggagaagagaaggaagaaaacactttgtatttttttaaactccttttgtaaaaatcagtgtgccccagtggctttagaagcaaacacatgtgagctcagaaagttctcattctctgccaacatgaggcattggtcaagttccctcaagtctcagagcctccgagtctttgttgtaaatggaggtaattgttattttgcaagtttattgtgagatttttgagataatatatggaaagaaccaggtatccagtaggtactctaaacatgatgttaaagaagggtggaaggtccctgctttaccaaaattaagaccactaactcactggctttgtaagtctgaatgacctcctattgctgctgtgatgaattcctggaagataattcaagcctggttattggctgttgttttcttaaaaatgacagcagttgtatataatcacagatgttatattcctattttaggtttaagttattactcttctcaaataatgtgctgagactgttctctggtttttatcctagatcagcctgtagccctgccccaaggactagtgccttctttccaaagtaaataggaagatgttgaaaaacaggcagagatccacgtcctgcctgaacttttaactctagatctacaaaagacagcagccagagaaggaccctgccattcgtgagaaatagtcttataacaggccaggaaaagtgataaaagagcggtattgtttttcttttctttctttttttttaagtccagctttcccttcttctgcagcatttagtaaagataaagacaaggaaaagaagctggatgatgagagtaacagcccgacggtcccccagtcggcattcctggggcctaccttatgggacaaaacccttccctatgacggagatactttccagttggaatacatggacctggaggagtttttgtcagaaaatggcattccccccagcccatctcagcatgaccacagccctcaccctcctgggctgcagccagcttcctcggctgccccctcggtcatggacctcagcagccgggcctctgcaccccttcaccctggcatcccatctccgaactgtatgcagagccccatcagaccaggtaagtgccctgaagattctcccttcagaaagggaggaggagggtgaatgggacaggcaaggtagagttagcataaacatcttaacactcaggttttagcaaagatcctaagagaggtaccttcttctgctccactcctggcagaggctctcccactttaatgagcatccatatcactcatctggagagtccggtaaatacagactctttgtatctacccctagaaattctgattttgcaagtctggaatgagggcccaggaatatgcattttaaccagctcccccatgggattctaatgcagctgatccaagggctgcagtttaagaaataacttacagttaatgatttggataatttaagcctccatcgcatcttgtatctcttttcctcattccctaaacacgtagataacaggtagactctcaatagggtttggtttacctatattcactcttgtctgtcctgaaggaaaaaaaatgtgagtagggatatggggcaggtatttttttttccatccttttcatcttgttttgtcattagctgagaagtagaatctaaaagcaggctctcatattgtgtttctgagccttcttcaggaccagactccatctctctcgttgctattcccataaacccaactgttcttatctttttttttttttcattttcatctgtctatcacactcagtccacctgtatcaaagcccacaaggctgcaaggtcagctgtaaatgatcttgaaatagtacacaaaaatatcacctgaaatgaccagtacttcaaaacccactgctaatgctcagatataaacacagattgaaggagctttgaattcatgcctttagcaccctgtagtaccaaatgaacaggaagaaagacgatttcatgtgcacaggtaaccaggaacaaagattcagccagataaatcatccggaaggtcacagagctgagggccttagctgtgggggaagacagaaagcaggacaatgcgaaacttgtgctagagattgttactgaactccgtgtcctcgactcttgtagaaatttctgtggcacatggagcaagatttaaatggaaggaaatgatgtaaaggaggaagagaatacccctgcctcgatatattcatattgaagttcctcctttcagacctctgtgtgctggccccttctccaaaattcactttgaattataactcaaggccactggctggaatggaattaattcttagcctccagccacccctggaggctgtgggagcttgggaaaacatgcctttatgtgatcctgatcccctgctacttagaatgtgcggtaccactatcttcaatttttttgtaggaacaagcaacaaaatgaataacccttcaaagtgggaaaacagccaggagagaagggaacagagccccagtgagagacacagttatgcctcggtcattgtgctctgtagactgagaatcaccactttgtagctgtgtgaccttagaaagcaacatcatttcttggagcctcagtttccttttttgtagaaggatacaatttctatttgattgagttattgtgaaaattagagataatacgtataaagggtcaactgattagcaatgagtcttctatttgtggaagcaattgtgatcattgttgtatgtgtcaacttttattacttatttcaatccctgtcttctgaaatatcttcgtaaggtaactaggtactgtatataacccttcctctggagagaaatgtcaggagattttgcccagtagttactggattggggtattttgaccaacacttgtaatcaactgacaagtatttcttagtcccctaccaaatttaggatgtgtaccatgttaggaatactatattttttcccaggagacctgcacatattgggtgttcacaccttggttcctactgagagtcaaaaattggggttttgggatttgaagcagcttgaaaactcatttgtcagagctcattagagtcagtattgatcagtgactctcagaaggcttggaatgcccaatcagagttgcaatgcatagcaaagaactcctgagtttcaggggatgtcattttgtaaggttctggtggaaagacactgggatcaaagggaacactgagggtctagaaataagttctccatttaaatgtcttattttaaataatggaaacacacttcaacatagtttccttcttggagttgaaaactcgatagtcctcatagaaaaggaaaaaagttaaacctcgtcttcaaataccaaactcaggtaaaataacactctgctgttcatagattgttgatcattataaagatgcaaaataaaattctaagagatgttggcctgatggatggatattgcaagcaaacctgaaaaaggagaaagttcttgattattctgtgtggctcacaggagtgaccagaatagaagtaccaagttaatcttgaggaaaataagtcctcagaagggaagagcacagatgtagccttggtcattctgggagctgtataatttcagtcttgattggtgtttctcaaccttggcactgttaatgttttgggtaaatcttttttttttttttttttttttgagacggagtctcgctctgtcgcccaggctggagtgcagtggcgcgatctcagctcactgcaagctccgcctcccgggttcacgccattctcctgtctcagcctcccgtgtagcgccaccacgcccggctaatttttgtatttttagtagagacggggtttcaccgttttagccgggatggtctcgatcgcctgacctcgtgatccgcccgcctcggcctcccaaagtgctggaattacaggcgtgagccaccgcgcccggccttgggtaaatcttgtgtcttacgctttataggatgcttagcagcatcgcggcccctacctcctagttgcaagtaggacccccagtgccccagatgtgacaagtaaaaatgtcttcagtcactaccaaatgtcccctgggcataatacagtcactcccggtggagaaccactggtctagaacttcaatttggacagcaaaatctggacttactttaggaccctgtcacacgcatggataaactacctgcaatgctttatggcaaaacttttaagaaggtcaggggacattgggttgccaagaagaaatagaatattaataagagcataattatacactttagttaataaaactaagccatcaggctaatcaggagataattgcagagtagtttaccaaacaattgtttttggctattcactcagcatgcatcttttgagctatgctccgttgtggtgttagtgcttcttgtttggttgaagggcaatgaaaccatgagctgataaagtatgcatttctaggtctaccccaaggatgtcttggaatgacaaggtgagcattcttgtgaatatttatttatttatttacttatttgtttatttatttttgagatggagtctagctccatcacccaggctggagtgcagtgacacaatcttggctcgctgcaacctccacctccggggtccaagctattttcctgcttcagcctctctagtagctgggattacaggcattcaccaccatgcccggctaatttttgtatttttagtagagacggggtttcaccatgttggccaggctggtctcaaactcttgacctcaagtgatccgcaccccctcggcctcccaaagtgctgggattacaggcgtgagccaccacaacctggcccatttttgtgaattctcatactatttaccatgactgccccaacccctttcttatcttgagcaccccatccctattcctctaactgtctgatcaaagaatgaatcaaatatctgaagaaatccagttttctttcaagaaacaatccagggattcattaaaacctgttgtggctattgtgggatcaccaagctttctgggctgacatcttaatgaagggaagagtagtggttcttggaggccagagctaactgcaggggctcctcggtcatccaaggtgcagtgtcctgaatgttcctaggccagcagagatgacaggagtcattctgatgacttcaatgtttgcattttagatactgtcagaggtgggatgtgggggtgctctcctggagggacgaatatgtgctgggtactggaaaaagaagaatctgtttgccatgagaattgagcgattgctttaaggacagccatccctttagggaaagtcatctatagcagacaaaggcagagttatttttatattacatgcttgtaaagccagatttgaaattatttcctctggtggtttttctttgaatagctggggggtgtcctaccactgttaggcccatattccgctgagaattaagaaggctgtctttctagttctgagcacggagactgggttatgatgaaggctggttacagagtaaagtgaaaacccttccatgtggttgtgtgtgggaaaaggatggcataagtgggtggcacaaaaggagcgggggtgggggagaacccattgtacctttgcaatatggagtttgtattctgtttctgccgaccttccttgtgagaaggtttgggtatggaaggaaaacgctggcctgggaatctgagtaatgatggagggaagttctgtgcaggtgattctgggtttatggaaggtcagaggattctcttacttttcccaatattatgaggtgaagctccgcttaagggcgtgcagttcgtgtatctttccagtccagcagactgataatgtctgcaggttgggagcgccatgactgatagtagctgtgcccggtgtctcaagcatcttggaagtgctgttcattcatcaggggctaggagatcctgaaggggagggagtctgcatggttctggagacaggtagacatttttctgtttcttgtagagtttatcttctccacggatccctgtagaggacaggcttgctgacattcacaggatagtagtcccaagcctgtggcaaaaggtatttttgggtatgtctggaaagcaaggcaacttggtggttaggattgtaggctctgggctcaggggcttgggtttacatcctggacccacccctggcttgccgtgtaactttgtgtcaatttcttaaccctttaagcctcagtttactcgtcaatacaatggaaattataaatggtccctctcccttggggttttggcagggttaaataagatcgcatgtgacaagtctggccagtgtgtattgcacgagtactgggtgcattcagctgttatggtgtcagtggcatgaggtacagaaaggaatgactggattcccaatccctgttttctatttagggatttatttatccagtccccttccctctgcaaaaataggacatgctttcatgcattttttttctttcccatcatgtccaacacttacagcctgacctttctcttccttctgggttgggacgaatcggttccctgatgttaaccccgcagcatggcttctgggttaccaactcctgttttgccaatgtggaaacagccactgtctgggtgcccagtcccccagctctcgtgtgagccctggcaaccctggctgcctgcctgcatgaccgtgtgctccaggcacgtggctgtgccctgtggagcttgcccaacgctgtgtggtgtgctggcttgcttttttttttttttttccctcctccccctcgcttcccttcccaggagaatgacagcaagtgccagcaagcaattgtaatcctgaccctggcatgagaaagctgagctctggagggcagttcagatgccagggaaacctgttctgtccaacattctagccagaccccaaacctggccctctctcctgcctgtctgcccagaggccctgtcttctctgcactgctgcggtgggcaggattcctggaggccagctcctgccaagggtcttggcagagtctttccagttcagcactgtgcctaccagactagaaaaatagcaatataaagacagaattaggtggaggagaaggaaagggggtgggggaggtgggaagaaaaaaacccttgataacatcctaatgtagaaagccagaggaggggaagacagccgtgatttattaggtttctcagaaacctctcttccaattagcactaatcacttttacccaggaatcattttttatgtctcagcaatgaaaatggaggtaagagggaaggtagtagagaaagtaataagatgaaaaaaagtagaaaataacatattagagaggtacagggcctgtgtttgattctgtaatgggtgtgggtgagaatattggtcacagctaatattgattatagtatttggccctcccccagcaaatgtcttgtcctaaagctactaaaccactgtttttctataaatttaaatttccctcagacttaggtgcctctgtctcaccatgcacaatgtctgtcagaatgtcctgtgtttgagacaccagtctatacgggcaatatagcagtaatgttttttagagcacagaattgaataaacaaaacagcctgagtgtgaatcctgactttgccactcattagctgctcacgatctcaggcaagtcatttaaatgctctgagctttcagtttctcatccggaactttggaataatcattggacctgcctcataggactgttgaaggtcatatgagccaatgcatgcagagtaattgtcacagtgcctcgcacacagcaagtgcttaataacagctgctgcaagcagcaccttcaccaccatctaatctcatttcccatgggaggaccaagcgtggggctcagaaagagtcttgatacttttcccttcctagctaattaagaacactggtcaagaaatttggatttctctcctgcttctctgccaagtcttgcttgcccttctcttagcctttgaattttaggtgaccttgagtagctaactgtaccctttactcattcttcctggctcatgggattaaataaacaaaatgcattttgaagaagtttttttgtttgtttgttttttgagacagggtcatgctctgtggcccaggctagagagcagtggcgcgatcatggttcaccacaacctcaacctcccaggctcaatagatcctcccacctcagcctcccaagtagctgggactacaggcatgcaccaccacacctggctaatttttgtattttctatagatacagggttttgttatgtttcccaggctggtcttgagctcctgagctcaagcaatccaccgaccttggcctcccaaagtgctgggattacaggtggaaaccactgtgccctgcccaaagaagttcttgattagatttcttccatgtcatatttgctaatagatcagtcagttactgctaccattgaatttttaacaatagacattaataattatatttaaaggcaatatagtgaccttgggggtaaggaaaccataaaggtatgttatggtgtttcagaaggagaaggttcagtttatcctccggcttgcaagcaagactttacataagcattccagaataataattcctcctctccccaaggggttctttaatgagtaaatccttaatctttctgaaccttgattgtctcttctgcaaagcaacatccttgttgggtttttgtgagctttctaaagctactgtgcaagaaagatccagcttggtgccctgtacatagtagccaagcctttaccataagtcagttcagttacttttctctaagaaatgataccatgattagaaaacaacagaggactttgggaggctgatgtgggaggattacttgaaaccaggagtttgagagcagcctgggcaacatagcaagacccatctctacaaaatatttttttaaaaatattagctggatatggtggcacgtgcctgtagtcttggctacttgggaggctgaggcaagaggatcgcctgagcccaggagttcgaggctgcagtgagccttgattgcatcattacactccagcctgggtaacagagtgcaaccctgtatctaaaattaaaaattaaagagaaagcaacagaggaggttttaggaggcgaagagcaaggtgtatggtcccagaaatagcatctgtttttgctctgtgctttggtgttttgatttgtgcaccctgaggaagagagacaagagtacaatttggctgctagtttcaagagacagtgatttagtagggaagataagacttttaggcaaagtgatgagtgacaggacaaactagcatgttctcagtgtcaaatgacgggtatatagaggcctccaatatctgctgaaaagaggaggttgaaagattaatcaagaaaatgaatataaataagggagcagtatagccaataagagctgccagacctcacaggaagaagcctttgctcaaggcaaaggtgcctggggcgaggcttcttggaagagttgtagcctgtgatgggcccggaaggaggggtgagagagccagattggagaggttaatgccccacaaagttatagaggcaggaatgcccacagggtgttttaggcaacagggtgtagatccaatttggctggtgcagaaaattcatatgaaggagtcagggagatgagtcagagaggttggtgccagtcaggctgacaacttcatgagtaccaggctgcagagcttgaactttatccagtaggcaatagggagccattgaaggtttttcagcaggaaagtgcatgtgaacatttccacttgagttcaaggttggatttgaaacatttttagaaacttgacaatagtttcctctggcaagccaggatttccttatttttattattttgaaaataaatactctcccttgaacatcaaacagcttttcaaaacacgatgttctaatgatctagagaaagtaattcaaaaacacagggtttaggtttcatttataaaacccataattttggtgattgggggaaacactctttggcaaggaaatagtttgagggatttgactggttcagaatttaaaagtccaaaagcaggcctggtctcataggagtagaaaaatagattttaataaacccaactcattaacgttcatcacttttaaatgcctctattttatacagcttactaggtttgcaaataagtatattgaaccagatgttatgtgtatgtgtgtgtgtgtgtgtgtgtgtgtgtgtgtgtgcgcgcgcatgtgtacgtgggcatgcgtgcatttgggtttgtgggtgggggtgggaaggttaatgtctcagtgatacaaatagtacctgattgtaaggattacctggggcagtaatatcaagctaaaaatacttagccaagtttctggctagcttaaatcagttttactcctgggaaacaaaggagtcattattacagttttgcattcttgagtcctgaccttgtatttgtggctcccttcttccctgaaaacagaactgtacatcatgcttagatatgggatgtgtgtgtgtgtgtttcatattgggagtactagtaaaggaaagggacattgtgggaggggatcggattggggggggttggactgctgaatgtcaagtgcatgaaatgacttgctcaagcaccccctgaagtgtgctctgatatcaagccaagatttcagaaggctgaaagagttgccataacccaatctagttcacttaaatagaaaatagctgtcaaggtgggcaatttcacctccagctacatagagtagacaattacaggagtgttggcagaatcgagtgtctgctgggggagaaactatagtatttgtttctgttaaattggcttgtggtgggtacagactccatgaccgaatgtggaaattcctaaaatgttggttttccttcttttctgacttttacaaactaatgttactctcttaactcactacccatccaatctcattttctttcctgaaaaactacacagctcccctgtcacacagggttcgtaaaagtttcgtttttagaagtttaatctgggatttgtttccttaatgatctttggaagaatgctttggaatttgaggtcttataatgagacatggcttgtggctattaaaccctgttgcctctcaaattttgcctgggagaccctagattcctaaaaacaatgagtgcatgctacagaaagatgcttcagggagctacaacactaaatcatctgtgacaaaatgttctcttagaaagtggaattgcataaatggatcagcagaaataaatgctttggcagaaattccttgagtggggaagagcaatgctttcttttctaattagctctgggtaacagtctgctgtggtgtctttgctgtggaacccaggcatggacagtagagcaggaaagtctcatcactgctctctaagtgcttctgcacttaatggaaagagttaagcacgcctgtccatttgtacccaataaatgcctcttgaattgatttgagtggcgaaggtttgtttgggggaaggatgccaccaggccctgaccaatgggaatcaatgcagcaaaccagatgaacaagatcatctagatatgcagtaatcagattacccagaacagaaatctcaataccccaagatatgaggggttattttaaggatagtggcaaacagttaaactcagcctgccctgaggattgagcagaagactgaattcaccttagtcattatgatgtgggctgagttagtaacactgaaggagaccatgcaggcttttactagagaactatgaaaacaggacagagatctcagatccaattagtactggatcaaaatagtattgtttttaaaaggccaaaggccattgaaagatttatagaggaaagagtaagtaatataaaatgtaaagatggaaataaagccttgaaagagttcctgaagacaagaagagagaaatttgcagaactgaccttgtaagaatttcataaaattcatttcattatgattgatttctttgtattagtacaccttcctggggaagtgagtatcttttttcctcataaaatctaaagcatgtttatttcaaatgggcagtgacaactaaatgatttaaaaataatatttatattcatgtcaaaaaagttatttttaacattataagtgaaatttacccaaacatagtaggccagataatgatatttagttattggcttcctggaagactgatgacaggaagattcagtattacacaaactaggtataaagaagcaatttaggtctacttattttatttctcctttgaacctctcacttgcctgacagtagcattgcattgattgagattttatgatcattttatcttgaattggttaaactaaaatttatatctttgtcttctttataaagaaagatattactagctgggcacagtggctcacacctgtaatcccagtgctttgggtggccaaggtgggaagatcacttgaggccaagagttcaagaccaacctgggtaaccgagtgagaccccatctctacattatatatatatatttttaatttaaaaagaaaaaatattaccaaacagattaattatgcaaacataattttgggacacagagttaacttgaggacaaaatagtttttaaagattttaactgtgtatatataaattaatatcctgaaccacaagtgcgtattagtgaatagcaaaagaatttttttcattctgacatttcagtaattcagattagcattcccaccaaattgttgccagttatctccatctgtccccttctccattcccccccaccactcaattttcatatctttaaaattaaattttcatataagtatatggaaccaaaatattattttcattcatttacctgccaccagagaggatgtcatcggccaacccgcaaaggtggtgggatctaccagccatataactcttctgcatttgttccctccattgtaagtgagggtgctgatacctgcttcagaggattcctggagaagtaaatgagatgatacatgtacagcacttagaacagtgctcagtatataaatggcagctttcagcagttttatttttattctacaattactattccttctcttcttccacctccatggctattttatggacacttaagtaggaacacatcttgtgttacagcaatgctatagcagtgatggcctggaaactgcttttgagttattgcagggaagaaaggatcaggaagagatacagcaggtgagcaccctgtgtttttacacctgtgagaagatacatcccacctcaaacaccatttgtggtcctatcaccctagcatgtcacagtgtaattgcctgctttcttggatagctctttgaatagatgtatgctctgtgagccctggctgtgtcttccatctccatatgccctgctgtgcctgcatatgtcttctggtgctatgcctggaagatcttgagtgggtaagggtgaaagggaatttagaatacatttcctttggtgctctagagcctttccaacatactgccagatttgtgttttaggtttcttctttttacccttggtgacacttctgggccataaagtagtgaactggctgtcctctagttgttgttgatgggctcttgagtgatgtggaggcaggataatgggttttcaatggtcacaaaactccctggccttctgctctccttagtgtgagtctctcaaatacataattcttaactctcctttctctgtaccagagggaaacgtggcagagaggggtccagataggaaagaatggactcttctgctgaagtgaaatggaaatacaaggaaattgtaaaaacaaaaatagattatttggaagaaatgtctaaaaacggtttttacacaaaggggacaactagaagttgatcgatttaagaattgagattaacctggtatgactttggtttccagctagattacagctgtggggttcttggcccttggcatgggtcacgcttgatacagtatgttgtgcactgtacatgtggatgtggcagggtaaggcttttaaaggtacagcagtcttgagggattacaaagtacatcagcatgaaactaggcaagattttagcctcttgtgagggatgttgaatttcagctaaagctccctcagcatatttttgtatcccatcaaatatctctgagtcgcggccaggcgcagtggctcatgcctgtaatcccagcattttgggaggctgaggagggtggatcacttgaggtcaggagctcgagaccagcctgaccaacatggtgaaaccccgtctctacgaaaaatacaaaattagccaggcgtggtagcaggtccctgtaatcccagatactcaggaggctgaggcaggagaatcgcttaaacccgggaggcggagattgcagtgagccaagatcgtgccattgcgctccagcctgggcaacaagagcaaaactccatctcaaacaaaacaaacaaaacaaaaaatatctctgagtctgtctccccttttataaaagagtgaacacaatgctcctaagtttaaatcagataaattcagtatgaaatcatagcaatagccattatgtgttaaaaccagcattgtcctaaacactgactgtaagtagttgtagcaaatcaactcatattagaaatgatattggtccctggaatttagtctgttcccaagaggactgaatgttgtgaatacattgccaaagtatgttttctttttttctccatcagcccttccattctgactacaggcagcttaaaaataaatttgggcatatctcagtggccaaaaaccatggagatcaggatgaaatcattttcaaggcagaaataacaggcgttgataaagatattcagagaaacacagtcctaatagcatcggcacgtgattgtggggccctttagtcaccaagctaaattgaatttggaatcaggggtctactgaaaagccaggaaacttttgagcaagtcacttgaattctgagcccccatttcctcatccagaacatgatggcctattttgcaggattgtcatgcaagttaaattacattaaacaagctatcagtaaaaaggatgtgggactgtgcctactcggattgtcacccagtgagttttaattcggagtccgaatctggtatttaaaggccacgttctaaaatgcacttgtagttaatatctttggagtcttgcttccaggtttttgagttgctggactgggtctttgtaagctccgtgatgctgctttgggaacacaagagatctaatctgtagtcctggctatgctattaattgcaagtataaccttaggtgttcagcttctctggcttttacttcttcatctgtaaaatgggaataatctacgtccttctaacttacaagtatgtcataatagaaaactgaccaaacagtttacatcaatgtccattattatttccattggcttttaggcggcaagagatggaaaacacgtagcaacaatttcaaaggtaggccagttccaaagagcactgaacttggagtcagccaatctaggttctaaagccagtttgtcagcattagatgtctctggacaggacaggtcaccaaatctctcaaagcctaatttttcttgtctataaaatgtaggtgctgtttctagctctacgactctgtgttcaaagactactatgtgctggaagacgactaacattcacattttggtgaatgtctaaaaaaatttaaagcctcttgggggtaatggagctgctcccaagccaagtagtagatggattaagaatctgacattcttccactcataaaggatgacagagtttaaaaactaacgctgaaaagcaaaaaacatttgacaccttttggaataaaaaaatcaacaataatcaagctagttacttccttaaaaaatggtcttcatgccgaatggaaaccaccagattctctctggtgttcagcattccagaacaaccctgaaaataaattatctggctggaatcattgctccaacggttggatttcttagtggtcgtttactagccagacaaaataatttttttataaagaaaagaaaaaaaaaaggaaagcccacagaaggaaacaccccagggcccactgctggctcttttgatggcaacttttctaggaggacagtggccagagggggcctttggctgctcctctaggtggctggagtcaggtttgtaggacctgcctgtgatagtaggtttcatcttgcaactggctctgatggattagtaggtgcctgagaagtcattttgaaagggtctgaggctcggtctgggctcagtgaagagttctgtgattaattagtgatgtctgcccttggcttgggtggggcagtactggtgcctggtgtttgctgtcctgccagagcaggtttggaagatcctttagtagttgtccttctactgggcagcagatcaaggactcaggccggtgttgcttccgatgtcctggaaaagtgttttctgagcctccagcacataatgttttactctctgaaggaggcttattctgattagcttaacagagggtatggaagaaaggaagtctattgattcagctccttggtcacgagacaggaattgcaaggtggagggaagctgtaattccaacacgtaagtccatggatactccagtaaagcacaggcataggtgccactgatccagcagaggcagccacaaaccacaggccctggtaagctgcctgtggccagaggtcatggctgcagattccagggaaactgcgtcctcggtaggcagtcagccgtacactccatacttgcgattcttgatatttgaaatcaaaatcaaagtgcagccactttctttaaggaagctttggagaacttgccagtctgtttaggattgaaggtgattctcagttatccatgctaaaggaacagataatctgaagtttatttctcctcagctgtggaacgtgctttgcgtttttgtgctgttgatctgctttcctggtaaggtttgaactcttcagatttttctttctataaagaacggttgagggggagtgtagtgctttttgcagctcccccagtatgtttctaacatagccagccaaatgtctctgagcccttccagcctcctaactttaaatccatgaactgcaccagggaaataatcaaccagttgcaatttgttgagcacttactgtgtgctccctgggatccaggtaactgtgtgacaaggacttgatccaagagtgtgttgggcaatagggtgaagtgggctccaggttaaacattggctatagggatttacaaaagagttcactgagagtgggcctgacttcctctgctactgctgtttcctgttgtttccagtaactgcacttgagctctgcatacggttaactttcaattatcctgaggctgattaactggtttgcagattaaccaaggtgaaggctcacctgggcctgggagtcgctcatcaactcagctgctccataattagctggtgatggctgattgcctgccccatggttgggaagcctgggcactgggcgactgcaggggagggggaccaagggatgacttcttccaggaccttctactctctccaaccagaggtgccctctagccctgtaaacttctgcattctccagcacagttcctgagaggttcagaagttacctgggtcctggtgctctgctcctgctacctttcagctcctgcccccaacaccctgttcaaattgggaacaagttgaccacagggcacagtgaatttgaaagtccggagattaagtcatatgttgaaagagggcccagtgagcaggggccactaatcccctttcttcctcaacctaggaacctcctcccttcccaagatatagatatatatagattgagaccctgagcaatggatctcttttgaggccagtggagaccaagaccactgaagcaaggagtcagggactgcccacaacagcaaagctccccagagtccaggccaccccatggtgattgtttgggttccctgtgattgcctcccatggctgccctcgttcatagagagttgactgcatttgcctgggtccctgtggggtgagagtatggaagtatgtgtattagtcacaccttacaccagaccagaagatatacagtttaacctaggagtcaagctcctgctatatttggaatggtctcagttttgagacgtggtaccttggatcccaggtatatccaaagtcttgagagtgtccattgaggactttggtctgtagccaccaagaaagagtaaacatttgtgcaggatcatgtttgatgggattccatggattgttttcatttcttaagcagcattcccctgagcctttgacatgtctttccatctctggctgtgttctcacttgcatttgccaggcctgcaatgcctctgccttgatacaacacagtgtgccagcagctgcagtcccttttcagccagggccatgggtttccttgggtccttctctctggctcacgttttccagggctgttggtgtgtacagtctagagatcacattttattaacacaaagaaatctgcttgggctgcctggctcttgcagtcacgtggagagaaatgtgttcctttggtccttcagcctgcagcactctgtgcaaaatacagcagagagctgggcactgggccaagcttacatttcacttcggaacacactttcgcatcactccttggcagaacatccacggtggtgtctatttggggagtaagttagagaagtgttgtttgcctcttatgagtgtcgagagataggacctttagaaaatgttttacttttgcgcctgtcttcatcttcttcgcggtgcccaggtactgaggtgatccagctaaatgtggcagtgatgcctgagagaagccccttccttcctcgggccacccttttctcttgcaaaatcagtaaacagagccaggactgcctgggacagggaaacttaggccaaggtaataacatcaaaaccaaagtcctggaactcttgagtaagctagttaccctcccagataaaacaactttgttgtccaaatcttctttccaaagatctaagacctttctaatgttggtccaaggccagccatggaaggaaggaacttcagcaagccgcctggaatggcaaacactgttaaaataaacaaatggacctttgccatttggttttccctgacttgtctatttttatttcttttctccccccacccttgtactttacctctcgatagtacccccctttctccacccctactcccattctcatctcacttttctcaggggccaagctggctgttttgccttcagtaaaacaaatatctaatttcaaaaagaggaattaggagaaagaggtggtataattcatttcttggggtaatctcgcttccctcagctcctctattgtctgttcttgtaggtggccacctgaagcttgacttgcttttgaaaataaagttggttttggaattttaaaccttccttaggaaagacttgaatggttagaaaacaaagatttattggaataataatgacgtttcttttctcaatgaaatagacccctctcataacaaacggttgaaaataaactctttttccccatcacaccaagccataaattccataaggatttcccagcgccaagccttattcagagtcttatatttactgctttggaatgttacttttgccatcagtatcatccagccaagcaacaaccaatcaagacttacagaaacttttccagctagatgcatgtgccaggctgcttcttccttccatgatggaaggcctcccttgtcatagaggatgcccaaaatctcagggactgggatacagcctcctgccagtctgtgggtacagtctttgcttactctgcagaagggaggtgacagaaacccattccacctgtctcagaaacctgctggtaattaactttaaaaataatgccaagttctcacgtggctggtagatgcattagctcaatcaggggggaggcaggggagaagcatgctgcttcaaagagtaatactgttgcaatcacattagtcattccaggggaggttagataaggttattgaaaaggtgaagtcaccctgtacattgaaagaggtcttctgaaagtgttgagaaatagttgaagttcagaagttttatttggagctttgctcccccttccccttgtaaataagaccagtattttttaaaagccacattttctttgtttgatcgatgaacactctcatagttgatgattgagagtcatctacagccagtatcaagggtcagttctgcattactcatgtgtagattatctctttggtatactagccatggtcactgtgtaagccctggccagttgccacccagcataacaacaccataaggcatctaccccctgcctgcacttgggaagtgttcagggaatgtaatttcattttataattaagtgaaacaatgcacagtgcatttccttggtggattctaacagcaggacagttattattcagaaaggactgtgtctggactactttgagaatcagtagtttaagttgttgcacctgtgtttggcctatcctcataccagtgtaaatacttcaatcctgcaagattttctcattttgcataaaacaggtgaaggtttgttgaagtccatcttccaaactcccaaagtactctggataccttggtaggtccttgtggactccctgttgttgacttgcaagtttcccagaggtggggactggcttttatctccagcacctaggcagctgctttgtaccagagttgatatacaggaaacatttgttgagtgaatgaagtaacaaagatactaatttcattagaaatggtttgaaatgagtgcttgtgttggcagaattttgtccaacatggttggtctttgcaaagggttatgatagtatgatgcacgcctttgggccagatgtgagtcaggatggtcttggaggaggcgaagtgcagatatacccctgctgataggctcctcataatacttcagtgagctgtttttctcgtgactgtttcactattttctttttttcttttttctttttcttttgagatggagtcttactctttcacccaggctggagtgcagtggcgcaatctcagctcatggtaacctctgcctcctgggcccaagtgattctcctgcctcagcctcccgagtagctgggattacaggcatgcaccaccatgcccagctaatttttgtatttttagtagagagggagtttcaccatggtggccagggtggtctctaactcctgacctcaagtgatccgccctccttggcttcccaaagtgctgggattgcaggtgtgagccaccacgcccggccagtttcactgttttctgattggtaaacattcaaggctggatgccatggctcacgcctataatcccggcactttgggaggccaaggcaggtggatcacttgagctcaggagtttgagaccagcctgggcaatgtaatgaaaccccatctctaccaaaaacagaaaaaaattagccaggtgtggtgtggtgtcccaactactagggaggctgaagtgggaggatcgcttgagcccaggaggcagaggttgcagtgagctgagattgcgccactgtactccagcctgggcaacagaaccacaccctgtctcaaaaaaaaaaaaagttaaattaaaaaaaatattcaagaatgaagagtgttttcagagaagaggatttagatgcttacaaataaaagtggatattgaccccccaattttccaccctttaatcacagagacatgattggaagtcagcagctccagcctgcatgttcccagatcacctgtaagagttcttaaaactcatcccacaggttcttaattgggatttttaactgggtaagtagagaagctccatgttgggtgtggggaagggaggatgcagatggatataaatttttttaaaaaaacatcaacttatgtttctttggttaatagatgcaggagaatgcctcttctctccatgtggcatgtcagggtatagcttctttgagcacaggatttggtttacagaatggcatgtctccccatgccagccagtgataaggggcactaaaacagacttggccttgctaaaggcttccaagcaccaggccatgagcagttgaccccaccacagaggtatgtacagctggcaggaagctgcccttctggttcactgactcaagagttggagcagattgatccctggatttgcagtgccctcaatatcgctgcacagaattcattctatgtaccccaggccctatgtgcccacagcaggaaatatagtgtgagcctctggcaatatccagagttgcttgagcctcctcacatttgcttctcctattcagtttagtgtgcctcagtttactaatatgctggggaaaataacacccctcttgccaaggtgagatagcagagttctctgcataaaatagtgcataaaattattcctatgacaaggcatttgaaaaattactttgagaatgacttaaaatacagaacaatttttttaaatgtggcaaacatccttattcttatcacccagaattaacaattcagtacagttgccatatattcatatataaatttacctatatattcatatgtgaatctagacattgcagattcacttgggggtctcagggaactttttataaaaagaaatgcatttagttcgtaaggcctgattgagataattccaagtctgttttctcagctcttaatccttcctagcactttgcattcattgtattaataaataagcctgttttcagcctagttagaaaaaaaaaggccagcctcattcattagaattctgcgttccctttggttattctttgttggagagaagggggctcactggtacagaattccaagatatttcgctttggaatgtgaaaggagtctctcttgacaacccaaggagaacctgcctcagaatgatctttcttcctcagtgctggaaaatgaaaaccagacaaataagcacaaccaacattaacagaaggccttggtacagcctcaagaattaaagtgctgtactctatggaaaacagtgtggaggttcctcagaaaactagaaatagatctaccatatgacccagcagtgccactgctgggtgtacagctgtacttcgttttatcggacttcaccatattacactttgccgatagtgtgtttattaaaaattgaaggtttgtggtaaccctgcattgcacaagccttttggcactatttttccaacagtatgtgttcacttggtgtctctgtcatattgtggtggttctagcaatatttcaagtttttcattattattatatgtgctatgttgatctatgatcagtgatctttgatgttactattgttattgtttgggggcaccatgagccacacccatataagatggtgaacttcataaatgttacgtatgttcttctgactgcttcaccaactggccgttctcccatttctctccctctccttgggattcctgttccctgagacacaacaatattgaaagtaggccaattaataaccctataatggcctctaagcactcaagtgaacagaagagtcgcaggtctctcactttaagtcaaaagctagaaatgagtaagcttaattttgaaggtaggtcgaaagccaagacaggccaaaagctaggcttcttgagccaaacagttagctgcattgtgaatgcaaaggaaaagttcttgaaggaaattcaaagcactactccagtgaacacacaaatgattagaaagtgaaacagccgtattgctgatatgaagaaagtttgagtgtcctggatagaagattaaaccatccacaacattcccttaagccaaagcctaatccagagccagggcctaactctcttcaattctgtgaaggctgagagaggtaaggaagctacagaagaaaggtttgagctagcagaggttggttcatgaggtttaaggaaagaagccatctctataacaaaaaggtgcaaggtgaagcaccaagaaatgatgtagacactgcagcaaattttccaaaagatctagctaagatcattgatgaaggtggctatactaaacaacagagtttcaatatagactacacagccttatattggaagaagacaccatgtaaaagttatagctggagataaatccatgcctggcatcgaaggacaggctgacttttgttagtgggcaatgtagtgggtgactttaagttgaagccagtgctcattcactgttccaaaaatcctagggtctttgagaattatactaaatctactcttcctgtgctctgtaaatggaacagcaaagcctggataacagcacatctgtttacagcatggtttgctgaatattttgagcccactgttaagacctactgctcaggaaaaaaaatcctttcaaaatattactgcttattggcagtgtacctgttatccaaaaactctgatggagatgtacaagaagattaatgttattttcatgcctgctaacacatttattcttcagcctatggatcaaggaataattttgactgtcaaatctcattacttaagaaatttactttttaagacaatagctgccattgatagtgattcctttgatagatctaggcaaagtaaatcaaaagccttctgaaaggattcaccactctagaagccgttaaaaacattcatgattcatgggaagggacattaattaactccaacataaactgaagttagtaggagttgattgcaacccttatagtggatgactttgaggacttcaaggtttcagtggaggaaataactttagatgtggcggaaatagcaagagatctagaattagaagtagaacttgaagatgtgactgaattgctgcaatctcatgataaaacttgaatggatgaggaattgtttcttgcagatgaacaaaggaagtgctttcctgagatggaatctactcctagtgatgatgctgtgaacattgttgaaatgccagcaaaggatttagaatattacataaacttagttggtatagcagtggcagggtttgagaggatcgactccaattttgaaagaggttctactgtgagtaaaatgctatcaaataacaccgcgtgctacagaaaaatgtttcctgaaaggaagagtcaattgatgcagcaaacttcattgtcgtgttattttaagaaactgccacaaccaccccaaccttcagcaaacaccaccctgatcgattagtagccaccaacattaaggcaagacccatcataagtaaaaatggcccactaaaggctcaggtgatctttaccattgtttagcaatatagtattcttaaggcatgtacattgtttttagtcataatggtattacacacttaatagattacagtatagcataaacataaattttatatgcactgggaaaccaaaaaaaaaatgatgtgacttgctttattggattcttagctttattgcagtggtctagaaccggtcctgcaatatctgtgaggtatgcctttatatccaaaggaatagaaatcagtctttcaaagagataccggcattccatgtttattgcagcactattcacagtagccaaggaatggaatcaacctaagtgtccatcagtgggtgaatggacaaagaaaatatggcatacatacacaatggaatactattccaccataaaaaagaatgaaattctatcacttgcagcaacatagatggaattggaggtcatttatgttaagtgaaataagccattcacaggaagacaaatattgtatgttcttattcaaattgggagctaaaaaggttgatctcatggaggtagacagtagaatgatggttaccagaggctgggaaggttagcgggggctgggatgtgggatttagagaggttagttaagaggtacaaaaacacagacgaaataagttcaagtgttcaatagctacagtagggtgactatagttaacaaggatttattgtatatttcagaatacatagaagatttgaaatggtcccttcacaaagaaatgatcaatgatcccagttactctgatttgatcattacacattatatgcatgtatcaaaatatcccatgtactatattaatatatacatttttttaattaagatttgaggtgctatatgtgcctgaggagttataggggatgccggtggaacgaccattacatgtggcagctggactgggcaacggccgatcgccactgtgctctgaggagagaaggcagagcttccccctttatctgctggctggtgaagtcctgagaaccgggcagtcagctaagcaccaagttttctctgactacagagctcctatcaaacggatgggtagaaaaggaatgttgtcataatagctaacccttctttagtgcttcttatagtctgggcactggactgaggtttatatgtgttatatcattaaaactcaatctctgggaacgactgttagtacttggtaggtatactattattattgtcgttttacagatgagaaaactgaggcccagagaaagtgagcaaaatggtgctgggggcgattaataggtggcagggctggaacatgaagccacagtctggcaccaaagcccattcatggagccccaactcaatgggctgcttctcagtagaaggctttgccttgtggaaggtagtagaatgtctaaaatcatcagaacacctgtgtggatggtacaacacggtgacagatatgtaccagggacctagatgtggagggagtgaggaggaaaggagcaacatatgcacctctggggaggccctaaggtctcctcagccaattcctagggaatttaattttaaaggacacagagagggtagtttttaacacaggttttacttttaagtcatgagggatgactttctaagccacagttccttctgataacggtcttaaaagagaagcaccatgaagtgataaacacatcagtccaggaagatttagagacagcctagtagaggaggattggaaacagtgtggctgtgtccctgagggtgctggtgctaaacccacggcacagtccatatcagtcaaagcttcattctccttgtgcccacactatgctgatctgccccagtgcaacagggagacgcatatggtcaagagaatgtgtctttcacgaatagattttctccttcgaccatggtgagaagtccttgtaaagaagcatacatgaatatatggatgtgttgggcatcagctgtgcgtgtggccctcagccaggtgagtggaggaagttggaggcattcagtgttcacctccatgtgcttttcagagacatacctggtgagctgtctgcagatacacagcgtagtgggagagatacgcacgtgaaagcagcacagggcatgtagctagcacttggtaaatattagtttccttcccctttctgtgtgtaaggcaagttgtacgagcaaagcatccgcagctcagaatgcaaaaatagatctccatgtggggatgtggcctcttttccccaagtgtggaccagatgtcaggccgccttgtgagtactcaaggaatgttacggcttccttcttcaggacttcactgcttctctccatatggagaaggctccctttccatgcacttcctggatctgaaaaacaagaacaagaaagaggatggctctaaagtctcaggaaatggacctttctatatcctcccttttaaaaagcatttgtatgtaggttttttaggtcttgctgtcaagtcggatacacagctgtcatctgttatatcggtgatttaataacataataaaaatttatagagaaccacaagctcatggatgtttgttttggagtgcatttattcatcattagtatgggtatttttaatcatttactgagggcctagcaaggtgctggtaattcagagataaggaagatgtcatcctttaaacttgagaagcttatgaatggcgaagagatataattaattgtgaatggagtgtggtagatagcatcaggttgtatatgaggtagaatcaggaaagcaagaatggccagctctgaatagagtgaggagggaagatgggagatgatccttgagttgtgtcttgaagaatgagcaaaaattatattcatggaaagaaaggatacaatataagtgacttgttgagtttttcttggctgatactaagaatgaattttcattaaatatgcaccagtaattcacaggaaatgatcaggtcagaatgttatgggacattggtctgaaatataatgagaggggaaaaaaacagaaaatttaaaacgtttatttatgatggctaatattcagaggggctaactccctcctgcccagataaggagaactttgccgcctggcaagggacctgcggctctgcactgccagggcaacagaaccacacgtctcaaacgtggtgtttaaagaagatgttggaaggttagaggcggtgtaatggatgggatttgacagttgctgtggcaacacacccacttccagaacattagtgttagtgggagggcaggcaaactcgtggtacttgccctgggctgccctatgtcccgtaccacctgttctatgccaaaggtatgaacaaattcaaaaggacaaatgcctcacatggctgatggctgcctgcctttgtagaactgaccctggaataagataagaagatgagtaaatcagagaaaagacaacagggaaatagcgtggaggaggagggggaggccagagcaagcagtgttaactcctttcaggtcaacatttcccagggttatattagaatgtattgactaactggtagatttttatggggaaaaaatgcatatggcatctgtgtgtctaaaatgcccttgatagaagcagtagtgtagaatgctttggggcataaatagtccttagagtagcaaaaagacaggttaatgcaaaattggttggacaggttttggttggaggcctgagtgattgcctccggagcaccaccttctggggagtcatgggtatgacatggtgtgaatattcctgaggtgtgggtggttggtttccttacaaggtagggtttgcaagctccttacatccacaggggctgtttcctctggaccagtcgttctcaatcttggcctcacatgagaattaccagtgatttttttaaaagaaatttaaacattttattacaaaattaatatacgattgttgtaaaataggactgtataaagagtaacttgagttcccatattccatttccagatttaactgtccacagtttctgcgtactcttccagacgttccctttgtgtttataagcatttatatacatatatatgggggtgggtgtgtatatattgtgtgtatggaaatatggaaatatatgtatatgcatacaatacatagtgttatgcatcttgcctttttcattcaatattttttggagatttttccatattaatacatatagatctgccggctgcatagaacctatgatctggatatgctataatttacttaacaatgcctctagggatttagattgttttcatcgttggattccattctttgtacacttgtgtggtatatctaaagttttcattcctagatgtggaattgctggatcaaagtgtgtaggctccaaaagaattgaactagttcacactcccactaaaagtgtgtgagaaagctgtttcctcttccattcaaaaaaatttttttttttttttacagagcccaggccccattttcagatcttctgggtgaggttggaggggagctaagtatctgtacttttacagagctccacaggtgaggctgatctgtaaccagggttgagaacttacatatgttcttatctatggccttagatagagggtgtaaaattaggagacgcagctcccactgatgatgcctgggtcatgtcctttcagatccaaattgcaagatctcctttaatgtggttaattgggagaaattgaatgacccatttcttctgaaatttctgttaaactggaggtctttatttagacaaatgtaaacattaatccatctttattaagataatgtatgattaaagcaacaaggtaccatctaggttctgtttgatacttttcttgttattctgtagttatttgttcataaaccattttttcttcttataggctttcaaggaagaattatctaattccttttggtgtggcctcagatttcattagcagtaggtagagtttgtagttattgaaagtctttctcttatttcagtttgaaatgttcccaggttggcacatagctttgggaactggaagtgtctcttttcccttgcttaggtagcctcaatagattgaaagaaaatggacatctcttcttcagaaaacctgttctaagaattatccatcttaggaaattagggtggttattgctcttctttactgcctgcctgaaaaaaatttcccagccctcatttctttcatcctttcctttgaggccatgacttgtcaccctctgctgtgttcctctgtcccctgagcagctgtaaggggtgagagtcacctaccctcaccccttacactcccaccaacctgaggaccacgtgtcttcatctaacagcatttctttttttttttttttttttttttttgagatggagtctcgctctgtcacccaaccaagctggagtgcaatggcgcgacctcagctcactgcaacctctgcctcccgggttcaagcagttctcctgtctcaacctcccaagtagttaagattacaggtgcccaccaccatgcccagctaatctttgtatttttagtagagacggagtttcgccatgttggttgggctggtctcgaactcctgacctcaggttatgtgcctgcctcggcctcccagagtgctgggattacaggtatgagccaccgcgcccagccagcatttctttcttttcctgtttgaagaaactgagtcctgtctactcccacccagcatttgcctggcatatcttcacagttggtctccttatcaaccaactgactcccatgattaggtcagattagatcccctgttcaggggatttatgtggggaactacacactgattgggacaggattttgtcaatgtactcaaatgacaaaggacttcagagatgttggaatattcttggtctacccaaaggttgcagaccacggtggcatttccttcttatataggtcctggtgggcatgggcttgagaagctgaaagaagacgcatggaactcagaatctgatcttttgatgatgacttcatatatatggtctgtttacccacgaggcacacaaaccttaccttatgcctgtgaaatataaaggcagatttttgtcccatgaaggtttctccatagactacattaagcaggagacagatgggtttagcttggctaatcttagtgcaagctggaaaatttcagtttttctgaaacaacatatttctaagaaattgtctggtctagaatgttattctagtgtatgttagggatctgtatgactgtaaagcaaggctgaattactgcaggcctataaatatgtgtgaaaatttacctacttctccctaccaacatggaggtggaaagaagtaggtttaataaaccccatttttattacgtgtgtaaatcagtggctgtttggccatttttctcctatgtaggacttgaatttatatgagaaaacttgagtgtatgccttttcccaagtcttggcttgcatctgaatgtaaaaatcagatgcatgctcaatgaatgttaattcagattatagatagctataaactatataggctgctctgtggtctttcctttccctctgcctgcatgactgaagaccaaactgtcacttccttataatctagttcttcccatgatacctcatcacaaaggtatatatcagttggtcaataacaggacttgtgcagtgaatacttacatgaagcagacactgaagtgcccagcaagaactgcaaaggctggcagtattaggagattgctcaccgtaccccaaatgagatgccagaggcataaagtccattttgtttaggtaccagatgactctgtggaattaacttgatttgtccccagtaatccatattctttagcatacacttccaggcaacacttattgcttagcaacacttacttagtaacctttcagaatgatcattaactaatagggagacagcctgtggtgccgatcgtaggctgttgaggctatctctacgggcattttcacctatcctgcctacttccgtaacctatgccccacaaaacatacactctccagacatgaaatttaaaaataatgaaagatgatgcaggaacttcagacactagatgcaatagacagcaaaaggaagcacctatgttagccttggttctcaacataccaagatgctcttatgaacacttctaacaaaatgttcccaaggagaacacaaagcaggcacctaacatccaagaagcatgtcatcacctcagcatgcctgccacacgtctagcgcactgcagccttcaactcctggtctcaagcgatcttcccaccttagcctcccaagtagctaggactacaagcacgtgccaccatgcctcgctaattttttgaaaaatattttttagagatgagttcttgctacgttgcccaggctggttttgaactcccagtcatattgttcctcatttgctttttttccttcttctttgttaagagacagggtcttgtcctgttgcctaggctggagtgcagtgccaccatctagctgactgcagccttgaactcctgggctcaagcgatcctcccacctcagtctcccaagtagctaggactacggacacatgccaccaccaggcccagctaatttttgaaaaatatgttttagagataagatcttgctacattgcccagactggtcttgaagtccaagcctcaggttatcctccctcctcagcctcccaaagtgctggaactacaggtgtgagtgcttggccttcctcatttgtttaacagatatagtaatgcagccacttgattaggaggcacagtgaccgctcttgagggatcaacagtgtaaccagggaaacatctctttggtcagtcccgtttcactagcctgttcaagaactggtttacctcctacctttctggcttttcctaagtaccttttacagagtcctcctcttcagctgtgcctaaactgtcagtgttccccaggactttttctttggttttcttgttctgtgtgctctcctggggagataatcagattataacatctgcatctccagtttacattgcccttctatagcctacattggtatatgaagctgagatccacatgctctaggcttcttcatctgggcatctgaaactcaatggatccacaatgagacattttattttcccttaaatgtgctcactccacaatattccctatttcagtgaatgtcaacacctcctttgcaggtgtccaggccagaaacctaaaagtgaatcttgctctctcctcctctttccccatgttcagttggcaacaattcatgttgcccccatctcattaataactcttgaatccacctagtcctctgctgttgatgtaggtgagctcttaccattcctggttcccctgtaagccaagctctgcctggttgccacaacaatctttctgaaacgagtcatctgatcaagtgagtcctttgctctaattgcatcgatagttccccgttctcttgaggatagaacctgaacatctaagacccttctgtgtctgtctcaatgcttaccactcttcttacccgccgtgagctccagttacaccagctactctcagttccccgactggcccatgaattctctcatatcttcatgccttcacatattttgttccctctgccttggttaccctttatcccatttacttttctggccaatttcaagacttggccaggatggcaactccctctgagggacatttcctgttgtccctgcactccctccaaagatagggatttgtgatcaacctttcaactccaacctgtgactccctgggcaaagcccttttatagcacatattattctgcaatctaataacctttttacttacctgtctgcacctccagactgcatgcttttaaagtttgggttttatttatatattctcagagcctggctcatagtaggggctcaataaaagtgtttaagcaaatgaatgtcttaatcaacaaagacatagtttatcattttctgtgtaaggcagtggcatggcctttgcctggaaagatttgcaatctcgttgattaaaaattatagagttacttaatctgataaaaaaattatcagtatagacattgtgagagaagttaggaggaattgtcgccaacattggtatagtcaggagtcggagggcttgaattagaccttgatatggatgttaggacaaatagaagtggcgaagacgcaaagcaagattgtctagaaacaaagcagaccattggcttaagcagagagcatgagataggaacaatatgcctccctgtggaggtctctccccagtagacaaagatttcagaccaggaggcaatgggaagccattggcttcctttgatcatggtggcgatactctaggaagagtaatctggtggctgtgttggcagatgggattgcaggtggcagagaccagttaggaagatcttgcagttgtccaagttcctcatgactgcacctgtcttgtgacagggatctgaaacacaaaggaaagcctccactgcactccaagaataatttattgctagatctggaaggagcctttgctatcatcccaaacatctcatcctattatttaacagtggtgggcaaactgaggactaatctcaaggttcccataactgatggggtctttggattccaatccttgtctcattttcccaacctgcctgggaagtgggtggttaaagtttaaagcctggaagaatgggggaaatagttcacaggcatgaggtgacctgcaggagaggctgatggtctataggagattggaggatgagtttggcttaaacatgttgatttagaaatgacagagggattggaggcaatgaccagcagtccacagatcagtttaggactctgtgaacgttagtggaagagattacagagaacactggctaggagccaaggcaagaaggctttggaaaggcatgtttgcctttgagtgcttaacttagagactcatgcgggaaagaatctgtggatctctttgagaagctgcagaacagcagatacacctgaatcctattcatgttcatccagaaacgcagactttaaaacaaccttgttattcttcctttgttttgtttcgtttggttttagggggttggaggggagggaagggtgtcaccgggggagcatatgggtcatttgtttgcagttcacaggggttcttagtgaacatcagcgaatattgtcgctgatttcgtctcctgcttcactctcttttctaaaaacaaaatatttaatgtagcccaaaggagaatagtcagtttaataactagccatggcagctctttgaaaactgcaggtttcaaataactaggcctgcacattttcaccaactcagacaattaaaaagactccagggacctaggtggtgctgattcaagtggcgcatattgtcatttaaaatggaaagtctatttctgaaaatagactccaggtatgggagaacttgtttctctgctggagaaggtagcccatcctagggggaccgaggtaaattgcttagtggctcaacatctacatagttaaaatgggcccatttggccctacctacttcgcagagttgttaggagggcagaatgaggctatagataggcagcatgtcattggactaggtccgccagatgcagaatgttgacaaaagcagaagtcccctcccctcagactcctctggggaaagctggcagccttgaccaccatcaccgctctgcacaccatagcagggatatgagaaggggctgaggtgagcattggactggaggctcctccagctgtctcttgttgcctgtcctctagtgtgtagagttgcagtgtggcttgaaatggtcatcacacccaccatcaccatggcagccctgggaggagggactggctgctactctctcaagaagggataactgttgcacaaaacactgcagactttgagctggccagcagttgaccagctgacctaacctcccgttttccaggtcttaacctaccatccattccctgcaagtacagaggaaactagaaagctacccttctcccaccatagttctgtaactttgggatggagtgagaagcatggcattgttaccaggtgatagggctcattgtccagtgcactagaagccagtattatggcactgggtctttaagaaaagaaaagcttttatttcatgtcagccaacaaggagacaggatccagctcaaatctgtctccctgtgcttgctggctttcaggcagcatttgtattagaaaaggtttaaggggtggattttgggattagcaggtgattggtggcaggaagggtgaggtctggaaagtccttgggcatgcacggttatctctctctgcatcctcatggatggtttgtgcaaattcagcgaggggggtgaatgtgaaacgtgtggcggaagttctggctgtgacgtcagtaagctcgttctgcacagactccagttggccatattggtcccaaacaattttagccagccttatctttccagtagagggagttttagtgtttccacaagcttttatttaattttttttttcttatctgccatcctgtaagctcaagaatttctgttagtcactggtttaagtctttggggcatggtttcaatatgagtgtgggaaaggggaagccattgcctcttgtttcccattcgtgaccatccctacccacttcagtgggcccagtgttgccagacctgaaatatacctcatgtgggtgtttgtctctggtactctgggttcatttctggtcaccctatgatatttccttgccctaaggtactggcacagctatcgggtaggaggaggccaaggtagaaggcacagagccattcttgcctcaccttctgccacacggtgaccccacatgtctggggagaggctcccggcccagggaggaggaggtggaaggtgcactgtcataaccatcacagggggcaatggcgagaaggctcatgggccacgtgcctcggccattagttgtcatgtctgttgtaccccaacttaactgacttctaaccggctgtggttatgagttccgctggtctcacctttcagtgggttcaagggggcagattttgctgacaccataggcaaggaagcatgatggtaaacaccactggaatgagaggccttgttaatccagcccaagctcctgccaagttagaagctgaggagtctagtctgggccactttgagtactgatgcatgatcccagggcgatgtgctgttctgggcacagggtcacactgggtgacatctaacaggctttgcttgggctgtagctagagggaaatgggagctggggagtgtgacaggagggaagtgtggactctccacctaccaaggggccttcccacatactgtccatcccattcagcgccctgaggtgggcgtcatttctcccacttgacagataagggaatcagaccatgaggcagagtaactggccccaggccacacacaactacgtagtgtcagagtcatgatgaatcctgtttgtctacaccttctgatgaactgagctacctcgtgcaggacaggcccaaggaaaggggctcaggccagagtgggagcattgaaacagggttcaaaatgtctgtctgcccaaaccaaacgttaatttgcatactaatagtttaagggcatagatataatacagacctcccccaagaagtgacctttgaagccaacttcttcttcatgtgacggaatacatcagacaccctgtctgccgggaatccttacccttctcctagtgagccgtggtctctggcctatccagaagctccttaaaaatactagtgcatgagatgtagcattgacaggagccctggcctgtgggtcaacagttgctttgtcaaatgcaatcttgcccttggcacagctcgccattcaggaggatggaggaagtggacgagagagagggaggtaaaagaagggagggaaaggaagcaggatgcctggctgcctggagcttccttgggctcttgtccatgagaggaagccatacctacctctctggggtttgccaactcttgtccaggaacctattgggctagagtggaggggaactgcagagtctccccttcctttctcttctgcccccatgaggaggaagtgaagtggagcagaaagagcgtgggctatggttgagcccactggagtctgcactccacccagcctccccctggctttctagctgtatgactttaagcaggtggtttcaccccctctccctctccactttttcctctttaaaatgtgggatacagtgcccgcctcgcagaggctgatggttctgtggagtgttgtgcacaaggctccagcccaggtcctgatgcaggactctcattctggaaggctgggtgcctggctctccttggggcacaattaggcttcctggctgcattcctggggcattcgcatgaaaaagaacatgggctttagagtgagaaggatggggagatgagtctctgtttttccatctgcgtgggcaaattatttagcatatctgagcttgtcttaagctttctgttttctattcctttatttccacatatggaaaatgggtatatgaactattctgccttcatatagctattgtgacaattaaatgaagtaatctctgaagaaccttactatcagtattactgatattaccagagaggtggctcatgtttgtaatcccagcattttgggaggccaaggtgggagcattgtttgagcccaggagttcaaggtttcagtgaactatgatcacgccactacactgcagcctggagacagagcaagatcctgtttaaaaaaaaaattgctgatattgattattcagtaggccagggaagcccgtctaccagcctacaggacgtcattgcattcaccttctcagtaaatggcaacagactcttttcctaatgtttacacgtaatggattgaactggcttagcatcatgctttacccatatttctgttgacagcctgttactgtgtggagagaattgctggataagagccactgagatcaaagggatctttacaatgggcctttcagtatatttgttctgtaatcatggactgaaaacttactgagcacttgccatctgaatgaggcaaaaaggaagtgtgtgtgtgtgtgtgtgtgtgtgtgtgtgtgtgtgtatgcatgtgtatgtgtatgcatgatttgtttttgccttaaaattagtacatcaaccgtgtaatgtgcaggacatttaaaatatgtcagagctatgacaggttcccagctactgggatccaggacaccttccaatttcatctttggctaagactttctatctcttttttcttcttctttctttctccccctcccttttgatgcctttctttccttccataatacctttctttattctttctttatttcttctttgattcattcttgtatttcttcttggtttcttaattcctctttctttctcttcctttcctccctgctgcccaatacacttctgacctcagggcatagatgcattgaagggcatctgctgctgtggccttttggatgggaaccctgtagatctcagctaggttggtttatcagctataatgtattccttgatttggtaaaacagccagcagcagagcaacatgcttttacctcctctttttttttttcctcatcccatttcctccctctctttggtttcttcttcctttcaagggggttgaatggtctcctctcagcggccttttttttttttttttttttttttgagacggagtctggttctgtcacccaggctggagtgcagtggcgcaatcttggctcactgtagcctccacctcacaggttcaggtgattctcctgcctcagcctcccaagtagctggaattacaagcgtgcgccaccatgcccagctaattatttattattattattattattttttaatagagacagggattcaccgtgttacccagggtggtctcgaactcctggcctcaagtgatctgcctgccttggcctcccaaagtgctggcattacaagcatgagccaccatgcccagccttctctcagtagcatttaacacagactcctggaacatacatgcacaaagtgaaaaaaataacatttttaatttctgattttgaaagtgaagatcctcattatagacaatttgcaaaatattgaaaataagaattaaaatttgcccctgttcctcccaaaagtccctgttaggatctggggggtgttatgtccagctgctcagtagctcgtgctgtcccctccatgcaggttccatctagaatctggggcagcagcaggtaaggccaggtcactgttctgtggggcttacatgggagtggagggaagagatcagcaatatcaaacaaataaaaaagatcgtttgggatggagataaatattgtaaaaaaaaaaaaaaaacatcaaacagagttgtttgatgggtattgagcaggggtagaggaaagtcagagggttcgaggaattggcatttatgctaatgtctacataacgtaggaggactaggtaggcagagagcagaggaagaatgctttaggtagagaggaaactaaatacaaaggcctgggtgggatcacattcaggggacgcaaggagcagaaggaaggccagtgtggccaagtgtgtgagtgaggtagagccgtggatctgatcatatgtggcaatgggaagccttgggagggtttgatatggagatgtgacccacacgggtctgcatgtttagaattatcacagtgtaccgctgtggagacgtgggagatagaaaagggataatggttaaaagttgcagtagttcagaggacagacagtgctggcttagacaaggggaatagtctgtttatttgatttactttcaagtatctctgaactattatctgtattttgtatatgtgtttatatagagaccatttattgcacactttccgggtactacagattgtgctaagcactttgtatgtattatctagttcatttttcacatagaatcaggcatagtaatctccttttacacataagggaattgaaactcaggtaggttaagaaaagaagggggaaaaagtcaacgatagtccctttccccaatacagaccttattaggatttagaggggcattttttgggggtcatttatttacaaaggcccaagtttataacatacaggtgacagaatcagcattcagacccaggtctgactcacttcacagcgtaaaacgactgtcctgtacaaatttaaatcctgctataatgttattgtgggtgtaaacactctccccctatgcaataactcagcttataggtcagtctccattgcaatgagaatgtttaccagacaatcacagaaactcaccgtacacaaataaaggcttattgttcactcatctgtaattgctatgggttgctcaggtggctctgctgatcttggccggactcacatatctagagttcaggtgatttaagctgacctaggctggcctcttctttcattttccagcaggctagactgggcatgtttatggtaatgacagaagtgctacagaaaaggggcagaaacatgcaaagcctctttaggcccagcctcagaactaacactatcatttctgccacattctgttggccagtgcaagtcagagaccagcccagatgcaagaggtagggaaataggctctgcctggaagtgcaggtcccatggaataggacatgaatgggttaggaatgagcctttggccatcaggacgttagtgttaagcttttgcagaaaggacttgttggacaaataacagattcctgctgcgggaatggagaccagctaatatggcctgagtcccgaaagcccatatccttaggctgtatttgtgaggttttaatttaatctttgtatatatcgtgagcactcttcgttgaccttatagtgttgctatcatctcctaagttgattggctccctgaatgtaaaaggattttcagaggcaggcatggtttgtagcaaagtcagctgtaatccctgatgatggtatcatcatcgagggatgccaagagggtaaaagcactatttcagattatggctacgtgggatccaggaagtcatgacaagtgaacagaccctaaactggtgatgaggaggagggcagaggtgagcaggagggaaagattcggcaccaaactttgaatcactaggagtttcactcatcagctctaaaggaaaccctttggccaaaataaaaattgtcttctctttcctcagccttaattgatagaggataatgttatcagctggctaatgctcatcagtgatcaacattagactactgtgttttgacgttactgctgcaaatctcctgctttattaactgcctgaatgaggagcacatcagaaagattggaggtgttgcaattagcctttaggatgaaataataagtaacactataatttgtgactttgatgcagacatcaatttaaaacataaaccactgactagagaagagataaagacagagtgctgctgttccccttcattgatggctgcttgctaatgagctaattgaacacaagctgctaaattcttgctaaaatacgaaagaatatgaaatatcctgtttccagttatactatttggaggtttagccttgcctaatctgtgacaaaagtagaggccaactttgggtttgaaggtaacttctattctttttccagatttctttaagccctttgttccaccctttcctccagaaaccctccttggttcttctggaagtgactttcagcaagaagcttttagaaagaaaaacaaaaaaaacgaaaaacaatgttccagtaactgcagaggctacatgatggggttgatcttgtccactatggatcttttaaataaagctttggaaataccaagctcagacttaacaaatacaggagaaaaaatggcatgattatctcaataaataaatatcaaaaggcatttaagagaacttaatacattatttctggttttaaaaattattagtaaaacaaggttggaagaattggaactgccttactttgtcaagttgtatctactaagatactagaacaagcctttatattgaaggatctgaagaattaaaagcatattcctttaaagtctgggacaagcagtgatcattagtctcagtctctctttcttctcattgtcttgcagaaaccggctaatgcagtgagactgaaaattattaaaaagaaagtaggaattataaacatagaaaggatgccacctctgtctatagaggcagaagatgagattgttcacctaaaaactaagagatgttagaactgttagaactattagaactaataagaaagtaaagtggctggatataaaccagtaacttttaaaaccagtagcttcctatatagcagcagtaaccgcttaggaaatataatagggtaatataccctagtaacaactcttataatacatttaaggaataaactgaaatgtgaaaggctaaaataaagaaaactataaaactaaactgatacatgtttttaaaaaagcccacaaaaaataaaaatggagagcatactgtgggtgtattcaatattttaaagatagttgtcctcaaatttacctgtgaaattgtaattcaaaaatgccaaatattattatatttaaaacggtaactttaaatataacttaactaatgtattctgaagtttacctagaagagtatatgtataaaagtaccttagaaaattttctaaaaagaacaaataaccaataaacatgcaagatgttcagtgtcaccagtaacaagggaaatggaaattataacaatagtaagaccagcctggccaacatggtgaaaccctctactaagagtagtctctactaaaaaatacaaaacaattttagtctctacttaaaatacaaaaaaaaattagccgggcgtggtggcgggcgcctgtagacccagctactcgggaggctgaggcaggagaatggcttgaatccagggggtggaggttgcagtgagccaagatcacgccactgcactccagcctgggtgacagagcgagagtctgtctcaaagaaaaaaaaacaaaaacaaaacaatagtaatagttgtgcatatcagattgccaacatttaaaaaatcatattgtgtgacacgtgcactcttacaaatggtggtgcaagtgtaaatagctatgacattttttggagcacagtttggcagtaggtttttaaaatttattattatttttaattttagattcagtgggtacatgtgcaggtttgttacatgaatatactacgtgatgctgagatttggcctttgattgaacccttcatgcagagagtgaacatagtacctaatagatccttttcacaccttgccccactcacttcctccacctttttagagccctcagtgtctactgttcccagcattatgtctgtgtgtacccaatgtttagttcctacttagaagtgaaaacatgcagtatttggttttctgtgttaattcatttaggatgatggccgccagctgcatctgtgttgctgcaaggggcattatttgattctttttaatggatacatagtattccgtggtgtagatgtatcacattttctttatccaacccactagagatggcacctaggttgattccgtgtctttgctattgtgaatagcgctgcgatgaacatgcgagtgcaggtgtctttttgattgaaggatttatgttcctttgggtataaatccagtaatgcgttgctaggccaagtggtaattctatttttagttctttgagaactctccaaactgctttccacaggggctgaactaatttatattcccaccaacagtatatgaatgttcccttttctctgcaacctcaccaacatctgttatttcttgactttttaatagccattctggcagtatgtttaaaaatataaaatgtacatgcctcttgcgtgagcagtctcacttctagaaatcacttctataaaaacatatacctaaaaatccatcagttgaggaattatacatcgttatatatccaaactatgggatcctcttgaccctttaaaaagaaaaagtagttttatttgtactaacattggaaattgcatatggtatattgatagattaaaaaagtaacttgagatatgtgggtagtataataccatttgggttaaatcacttatgtgtaaaaaccaagatataagaggttcacgtcaagatgttaagggtgatcacctctggaaagacagtgagtgagactgggggaagaggagaatagcaagaaccaggactttcactctctttacacattcctgtatttgttaacatttcgcagcgaacatctttgatcatttaaaaaattaatgatgcattcttatattgacaattcttatactaaaattttgaaaatccacaggagataggaaaaaataccccttacttttgatactattgacattttgaaatgaaaggaaaaaatgagtttagtagagttaattcagcagaaaatataaatatataagatggcactaaggtatctttggggagaaacgggacctggttttgtttcgcaggtcctttgccatttgctgtttgatactggggaagccacgtaccttgtctgtggtccagttaggtttctccactctgcaggtagggctgacctacttccattggaggaaaaacctagagagaaagaatgtcaagaaaggttccacctgaatgggaagtgttattgttagaatgtccatgaatgaatgtcagagtccagcatctcagaggccatcattaaatgaggagcagtctttgtagaagctgaactctgaagtatgcatcatggtgaggagtcaggtggggataaatgaataaaacataaaagaccatgtggtatggtagaggaggaggtgtgtgcgtgtgtgtgtgtgtgtgtgtgtgtgtgtgtacagcttaagaacataaagcaataaaggagaacattttgatacagcataataaacaatattggagtactaaggaggagcttggagcaattcgatttgggaagtattaagaggtgttacatgatgataggagatgggtgcacatgcctgtgtaagaatggggaggtggggacattgtagtgatggggcattggcattgggtagctttgttattaagttcaaagagtttctaaagggaaaataaaatccccatttgaatcacaggtggttcattttctgaggcaatctcaagaggcacaagatcaaatctagcttgacaccatccagtacagaactcagcagtctctagaagctggagctgagctacagcttggctaatgagaactctccatcctctgccagcacctcagggcccatctcttcctctttggcaagcaggatacaaagagagcgcaaagcagagtgggacctagaaggtcacccagagcattcattttgcaaactccccaccaggcctttccagaagacagatgatcacggtttcacagttttgctagaatccgagccagtggcttcatgcttcgacctggggtaggttttaatgaaacctaaagaatacttcacacattgacctaccattggcagtgaggaagagggggagatgggccaaacacagctgaacgacatcctctcatttattcatggggcgtgagaggagtgattgtaaaattcagatgaaaactagaagttaaaattcagagctcccagtataaacatttgggtctggtatgaagttcactttcaccagtaagacacattgagaaacacaagaaacccattgttctctggatgtttgtgcatttcagtggttttgcctgtaggaccctcaagtggaagttagattgtctctattatgttctttctaatttgttaaatatttcttgaactaatctccttctcactatctccattgctaccgttaatgtgtacactgtttatcacaacagccttgcatctcatcagtctgcagccgtggctcatgcaatccgttcatcatgctgcctgattcttctttccaaacatcagctctttgtcacttcactgctcagcatctctcactgacatttggattgttcaaaatcatatccccactgcccaccttcttggccacatctcttgtgcttgcacctctccccactctgttttcttctgattcaatgtgacagctacccaagactatacgtggttctgcaaaaatgcaaacctctgtcttgtcttggcacctagaataccctttttttgctaattactctttgtctcaagatgcggctgtaccaagagtcatctctaggaaatgctccctaacctcctttgtgttacgtaccatttcctcacactgtggaagcacatgagaattacttccatcccaacatctgtactctcccctaactggctagttattggtctgtctccctgactcacctggaaaccaccctcaaggtgaaaattacgtagttctgttcattgcatcttgcagagtgcctggcacatcgctgtgtgataggaaagaatgaatgtgtatttttaaattgggcttctccttctctagtttttgaacatgtgtatgtgggtttctgttttgcctgatgtgacgtgagtcaagtcatactcaacctgctgtgttctcagaaatgcagtgcggatgagtaagataaatcatgttagcatcatatataagtgagctgaagactcttaccactcatctcagagcaccattaagtagctgcctactgggtctctctagggtgttcatgaattaaaactcctgtgttgttccaggtcagctgttgccagcaaaccgcaatacaccaagtcccattgatcctgacaccatccaggtcccagtgggttatgagccagacccagcagatcttgccctttccagcatccctggccaggaaatgtttgaccctcgcaaacgcaagttctctgaggaagaactgaagccacagcccatgatcaagaaagctcgcaaagtcttcatccctgatgacctgaaggtaaattggaactggtaatcagtctttgggcaaatggagagtgggatccacagacagattaaaagggtgaccccaggatgatcccagaagctagtgcatgaaggatttctgatttctgatcctgtttcttggcatgtgacttctaggccagttgtttcctctctgggtattttttgaaatgcacttttatgtcttgatgctgaacagaaacaaggagaagcagtaaaatgttggagtgattttaaacccatgaaggaaacaaacctgctcctatctgcatggaaacccacaaaagtctaataaaattaaaccccacatctttcaaggttgagaagagaaagaaaatcatttgagaagggcatctgaacctcattgccctcgaagggttaccttccttttagaaaatttttgataatttgctgctgccatttccctgtaggctgcgaggaataacagccagagataggaccttcctccatattgccaaccttggatgaccagggtgggattttgtgaaggaaactggtagttccctgacaccatttatatgtatcttaagtaacgatcacttgaatatctcaccgctagattaattctaagtaggttttctctgcagtgttgaagggacaccttatttataaagggaaatagatttaccttggaagtcaaatacagcttaaaacaaaattaaccagacacaataatgacatcttaggatgaaaattctttccaaaattatgccatgtctgctaatgccaaaatagaaccatttcttattaaccattgcttagaactttcatgcttctttccaatcatgtgggtactagagatatgattattatgtagtcaaggccttggaaccaggcataattagcccttttctactgtctgccccccatctctcaaacctaactattgttcctatgtagagacactcctaggctgggaaataggaatttgagacaacgtctgaactggcttagaccagttgttcctgctttacatagctagaaaaaatgctggaagcagaagtacctggcaaatttaaatcactgctgtcatccacattcctgagattaccttaattgatgcagaataggaaaacatcagggctgaaggggaccttagagattcatttgtccaaaattaccacttgcagttgaggaaatgcagaaaatggaaagctgaagtcagcggatcactacctgttagagaaaggcttagcctggctcccaggttgtcttgcttcccaaaaggtcacagcagcatgttggccctgacaagggctataacgggggcccatgggtgacaaatcaatggctgtcaccctgagaatcaaaaaaggaaatcacatggtaaaaacaccagaaaatctaaactagtcaggacattgatggttagactgagatggggtaaaaaaggggcaccatgggctcaggtcttgggcaattaggtaccttatttcaatgagatgcctttcctagtcttgtcttcttagtgatccaattttttatggtgttttttttttttttttttttgagatggagtcgcactctgttgcccaggctggagtgcagtggcacgatctcagctcactgcaagctccgcctccccggttcaagccatcctcatgccttagcctcctgagtaactgagactacaggcgcacgccaccacgcccggctaattttttgtatttttagtagagacgggatttcaccgtgttcgccaggatggtctcgatctcctgaccttgtgatctgcccacctcggtcttccaaagtgctgggattacaggtgtaagccaccgcgcccggccttttttgtgtattttaaagcctcgtatcttaaactaaagccagggatcctgttcaacctggattttctcttgaatggagggtagtttgaaaggatgctgctatgagtgatagacagaacttccagccagactttcacaaagtctccagatttatcaaagagcaagattagttaataacccaggtaaccttggcaacaaagaggccagacaaaaaccgtctgtgctggaattacacatattgctgctgtcatggtcaggcctgacctttccacatagcaggtggggaatgggcaggaacattgtcctgccaggtgtccttggatattttttagttgtggacgaagtctcaaactaaagaccatgagctaatataaagcaggaagcagagctgtaacatgtttctccttctggcagaaaggtctgagctaagggtagatggaggagaaggtgtttctggcccccagcattggacaagtaaaccagttcaatgaaatggccccactaaaaatgatcttccctgtagctgcctgaacttcctctcttgagccaatcattagggttagcatgcatgcgctggagaaagaagggagaattgaggttgacatgctggggtacctagctgaaaatccatttaattaccttgattttttaaatgcttttaatggtccattcattcacttgatgaattttttcaaatgctagtgtgtgccaaccctctaaccctgtatcaggggctgggaataccgaggtgagccaatactgatactgttcctgccttcatggaacttgtagtctggtgagaaacagggagtgttgatctgttgggtggggcggggctaagtgggtcccttgttgcatggaggtaactgggtagccagatggcatcagcaactgggagagggaaagggggcagaggatggagtgccaagtttatcagccccgctcaaaatcccgcttcccccctgcccgcaacccttctgcgataacaaagggaggcgagcaggcttttctagtccaggacactcctttcgtcattcctgccttctgtatcctcttctggacccggttcccagctcccctccctcccacctgaaaggtttgttttgcattccacaccttggctggctcatctgcatgtgtggacaggtgaggctgggaaatgagagcactttagaagtgagaagagctctaataagttagagagaagttggttgttaccctgaagtcagctggtgactccctggtcattaagacctggtcagaattgtcttacaccacatcaagcctgtggcctatggtgggaccccccattcctcccccatcacatacatgcagtttctacagtgttccaggggcttgttcttatgtaccccttcgcctcctgggctcctgttcccccgtgtgcagactctgatacatcctaaatcaagtcctcttttgagtgctcttggaaaccgcactcccaggcacattgttgggtatagatttactgatactgtgaagggattggaacccaggcttctatcaaaacacaaataacttccatcagaactggaggcttcaccactgttgttaactggaggcttcaccactttgggccccctcaccaccatgacgtcattgactcgcctgactcctcccagcctctcccctgcctccagctcccctgctcgctttcagaagcacagacaacaaattcggccaacaaccattgcacacctgccctagcttgctcacccaggtattcttcaaagagcagcctcctccctcctacccagaagaattctggtaacatctattttgaaaatcgtttttttaccctgttgcatattgttatgaaatgtataaaaagctgggggtgctttatttaagatgatagtactagtttgtggatggcagataggaggtatctacacagtttctatcccacactttctgtatttgtgcagggcaaatgcctgttgagggtaatgggcagttttgggggtggaccgctgaccttagactttccttgcagctttggccccaacccatgtgacctccttcaatgccaactgccccttggaattctgaggggtgcaagcactggcctgacccatttattctgggtggcatgtaactgcaggtagtagcattgctaggactgagggatttgctgttgcaaattgttgaaaaaggggagttgcaaaattcaccaggtgccaccatcagtgaattgggaagatctaaaagaagatccctgtttcttagtcttcttaagaagtttttcctttctgtcagggaggcagcagtgggggtggagggcagggaaggagggattgtttttacactgaccacagtaaaatattactcaggctaattaaggcctagagaatggttaaacaagaaattagagtaaattatgtaaattctggccaccaatatgagtacattgattagcggcaggttgaagatttttttttttaatttctatttttaattaccaaagtgtatgtatctattatatgatattgtaatagttcagaataatataaaaggtagaaagtcttacatctttgcctctgccaatcccccttctagaggctccacctttatagattagtataaatctttttgcgcctctttctatgaatatatgatttttaatcaaactgggatgagaccatacatatttgtgtgtaaactgtcattgtttccacccacatagtggcatatcatatgaacatctttctggtgcaggtgggtcattatttttaacagctgccaagtatccctttgtatgactgtatcataacgtggttgttaaatctcctatgcatagtttttcctcattttttctactgcacataatgctgcagtgaacagtttatgcttgtgtgtacatgcacatgtatggagattgctacaggacaaaatcctggaagtggagtgctagatgaatagtatatccatttaaatagttgatagatattgccaaattgccttctaaaatttttgtaccaactcatacccaaaaaagcatatgagtgcccttgaaggaaaagggttcttaaaatgttgagcagggagagtaaagaaagttgaaatgtaatttaagggtgaggtgagccacctgctttcatccagcctctgatctctgcttcactgagcacgcctctgctgggcaaagagtaggagcctgttgggacagatcggtgggtccttgctccaagaaggaagtgtggctcatgggccacactctcagacatgcagaaactgtaaaggaaggagacacaagctaagaaacccgggctggcacctctgcacaatcctggagcctgcccgtgccctggctggcactgggctttgctgaaatctaatatcttgtttctttttcccttctgtaactaatgagcaggatgacaagtactgggcaaggcgcagaaagaacaacatggcagccaagcgctcccgcgacgcccggaggctgaaagagaaccagatcgccatccgggcctcgttcctggagaaggagaactcggccctccgccaggaggtggctgacttgaggaaggagctgggcaaatgcaagaacatacttgccaagtatgaggccaggcacgggcccctgtaggatggcatttttgcaggctggctttggaatagatggacagtttgtttcctgtctgatagcaccacacgcaaaccaacctttctgacatcagcactttaccagaggcataaacacaactgactcccattttggtgtgcatctgtgtgtgtgtgcgtgtatatgtgcttgtgctcatgtgtgtggtcagcggtatgtgcgtgtgcgtgttcctttgctcttgccattttaaggtagccctctcatcgtcttttagttccaacaaagaaaggtgccatgtctttactagactgaggagccctctcgcgggtctcccatcccctccctccttcactcctgcctcctcagctttgcttcatgttcgagcttacctactcttccaggactctctgcttggattcactaaaaagggccctggtaaaatagtggatctcagtttttaagagtacaagctcttgtttctgtttagtccgtaagttaccatgctaatgaggtgcacacaataacttagcactactccgcagctctagtcctttataagttgctttcctcttactttcagttttggtgataatcgtcttcaaattaaagtgctgtttagatttattagatcccatatttacttactgctatctactaagtttccttttaattctaccaaccccagataagtaagagtactattaatagaacacagagtgtgtttttgcactgtctgtacctaaagcaataatcctattgtacgctagagcatgctgcctgagtattactagtggacgtaggatattttccctacctaagaatttcactgtcttttaaaaaacaaaaagtaaagtaatgcatttgagcatggccagactattccctaggacaaggaagcagagggaaatgggaggtctaaggatgaggggttaatttatcagtacatgagccaaaaactgcgtcttggattagcctttgacattgatgtgttcggttttgttgttccccttccctcacaccctgcctcgcccccacttttctagttaactttttccatatccctcttgacattcaaaacagttacttaagattcagttttcccactttttggtaatatatatatttttgtgaattatactttgttgtttttaaaaagaaaatcagttgattaagttaataagttgatgttttctaaggccctttttcctagtggtgtcatttttgaatgcctcataaattaatgattctgaagcttatgtttcttattctctgtttgcttttgaacgtatgtgctcttataaagtggacttctgaaaaatgaatgtaaaagacactggtgtatctcagaaggggatggtgttgtcacaaactgtggttaatccaatcaatttaaatgtttactatagaccaaaaggagagattattaaatcgtttaatgtttatacagagtaattataggaagttcttttttgtacagtatttttcagatataaatactgacaatgtattttggaagacatatattatatatagaaaagaggagaggaaaactattccatgttttaaaattatatagcaaagatatatattcaccaatgttgtacagagaagaagtgcttgggggtttttgaagtctttaatattttaagccctatcactgacacatcagcatgttttctgctttaaattaaaattttatgacagtatcgaggcttgtgatgacgaatcctgctctaaaatacacaaggagctttcttgtttcttattaggcctcagaaagaagtcagttaacgtcacccaaaagcacaaaatggattttagtcaaatatttattggatgatacagtgttttttaggaaaagcatctgccacaaaaatgttcacttcgaaattctgagttcctggaatggcacgttgctgccagtgccccagacagttcttttctaccctgcgggcccgcacgttttatgaggttgatatcggtgctatgtgtttggtttataatttgatagatgtttgactttaaagatgattgttcttttgtttcattaagttgtaaaatgtcaagaaattctgctgttacgacaaagaaacattttacgctagattaaaatatcctttcatcaatgggattttctagtttcctgccttcagagtatctaatcctttaatgatctggtggtctcctcgtcaatccatcagcaatgcttctctcatagtgtcatagacttgggaaacccaaccagtaggatatttctacaaggtgttcattttgtcacaagctgtagataacagcaagagatgggggtgtattggaattgcaatacattgttcaggtgaataataaaatcaaaaacttttgcaatcttaagcagagataaataaaagatagcaatatgagacacaggtggacgtagagttggcctttttacaggcaaagaggcgaattgtagaattgttagatggcaatagtcattaaaaacatagaaaaatgatgtctttaagtggagaattgtggaaggattgtaacatggaccatccaaatttatggccgtatcaaatggtagctgaaaaaactatatttgagcactggtctctcttggaattagatgtttatatcaaatgagcatctcaaatgttttctgcagaaaaaaataaaaagattctaataaaatgtattctcttgtgtgccaggagaggtttcagaaacctacctcgtcttacaaatttaaacactttggagtctgtacaggtgccttatatgtaggtcattgtcacgatacacacacacgaacactccctctggactggctgcctctccatccagggcagttaactagcaaacaaggcagatctgcttcatggagcgggaggccatggcttgactctgagtgatttgggtcaaccggagtcagacgcatgtctgcacgctgcagctattatgagagtccctttgtcatttttcaccttttcatcctaagcatctttcagagattaattatttggccattaacaatgaatccaaatcatatcatactgacatcatctagacatgatttggaaggaacagcttaggacctcctgatgaggtcacattgttgtttcttttaactagacttggcaaagaaaggcaaaaattgaccagcctatctttctgctggtgctgccttaaggaggtagtttgttgaggggagggctgtagatcattacttctttctcttcaggaagtggccactttgaaccattcaaataccacattaggcaagactgtgataggccttttgtcttcaaatacaacaggcctccactgacccatccctcaaagcagaaggaccctttgaggagagtacagatgggattccacagtggggtgggtggaatggaaacctgtactagaccacccagaggttccttctaacccactggtttggtggggaactcacagtaattccaaatgtacaatcagatgtctagggtctgttttcggaagaagcaagaattatcagtggcaccctccccactgcccccagtgtaaaacaatagacattctgtgaaatgcaaagctattctttggtttttctagtagtttatctcattttaccctattcttcctttaaggaaaactcaatctttatcacagtcaattagagcgatcccaaggcatgggaccaggcctgcttgcctatgtgtgatggcaattggagatctggatttagcactggggtctcagcaccctgcaggtgtctgagactaagtgatctgccctccaggtggcgatcaccttctgctcctaggtacccccactggcaaggccaaggtctcctccacgttttttctgcaattaataatgtcatttaaaaaatgagcaaagccttatccgaatcggatatagcaactaaagtcaatacattttgcaggaggctaagtgtaagagtgtgtgtgtgtgtgtgtgcgtgcatgtgtgtgtgtgtgtatgtgtgtgaataagtcgacataaagtctttaattttgagcaccttaccaaacataacaataatccattatccttttggcaacaccacaaagatcgcatctgttaaacaggtacaagttgacatgaggttagtttaattgtacaccatgatattggtggtatttatgctgttaagtccaaacctttatctgtctgttattcttaatgttgaataaactttgaattttttcctttctttcatgtatttttattaacagttggctagcaatggtattctgttcccacctcggtagcaaagagaccatttgtagagattattacctagataataaaatgataatactatataattagtaataaattaacatttattgggtagttatgtgccagacactgtgctaaacacttagatggaatattttattccatattagctctatgaggtagggacaattattatccccatttacagaagacaaaatggaaagttaggagagtcacgtagcttacctaatgttacagaggtaaaagtggctgagatgaattctgatccctggagtgggcattatttagaggggtggttcccaaaagccagtccacagactgtcttgttctctaatatataaagaataattcagcaacatctaggagtataaatccagagattctgaatcagtagttcttggatggggcccagaaatctgaatttttaaactgatcccagccaacttccatctgcagccaagtaattggtgtcaaggatttatagacttggctcttaattcaagttcatgacccttgggggatccacgcagaggcttcagagatgccataattatctgaaattgtatgcaactttttatgtataaacatttattttgctgtagagaagacttgtagctttttttttttttttttttttttttacttccctaaaggaacctgtgatgcaaggcggaataaaacccctgattcatgtaagaaggctgatgtagagcagtggttctcagcccagggagcccagtagattcacctggggagctcaaaaccggctgtgtggggctgcagcccaggccaagaaactcagcatctccggcatagtgagaagggggctctgtgttgaggagtacaattctggattcaaatctgtcacctagtgggtatgtgaccttgagcagcttctaaaccgttttgaacataatctcatctgtgacatgaaggtatactcacttctgagggttgtggggggaactaatgacaacaaatgaattgtctctggcacatccgaggccttcaacagataactacatggggcccacgagagtagaatggatgccttgagcatttttccaattcaatatttcagactattcgttccttcagagaggacggaaaagaattcccctgctcatatgccagagcaggatggctgatggtatgggaatgggtggtagagacgttgtttcatagtgtgacttcaccaacagttcatagactagcgccagctttgtgcacaaggtcgatgggcatctcttacttggtgacaacctctagttaaaattgagtggttacaagttagggttcagctctattttcatccatcaaacacctttcacctttttgttgttgttgttgttgaggtggagtctcactctgttaccaggctggagcgcagtggtgcgatctcagctcactgcaacctcagcctcctgggttcaagcgactcctgcctcagcctcccaagtagctgggactacaggcacgtgccaccatgcccagctaagttttgtatttttagtagaggcagggtttcaccgtgttggccaggatggtctcgatctcttgacctcgtgatccacccacctcgacctcctaaagtgctgggattacaggcgtgagccactgcacccaacccacctttcacctttctcagaggaataagaatagtgaccttagcttaagaatagtgaccttagcctaagattcttctggggcatcttcaaatctcttggaggaaatgacttcatgcctggagagcatttggatccgagatggcaagaactgatatgaagccaagctgcgtagactcccagtcatacacaagtcctcagtccctgggggcccatcacatgctgcatgtaggatggctcttccatgcacacttaagcataagatgccacccaatcaagcccctctcttcaaagcatacaacttcaatttccttgttgaaaatcattggcttagaagtctctttggacatctttagctaggaactgggtgagaactttgaaatcttgtctttgtggtcagaagatggcttcttgctaataaatcaaaaggaccctttggaggagataggactagtcaaaggtggcaagcatcctctgcctctctgggttttgagtcagggaggacttggatccaaagtccctgtctctaacttctttttatcctgcaaagcctggcacaatgcctggaaatggtatagagagataacagttactgagtcctaaacctgtgccttccacatctcatttaatcctcacactacaaaacaggtactattattatccctgttttgcagataaagaaacaggcttatggaaattaggtaatcagcatttttaacccagaccaaagcctgaccccagagtttgacaggggtgggaaacatcaggagtttaccaaacctatttatttaccttctggacattcaagtagaccactttttccagactcccttacctctagtatgaccattcaactgaattctgtccaaaggaacataagcagaagtaaccccaggtgtcacttccatgaaaggcccataaacagtgccacctgatgctctctctctcctttttttctggctcctggagaagatggagactaagaaggaagggacccaggtccctgagtatatggcaaacgcacctgacagcaataacttcagcatactctgagaatgaccctgtatggcagacacagctgaatgtgtgttcagagttccaagctcaggaatctgggagtggccagcctggaggttcattctttatctgtgacgaacatctgaaccctcagcctgtcccaaggaccacgagccatacaggggatcatagtcctctgttttgggttaaatgaaggttgtcaggtggaggttgttaaggggagggtgcgaagtggaaatgctattttataaactacatactatttgcaagtggttgtagttctgtctggcccactgccactggaccatccctacatgtaaatttcctctaataataatttatatctcatttgctagctctgggtttcttcttcagcctctcaaacatggttccttccctgttgagattaataggggtctggcatgacactaagtcatcaaactgttacacgaggaaggaaaaagcctcgctgtattaaaccattgagatactggggtttcttgttgcatggcctaactgctgattagcctaaccctaatatgaggaccttcttctgaagcccagtgtccttaatttgaggtcttgacatctttgccaggttcccaactgtaatctaggctcatcacccctcacatacctgactttgaggtttgtccaccttctggacagacctcccaccctggttaggctaagcctactgggttggaccttcagaacatcactgcctacctcttccctccatttatcctgcgtttgaacactgtccagaattgttcaattgctctcagggtgtattagtccatttttgtgctgctgtgaagaaatacctgagactgggtaatgcataaagaaaaagaggtttgatggacttacagttccacatggctgaggaggcctcacaatcctagcagaaggtgaaggaggagcaaaggcacatcttacatggcagcaggtgagagagtatgtgcaggggaactgccccttataaaaccatcagatcttgtgatacttattcactatcacaagaacagcacgggaaaaacctgcccccataattcaattacctcccaccaggtccctcccatgacacaggattgtgggagctacaattcaagacaagatttgggtggggacacagccaaaccatatcacaggggaagcagcctctacttccagatcagcttttctactcattatcctctcccgaatccaaattctctccctggccactcagtgcccccttcatccccagccccagttattcaggtactcacttcaagatgaggcctaccatttcttagagcactggtctttcagtttttttgctcacatgctcccaaaaattctttttaaaccatgaatccacattgcacattataaagttgacaactaaaatttttttaatcacaagtttaaatagttgcaaaggatgtaatagctgctctaagtactggcatttaaaaataagctactacatgactctttttaatatatctgatgaactattaaaaccctagtgatttactaccaaccaacatccatttgaaaaatagagttggaatttgtacaccacttttttttaatcaaaataattatttacattgtgtttcctcactgagtttgtctcttatgtaatatatttttatgcctcaaagtcttatattgtccctccatcgtatttctcagtcataaaacaacagctatagactgagattcttatttttattttcaaaaaaaataaaacaaggctcataaattttttatctttaggtatgagttatggttaccttcattactagcacatgcatgatcaaaaccatgtctatagtaaaattttaaataattattatccatgaaaaataaaattttaacaggactacaaatctaggaagatggataggagtggttgtggataactgataaagaaaaagacttcacagacaacaaacttccttgttgtccctttgtctggtgccacaaacatttttatgcctggaactggagcccagagctagagtaagatttagcctgggtaggaagtatacctatgttttgtaaaacgagagaaatgtgattgtaaaaggagaggaaaggaaaaaaaaaaaaaaaaaccaaccagcgtgaggcctcatcaacaaccactttctcaggcaggtcaattttaagaaaaaatacgtatagaatttgagggcctagaaattcccttaagacttacctatgcaaatatatcccttggatatactttatgcagcactagatgtgtgtcctgctgacttaaaaagcagggcattagagtggggctgatggaggtaaaagagcagaagggttatttggccagttctaacatttttgaaggggctcaaattagaatgtttgatttgtttccaagtgaatatacatattcctaaagatagaatgacaactttttttgtaactttcttctggcatttctatatcttttgaaatgtcccttatagcccctaaaatagaattggcctcatgcctcccataagctctgatggggcacaggatgggtctggggagtccccagaaagaaggtgatggttgaagtgagtgaagataagcaggagcttgtcaggaagagatggagagggatatcccaggtggcaacacagaggtaagagaagagaacagaacactcccacaggcgacagcatggtaggtgcaaagggtatacggtgagcggtaaaaaatgaggtatgaccagaccatgaaattccttgcatgctgctctaaggcctttggactttagcctgaccaggagaatgacatgagcaggtttctatgttaaaaatattatactggcagttaagaggaagatggattgcaaagaattaggaagagtgagggagatttctactttagtctctgagtaagtctctagggatgaggtgggtgcatagattcagagctatctaggaaggtttagcctgcagggtttagtagaaggggtcaaggacagctctaagttccatgatctcggtcgatctatggttcacggtcagggatgcacataagaatcctctcaggagtctgcaaaaacacccatgcctggcaccaccctgtgactcgttgaatttgcagcctctggtgtggaacgccagcccattttccttagaaagctctcttggtttattctactctgcactctctgggtgagaggaatatgggccaggaattgtaggcttcatctttccgttaaagaaatcaaagctcaaagagttctgaaatcagaattcctggagcaaagcatataactagggaaatggtaatgccaggatttgaacccaagttacttggacttcaagccccttcctgttccagacgtgctgatccttgcctacctgcccacttctgcttcctgtttgaccacctgtcctatatattcctgagtgtggctgatgtgttcataatttcagccctgcctccatccacagctgcctgactaggagggacacctggccccagaggagccactccattgaatcagctgatatctaagatagtggctctcaaactttgctgctcattagaatcacctggtaaactttaaaaaaatcctgataccaggtcatatttccattcaactgaatcaaaatgggaggggtggaaatggggaagggggtggaacccaggcatagtttacaattttttctccaggtgattacaattggagcttatgaactatgatcaaagttctccaaatgttgtccacaaattagcagcatcaatatcagctggaagctttgcaggagcgtagactctttggtcctatcttagactcctgaatcacaatctctattttaacaagatctccagatgattcctatgcacattgcagattgcaaagttctcccctaaacaacacagagtgcagtggctcactcctgtaatcccagcacttcgggaggccaaggcaggcggaccacctgaggtcagaagttcaagaccagcctggtcaacacggtgaaagcccgtctctactaaatatacaaaaattaactgggcgtgatgttgggtacctgtaatccgagttacttgggaggctgaggcaggagaatcgcttgaatgtaggaggcagaggttgcagtgagccgagattgcatcattgcactccagcctgggaaacaagagtgaaacctcatctcaaaaaataataataataatacaaaaaattagctgggcgtggtggtgggcacctgtaatcccagctatttgggaggctgaggcaggagaatcccttgaacttgggaggcggaggttgcagtgagctgagactgctccattgcactccagcctgggcaacaagagcaaaattttgtctcaaaaaacaaaaaacataaaacaacaacaacaacaacaaaccgcagaggagcaaaatgagtcagtggaggaatgaatggcagattagtacatgtccttgcaatccttcaaagtccttggatttccttgattcttgcccttcctgatgtctaactgttgcgcttcccttgaattctgaacaatatctagcattataattaccctttcccgccccacctttttttaggctactttgagtaggcttctatctcttgcaactgttagcactaggaaacatatccgagtcacgcagcaccaaagtatgttagcagcagcgaatccttatgggtctgcagcaacctcaattcttgcctcctcaaaagaaagaattcgaccaagggtcataaggcagagggagagacggaagcaagttttacagcaggagtgaaaggttattaaaaagtttagatcagacgggaggctgaggcaggagaatcgcttgaacccaggaggcagaggttgcggtgagccgagattgcaccattgcactccagccctgggggacaagagcaagactttgtctcaaaaaaaaaaaaaaaaggggggggtttagagtagggacaaaaggaagtaagatacacttggaagagggccaagcaggccacttgagagattcaagtgtgtggtttgacctttaccttggggttttatacatcagcatgcttcccaggcgggtggagtgcacctttctcccctgattcttcccttggggtgggctgtccacatgcacagtggcctgccagcacttgggaggagccgcacgatcagtgttttctgaagttgtatgcatgctcactcgaggccttcttcccttatcagtcaagtgttcctagaagaaggtcatatgccagttaaatgccaccattttgcctcttagcgcacatgcttgagcccactcgcccaactcctgagaccgcatagggaagctgctgatcaccagtttcaggtgtttttatctgttgggaggctggccttttccttgtgctggctgaggccaattattattttagagagacagtttaacaactgcctgaccaacacctgatggttgcctgacagtcccggtggtgggggtgggggaggcgggtcctcttctgccctgctcatgtctcactaattacctactgtaacacaaccacaggtgccacaacatacttgctttttaaatttccttttgtttgaatcaaccaatgtgccttgcagaatgcttcgtcagtggagtggggaactgaagtcatcactgattatttggtgcaaggtctcaaaagcgtttctcctgaatgacattttggacaaagcttgccaaagacgggcagcctttgaagaagttcaatcaccatcttcctttccaagttgggcttgagg

SEQ ID NO: 286 - DNA, 50749 bp, Homo sapiens
tcacttgggagcttctagttcaaggaacactatgacaaataccatttcaaataagtaacgttttttaaagaaagagaataatcaagtgaaaatgtccattctgtgattcttagtctcttaaatcaggtttgccaaaaggagggtccctgctccccaacatctgccactatgaataagtggtgcatttataaactgcctgctgctatggtctgctctggactggagaccagcgacccatccccaggcctggctagatttcatccagtcctggtaccaggatgcacatactctgtttcagtggcttgaagaactctctacatgaaccagttagagcagccaaagagctgtgaacaacagctggacatcttactagtttaaaattttgaatttagagcaaagatggcaccaacgtggccgggtgcggtggctcacgcctgttaatcccagcactttgagaggctgaggcaggtggatcacgagatcaggagatcaagaccatcccggctaacacggtgaaagcccttctctactaaaaacacaaaaaatttgcctggcgtggtggtagcgcctatagtcccagctactcaggaggctgaggcaggagaatggcatgaacccgggaggaggagcttgcagtgagctgagatcgcgccaccgtactccagcctgggcgacagagccagactccgtcccaaaaaaaaaaaaaaaaaaaaagatggcaccaacgtgagtggcagctgcagatagcaccaagaacccttttctctgagtggtgagtgacagtggcactaagcaggtagaagccaatcagcctcaagaatgtggtgacgcggtttataagacagtgggggtgaaggaaggtgaaagggtggggggcagggttgggccaggttgtggacaaaggtcagcagactaagagaggcaaacagcgccagatgagactcccaggaaccttccaaaaagcccgggagccagaaaagtccccaggccccacttcctgctccagctgccaagagagggaagcagctctcaagttcaatgagggcagaaatcgggctcatgtcccaaggcagctgtaagctcaggcgcccaaggcttcagataggtgtcccacgtgggcctgagggtgaaaaagctcattcttcaaaagaagtctgatttttggatgaaatttcccacttttcaagacactacatggacgagacaaaacccatctgtgggaatgcagcagggagaccacgtgggatacacaagacttgggtggaagagggagccctcaggggcgggcatcacctcgggcacagaacagggaccccccacacaggttgggaagatggaactgcctcctccctccgtgcaatcgggccggcgggggggccctaccttcagctccagatcagtgtaaatctgcggcctcagcaggctgagcaggtaggacgcgcgggagaacttaaaccctgaaaccgaatccgatgaagactgtcaccaggggtcaccagggatgaggaccgtcaccaggggtcagcagggatggagaccgtcaccaggggtcagcagggatggagaccgtcacccggggtcagcagggatggagaccgtcacccggggtcagcagggatggagaccgtcacccggggtcagcagggatggagactgtcaccctgagtcactgccctccactcccccatgccacatcagagctcacctgggatgatctcctcagtgacagctgcacccccgatcacatggcgcctctcgaagacggcggtgttcacccccagtctctgcaggtacgctgcctgggaagtggggcagcacacagggccctccctttatccctctgaaatgtcagggctccctcgggctgacccgcagactaaggtcctcactataggccagtatgggccacaccccatggcctccctgccccgctcatgctgttcctgcctctgggaatgcccttccctgtgcttccctttccaccctcgccttttctagatgtcctctaagatccgacaggcctgctcccgcccctccacttcccagctgaaagtggtcttccctccttagaggcctggtgcctcggggactcacgctgcttcctgccaccctgccctgggatgtcgctctcctccaggcagggagccagcctcatttctcctacaagcgcagcacagtgaggtggaacttgtgaatgctgacccttccacccaggttcagtccctcgttctctctctgctgctgcagcctcagtacctgatccgtctggcctcagtttgttcacatgcaaaagtggggctgatgaaagtagtcccggctttacccacttcataaggctgctgtgaagattaactgagctggttcctagacagggtttaagtggtccctggcacagagaatgtactcagtaaatgaagcggttcatagcagagctttattttgggagaacaaatgatgcaaggatttctattaatttttttctagcacttagtggaaaaatcaataaatatttgttgaaccaaactggtcatgaatctaccgatctaaaatgctggccctgtgaccacaggaatggtgccatgcaaaagtcggacttttcaaaaagctcacttggcagctattatgtgccagaagcagtgagtacattgtcttgtttaatttttcccaccagccaagaggtaggtactatgattctcccattttacagatgagaagactgaggcccaatgaggttaacagcttgcctcaggctcacagagctgatgagtagaggtgttgggaattgaaaccagacagcgtgaaaccagcatctatcctcctaacataacctcctatcataacctactgagaaagaaacagcagctgtcactcagtggctgaggcctggcacgcaaggtgagctgcgtcattctcctattacacaggaacgatctcacagattgacaacctcaaataaggtttctatgagactatgataaaatgaggcaagcacaaacaaaagcaatgtctctgtgccatccagaaaataccgaacacccctcttggctgaaatgagtgactgctacttctttatcaattactgctctctgcacactcgtctctcctccctacagatcagatttcttgagctgcccagttgcagggctgtccctccttcctgacagtatctaatctgtggcaacccctattttcgtaggccttccctcaaatcaccaaagctcaaatcctgtgctaggttctttctaacaccttcctactgaggcaacccgaggttcccctgatgtgagttccctcgctgcaaagagcaagaaaccaaactagactaactacaagtgtgttcctggtgggctttgggtgaagggctgtggatgccagccttccttggcctggaaacttccagtaataacagccaccatttgggcaaggctgcatgtgccaggtcctagcagcaaatgatctattaccttcacagcagctctgtgagggcaggtgccattgttccattttaccgtgactcggagaggctaagtgacaccttaaccttcacaaagtggcagagctgggagatgaatctttgtttatattaatataaaatcaggccgggcgtggtggttcacgcctgtaatctcagcactttcagaggctgaggcaggcgggtcacctgagatcaggagttcgagatcagcctggccaacatggcgaaaccccgtctctactaaaaatacaaaagttagccaggcatgatggcggctgcctgcaatcccagctactcaggagattgaggcaggagaattgcttgaacccgggaagtagaggttgcagcgagccgagatcatgccattgcactccagcctgggtgacaagagcaaaactccgtctcaaaaaaaattaaaataaaataaaataaaataaatgttttaaattactgatccattgagttacaaaatgccgcacgtaaaatgttcaagtaaaacttagacatcaggcaaagtattaaggtttaacatcagtccgttagcacagccacagtttccccctatattgatgttctagagctgctgctgcttcaagaagatgttccacatttgttttgtggccttgaatgccttctgtggcctcctggaggtatctggactcaggttacagaagcataagctaaggatagctctgggatatccagctcagtttgggatcttgaagtcagttgtgttggggacagggcacaggcccttctgctagactgagctcctcaatgtctccagggcacactttggccacatagcagctatgtactccaaggtggtacctggcctggacctggctgggaacacagggctctagacacaagggctgcctatgatctggagtcaagggcccccaccccgccccaggtgcccaatcccctggttcccacctgctctcatgctgtgttggttacatgcttccccaccttgtcagcttgtttctggaagctccctgactccctcacaggccatggggaaaccacctttccccattaggggaaggggaggaaaggagcctgtgatgtccacagctggctgcagatgagcattcgacccagcccccagtcagcactggagagcagagagcatcgactaggctgccttttccttctctctcaaggcccttatcccacctgcttcttcacactccttcccaggctgctgagagccacacgcccagggccagtgaagtgggatcaagtggggaggtactcacagccaccagtccgttgtgtcctgcaacaaaacgggacagggaaggaaaacatcactggtcagcgggcgggcagacagacagtccttgaggaatgtgctccccgctgcccgtccccatgccatgaagatccttggtgaccctcccctccccttcccgcactcagatgttggaacagcatctagttcaactccatgaaacaccagatcttcaaggagtcagaaaaccctggttcttgccttggctggaaaagtcctgctcccctggcttggtcaggggctctgctggagtgaggggctcatgagagcatcgccagggcttccattgcttgggaggcgcaagtgatggtgtctgagggagcagcacggttgagttggcaagcaggagaagcaatgggtggctggcatgctgctgcgccaacgtcccgtctcgcatggcagcatcagcatccaggggagtgctggtcatgtaggtagttgctatcaagcgcggcttgttttgtccacgtgtggttcacaatcggcacagtggtgccctagaaggctttattcacatgggttttttttttttttgccaatccccagtgttccaaaaataaaacatgaacagttcaacatgaagtaaacatgcacagcttcaacatgtgctggagtgactagctgtgcttcagggtgccttgagctgagaggcctgaatttggctttggcatctcacgttccacaccaagcccctgggtagcaagtgcctctccagctctgataagctcagaatcacctggaaggttgtataaatgtcgactcccacagacccccttcccaggagtctgttcagcaggtgtttcacagaaccaaaagtttcatgagctaaaattaactcttaccatatgagaagcatgtgagaagctagttggttacagttcatcttaaaaagtgctggttgacatactctttatttgtatgggcttttgaaaatgttcataagaaagtttaaacaatccgccagtgggactcatgaacagatggaatctgtctctcaaagacatgcagcaaactaaaggcagacagtcctgggctcagcccagcctctgctatttgccagggcatgacctcagagagtcatcagctgccctgagccttgagtttcttcacatggggaacagagggtgccagggaccctgcagtgtggcaaggatgagataaatgggagctatttgtcttttaattggtgctgatgatcgatcttggaaaactcatagtcttccaggcaactgggtccagttcaatcatggcagacctcaaatgagtaaggtcaaggatccaaagcacaagaccccctcccagtgaccaccctcaagtcctggctgagccctccttggcttctggtgacacctctgttcccttgaagaggacttcagctgcgggctctgctaatccccagacctgcctcaggggccccatagcaggcgcctgggcccttgaggagctgctctgggcgtgggctctgcagctgcctgcatcaggcagtgttggttgggtggatgtgctgacctctgggagacacctcccgccctcagaatgctcgtcaccaggtatggggccaggaatctccattttaacaagccccctcagtcactctcaggcacatttagtcaaatgactaaatgagattcatcttcaaggtggcggccaggtgccagtgtgccttcagggactcagaggtaacccttgtctcagaagatgccgttctgttcctcactgaggcccaagatgcctttaaaccaggctttatggtatgtttagcaactaaagaaatcatgtcaaggaaaagctcacacactgagactcactcgcacttgtaggcaagtcaccaaggcagctggtgacctaaagtcaaccttccccattaggagacagcagggtgagctgtggctgagcacggaaggaggcagggggcttctctgaggctaagtgaggtgctggagatggctcccaccagcccggggagtttgtgagccggctgtcaaacagccattgatataaactaaattatataagcttacaattaaataaattaaaaacaaaggtaataaatactcaaaacacactacctcctatttgttttactacatttgactgttgcccatgccctggcagtcactggcctctatgtacatatctgcatggtggacacactatacaatgatgtgctactgggtatctctcctaaatcacattgagcaacctcatcttggtaacagaaaaggctatggtgggagtatttacaccactgtcatcagcaaatattacacagaagggctgaatttattttttgtggtcaggcttaagaaagtgatgggaaaatgctaataatgcagattaaacctaacagtgttagctgttatagcatgaataaatagcacaaaaattgaaggaaatattctagtattagaacaatattatcttatttgagtaacatcattcctgtcatttaaagaaggaggccgggcgcagtggctcacacctgtaatcccagccctttgggaggctgaggcaggtggatcacaaggccaggagtttgagatcagcctcgccaacatggtgaaaccccgtctctactaaaaatacaaaaattagccgggcgtggtggtgggcgcctgtagtcccagctactcgggaggctgaggcaagagaatcgcttgaacccaggaggcggaggttgcagtgagccgagattgcgccgctgcactccagcctgggcaacagagcaagactccatctcaataaatgaataaataaataaaataaaaataaattttaaaaaataaaggagtaaggttgggacataaatctttgttgtttcatttgtttcacgatcatcctactctttacagaaaatatggagcaccgttctctttggagctaccctcatttgtcatttgcaactataggttggctactgagtttggcaaaaatcaaagaaagcctttggtaagaatcactcgggtagactgcatttaaattgagagtattgtatctttatttgtaaaattgtgtgcagtgtatcttttatttcaatatttaaaataagcatgtgtatatgtgtatatatatgtacgtaacacatatacatatatatacacatatatgtgtgtatatatacatatatatacatgtacacacacacatacatcacacatttttccctggagaggtgagtgttgagtatctaccagctcgcaactgctctagtacatatgaaaatgaaggcatgccctcaaagctgcatgttgagtgccgtctgctttcggtcccgtcattatctctgtatagacccagttggcaatcatgcatttggggccctctgcaagtgtgaaaggaaggcactaaggaaagaccacctggtcctgggcctgcctcttcccctagcacccagtagactgtgatactctgagcccaggggttggcaaagtgtggcagatcactgcagatccccaaatgtcccagagctgcaaggcaatggggtccatctccctctgcagacacgcagtaggaactctgggactcagttctgttttatcctaactggcctttatgaaatgactgcagtttcttgtgacgaggggtggcctcagtggtaaggtagtggtgaccagaactcagggcactgagggggcggggtgctggatttcacttgtctgttggcccagggctctttccaacccttacaaaccataggctgagaatgtggtggaaactaggtcactttgcaagagatatagggaaacccctgagctcacctagtcttcctgtcattctccatgggaagatccaagcccagagaaggcaagcatttgccccaggccacacagcagagccagcaccggaatcccaggtgcctgcctgccagatggaagggctttccattgcagcccctgctagcgtataaacttctggctgggttatgccagaggagagagcagtggggcttggctccccctccccctccccaccaagctctgagcagggctgtcttcccgcccctcagctctggcccggcctgctttaccactttacctgctcctatcaccaccgcatcatactcaggcttcagacctcccctggcttccgtgttatctcgtctccacgccgggaagggagaggcggccacagccttgcagagacctcggccacttgcagccatttctgccccaggctgggccttgctaggcagggagtttgctagcgattggcttttgtgctgccctaggcacggggtggagcagggaggaagcaggaagaggaggagctgcagtccccctccaggccccctccaccatgcattcttggccacaggccagcctcctgctgccctggggctgtgctgggccgtcgggagtgttgcctattaaccaggcggtgtcacctccaggatgcaggggataatggcaaaactgacaatccactggggttcctatgtcaggctggcattgtgctgaaccctgtaggcaaaactccccattttacagatgagggcgctgaggctgcggggttagggaatgagtggtggaggcagagtggagctcgaaagggccctctcctcccctgtgcatctaccttctcagtcagaactgaaacgcctgggatggcaagtgctcgtgtcagactctgctccaactccatgctgagtctgccagtgcagagtggtgatgcctctacgcccacaggaggcgcccagggcggccatctagcgtcaccacgaccagggccttcagacaccgcagaggcagctgtgtctgtcgctgaggagcactggagtcctctcctaaatgctcaaacacaaacccacaacgagggcttaggggcaagttcgctgtctgtaattctctggtgttttagttttgaaggcctggccagttctcctcttttggcaccttgcccattttccaagaatccccaaggattcgaggtcacatctgtaaatacctccagctaaagttctttctgaccctcccttaggcctgccttgaattaggagcccctttgttctctgcccattacttagcagagtgttcccctaggaggaaaaaaccccttggagcggagagttcctgcactgctctgatatcgcagtgtgacggaaacctgctattggtaacgaatctcagaactgggagagtatgtggagatgatcctaagagggggttccgaggacccctccacacaccatggacagttaccccgcatgtgagcatctctgctaagatctgattcaggatgttcactcctgtgttatttattatatagaaagatcaaggggactggttaaactagacatatcacatccagccgctgctaaaaactaaagggaaatagtaggtgacaaaagcaggggtcctgaacagtggtgggctcaggggattggagttttttcctttatgtttttctgtattttccacaatccacgcttttcattgccattccatcagatgatgttaaggaggaacacagatccagtcacctgaggggatacttcctcactgccaccttctcagggtttagaccaacatgtgggttctagttcccccagccccaaagctgttccctgcaaggaagagatcagtctttgagcaaattttggctcaagactaaagacacagaaggcgaggctcctgcatgcacagcacacggccatctgatcctgtgctgcagtggacgctgactttcgccacgccgtcctctctggcccagcaccggcctcctggcctcagaggagcagacactcccagtcccagggctctcagggtctcttgtccctgggtccattctgggacaggaacttctcggttggaagagaggggctgtacccctcgggtggtggttctcaatccagggcgcaccacagaagctttgaaagacatcaaaggctgggctccacggccgccaagggaatccaaatctctgggccagggccaggggcttgagaaccccagccctagggcagacgccagccaagcatgaaggggctgggacttagcaagggcttatcagcactgacagaagggtctagaagcactagcatgttgggcttcagtgataacaatgaccaacatttattgagcacctaccacactgggtaatcctcacaccaccctgggacggaggtgccatcgctttaaacgtggggaatagaagaaacttgccaggaggtgcagagaggaagtggcagcgctggaattcaaacccaggcaaaggagcaccttttacctggggtaggagagagcttgctgggtgggcttcctccacgcagggaacagcagagatggggcttcctccccatctcccaggataaaggcagaggcagctctggaagaggagctgttgccaccgttgttttacaaacaggacccctgggcttccctcttcctccagagagaaggatctggggccttgctcagtacctgacatggagggtggtctaggtggggttttagaagccctggggccaccctgggcactctgccctatcctcaggatggccactgcagacaggaggctctcgtcatggggaacagtggcaagcaagggtggctggaggacaggatgcaaaggcagactgcggccaccttggcctagagcagggggatacgggaggcctcccagaggcgccgggccagctggccggcctgctgcaccagcaggtcagtggggatgacagacaggtgcagggccagcagctcgtagcacctgacagcctcggttgggcggttcttgctgtagtagcgcaggagcttcctggggaggaaggggaggatgggattcaggagtgaggctgtggcactcctccagcgccagaggcctctctgggccctcgcaagcaaatgcccatgccctcggtcatctcactaggcccctgcatgtgggccttgacaaccgctccggttcctcactgacctaacagtggcatcctggctacgaggtagcagtggggatgttctgggccgggcacagacgttccccgtgctgccaagaccatgccagcaggaaggtggtaggaacacagatgtaccctccacacccgtcctccctcgctgcacacagggccagccgggaaggtgttcccagcgtggatttctgggtctgaggtagggcactgctgaagcagaagctgctcccggcagaggcgagcacttatcacccaaatgggggcatctgtccccagtggctcccaacgcagcgtcacctgtagtagtctcctcccagcatgccgataggcactgagtcgtcggagaggacgggcacctcgatcatctggagtttgtacccctgaggagggaggacagggaggcagtgggtgtgggggtagtgcaagggcctgagtcagacgcaccgggcttgcggcctggcttggctctgtcatgtgcgctgggtgcttgggaaaatgcctggaccttgttttttcatctttgaagtcagaatgacaacagtcaccttatgaacattagagaaaaagtatacaaagcttcaagggccggcagggtagctctcattaccgtcaatacctggacctgtacaggccacaaacacacgctcaggagggcaccctgcagggctgtcatacaggtcttgaagagcagagcattcacaaaaggcccaagcctctgctctgaaagaattgggaattcccagggtgggataaggtggggaagggaattaagatctgctggacgtgccgtgtgtgccaggcatgaacatggcacttagctgatgcttgcctgggcaccgtggcctgccctgcagggggagtggactccctagtgtgcagggctgcccccacggcaccggctgggctgtgtggctggcattcaaacctggcctctccagcccacagctctgcctcactttatcaccccacggggccacccaagcacacagactcctgtccctccctagaagtgaaggtaaaggtcacaggaattttctagcacttctgttgtacacacgtcctgggcacttctgagggcacggaggaaagctgggagcctgcaggccgggggagcagagcttgggctccggcttcctcacttacagcctcggtggccctggccatggcgtctgatctccggatcattgtgtctccatccgtacaacggggtcaggaatccctgccccagccactttacagggctgtgagggggtaactgagagaacagtggtggagagccccagtaaccgccctgccctatggaaagggatggctgtcaccctcagtgaacaaagagtgcagggtgggggcaggggaaggcacaggagtgcagggacccagagaccaagggctgcgagggaggaggaacactcctgagagctggaacaaccactcctgagagctggaacaaccacttatggtgacaagcgagatgcaaataaaagagaaacaggaggaaagcgaagaaagggaaaagacagagaggagggagagacaggaggagaggagtcccagccactgcacccctcacagccctgtgcagtggctggggcagggatccctgaccccgttgtatggatggagacacaatgatagtaagctccccccactggaccctactctgcagtaacagtgaggcccagaagaagcagtgcagggcctggaggccagggccccgagccacaccaccagtgtctcctcaggcagcctggctcactgcttcaagcaggggcctatgctcttgagttcaggggcctatgccacagggatgaccatgtgccacacttggcatgtgacgctggcgacatggaagcactagcgacaaagtgtgtggtctgagtcgcatttctcacagtggggcatgtgcctttctgctcacatgtgtgcctggatgccacgtggacaatggcaagagtttgccagacagctgggcagagggatcacaaagcagttaaacgcccatgtgaaaatgtgacctctgaactctggctcccaacctgctgggcttaccagcaacaagaagagaagatgagacagacagacaacaattcagaagaaaggaatccaagagttacagagcgggaagtgtgtgtggcccgtcctggcccagggactcagcctcacctaccatgtcattctcgaaccacaggaagtaggagcagtagaaatccccctcctggaacagcagcgtggtgtagcccttctgcaggtatctgcgcgccagctggatcagagaccagacctggggaaaagacagcaagcatcaccactctcccagccttggtctgcctgggcagctctcacctccgaaggaaggaaagggcacagccgagaagctccgtgagtgccaggggcctctcctagtacccgggcactgccttggctcagagcaggaggctcaacaataaatcattattggatggatggactaccctccagttagcgtgggggcaaaatatatgtaaaaaagctttgtgtaactttactatacacatatgccataaattagtgaactgggctagtgtggtggcttacgcctgtaatcctagcactttgggaggctgaggtaggtggattgcttgagctcaggagttcgagaccatcctgggcaacatagcaaaaccctgtctctacaaaatatacaaaataattagccgggtgtggtagcacacacctgtagtcccagctatttggggggctgagatgagaggatcgcttgagcccaggaggtcgaggctgcagtgagctgtgcttgtgccgctgcactctagcctgggtgacaaagtgagaccctgtctcaaaaaataataatattaaaaaaaaaataaattagtgaaatgatcattcaggccagagaatagccagggacatcattaatgaacacaggagaacaaggtgtggtctcctgaatcccctcctctgcctggggtcgcccactcacctagtgcccttcaggctgggaactgatggcacaggtgagtgaccctgtaggatgtgctgagccaggggggaagtccaaatcagagttcaccaaggggtcagatggaaacacagggcctgagaaaccacgtgccttagctcccctgggaatgtcctcctgcctgacgcagggactgtcaccagtgctgccggtgaagtgccccagggaaggcagcagggacagtgggctctctgccacctctcagggctgggaagagactcgaggagccctctcctctacccttaacgggagggacaggcgatctgctccaaactgcatcgccgtgtgattactcattaaatctgccatggattgactgtacttttcaggaaagtaatttgacaacatccatcaataatcttaaaaacattcctcccatctgacttaataattccatttctaggaatccatattggggacataatcagagatggggacccagatgtatgcaaggtgtatactgcagaattatttataacagcaaaagcctagaaataatctgtatgtctaaacatcagggaaatggttcaataaattatgttacattcacatgatggactattatggagctgctaaaaatcatgtctataaagagttaatggcatgagggaaagcatctgatataatgtgaaatgaaaacatggtagcaaagttgcacatacagagtgatctcaactacaacaaactgcacagaaaaccaacagaaagaaacgtaccaagataaccccaactgtctccagaatgaggggcaaggatgaagatggtgatgatgatgccaccagtaagtactgaatgaactgtatctgtattttgtgctacgtgctatgctaaatatttgatacgtatcctctcatgtactcttcataactctgtgatgtaaatagcactattatttccttctacagatgaggaaactgacccttgggctaagtactgcccaaagccacataactggtgggagacggggctgggcttccaacacatgcctccaccacccatcttcccatcttgttttaaacattagaatacactttacttgcctcccccaccaaaacaaagaaagaaaagaacacacacacacagacacacacacacacacacacacacacacacacacacgtatagtttttttggagagtggcaggggtcctccccctatcaaaaatacaactttgtcatgaaaaacagtcagttaaataaggagaataaaagaatttccagggaatgcttccttaacagaaatcaccttgttttaaattctgatgcccaactgatggaccttgccgttctctccattctagctcattcaacaaatacttgtcgagcatttatttatgccggcactggccactgcctccttgggcctgctgcccagcgcactctgctagccccaggcatgtggatcacaccaggaagggctacccaatattggctgaggcccacccatccccgccctgggtccaaatggttaccttagttttgacaaaggcagccagcggccccttgcccaactccgacgaggtcttttgactgcagttgagggaaggcgccaccatctgcccagtggtgcggtccacatagatgaagtgcaccaagcctgggaagtcttctaggtaggtgaaggtctgagttaaggtgcttacaagccaggagctagggacggcctgcctctgtcctgggcttctagctgtgcccagtcatggtggcaggagggccaggactgcctctttccagcagcttccatttcagctaagccccctgtatccttgcttcctcagatcccccactacctccaagctccccaggccttgaaaagctgtaagatcctcaacacttgcacatttgacacgggcagttctggccctacaggaacatggtatgcatcattttcatgagggatgaatttaagtcagacacacgtgaggctggagtgtgagcacagccacttggttcatgagtgagcctagctgactgcccagcctatgcacctcactgtgatcttgctaaacccttacacttcatcatgagagtttggaaggctcccatttgggaggggaagagacatccatagaagggcagcagctggtggctaaagaggccctctggcatcctttcacctgcccactgaggacctgcctcaggagactgggggctggacatttcagagatgatatgggaaaagctgctttacatgaattttcatggaaaatcagtattcgataaaattagtgttccataataaaagggtcaaatagtcttaggaatggcttctgaaacagggataaacatttgccgtaggccttctagagcttttacatgccactgtgcactgtcatgatctaagaaggacaacggccctttcaaccaaactagaccacaggaaccccccccccggtccccacccctcgtggaatacctactaccattttgccagctgggcaacactgacataaagggtctttatggcttttgtgaattaactttgggacaggaggaattcctgaaatttcagcttgaagtattcctatagacaaggcacatgggccactatgtcccattattttccttcagagaggtggtgagcagctgatggggtggaacatatatcccccttccctggggcccatagtccctccagggagcaggtgtagaggcagcagatccaagaggcttgttgggctggctggggccccggcgtcaggatatgacaccatggtgatgttcctcctgctcttcaccagcaagaagtccttccagtccgtcagcttctccctgccgagggaagctcgggctgcgtgaaggaagtacgggccccagaccctgccctggccacccagggggccgcactgcacttaccgcatgagcctctgcacttggtcctgcaggtgctggggcaggtgtgggcctcccctgctgggggctgtggtcagaaagttcagccggtagatggcgcagagctgccgcttcagcttcccacatgcctggagcagcctgagcacgagagaggagggcattacagcagaagggacctaggggagcccctcgccctgtgtggaccaccttgttcctgcacccaggacagacagacctggggagcccttcccccttgtggaccaccccactcttgtacccaggacagaccaacctggggagcccctcactcccaggtggaccaccctgctcctgcacccaggacagacagatggaaagacctaagggggcagccacagctgatcaggcaatgggaaggagcttcccagcttctccacgcggtgctccacgtatgtgggaagaaatctcctttcttgaaattattttgctgataaatgaagggcagtggtggaggagatgtggcctcccagggaacagtcccctgggcacacgacccaccccttgtcctgaggcccaccactcactcccaggaggatccgggctcacttttggagaaagccttggccttaaactccagccaggtgctctggaaggaagacagggggcaggtttgcatcccgaccatatttccagtgaggtccaggccaaagtccttctcagatcaggctctgagagggcacagggcccccagacaaatctgcccttctggccaatgcaggctaccctggcaggccccaccagccccctgcagacttcagtgtgccatgttctagtcactcagcagcgtttatttaaagggcagtttccaggggctcgctgtctgacgggcacaggcacacatagtagcaccgtcacagcaaccaggccagcccctcggggtggggggcacacacagggcagcggctggggtgtgcggaggaggtgctgctgcagaagctgggagggtatggggtgggcatggggtagccatgcagggggcggcctcacgggatctctataaagcagaagaacttggtgttctagtgaaagtgctccttaggacaccctgaggcactgcgggatgtggcactgcctcctccagccaatcctgcagccttcagactgacaggcactccagccacaatgggtcccagctcctcaaacaccaggcgcctccactgcttaaatccagagtcaagccccaccagccccactgccgtccaggccctgatctgggctttgtcagagcacggggtgatggactgtttctactgcctgcacattctcacctgtctcctggtctcagctccccacctgggccctaagctcactgggggtggggtggagccgtgacctgcacatccctgtgttgccctgtgagcccggggacacagccccgctgcagagaggaagcccgtgacgggcggatcccgactgcacttgctcactgcatccgggctctggctccactgctcatgagctgcataatcttggccaagttaaaacttgtctaagccttagtttccacacctaaaaaaggggaattataattcgtattctgccaaacacacataaaaagattctgaaaaccaaaaagcagctaagttttcaatatcatttcataatagggaaaacaaggatcgtaggcccgggggaggtggagcccggacaggaacccaggcccattggcccctcagctgctgtggaccggatgtaccctgctgccagccctgcctcttccccaggtggggaggactggaacttgggtctcacctgaatctcctgtgcccctcgattcttgacaaacttgtccatcctctggcgcaggtctcccacgaggggctgggagcgcagggaggccccgggctccggcccttccttcagcttcttctccagcatggagaagccatccatcagctgggacagaaccagggccaggggcgcgctggggctctgagggtaagggccgagaggcgggtgaacggggctgcccctggggaagacgtgccaaccctaagcatcatcagggcagggtgaggggctctcctaccctggtcaggagcaccaggttgatgccctgccacaggggcaggcagtacatggtgtggggcactagggggcagtagctttccttcacgttggcatccaggaagatccttctggggccggaaggcacagggcagtggggaaccagtgtttggagggtgtcctctgctatctacagaggaagaagagctgcagtgagaggtgggatccctaagttggacccacccattgcggccctatctgtgaaccacaagaaataatcatttttagctccaagaaactccagtttttaaattcctgcactctgctgaacctgccctcgcagctccagtttcgctgttgcccctctccctcagctgctcctgggcctttctgcccagagtctggcccgggtgccaagcagggcagtgggcaggggcagaggggctgggtggtggcacagaggaccgagaaggcagggaaacactcgtggatggggagtggacggggagaggtcccctccccacatttgcaacagatggaggtatctaatgttcaacattgtatcatttcaatcaccctcagaacatcccaacagccactcaaattggggaaactgaggcataaagtgaccaaatgggcaaggctccagccttacagagggatctaagcaagaaagcctttagtgcaaaaaattatagaattaaggaaatcatgagagatgccacaaaaattcctcttcagtgtcatacctaacagcaaacactggacacatgacgcgattttcctggggatttgctagataaataacatatgcatgtgatggactaccaatcattacaaaccacactgtgggagtgcttaggaaatggaaaaatgtttaaataaaaaagtataatgaaacacgttagtatccaaatctgattttaaaaatacacatgtgtacatatgtagtgtgtgtgtgtgtgtgtgtgtgtgtgtgtgtgtaaagtcataggaaaaaaagactagaaggaaacaccccaagatgttaatctcattttgaggacgggattaagagtaatttttattcccttttttatagtttacttttgtatttcccgatttttctacaataaatatacatgctcacttaaaaaaaaaattctattggactttcactcccaagaacaatggagctgagggacagcacctgggggaggggaggggcaagttcgccacccctcacagcccattcctggaccctgcctctgggctgagctctggcaccaggacaggcacctgcactgaccagccctggggtgggcaggaggagggctggcacgggtagagtcaccctggaggcgaaaccctcagagcccccaatactcactgcggcatctcagatcagctggcgcccaggcaggcacaggagaaactcacctgaagggcatccatggggggggtgcccccctccagccagatggtgctacctgcaggccacaggtaataacataacgatgtaagtaccatgagatgtaagcaatggctcaacagcatggggtagggggcccaggtgccccccacaacctcagcccttggctgccagctccacgcaggggtgctaatgtggctggggcaacaccccttcatcctaagttggcaggcacaaggtgaactctgcagtaccagggctaaggcggcctgggcctggcagagaagctgcccccagagccagctgctgagaatcaagctcctgaggacatgtttggtaatggtggtcagggggtagaggggcatcttcctcccccctcccttgcccccaatcccctccttgttctgtcccctgtattccttcaggcctcaacccgcccctcaggagtcagcacacacagtccacgtttgcccattcatttattcaaccggcaagctcttactgagcacctgctgtgtgctgggaattgaggtggatttccttcctaatataacgcacaaaaacctactgaacccaccacatatctgaaatattatgtgtctgtaataatactgttacctcttatatttcattgcaaacaaccctcatttataatcatgtttctttgggggaagtgtgttcctacatcttaaacacctgatttacaaatggatgagtgcaacccaaaccatttgtaagttgtgagttctctgcacggtggaacagcattattttttacagttttaaggcataaaaaaccactatcaagagagagggactgggaggaagatggtgatgaatgaggaagggagtggtaagaggaacttcggagattacccagaactctgcttctcaacaggtctcaggctcatcaagagctcagggaatctgaagatagctaggaaccctcaccccaggaatgcacaggcatcagtgagttcacacacagtctcagggggtcctaggcttctagccagacctaaagttaaaagcatctaacccagtggttgtcaaccttggctacacacgaaaatcatttggggacttttacaaaatcctgacgcccagggcatagctcagaccaactgagtcagcatctccgggtacaggctcagcttcaataattgttaaagatccccaggtgagttcaatatgcagccagggggcaaagcatgctgtaacctaaatctgtgcacagcagtggtttgcacccgaggcacactgaactcacctgggaaaatttcctagaagtattcacacctgggtcccaggcccacagactgtaacttaattgggctggctgaagctgcctggtgattccaatgtgccagggttgggttaaaagcagccacataataaattcctttcaaatcctagtccccagtaggtttctcctcctgaaaccctggccttctttcttccatcagatgatgtggagggaccacaggacccttttttttttttttttttacctaagaacttcagaaataaatgtaatgtttattcatagtgaccacaacagtctggattttggtttatctacttctctaagcaaggttgtccattttttgttaacattttgaatatttgtagttttgttttgtttttttttttgagacagagtcttgctctgtcgcccaggctggagtgcagtggcatgatcttggctcactgcaacctccacctcccgggttcaagcgattctcctgcctcagcctcccgagtagctgggattacaggcgcctgccaccagacctggctaatttttgtatttttagtagacatggggtttcgccatgttggccaggctagtctcaaactcctgacctcaggtgatctacccgcctcggcctcccaaagtgctgggattacaggcgtgagccaccacacctcaaccattttgaatatttatagtttttttttattgtttacccacatactttggagaaacaaagtataaactacagatgctgaatatattttagaatgtatagaaattagatgattattactaaatttaacttaatttttaattttaattacaaaaaagatgagtctgagaatgcatgtacagaagttttaaatgaatcaacttgtcatcaacagctttagggatcagtggagtggtcttaacaatccttgagttcaggctggagctggcagggaagatggggagccgcagacagcgtcctgtgctctaggaacacgggtacctgcactcaagccttaggaggcacgggggtccactggagcctaagacagatgtcctgggctgcctgtcgctcgcagctagctattgtttcctcctgctttcctccggtcctcacctgagctctgatcgccaggggaaggagctggtgtgaagtactcctcagggagggagaagctgtctgtctcctggaatggagaaggtggctcaggttgagaggctctcccagctggctcaaccctgtccctgctctcccaggagggatgggaaaggcctggtcgcctgcagaggccgatcccctcctgcccctgactccacgaagtgcacagcacacaccgtctctgcagagctccccccagttgggcccgtggagtgagggctccaggcctgctgcacggggatgttctggctgctccgggccctccgcggggaaggctgtgcagggcaggggagaggctggttagctcctatctgacctggctccctccaccccttctgcctcccagcgcttcacagagaagcctccacccctccacccctccacccgttccgggtgcagtcctgggtgtgtggtcctcagacttcccagggattcgattctaggcggtctgttctgtggaaattcgagaaattccaacacaatggtatccaacccaccactacccctggtgatgaggtcaacagcgatggtggtggctgacactcactaagcattcactatgccccaggcagtgccaggttctgtgggaaccaccccttttgtccctccaaatacccctgagaagtagatgctttgttattcccattgcacagataagggcactgaggctctgggggtgcaagtacgggctcagctcacacagccaggtgttgaagctgggtttcgaaccatggctgacttgaaaaatctgcacttttaacccactggaccatgtgcactccagaattccccttacatctgaaagcagtgggaaagaagtcacgcccaaccacacacccagaattgtgacttagaaaacatggagtccccagggggagcctgcccaccatcttcaggcaggttttctgaactacctccctaatggcctccctctgcccagaaagctgccctgagacctgaatgtcgtcctctgctgtgctctcgctggggtagaggtcctgaaccaggaggatgagggcaagcaggtcggccgggcgcagggagctggcactgtggctgcagacacaggagcatggccacccatcagcacatgcccagcaggagacggggcaggcaggttaaaggagtgtggagcctggcccctgccctcaaggagcaatgtacttctggagatgggcaaggcacaaatacaattaattaactcgtcaaatttcaaaataaaacttggttgtatagaacaaagaaaagaaaatgatttagcagtgggaaagcaccagggaccaagaacaacataaaaggaagttctagattgagactctaagacagtgttccaggaaggaatgatacagagaaatgggtgagctgaaaaaggttggagaatcaaatctgggaaggtttcaggcttcatggaggaggtgattcttggctgggcaggtggtgcttttcaggcagaggccataggggagtgagaaggccagggagcctttagccaccacatgccagaccttgagctcacctagagtagaatgccagcagcttggagtgcacgagcaggaaggcatgcagggcctcctcgcctccccgctcggggctggtgttgacagcctggatgacgtgccgctccagcgcctctatgcacagctcacagagctgggggtgaatcagtcgctccagggcctagccagggcaggaagggagaggaagccatatcaccaacaaccttgccccactccaagccctgggctagtggggacattcactctgtccacagtgagcttggactctgcaccagatacttggaaacagggggactaagacccaccaggtcccagccttcctgaggcttactgtctggtcactagactccagtggatgaggcaaggcaatacacaaggaaataaagtaagtgccatttgtaagtaagcaccaagtacaaaatacacagcactaggctagagagaaatagcagagacctccttgggtagggtgtccaaagaaatgtccctgaattaggtcacctttaaactaatatctaaacaaccagatggcccaccagagaaagagggagagagagaacactgcaagtcaaggagactgcatattcagaggccatgagatggggacagagtttgcaatggtgctgtccaacagaaataaaagaaaggccctatgcataatttaaatgtttccagtgaccacattaaaaaagtaaaaagaaacagttgacattaattttaatgatatatttcattttactgaatatatccaaaatattatcaccatatgatataaaagccttattaatggaatgttttacattcttttttgtgctaagttaccaaaatctggtatatatttcacatgcatagcataactcaatttgcactagttatatttcaaatgttcaacagccacatgcagctaatgactatcatattggacagatctaaatatagagttttcctgaaacttaaagaagtttcatgtgactagcactcagtaagcgtggacaagagaggcataagatgaagctagagtgaaataggcagcgatagatcacacagggcctggtaggcttgggaagagtttggattttatgctaatggcattaggtcacctcctaaaagaagtctttcctaatgtcccagaaagagtttaccactccatctcttgtgccaccatagcttttgatgaaaaacctaatatggcaccaggattctttattatatcttttagtatatacatggctgatttcccctcaagggcagtgaatatgtctttattcatctctttattcccatggcctggcacacctcttagcatataataggtactatatgtttattggaagagtgaatgagtgggggtatgagaatgaattccttcagatctattttccagctcattaattctccctctagctatgtctcatctgctatttaacacatcccttgagtttttcattttaacaactatgttttcttttctaaaatatctgtacgtgttctttttcaaatttgcctggtcaatttagagtttcttcttatctcattttgtgattctacatttcatatttttaaatatttcatagttattttatattctatacctaatagttccaatgtatcaagtgccttgggatctaaatctgttggtgattgattttcctgactctcactcgtggtggcttattttcttccatatctgattttcttcagttgtgagttcacgtttgtttgatctttacctttcctgctctagcagtggttttcaaagtgtggttcctggacaagcacaataaacagcacctgggaattttttagaaatggaagttctagggccgggcactgtggctcatgcctgtaatcccagcactttgggaggccgagtgggcagatcatgaggtcaggagttcgagaccagcctgaccaacatagtgaaaccccgtctctactaaaaatacaaaaattagccaggcgtggtggcacgtgcctgtaatcccagctactcaggaggctgaggcaggagaattgcttgaacccgggaagcagaggtcacagtgagccaagattgctccactgcactccagcctgggcaacagagcgagactccatctcaaaaaaaaaaaaaaaaaagaaatgcaagttctagagcccccatcccagactcgctaaatgagaaaagctgaaagtgaggcccagtaacctgtatttaacaagccctacagaggattctgacacacactggagtatgaaaaccactgcttgaaagagaatttggtttacctctttaggaaggcaaggagtgctactgaccagcagccactttagtttttatttttaattttttagttttttatttactagggctttataaaaggaccagtagccactttaactttttggggctgggcttaacctagagttgcaggctcagctctcctatgctgctgctggcctaaggctatttactggctgtagtgctggtatcatttgcactcagggaatcttgcctttagcgctgtgtttttctccactgctttcccctccagttccagctcaatataattttgtgggaaaaggaggggagggttgaaggaactgtcttcaaagattcctgtaatttacagtgaacccaaaaattgcattaaaagtatgtgttatccaggatcgagctgttttaccatgggaaagcccatcagggtacccaaccctccatatggccagaaagaacaactctctctgaatacacgagtttcaggggctgcttgtgccttcattcattagggttaaaacatggtcttaaaggtggacgccccctctgacctgacagcttcaagtcctgaggactcccgcgcccagtagtcacctccacggcgaagcactgctcctgctcccgcaggcggctgtaggtccacagcaggctctggaagtgctcccacagctggacacgctgcgccaggtctgggggccgcagcctgggggcagagccagagagggcgggagagatcacaagaaagctggtctcccccacacccaaccaaaggaccacagtctcagctcagcatcagagcttggtgagcccatatgacctgcccacacagctgggaaagggggccaggtttccggccgagctctaactgtggagtggggtgggataggcacggagccggaaggcaggcagctgagcaaatcacctcactcctcagcctctgtcacacaaacacatgtcatacaaagccagctagagagagccagggtgatgcttaagcttctcacacagaggccactgaacacagaaagatctggtccatcatcagggccctactcagggtcgcagccatctcggatgctggcaacgtctgcactggccactgtgattcatgtaacaggcatctgccacctgcagcatttgccactgacaccatgacctatctgggctaaaatgactcatgaaacaatgtttgtgcatttgagaaatgcctcaatatgggtagttgctcatatcgccacaaaactaaagtcccagagcttcacactccgcagcttcccaatccatcttagagaatcagggggtggtgatactacgaacttctcttttctaggtctacatttcaactacaagccttttctggggtccctcccacctcagtgtatactctgaaccatgattctctttccccaagttctttactgtgggcccagagacaggttttaaggtctgtctcctgagaaaaccttcacgagactgtatgaatgtgcatgggtttgtgtttttctggagagagagtctgaagcttgagaagccagagaggactagctcagaccagatttgtaatgacgggtgatgatgttgggaggatggaaagagcactggactgagagtcctgagctcaaatatccagtttggatgtggccaccaaccagctagatgaccccaggcaagtgagttccattctctgctctgtttcaccagatataaagtcagagggtcagaccagatggtctccaaggttcacttgagctgtttctctgacctagggacccagctgggggcagtatgtgaaaaatggcagcttcacaggggctgggcacacgctgcctggcccagcgagggtgctcggcaaaggacagaggggaccagctttgaagactcactcctttcggataagatgaccgtccacagtcaccagcccaaagtgcacttcaaacaggtacttgagcacatacagcttccgccgcaggtccccctcgctctcggtgtggtcaccattgatggcaatgaacaggcattctccaaactgcaggcacaggcaggccagtgtcagccagccccaagggcactcccttcacctgccctggtctctgcagacaagccaggggaggctcgggtcccaggcgggtttgataagatgccgtttctgccttctaaaggagtctaaagttccaaataagagaggcctgtggactccccatcaagctgagggaagaggaacatgggccccagagctatagactcaccaggtgaaggacatacaggaagttgccattttccgtggagaagcaggtgtaggtgtccgagagcttctccagcatcgtcatggaggagatgatgaccggggctaggagggtgctgagctggtcctccagggcagggagctgcaaaaatgggggaaaatttcacagcttagagtgggccagacaccaagaactaaggaagggacaagatcaggccttgatatcaagggttccatagtgttagaccctcctgggagggtatcactgtcctggtagggaggggagcaaaaagagactgtccccaacacttcgggtggtggttaggaagaatggggagggccagctgggtaatggtgctgtttaggctctgaatctagaaggaaacattaaggaattgggcctcattacaacagtggaatgtggggagcactgaacggggagctggaaggaagtttgtagcatgtaccaaagtctatgctgttttttgcaataagtctactttggaaaatttgtcctaaggaaaatgatcagagattgggacaaagatacatgcacaaagatgttcactactgcctaatttataatagcaaacaactggaaaaaaaatgttaacatctagtatcagggaaatagttaaataaatagcagcacatcaaaattatggaagggtctatagccacttaaaatattagagtgtttcaatgacatggaaaattcctctgatacaatgttgtagctaaaaataaaacaagaatgtgaatgcatagaaaaaacgaagtattgataaaatactgagaaagccaacactattaaagttacttctggatagaggaattaggagtgatttttttccctctatttttaagtatgtttctgtacttttcctattttccataacaagcctgcattgactttgataagctcttcctccatccattctctcagctctccaaaagaaggaacaaaacaaataaacaaaaacaaaaaggaactggacaagtttgttgcaaatgtgtgaataaaatgggataaagccagtggaacagttacaactcaaattctccgtagtggaataaaaagaaaggaagaaaacagcagacttcccaagaagatttcaggagacgtgaatgaaatatggggaaggcacagtcctaacttggagctggggaagtctacaagaagctgagtaagaccttgccttgaaaagaaagacaggcaactggccagcgggaaggtgcagcattgaagtacaagtgggacacagcactatggagtaggttttcctgccaacattcgggaaccaaggactgtacccagctcccacagttagtctgtccagctttcacagtggctcctacttatcattctggttccagctcagatttttttttttctggccacctcaggctaccgccctccacctctgtcactccccatcccataccccatttaacttctccagactatttgtcactatctgaactcatggtacttatttgccatctggttcactgtacaatgtccttctttagactctaagttccatgaaagcaaggatcatgttgctacgtttactgctttaccccgagagactggcacatggtaggttcccaattaatatttggttaatgaataccccacagataggcgagaattccataaacaggcaagaattcaaatatttgctgaattattcatataccatgattttcttgaacaaattttattaatagagaagtcacttatgaatctagatgttgatagaaactcatcgtaaaagcagtatagtcacatactgaagagcaatgttttggtcagcaacagaccacgcatgatagtggccccataagattatactgctttatttttgctataccttctctatgttcattcagatacacaaacatttccattgtgttacaactgcctgcagtattcagtacagtcacatgctgtaggtttgcagcctaggagcaacaggccatactgtacagcctaggtgtgtagttggctacaccatctaggtttgtgtaagcacacactatgatgttcacatgacaaggaaatcacctaatgatgagtttgttattaacagaatgtatcaccatcattaagcagggcatgactatagctttttctgcaggaatagaacttttttttggtgaggggatgacatggttaagctttgtgtccccatcaaatctcatcttgacttgtaatccccataatccccacgtgtcaagggagacctggtggagataactgaatcatgggggtggttcccccaggctgttctcaacttgttctcatgaaaatgagtgagtcctcaccagatctgatggttttataaggggctcttccccacttttcttgacacttcttcctgctgccttgcgaagaaggtgccttgtttcccctttgccttccaccacgactgtaagtttcctgagttctccccagccatgctgaactgtgagtcaattaaaccttttttctttataaattacccagtctcaggcagttctttatagtggtacgaaaacggactgacacagtaaattggtaccacagagagtgaggtgctactataaagatacccaaaaatgtgaaagtgactttgaaactgggtaacaggcagaggttggaacagtatggagggctcagaagaaaacaggaagatgtgggaaagtttggaacttcccagagactcattgaatgcttttgaacaaaattctgatagtgatatggacaatgaagtccaggctgaggtagtctcagatggagatgaggaacttatttggaactggaacaaaggtgactcttgttatgctttagcaaagagaccggcagcattttgcccctgccctagagatctgtgcaactttgaacttgagagagatgatttggggtggaagaaatttctaggtagcaaagcattcagggagtgacttgggtgctctaaaaagcactcagttttatgcattcactaatagatggtttggaattgggacttatgtttaaaagggaagcagaacataaaagtttggaaaatgtgcagcctgatgatgcaatagaaaagaaaagcccattttctgaggagaaattcaagccctggctgcagaaatttgcataaataatgaagagccaaacgttaatcaccaagacaatgggaaaaatgtctccagggcctgtcagaggtcttcacagcaggccctctcgccacaggcctggaggcctaggaagaaaaaactgtttcaggggttgggcccagggccttgctgctttgtgcactctggggacatggtgccctgcgtcctagccatggctaaaaggtgccaacatatagctctggctgttgtttcagacagtgcaagccccaagctttggtgacctacatgtggtattgggcccacgggtgcacataaatcaaaaactgaggtttgggaacctccacctagatttcagaggatgtatggaaatggcaggatgtccaggcagaaatttgctacaggggcagagccctcatggagaacctctgctagagtgattaagggaatgtggggtcagacacctccacacagagtccccactggggcattgcctagtggagctgtaagaatagggccatcatcctctagcccccagaatggtagatccaccgacagcttgcaccatgcacctggaaaagccgcagacactcaacaccagcctgtgaaaacagctgggaagaggactgtgccctgcagaagcacaggggtagggctgcccaaggccttgggagcccacctcttgtatcagtgtgacctggacgtggatagagtcaaaggagatcatttcaaagctttaagatttgactgccccactggattttggacttgcatgggtcctgtagccccatagttccaatttctcccatttggaatgggaacatttacccaatgcctatacccccattgtgtcttggaagtaacttgttttttattttacagggtcataggtggaagggacttgccttgtctcaggtgagacttcagtcttggactttttggttaatgctggaatgaattatgactttggggaactgttgggaaggcatgattggttttgaaatgtaaaagggacatgagatttgggagggtcctggggcagaatgatatgattaggctttgtgtccccatccaaatctcatcttgaattgtaatccccataatccccacaatcctcatatgtcaacggagaaaccaggtggaggtaattgaatcatgggagcagtttcccccatgctgttcttgtgacagtgagttctcatgagatctaatggttttataagaggctctttccccttcactcagcacttctccttcctgctgccttgtgaagaaggtgtcttgcttcccctttgccttttgacatgattgtaagtttcctgaggcctccacagccttctgaactgtgagtcaattaaacttctttcctttacagagtacccagtcttgggcatttctttatagtggtaagaaaatggactaatacaggggagataaaaatatttggtgtatataaaggagcatactcatatattacttggcggaattataaagtagtacaatatctttgaatggcttttgactcaacatttttatttttaggaatttatcctaaatttatcctaggaatttatctgacatgagataaaatttaagcacaaatgtttcttaaagcaagagtgatatagcaaattaggagcaatatttatgtccatatgaggaaaatggttaaataaaggatgatacactgattcatgtactggagtacaatgtttccattaagaattatgcttctgagactatttaaaaaaatagaagaaatatcttgatataatggcaagtggaaaaaaaaacaggcagtaaaactgtaaatgtggtataatcccaattatatagaaaaaataaagacccaaagaaagtatattaaaaagctaatagctctgggtcatggaattataggtcatttaaaaactatctctttgtatttccaaatttcctacaattaactcattatttatatgatgagaaaagaatgtgttgcacattaacaaaaaaaaaaaactttaaagaccacctttcctttacactactcatttttaggaactgaaaattcaggagttcgttcctttgccaggttttcaataaagaggaagagaaaggccaccaaatagtttgcttcttaagttgacatagttgtaacagtagtttaaaaactgaaatatttaaaaattcttaatttaaatattatatgtattgactgttaaaaaataaaaaagcctaacagttagcttaaataaaaccacttgaatgtctatgatctctgatatcttgtgtttgcctaaagactgtgatgagaacacgagtgatgttgatggtaaatggactccctgaggtggagtcagctcactcattggctggatgatgagaccccttagagcagaaagggacagagaggcaatcagcccatgctgcagaaatgtaagaacaccttccactgcatccccagtaaaaatatttttaacccaaaattaatctggaaaacattttcaaaataaattactcctttaaaatgtagagtggaaattatgtaagtgaaaatgacaagtatttctgagttgtaatgttaaactgttgaactggatgtccacatgcaaaaaaaaaattatcttcaatccatagctcataccacacacaaaaattcaaagtagatcatcagacctgatataaaacctaaaactataaaactttcaaaagaatatgtagagaaaactctttgtaagttgggcaaagatttcttagatataacactaaaagcataatccataaatgcaaaatggataaactcgagttctaatacttctgctctttgaaagataccattgagaatacaaacacaagccacaaactgaaagaaaatatttgtaaaacatgtatctgataaaggattccatccaaaatatattagaagctctcaaaactcagtaagaataagaagaagaaacaatcaactcaaataaaaactgggcaaaagatatggcaaataagcacatgaaaagatgctcaaaagcattagtcattaaggaaatgaaatttaaaacacagtgagattctagtgaacatctattagaatggctaaaattaaaaagacggactatagtgttggtgaggatatggaggaactgaactctcaaacactacaggtggaatcaaaaattacacaaccactttggaaaagtttggcagtttattaaaaagttacacatacacctacatgacctagccagtctatcctaagtatctgtccttggacatgaaagcatccatgtatacatagacttgtacgtgcatgttcatagttgctttatttgtaatagtcaaaaactgaaaataacacagatgtccatcaacaagtaaatgaatgaacaaatggtggcatcctgatacaatagattactactcaatgacaaggaatgaacgattgatacatgccacaacacagatgaatcacaaaataattatgctgagtgaaagcagtcaaaccaaaaccaaactaaatccaagcacatactgtatgactccatttatataaggccatatgatacaaactaatctatcatgacagaaagcagatcagcagttcctatgcgatggggatgggaaagaagggattacaaatgtttgaggtggtagatatattccttttattgattgtgatagaatcataggtatatacatatcaaagcttatcaaattatgcactttaaatatgtgcaatttatggtatgttaatcataccttaatacagctattaaaaaattaacgtgttcagcttacgttaaactttttttttttttttttgctctgtcgcccaggttggaatgcatgggcacagtctcggctcactgcagcctctaccacctggactcaagtgatcctcccacctcaacctcccaagtagctgggactataggcacgcaccaccacacctggctaatttttgtattttttttgtagagacagggtttcgccatgctgcccaggctggtctcaaatccctgagctcaagcaactggcccaccttggcttcccaaagtgttgtgattacaggcgtgagccaccgcgcccagccttgttaaactttttaggttacagaaactgatggctccaagttcttctgttacgtgataaaattcgacttcttcttgccctcatttagtccagagaggactggtggggtgtgggggtggggtcaccgagctcagagcatcaagaggccaaccttgaggataagggtctaggtgtgaaggatgctggaccccacccagcaccctgctcatgctgcccaggacagggtgaacacaggttttcctgcctctctgcctgctgggagttttgtatggttccttcctatccacccctcctgggactgcctaccctgcactcacctcttcttcctcattctctgactgcccgaacttcagccggagactctcttcaaactcctgatctgtccagtagaagaggacctctgcgccctcagtggccaccaagacgcacttcatctgccagggaaaggcaaggtcaaggtcagcctccagccccaacatctatgagctcagtctgagtaacgaagaggaccccaacctcagcaaacattcagtgagccccttctgcacaccaggcatcacaagggacttccatttttgttgcaccctcacaactggacaaagtagaactcttcaggtacccccattttagagagcaggacacaggcacagcctgaagtggcaaagctgggatctggacccagacctgtttgatgccaaggctggggccctttcctctgtggtatctggtccctctcagcacagcaacagacccaccacggggcctactggaaccagactggcacaggaagggacccaggtcttggcctagacatggagccgaatgcccagggaggccatgctcacggcagccagttagtgcctggtgtggatcggagggcactggtgcacctccatctctgggcagtccagagatatctctccctcagataaaaacagttccagggctgggcgcggtggctcacgcctgtaatcccagcactttgggaggccaaggggggtggatcacctgaagtcaggagttcgagaccagcctggccaacatggtgaaaccccgtctctactaaaaatacaaaaattagccaggcatggtggcaagtgcctgttatcccagctactcgggataactgctgaggcaggagaattgcttgaacccgggaggcagaggttgcagtgagccgagattacaccactgcactccagcctgggtgacagagcgagactctgtctgaaaaaacaaacaaacaaacaaacaaacaaacaaaaaacagctccagaagatgagcctcaaagcccctgaatttacttcagcaccacagaagtttcattcaaatgctgctctccctgttcatggtgagaacagaggctgcctaaagcccctgtacctagtaggctgcagcttctagggccacagccaccagtgtcttcagccctcccaaatctccttccccacccccccgccacacacacacacaccacacactctgtgcttgattatgtaagaaatgtcttaactattcacccactggaagatctttaatacagcttcccacactgtgtgccatggccctctgcgtgcggcaaaccctcgatcttctaaaacttggggcagcctgaccaggctggtgaggacagtgctccaggctggctgctgcagctaagaggcctcaggcagtggtttcaaatcctcttatgtgcctcagggtgtcacgcagatataatcatgtggtatgtgcgctaagccatgacaatgattaggaagctctgctgtaactctcacacaagtggatttccagttttcttgggaggatcacagcatctccaggtcttgtgttccgtcatccccatgtccagcttagtggtccttactgaattcctcccaaactaacttggtgcaactggtcccaaggtatttatggcaaatgccaggagacataacagcacagtgaagaaggaatgcagcctattcccacagaattactcaatgccaaggcagacactgagagtgcaacaggtgtgaaaaggaggttgctgggagaggcgggtggacctgaagaggctgctctgggactcccaggtacatgtgacaaagctgaccagagtgtatgggttagggagcagtgggctatggaatggaggctgtggttgtgagcggagaagtgaccggctggctggagatgggcaggtcaaggtcatgaaggcggtcatctaggtgcgggtgtcaggtaatgagtgctcaccccttggtgggggctgggaggagctttaaagatgcagcaggctgtgatgacctgcctggattcgaggggtgaaggagagatgaggcatcaggatgggggtggcctcaggatgcagggctggggaggggatgagcaggtgtgcagagcccagtagcactcagtccactgcctacctcattccatctgcctcccaaagccccagggtggatgctgcctgcctccctgtcctccccaggtggggcaagatcatctaccttggcaagcacagtggagcatccagacggccagaggttcagaaagggctgcagcagaccgactcggtgactggctcatgggagagcagcacagcatccctggtcctgcaaatgcttaaaacagagagaatatgagggcaggcagatgccctggtcttgactgctgcccgttgagaaaggacaagctggagaagggctgcgtggtccctggtctctccaggccctgaggcagtctgctaagaacatatctgggatcctgcccctcacctcccataatggagaataggaacccggccagcacagccctttgcacagagcaggtgcccacttttgttccttcctcctttgttcccatgaagtgctctcacttctgcgggtcactcagagctccccaagcagccccagggagcttgctaggagtgactgacgggagacagcatagcacatcccaggtggtgaggatgcagtcccggtgaagggagtggggatcctgggatgatacgatgaatggaaggaaactaacaggaaaggcatctgggaccaggttctagttttggctttgccaagtcccataaacctctctgagcctcaaactcctgcggagaaacagagcaacatcccctactctacctccctacagggttagatcatgggagtgaccaggcaagctgcaaagtaaccttagcaaactgcgttcttacataggtgtggggatcattattcctatttcccagcttcccttcttcaaataacaggattaatcaatctggttccggaatcattcatatttgaatagagggcaggaacaacagaaaacttaattaggaagtcaagcactgtgagccagtaagaggcaagtgactacccgccacagagactgctgttacgagttcggcctttagcagccgaaccctgagacgggctccatcacccacatgattggcccgaatgccatattcccgaaacagggggatgcttcccaaaggctgctgggaagagaacctcgccggtgtcacactgagacttccgcttcacctcgctatcttgccctagaaagggaactcggaggggactcactgacgaaaggagctccagatggcggggggccaacctggggcgacccccagcgcccactttcaccatctggaccccagcaaacctccctgtggcccttggtcccgtcttcagcagctccttctggggtcccacaccttcggagcccggccctgcccctgagtctctggagagagcgagtcagcagttcgccgccgcggggctcccgtttgcctagcacgccagtttctgtccagtttcaccccaaatccccacctccccccacccccgaacctcacggccaccctgggaaggaggcttgacttgtgacatccacccctcttcacggctgaggaactttggccccgagcgaggaagcgaccggcccacggccacacgcccggagtgggtgaggctaggagtgggcccgctccgggacccctagggaccctacctcacttccgggagggttgaaggggggctccggagggaggatcgccgcccccagaggggacagcccggaggcccacgtaccggatcgcggcgcgcacagcgccccgcctgcaggagcccgggcgcgcttccgggtaggaccgcgtgatcgcgcacgtgaccgcccgccccgggaggggccggagccgccgtcgccttccgcgggttcgagccccgcccctgccaggccttgcccatgccccattttacagaagaggaaacggaggcgcagagagaagaaataacttgctgagggtccgaaccaggctcagaacccaggtttcctggctcctcagctgatcccttctctcctccccatgccccggaacctcaggctttgcctaatgaactgaagttctggggctagagctgtccttttgtgactgctctccctgacctttggggaggtgacatagcgcacagaagggctcagttgcccccagagtgccaacgctggaatttataggagttctcaatctattttgggagtggagtgcacattaggagttttgtgttgaacctatgtttgcaatatttattttaaaaaatcgtatgtgtattgggggtgcctggaagtggagggggcgctctggaagggcctaaatccccgaacagtccacccctcagtgcctgggtgccacctgggagctttgagcccagcccagcaaggtatgggttgcaagaactggctggggatatagtagattgagcatctcttgggggaaaggcagaggctaagaatcaatacttccaccacctgcagatcaaagagagcatcactccccccaacccactacccaccccttccagcccaccttagggcaaattcttccaactccccatctacagcacatagccctgccacacgcatctctttgctcagcccaccgttgagatcgttcactcactatgctttcagtggtcgaatgaattccatcaaatggatatgctgttatttacttattcattcccctactggtaatttccatttcccaactgcaatgtatgaggattctgatttctccacatcctcaccaatgcttgttattgttgatttttttttttttaagtatagtaacccagcgtggagtggtgtcttgtgattttatttgcacttccctgacgttcggcatcttttcatgtgctttttgcctatttgtgtaccttctctggagaaatgtctattcaaatcctttatccatttttaaattgtctttattattgagttgtaagagttctttatatgctctggttacaagccccttatcagatacttgatttgcaaaagtttttttcccattatgtggcttgtcttttcactttcttagtggtatcatttgtagcaccaaagttttacatttttatgtaatccaatataatctattttttagttatgtacgggttttttgtgtcaacatgtttctttttttcaaatttgtttgtggtaaaatacatataatgtaaaattgatcattaagcattttaagtgtattgttcagtggtattaactacattcctaatgctatgcagccatcaccaccatccatctccacagctcttttcatcttttaaaactgaaactatatccattaagcaataatgctggccgggtgtggtggctcacacctgtaatcccaacactttgggaggtcaaggcgggcggatcacaaagtcaggagtttgaggtcaccctagccaacatggtgaaaccctgtctctactaaaaatacaaaattagcagggtgtggtggcacacagctgtagtcccagtgactcaggaggctgagtcaggagaattgctggtaccaaggaggcagaggttgcagtgagccaagatcatgccactgcactccagcctgggcaacggagcgagactcccatctcaaaaacaacaacaaaaacaacaacaacaacaattcttcattcctcctcatagcaaccacaatgttactttctgtctctatgaatttgactactctaagtacctcatataagtagaatcatacagtatttgtctttttatgactggcttatttcacttagcataatattctcaaggtgcattcatgttgtagcatatgtgagaattccttccttttttctttatttttaagcctaaataatactctatagtctgtatatactacattttgcttatccatttatctgctgatggacaattgggttacatccattgtgaataaggccattatgaacatgagtgtacaaatatctctttgagactctgctttcaattcttttgggcatatacccagaagagaaactgctagatcatatggtaattctatttttaattttttaaggaactaccatactgttttccacagcagctgcatcattttacattcccaacctggaacaagtgttccagtttacccacatctttgtcaacacttgctattttctattttctttaaaatttttatagtagccatcctaatgggtgtgaggtagttcaacataagtttatatttctcttaggtaaatatctactcatgggattgctgggctgtatggtaagtctgtgtttaaatttatattaaactgctgaaccattttccaaagtggatgtaccattttacattccttctagcaacactgagaggtgtaattgctctgtagtcttgttagcacttgatattgtcctattttaactttagccattctagtaggtatgtggtagtatgttaagtgttcaaattttgcctatttaaaaattggattgtttgtcttattatttatttatgtgtttgaattcaagccctttattatatttttttttcccagtctgtggctttgtcttttcattttctttacagtgacttttgaagagcagaaatctttgtgcattttgtgtcctatgtaaagtctctgcttagccagggtcacagagattttctcctgttttttcttttttgcagaaatttaatagtcgtagattttgtctttaggttcacaatccattttgagttaatttttgtgtgtgatgtgaaagaaggttgaggttttagtcttttgtgtgtgtgtgtgtgtgtgtgtgtgtgtgtgttttgtatatagatgtccaatttttctagaaccatttgttgaaaaaaaatattttctcagccaggcgtggtggctcatgcctgtaatcccagcactttgggaggctcaggagggcagatcatctgaggtcaggaattggagactagcctggccaacatggtgaaaccccatttctagtaaaaatacaaaaaaataaattagctgggcgtggtggcatgcacctgtaatcccagctactcaggaggctgaggcaggagaatcgcttgaacccaggaggcagaggttgcagtgagccaagatcgtgccattgcactccggcttgggcaacaggagtgaaactccatctcaaataaataaatcaatcaatcttttctccattggattaattatcatggcacgttgtctcaaatcagttgaccatctgtgtgtgaatctatttttggagtctatgttcaataaatttaaaaggagtttattgattttcttagaggcagtttttggttgaatcaatttttattgatcctgtttttaaattcatcagtttctgttctgatagttactatttcgtgtcttctgtttactttgggtttttttttcttctagaaacagaggccactgatttgagaccttttgtcttttctaatggagttgagtgctgtagatcttccccaaggtcctgctttatcagcatcccacaactttttatctgccatgttttcattttcaattactttaaaatgctaatttttcttttgatttatttagagtatagttcagaggtcagccagatatttgagtgtactttgtaccagctttttaagtttctcccacctgttccctttccctctccattcaattttcagctgctctggcagtcttgaacaccaatgtcactccacggtctaatataatagctgcttgctgatggaccttgctctttgttgtgaactaggggaattccttcaggagaaaagccaaataaatgtggatatcacccagtgtgattttcttcattcaagagctatatctcctgcagtttctgcctgctcttagctgttctgcattgccttcaaagaattgttttttcaaattttgtctaaggttcgtaattgttattggcaaaagggtcagtctgatacaactgtaacattaccagaaattggaagttctttctgcatatttttatatgtagtcttttccatttagtttaaaatattttctttttattgtgatttctgatttttttctcatggaatattaagaagtgtgtttcttaattttcaagcacagggagattttctagttttctatctctctatctatctatctatctatctatctatctatctatctatcatctatctataatttccacttatattccactgctgtcagaaatacattgtatgttattattctttgaagttttttgaaactttatgtcacagtatataaccacgttttataaatatttcgatgtgttgttgaaaaaggactttattcatttgttgttgtaatgttctccatatatcatttagataaaatgttaattgtattgtttaaatcttttctattctttctgatttttgtctgccttttctctcattttctgagagaaatagcagttaaaaatctattataattgcaaatttttctatttctccttttatttctgttagatttttgcttcacatataggagatgtcattaggtacatgcagatttataattatatatcttactgttaaatcaaaactttcatctttatgaaatgtccctatcactagcaatgctttttggttttacaaaagcatttattgtctcatataaacataaggacatcaccttttgttgcatggcatatctttttcttactccttttaatttcttatattttagatatttcttttgaaatagcttttaattgaactttcttttatcttatctgacaaccttcatcttttaatcggagcatttattccatttacatttagtgccattacaaataaatttggttttaaatctattatcttgctagttgctttctgtttgtcctgttcttcattatctttgtcttctttcttgctttctgttagatgaagcgtttttgttatgattccactgcctctccattcacttaaagaatatactcttttaagtattctttcagtggttaccatagagactaaaacatgcatccttgacttatcaaagtttaatgtaaattagtagttttacctctttcttgaaaatgtaaggatgttaatatatcttccatttaccagctttcaatatgtatggtattattgtaatgcatttttaattatttacctattttaaattgcaagagacattgttattattagattatatttatttagagtttcccacataattacccttcacgttgctttttattctttcctgcatctctcattgcattattttgattgttcattctttctctccctgtctgtcttcatctttcctttcactgtctcctccaattttctcagcctcccaccacccatgcacttgtagacatagttgagttccaagacattaggtgcatacgtggtgaaattctactataatacatttcagttgctgctggagcaaccccacgtacttgtcttaaagttcaatttaactaatttctcctatgtgaggtcaatcttttccttttaaaaacctaacaaggtgggtatgccttggggcatgcttagtctgcattaaatatgcactaaatcacggcttggaagaaactggggtggcaagagtcaagtaattaactcaaaaataaaatcaggacactatccctgagggtgagaggatcttcaaaacgtgttatctgtgttgaatttcatgtgcatgcattctagaaggcacgttgcatttaggtagaaatagcaacaatttaaagctaactttgaaacttctcaaaaggatgttatctaatatataagctaacatgaggaggaaatagaaaaacaatagcacttggaccagagaccatctgacataacatcagacaacagggagtttcaggtaaacttagatttcacttaaatccaaagtcctcattttatagatgagaacactgaggtccagagaggctgagtgacttgtcttctgaggtggataaaatcagtggaatagcctgttgtgatctccaggtgtgactgttcattgggtctagagttggcctctatgattctctagttaccttttaacccactttgctatttgaggtttcaaattatatttttgatgtttctggtacagggggcagcatcttctactatgtgcatctacattggatggcagtggagcaacacagattgttttctgacaaaaatcagccaagtactaggagaggcaggactttagaagtggaggagatggagaaggaagcttaggttactatggagtgtgcaaaaaggtcctgtggatttagataccaccacacacaaatggtatgtaatactcacttgaagacaaatcagccagagggatctaacagcattgacccattctctggtcttctagcatccatcatagttttgtgctccttttccatgaaacacagctgttgttggaaggtacctgcccagataaggactgcatttcctctagcatccagatgggaccaaatgactgctggccaatagaagtgagtggaaaggactgactccagttccaggttgggcctccaactgctctgggcacgtcgatggaacagaacaccacctccaccccaataccaccaattcaactttacatgaattataagcgagaaataacttggactgtgttaagtcattgagtttctggggtttaactgttattatagttaagaatgactttaactaatatagtcaatgacatctaactggagttatgaaattcaatttctacttagagtaattgaagcaaaggttgtgggggaggggaggagggcagcacaccatgaaatcagagatccccagtacgtgttagttcatcagtcaatcagtcttaaggtcagggtgtagtgtgggcagcagttgcctccctctccccacagaacaccctgagaataggaagttagagtagtcgcatcttattacttacaaaacattacctcaaaatgcaaactaccccctggacccaaactctctacaatcaccaggttccataaactataatctactctgttttctggaagaaaatattaacctgttaaaattccctgcacagagaggaaactttttctgggaggtattcctgaactcattttgccaacttccagatgaacaaaactaaagtttctttttgcttcttccaaaaacataaattatcaaataacatttataacttgaaaaagaatcctagaatattttcatgaataataattagaagagtaatgttcacatgggaagggcgtcttttctctgctgtgtgcataggaccctgggaccctgggatttaagtcatatggaacttggtcaactcctccaaaatgctcccagcgctcacaggggctgccttggtgtttggaaggaggtggtgccaaagcagttggtttgctggattttgactttctttttttaaagtggtatttgcaaatactaccccgagggcaatggttaatggatttgacctttgggtcatgggggccagggagcagcactcatagaagctgtgtgtgtgtgtgttgcggggcgggggcgggctgctgactggctctgccactcacctctcaggccttaggaatactgaagattctcacctacgattggtggcgatggtgggagtggtccttaaaactgctttatagaaaatcatagtggaggccaggcgccgtggctcatgcctgtaatcccagcacttcgggaggccgagatgggcggaccacgaggtcaggagatcaagaccatcctggctaacacggtgaaaccccgtctctactaaaaatacaaaaaaattagccgggtgtggtggctgacgcctgtagtcccagctactctgaaggctgaggcaggagaatggcgtgaacccaggaggcggagcttgcagtgagccgagatcgtgccactgcactccaacctgggcgacagaaggagactccgtctcaaaaaaaaaaaaaaaagaaagaaaaagaaaaaagaaaatcatagcggaacagaccaggatgaccactgatcggccaaggtgaacctggactcaaagttctacagcaaaggctgtccacaacactacttactactcactactcacaagagcttctagttggcatcctcaaaccagagagcagttgtactgggggtaaggcactgctagggttctctgtaggacacacatgagatgttaaggaatctagctgtgggcaatacagagatgagaaataggtggctacaatcagtcaggtgagaggtagcacagtgtagggatagcaggctttgaaatttttaacagacctgggttcaactcctagttttgccacactgtttttctgggtggtcttgaacaagttctttctctaatcctccccatctataattgggtctgaacacttaccataccacccagcactgctgtgagcattcaataaaatagcacgtctgataagaagaaggcacttgatcaaggaagggcagccacagaagccttcgtgccatggttagtggaactcagagagaagggttctgtatgtcccagttgtttgggccttataataataataaaattcattttagcactatctctctttggagtacttcttatctgcttttcaatcctggtatatcctaagaaaagattacaaacaattctaaaatggaaacttcacttcaatacagcagatttccctgggctcctggctgggcacagagtggctggcagaggggagtctgtggacgtggagagtaagttggtggaaacgagcactcagcaggggccaggctggggcagttgtgccgatgctggagagaggagaagtggaggaagccatgctaggtaaagtttatgccctttcttctcttgccttttccaagccacagcactattaattttggttgctctattgatatttcaaaatgttagtcttcccttccccttgtgtttttatcgtcagagggatccacctggttcacctttgcttctgcagagactcaacactgcccttttgttttcaaacataaagctactctcaatggatttccaaggtgaatcctgcagctgcatccatcccagacactggggccttgagtgcctgtggagcacacctgcagatgctgggcctcgccatgaccaccagaggctaagtggttagcacacgagtcctcactgccagggggccacagagactcccagtgctgacagcaggtgggagcctcttcaggcagcatccaccagcaacctctgccctgctggagagtgcaaggctttgagcccacctgcctagggaccgcccgcctgctggggaagggtcaggctgcagagggccactaggcttttgggaattgagcttctgggagccccaggccttagtctcactgtagcccagttctggtattttcaaacttttctccagcagagataatgctaataatcccacagctgcagcattgttcagggcactagaagaattgggactttctctccaaataacaatgagtatttcttctgagcctttgtgataagaaatgagaaagaagatcattcctagaggcagaagcagaaaaccagctcaacaataggcagaaacttttcattatacattattagtctttcaaatgagcatttctgccagcccattctaggtttaaaataaagtggcttttaagtctcagattattatggccacatcttgttttaggaaggaaatatctgatctggggcagctgcccgaccagctcttctgtgcttttgtccctgctcccagctggcaacctgctcccttgaagtgcattgtgatgctgcattttgccacaggctgtctttttgcgggtgagtgtgataggggaatccctatgacaagcaacccccacccc

SEQ ID NO: 287 - DNA, 24441 bp, Homo sapiens
cccttgtcctgggtaggcccctgcctgcccctctctgccttttcctcgggtgtccctcctcgagcccctgtggcattggcttgggtggcagagcccacttgtttcagggaccccaggaggtgccccctggctcccaggactgtgtgtgggtccggggggtgggggggtggggagaagggtcgggcagggggtgcaggggaggaaactcctcaccaggagagccaaagacagggttgtgccttaccccaggagccacccctgtaccccccttgccctgccattcaccctccacccctacccctgggcggcctgctgctttttccttctcttcctcccctgccctgagctgcatggttcccccaccctgggcagccaggaaggaatctgaatggagaatcaccaaccaccagagaaaaaagactgtggggccctcccctgccaactccccttccctggccgcccactcaacccacacctctttcacgcaggacaggctgcccaccctgtccacgtgaagtgccaacgccctccccaccctgggccgagcccccacccctccctgggcccccaagtgagattgcacatttaactactgtaaggagaggagcggcgttggcaaatgtgaaccatgagaatatcagtgatactgatgagaataaactaaacgcctttgtaacagccttgccgcatgctcgttacttgggggcccagggaggaacacacacctgcattgtgcccagcagacccaggttgctgactgcaaactgacagcctccgattctaacacgcatgcaagttaccccaacagatacagataacgcaacatatgagctggtcctacacacacacacacacacacaatttttttttctttttttttttttgagatggaatttcactctgtcgcccaggctagagtggcgcgatctcggctcactgcaacctctgcttcctgggttcaagccattctgccttagcccccccaaatagtggggattgcaggcacccaccaccatgcccggctaatttttgtatttttagtagagacagggtttcaccatgttggtcaggctgggctcgaactcctgacctcaggtgatccacccgccttggcctccccaagtgctgggattacaggtgtgagccaccgcgcccagcattttcttttcttttttttttttgagtcggagtttcgctcttgttgccaggctgtagtgtcatggcgcgatctcggctcactgcaaccaccgcctcccaggttcaaatgattgtcctgcctcagcctcctgtgtagctgggattacaggcatgcaccaccaggttcagctaattttatatttttagtagagatggggtttctccatgttggtcaggctggtctcccaaagtgctgggattacaggcatgagccaccaccacacccagcctgaaaaaatacttttaattagctgggtgtggtggcatgcacctgtactcccagctactctggaggctgaggcaggagaatcacttcaactgggaaggtcaaggctgcagtgagctatgatggcaccactgcactccagcatgggcaagagtcagatcccatctcaataaaaaaaaaaaagggagctgtggctctgtcaattttacagcaacactggctcactcggtgcccgcctgtgccgtggctgatatgccaagccccagaaacacatcccatacacacacactccacgccgcattcagaagagcattcatgcattaaaagaacataaaagagatcggcagggcgcagtggctcatgcctgtaatcccagcacttcgggaggctgaggcagatggatcacctgaggtcaggagttcgagaccagcctggtcaacatggcaaaaccccatctttactaaaaatagaaaagttagctgggcgtggtggagtgcgcctgtaatctcagctacccaggaggctgaggcaggagaattgcttgaacctggaaggcggaggttgcagtgagccaagatcgcaccattgcactccagcctaggtgacgagcaaaacttagtctcaaaaaaaaaaaaaaaaaaacgagatcacaaaatttaaccgatattggaaatatctgggtgaacaagagggtcccaagaatatgaaaggacaaatggttctatcaagtaggaaaaaccatggatgcaccgtgggtccccatagactcaaagataacacaagattaaagtaactgggctgggcacggtggctcatgcctgtaatcccagcattttgggaggccgaggcaggtggatcacctgagatcaggagttcaagaccagcctggccaacatggcaaaaccacgtctctattaaaaatacaaaaattatctgggtgtggtggcgggtgcctgtaatcccagctactcaggaggctgagacaggaaaatcacttgaatgcgggaggtggaggttgcagtgagacgagattgcgtcactgcactccagcctgggtgatagagcaagactctatctcaaaataaataaataataacatagaagccagtcatgatggctcacacctgtaattccattactttggaaggctgagagaggaggatcagtggagcccaggagtttgagaccagcctgggcaatatagggagaccctgtctctacaaaaatgaaatagccaggcgaggtggcatgtgcctgtggtcccagctacttgggagactgaggtggaaggctgccttgagcccaggagttccaggctgcagtgagccatcattatgccactgcactccaacctgggagacagagtgagagagaccctgtctcaaacaaacaaacccaaaataggccaggcacagtgactcatgcctgtaatcccagcactttgggaggctgaaataggcggatcatttgaggtcaggagttcaaattcaagaccagcccggccaacatggcaaaaccacatctctactacaaataaaaaattagttgggtgtggtggagcattcctgtaatcacagctattcaggaggctgaggcatgagaaccgcttcaacccaggaagcagaggttgcagtgagccgagatcacgccattgcactccagcctgggcgacagagcgagactctgtctcaaaaaaatataaataaaaataaaaagatcaagagaacctaaaccattaaaaaaaagactcgcatgggtgcggtggctcctgcctgtaatcccagcactttgggaggctgaggcaggcaaatcacttgaggtcaggagtttgagaccaacctggccaacatgaggaatcccatctgtactaaaaatacaaaaattagctgggtgtggtgacacacacctgtaatccaagctacttgggaggctgaggcagaattgctggaaaccaggaggtggaggttgcagtgagcagagattgcaccactgtactccagcctgggtgacaagagtgaaactctgtctcaaaaaaaaaaaaagaaatccggaacacgcacatgtgcacacacacactggagcacttgtgcaagcagtggcttagaatgggagtcccaatcagggctcggtcacgcatttgcagtcaacacacaccacacgacacaaatacgtataaaaaaggctgacattttatttccaggttggcacgtgtataaggcacaggggcaaatggctttggggtcctggaactggaaatggagacaggtgtgtctcaggtgtccctgcctccaccaccccctaagtgcacttgagacaggaccagtggtggtggttccagcccagggtcctgaagggtcccactggctctaggggagagccatggggacagctccccaggcgggaccctctactctccagctacccaggagggaccctctcctcctagggggcgaggccagctccaaagtgcttggtggctccccaggcttaagggaccagcctgccagggagggctggggtcagagagagaatagtaagatgagaacgaggagaagcacccccactagcacggcgatggcacaccactgtcggcggtctgggaacgagaaggtcaggggtcacggggagagggtaccacctacaacctgcccccaccaggactgacccctcccctgaggggactcaccactcgtcatgtgggatactttggccaacttcctgaggaccccgtccatgcgggactgggtgtggtccatctcttgggcgaaggcatccagcatgctgccaagaacaggatggcatcagccccagatggcccagacacaccagggtggccgagagcccctggcccacccccagggtcctggcctcacatgccctgctcgtccagctcttctccaacgcggccggacatgtgcttcagaacctggatgctcccagacaccatctccagctgttgatcctgttcatccatgatcagctgcagagcgaaggggtgggagatgctgttgaaaacgaccccagaaggccaggcgctatggcttatgactgtaatcccagcactctgggaggccgagacaggcggatcacttgaggccaggagttcgagaccagcctggccaacatggtgaaaccccatctctactaaaaatataaaaattggccaggcattgtggtgggcgcctgtaatcccagctactagggaggctgaggcaggagaatcactggaacctgggaggcggaggttgcagtgagctgagatcgcgccactgcactccagcctgggcgacaaagcgaaactccatatcaacaacaacaacaacaaaaagggaccccagacctcagatcagtctgcaaggctctcccctcccaagatccaccccgctggccccaaaacctgctgtgtggcctgctgctcctcgatgtagcgagatgtggccgagactgcgctggcatccagcaggtcgctgggtgacttctgggcagctggcttgcctgcgagtatctgcaggggcacacaacataggctcagggagagaccccaactcacagcggggcctgtggggcaaatccccacggtggtaagtcaggggggcagactctggggcaggacagcctgcattccccactcaccacttactagcaaggtgacccagagaccccatcatttggcttccttgtgcctcagtttcctcatctgtaaaatgcagagagcaggatggggcatggtagctcatgcttgtaatcccagcactctgggaggtggaggtgggcagataacttgaggtcaggagctcgagaccagcctggccaacatggtgaaaccccatctctactaaaaatacaaaaattgggccgggcacagtggctcacacctgtaatcccagcactttgggaggccgaggtagatggatcacgaggtcaagagtttgagagcagcctggccaacatggtgaaatcccgtctctactaaaaatacaaaaattagccaggcttggtggcgggtgcctgtaatcccagctactagggaggctgaggcaggtcagaatcacttgaacctgggaggctgaggttgcagtgagccgagatcacaccactgcactccagcctgggtgacaggttaagaccttctctcaaaaaaaaaaaaaaaaaaaaaaattaccgggtgtggcagtgcatgcctgtaatcccagctacttgtgaggctaaggcagcagaatcgcttgaacctggggggcggtggttgcagtgagctgagatcgcaccactgcatttccagcctgggtgtcagagtgaccttgcctcaaaaaaaaaaaaaataaaataaaatgggaagagctagaatccgtgtttcctgggttgaaatgaggatttaaagaattaattgatgggggacacttacagcagtgcccaacacatagtaatgctagtaaatgtcacattttactatttgtttatttttggggggattttagctgggattacaggcacctgccaccacatccagctaatttttgtatttttactagtgatagggtttccccatgttggccaggctggtctcgaactcctgacctcaagtgatccacctgcctcagcctcccaaagtgctgggattacaggcgtgagctaccatgcctggcccaacagatgtttgtttgtttgtctgagacagagtcttgctctgtcacctaggctggagtgcagtggtgtgatctcgcctcactgcaacctccacctcccgggttcaagcaattctcctgcctcagcttcccaagtatctgagattacaggtgatcaccaccacgcctggctaatttttgtattttttgtagagacagggtttcatcatgttggccaggctggtctcgaacgcctgacctcaggtgatccacttgcctgggcctcccaaagtgctgagattttaggtgtgagccaccgtgcccggctccaacagatgtattttagagtttggacttgaattcccccaaggcagcacatctggaaggcacgtgggcactgctatgggatgacaaactgggaggagcctcagtcccccaccctccccgaccccacgtacgcttatgagggagagagaaaggctggtggttctcaacatatgaaaaatatcaacagagaacaccaagagaaaaagtggactgacagaggtggttgggagaaacacagaaacacacacacacacacacacacacacacacacacggcaggcacattacagaggaaactagcagatattaggatatgaggggggaaaatgcagatacactcagaggccaagtgcacgcacccaaataggttaggtgcatgcacagatgaaaaggcgggggcggatcacctgaggtagggagtttgagaccagcctggccaacatggggaaaccctgtctctactaaaaacacaaaaattagctgggcatggtggcacactcctgttgtcccagctacccaggaggctgaggcaggagaattgcttgaacccggaaggtggaggtttcagtgagtcaagattgcaccactgcaccccagcctgggcaacatgccaagactccatctcaaaaaaaaaaaaggaagctggccgggcgcggtggctcacgcctgtaatctcagcattttgggaggctgaagctagtggatcacaaggtcaggagatcaagaccatcctggccaacatgatgaaactccgtctctactaaaaatacaaaaattggccgggcgtggtggctcacacctgtaatcccagcactttgggaggccgaggcaggtggatcacgaggtcaagagttcaagaccagcctggccaagatgttgaagccccgtctctactagaaatacaaaatttagccacgcatggtggtgggtgcctgtaatcccagctactcgggaggctgagacagaattgcttgaacccgggaggcggaggctgcagtgagccgagatcacgtcactgcactccagcctgggcgacagagcaacactccgtctcaaaaaaaaaaaaaaaaaaaaaaattagccgggtgtggtggcatgtgcctgtattacagctactcaggaggctgaggctggagaatcgttgagcccaggaggcggaggttgcagtgagccgagactgcgccactgcactccagcctggcaacagagtgagactgcatctcaaaaaaaaaaaaaaaaaaaaaaaaaaggaagttatgtgcgatggctcacgcctgtaatcccagcactttggaaggctgaggcaggcagatcagttgatgtgaggggtttgagaccagactgaccaacatgacaaaaccctattaaaaatacaaaaattaggccaggcgcagtggctcatgcctgtaattccagcactttgggaggctgaggcaggtggatcacctgaggttgggagttcaagatcagcctgaccaacatggagaaaccccgtctctactaaaaatacaaaattagccaggcatggtggcgtatgcctataatcccagctactcgggaggctgaggcaggagaattgtttgaacccaggaggcggagattgcggtgagccgagattgcaccattgcactccagcctgggcaacaagagtgaaactccatctcaaaaaaaaaaaaaaaaaaatacagaagttaccctggcatggtgacgagcacctgtaatcccagctacttgggaggctgaggcaggagaatcgcttgaacccaggaggcagaggttgcagtgagctgagatcaagccactgcactccagcctgggcaacagaacaagactctgtctcaaagaaaaaaaaaagagtaaaaggcaggcatgcgtcctggaaacaggtgcacacaggacaaatggcatggaagcagaaaggagataggtacacaggcccccagccctctcctgcaacaggaaaccagtatagacccagaggacacagtagagaggaacccacggacatatacacatagagaggttcaggtgcacacaccgagaaagtgcaggcaggtagacagcaagaagataactgcccacagagaggacgggcactgtcgcaaaagggacaggtgaacacgcacagagggatctggcttggttacccccaggggctcaggtgggcagggtgggtcaggaaggcttacctctctgttattcctctccaaaaatgctacggctgttgggctgaccatatggtccttcatttcctggaggtaaggacagcattagggaggaaagacactcaggctgggcgcggtggctcacgcctgtaatcctagcactttgagagaccaagccgggtggatcacctgaggtcaggagttcgagaccagcctgatcaacatggtgaaaccccgtctctactaaaaacacaaaacttagccgggtatcgtggcaggcacctgtagtcccagctactcaggagactgagacacaagaatcgcttgagcctgggaggcggaggttgcagtgagccgagattgcaacactgtactccagcctgggcgacagagcgaggctctgtctcaaaaaaaaaaaaaaaaaagaaagaaagaaagaaaaaaaaacacactcaaaccttcccccactccccgcctgcaggacctttcctgacctggactgcctctcgcatccgctccacgaacacctttctctcctgcaggtccccggctgggagcttgaacttgcctgggttggcttccactatacgtgggctgagagtcaagggtcaaggccggagccagatatcatccccgtccctaggggtccagccctacccgaaggtgggctgccaccgcaatgggctctcccatgccaccctctgccacaaagccccaggatatcgatggtctcttccaggtcctcgaggtcccactcgatgctgcgcaggccattccgcagctcattggtcgtccagtccagctcctcgcgtccgaccgccgcgctttcctgcaggagctcgcaccagcgctggtacagcccgcgggccgtgttcaccgccttctgcacctcgctgcgggcaggggcacggcgggcgcggctgggggcaggcggtcctcccgcctgcctctgcccccgactgcaaacccaaacgcatgggggactccggagacccctatatacccctgcgtgcgcctcccactctgcaccccgacggccttgcccagcccgccgggcacgctggggccggcacccgggcactggctggcttgggtacagagcaccctccgccctcccccgtcgttgtcactcaccctcggactacaaaaaaggggtcttcgagagacatgtcagtcccttcccccccaggccgaacccccctcccggcctgggttcgcgggctggttccctcccaaccgaggagaacgcgccgccacccccgcccccgtcacgccaccatcgagagccggaccgccaggggagaaagagaagcctcggaggcccgacgtgcggacacttccgccctctcctcagccatcttggttgtgggcagaggcagcttccggtgcacatgcccccgccccttagccctctcgtgccgcaccgtagggggcggtgtcggagttctgtctgggcctattcgggtccgagttcggaatttcggttcaaggcccagttcctcggattgttcctgcgcaacttcagtttcccttccaggcacgggcaatgtaaataatgatagcctccctcatctctggcggctgggtattatggctggggaaggggctcattcgattcgttgaagcttttcatggactccctgagctggcacctgggagatcgtcccatcccagggtcccgagtgtcaggtttggctagggtctgggggagaggtggtcctcccttctccctgcgggggcgcggtgaggagcgggcctgctcctccggggagttctgccgcattctcccaatctctttcctgagaagtggcggagttgggggcacttcgaggtcgccttggggcgaggtggtcgtgagggggtcccagatatgccagcagcggggggaggtcacctttgagaaagtgcgtggaggtgggtttcttcagaagcgcggagtctttctgggtgcgagcctgggggtagcgggtggtggctttgaggatggtctccaggggggccctctgtgtgtggggtctccgtctgggtaggggccaggaatatcagcggagggactcagggtcgtccctatgtgtgacagtggcgctgtgtgttggggagcttcgggaaagcactttttttgagtgatagggggcctggtctcccctggagggtgggcgggttatctgagggagtcctcggagggtcgcccccttgcgcgtcagagttgctgcgtggggtctcagagatagcgcctgggctggggaaatcattgtggggtctccgtggtaaggttagcggggtggggacggcctgcgtcttcggcaggtcgtcgcagtctggcaccatcgttgaatggggacgagtttgggaagggtattttaggggggaataacttttgagttcccagcgtgcgggggaagggcgggacgggagggtgtcccaaggcctgagaagatcagtgtggggcaggggtcaggaataacctgggagggggccttgtatgggggaaataattgggaagaggagagatgggatgaagggggcctcagcgggtcgtctcctgtgtatgcagggtcgttctgcagcgtctctgggagatggcgtccctgggagccctcaggtcgcccctacccgctgcggggtgctttcctggcgtcacgccttcctggcccctggagggaaggaagtgaaactctcctcttcccccacccggctggaatgcgagtcaggaagcctggggctccagcctgctccggctgcccgggtcggggatggggaggggcgtggccggagcgcaaagccccgcccctccgcgccccccccccggaagccccgccgccggccgctaaggcgatcacgggccctgtcctaatatgggcaaccggaagcggcccgcgcgactgccctacgtcactccgtccaaatttagttgtggaagtcagcgggcgctggtggcgggaaggcgccgcgagccagtgcgggcggaaagggggcggggggcgcaccaccccttaaagggcccgcaccaggaatgaatggagccattcgaacaattctgcatcctatttttggaggaagtggaattagtatttcttggagagacggcgcgtagcggagggtagggcggagattttctatctgctctgtctctgcattgctgggtttccagctcccaacctaaccccgcctccccgaacgcggagacggaactcggcccccttgtttggggggcggcagccacgtgttcacggggactgtcgtgcgcgccgggttcgcagccgtgcgagctctgaacccacccgtggagctcctgtcgcgggaaactgcgggggaatggcttggtacgaatcacgggaacccgtagcccggggcgggtcaccgcctacaagcaagggctggcgtacgctagagaccgaagagctggaggccccagtggccccctttcacagcagtagcaaatattgtttgtttagtaaatattggcctagtgactctgccttggtttccccacttgaaggaagcagatagaacagtatcctccgaggagtggaggctggggatcggtgaattattgataaaaggagagctcttaacctagcctggcacgttgtaagcgctgttagcatgattattggtgcagaaaacactcattagacacacctggtaaatgctaagaacagtggccacaggggatgttcaggctggaaccagggtcttcccctgtgtgaagggaaacttgctgcccacgacccactggggcctccagacgggagcatgtgggtaggccgtgagctccacccccggcccccctcccttgggccaaggcgctgatgcatcggcggggctcagagaaaggagcccacccagaaagctcagcgtggagtcgggggacgctcctcctcgccagggttcccgtcccctttccctgctgggtaaatcgcattctgtctctttaaggagtgtttggccgcgacgagttggaaagcccggatgcgtccttcggttgggcggggtgtctcagtgacgtcactgggggtataaaagggcctgggtggcgggcgcctgggcagagcgtcctagcagtgtcactgcgtgggttggtttgtgtagagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctgtcgctggtcatgcgcagcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgctggactggtcccgagcaagaaagcccgtctggaagaaaaggaagaagaggagggagcgtcatccgaagtcgccgatcgcctgcagccccctccggcgcaagcggagggcgcctttcccaacctggcccgcgtcctgcagaggcgcttctccggcctcctgaactgcagccccgcggcccctccgacggcgccgcccgcgtgcgaggcaaagcccgcttgccgcccggcggacagcatgctcaacgtgctcgtgcgggccgtggtggccttctgaggaccccgagcggcgctgccggagcccagagcgcgcgtcgaaccgtcggcccgagggcgcagacctgaggcgaggccacccccctccatcctgggggaagcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcacccgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagtaaaaaagccggtgctgtctggttttctgctgtggtgggggaggggcggggttaaagcgtcaggggctggcagccgctcgctggggccccaagaaccggtctgaccggttaccacgtgggcgagagagggttgggcccccttttccttgcccgggcattccctaactggtggagccccgcctcccccagatttgggggttcccttgaaattgtcctacaactccgggacagggagatcggggctttctgagttgagacaatagtgctaaacacactgccccaagcggagctggggatcgattgcacgcactttgaagccttgaaaggtggtagatctcgcccccaccccctagaccaaactgaatcagctgtggccggggccctacagtatcaggtggagctgagcgggtgagctttgaagggctctttagtccccagttcccgtatcttcctcgaggaatcgttgtgtgtctcaggcagggacgtgcagcctcagtttcctcatctgtgaaatgggcctctaagcagcttctccacccggcattaggtttttaaaaatgcccattagagccctagttattttcttgggtcactccccagctctagaataaccaccccgaaacgagaaagccctttcaatataccccacgtaggtttaagagtggggttgtgggcgttgccccagggcgaagggagggggcctgtcgggaagacaaaggagtcgcaggtgcggggagtggtggcggcggcaggcgccgggaaagcgctcgccccgccccgccgacggctggctctgccgccgcaggcttcccatgaccccaggggaactgaccccgtggccacagggtagaaggaggggcaagccggcctcagaacgtctgctggtggaatctgggagctttggctcccctcccgcccaacccacaccccctttcctctcctgtgtggattgtgaaggagagcttctcaccgttctccagccaagctcgcccccacggctgcctgattccttcctgggaacacgtggggggacttttaaaaggcgccacctactccgagtcctgacccacccaactctcccaggggacgtgggggcactggagccccacaccgcaggcggtagctcaatgcacccgcgtcggagttcctcccccgcgagcgtggcaaggctcagggaagtcccgggcccctggggagggggccttgccgcgcatcctgtcgcaggaaccgccgggcccttccttccgcgggaagcggcttggccgacccccgcccccgcccgggcctcttgggggtttccggtgcccggccaccgtggggctggggactgaaagtgatgggactgaagatggggctggaacaaacacactacagacacatccccttaagacacacccatccccaagaccccactggacccatcagaaaaggcagcattgaaccttgtcacagcaaataacattggtgaggcctggactaattgattggacaatggctgtgaaaactaaaaaggtcacccatcctgtgaccagcaggttccagcagggaaccccaagcctgctgcaggagactccagaaaggtgtttgctgctggcttgtactaaattggcacaaactgcaaacagcacagcctacatgcccatcctcccagatgggtcctccccagaggataaaaggccggagccagacagaactacacacacaggccacacagataattcggtaccagaaacatgatgctgagtgacaaaggccagctgcagaagtcaggtaagaagcacatattctgggccgggcatggtggctcatgcctgtaatcccagcactttggaaggctgaggtgggcagctcacctgaggtcaggagttcgagaccagcctgatcaacatggtgaaaccccatctctactaaaaatacaaaaattagctaggcaaggtggcaggcgcctgtaatcccagctatccgaaggctgaggcaggagaatcacttgaactcaggaggcagaggttgcagtgagccgagatggtgtcactgcactccagcctgggctacagaggaagactctgtctcaaaaaaagaagaagaagaagaagaagaagaacatattctggagggagggaaacaaccaggtctactttcgttttcttgctatgcatccttgagtgagtcacttgacctctctgggcctgtttccccaaccgtatactggggacaataatagtccctgccttttaggtttgttgtaaggattgagattacacatgtaatccttacaacaaacctagcagagtgctggcacgtagaaaatgctaaatgtgctgggtgccatggttcatgcctgtaaccccaaaaatttaggaggctgaggtgggaggatcacttgaggccaagagttttcagtgcaatcatggctcagtgtagccatgtagcctcgaactcccagactcaagcaatcctcctacctcagcctcccaagcaggttggaccacaggctcaggcaccatgcacagctaatttcttttttttttctttctttctctttttctttcttttctttcttccttccttctttcctttttctttctttcttttctttccctccctccttcccttcctttcttcctttctttcctttctttctttcaactagagtctctctatcacccaggctggagtgcagtggcttgattacagttcactgcagcctcgagctcctgggctcaggcaatcctcccacctcagcctctggagtagctgggactacgccaccacacccagctaatttttcttttttttcttcttctctctcttttcttccttgtctctttcttttcttttcttttttgtttttgacagagtctcgctctgttgccaggctggaatacagtggtgcaatctcggctcactgcaaccctggcctcccggattcaagcagttcccctgcctcagcctccgaagtagctgggactacaggcgcacaccacgacacctggctaattttttttttcccaccggttgtcaaatgaccctttattgaaatatttttctttgtgcttcttaactagctgggcatttcacagcaccactgtgggtttttctggttttttggggtttttttttttgagtcggagtcttgctctgtcgctcaggctggagttcagtggcgcgatctcggctcactgcaagttccacctcccaggttcacgccattctcctgcctcagcctcctgagtagctgggactacaggcgcctgccaccacgcccggctaatttttttgtattgtatttttagtagagacggggtttcaccttgttagcaaggatggtcttgatctcctgacctcgtgatctgcctgcctcggcctcccaaagggctgggattacaggcgtgagccaccgcgcccagccatcaccactgttgatgtcatctatgatgtcacgagggtggcggccatcaacattacggcctacagactgggcagtccccaggatctctttgatggttccagagagttctctggctaaagatcggtgccacatctgtcgagtaatgttgacgatctcatcaaaagtgatattcccattgtgtctaatgtttttctgtttctttctgtctcttggtggttccttgagggctttaatgatcagggcagaggcagaaggcaccacctcaatctgggcctgtctgttctgaatggtcagtttcactgtaatcctcaggcccttccagtcaccccattgccttggcaaggtcattaccaagcttttttggagacagacccagggggccgatcttgggggctagtgcagaagtggcacccccttcaccccgagtgcacctcaggtatacaaatttgatctcgttggggttgaactttggcagcatggtggaggtgattggttttggaaaaacctggattctggacaaccgaagaaagctgcaccttgggctcctccaagccgaaagcccagctaattttttttttctttttgacacgaagtcttgctctgtcaaccaggctgcagtgcagtggtgcaatcttggctcactgcaacctccacctcctgggttcaagcaattctcctgcctcagcttcctgagtagctaggattacaggcacccgccaccatgcctggctaatttttgtatttttagtaaagacgaggtttcaccatgttggccaggctagtttcaaactcctgacctcaggtgatccacccacctcggcctcccaaagtgctgggattacaggaatgagccaccgcacctggccgaaattttttgtattttagtagagacggggttttaccatgttggccaagatggtctccatctcgacctcgtgatccgcccgcctcagcctcccaaagtgttgggattataggcatgagccaccgcgcctggctctttcttttctaacagggtcttgctctattgcctaggctggagtgcagtggcacgatcttggctcactgcaatatcttcctaacaggttcacgagattctcccacctcagcctcctgagtagctgggattgcaggtgcacaccactgcgcctggctaatttttatattttttgcagacacagggtttcaccatgttgcccaggctggtctggaactcctgagctcaagtgatctgcctgcctcagcctcccaaagtgctgggattacaggcgtgagccactgcacctggacgtatttattttttacttaggatttgtgccctaactcagaagttaattctgttaattctaccaatgtccagcctgagcctgaatgagtgaatgaggttgttttgggtaaacaggtgttacatgcttaatgtttatcatctcattaaatcagtggcttctacatgactcttagaatttctcaaacctcagatggttgaggggtcaggatatttgtgatattttcataactactgtactattattattatcatttatagacagggtcttgctatgttgcccaggctggagaacagcagcgccatcatagctcactgcagcctccactgcctaggctcaagcagtcctcccacctcagcctctgcaggagctgggaccgcaggcctgtgacaccatgcccagctaactgtattcatgtaatagttttctttgcgttaacccacttattaatcactctccctatttagaaagtaacagttttttaaaaggttacaatgaaaataaaacaatgtcaaaagatcctgctgaaacagtaacaggtttaatagtttcaaagagagattagccagccttaacgacacattgtttccaagggaagaaaactatgcttgggctgagaagggggatgcaagttgacaagggagaaatttggagagatccagtccacgttatttaaataacattgaattgggctgggcgaagtggctcacgcctgtaatctcagcactttgggaggccgaggtgggcggatcacctgaggtcaggagtttgaggccagcctagccaacatggtgaaacatcacctctaataaaaatccaaaaattagccgggcatggtggtgagtgcctgtagtcccagcgacttgggaggctgaggcaggagaattgcttgagcccgggaggcagaggatgcagtgagtcaagatcacaccacggcactccagcctgggcaacagagtgagactgtctcaaaaaaataaataaataaataaataaccttgaattattttgccacactgtcccagaatatggaaaattctgcttctggaagagggacaaactcctatgatgatctgcaaggccctgcttgatctggggccatcccatctctggatgaatcatgcatcaccctctggccacatggacctgctttttgttcctcatacttccacagccttctcagccacatggcctttggatatgccgtgacctcctgaagatctttcagcttccttgctcacctagtgaagccagctcagctcaaggggcaaatcctcagggaagtgttccctgtctaaccctcttttggcctaaggactgctttattttattttttatttttattttttgagatggagtctctctctgtcacccaggctggagtgcagtggtgcgatctcagctcactgcaacctccacctcccgggttcaagtgattctcctgcctcagcctcccgagtagctgggattacaagctcccaccatcacacctagctaatttttgtatttttagtagaaatggggtttcaccatgttgtccaggatggtctcgatctcctgatccgcccgcctcagcctcccaaagtgctgagattacaagcatgagccaccgtacctggcctattttattttattttaattaattaatctatttttgagacagggtcttgctttgtcgcccagactggagtgtagtggcatgatccaaggctcactgcagcctcaaagtctagtgcttaagggatcctcccatctcagcttccagcatagctgagaccccaggcacacaccacgatgcctggctaattttttattttttttgtagagatggaatttccatgttgcccaggctggtgttttttatttatttatttaaccagtctctgatgggaggcaagacccctatatttgacactcggatcaagagctactttatttaaaacatttggccaggcatggtggctcacgcctgtaatgccaacactttgggagaccgaggcaggaggatcacgaggtcaggagttcaagaccaacttggccaataaggtgaaaccccatctctactaaaaatacaaaaattagccaggcatggtaacacgcgcctgtagtcccagctactccagaggctgaggcaggagaatcgctggaaccttggaggagaaggtttcagtgagccgagatggcaccactgcactccagctgggcgacagagtaagactctgtctcaagaaaaataaagagaccaggcgcagtggctcacacctgtaatcccagcactttgggaagccaaggtgggcggatcacaagttcaggagctcgagaccagcctggccaatatggtgaaacctcatctctactaaaaatacaaaaattagccgggcgtggtggcaggagcctgtatcccacctcttgggaggctgaggcaggagaatcgcttgaacccgggaggcggaggttgcagtgagccaaggtcaagccacttcactttagcctgggcgacagagcaagacttcatctcaaaaaataataataaaataaatttttgcggggctgggagtggtggttcatgcctgtaatcccagcatttttggaggctgaggtgggcggatcacttgaggtcaggagtttgagaccagcctggccaacatagtgaaaccccatctctactaaaaatacaaaaattagccaggcgtggtggcgcgcacctgtagttccagctgctcggaagggtgagatgggagaatcgtttgaacccggggccggggggctgaggttgcagtgagctgagatagcgccaatgcactccagcctgggtgacagtgagactcagtctcaaaaaaaaaaaaatttttttttgttaatacttatcacaagtgcaattttacctttgtagaattaaaccgttgtttctgagttagtttcctcttgtagcctactgcctccaagtctagcagatggttaagcggtttttgtgaatgaatgatgcctttgcaaccttcgtttgagatctgtcctcttaacgtccactgtgtatatatgaggaaacaggcccacagagtttcgctctgcaagacagcaagtaaaggacagctctagtcgggtcctctatcccgaagcctcctccccactctgccctgccctgccgtgcaggacccaaaggaagggcgccccagttcagcctctgtagatctgggaaagggccgggccacaggtcgggaccaatccagaagcagcacccagaccggtttacccggttccaggaccttgggcgaagtccacccgcccgagggcagggacgacgcaggccacgccgcggcccagttgctagccaggcagggtggggatttgatcttgccaaggaaatgtgagcgggaggccgagcgttggaggtgggtaagtcgtcactatgcagggcggagccatcctgtgtctatcacgcccaagggcggtgcatgcaaattgactcccgcatttggcttttccccgggctccgtctccgcgcgctgcaacccgcgacttccaagaactccccgcgtagtcagctgcccgggccacgccccctttccggacccgccctgcccgccccagggaggcgggggcggagcttgcggcccagcgggaaggcggaggcgggggtcgcgcccaggtcccgggggcgtcagaggcaatgggaagtcgtggcttctgcaccgcccttgggggttcggctcccaatcagggaaaaagggccgagagaatgaaagagtaatgagacttgcgagtttgaggctcacactactctctttgggttgggggttgctgaagcctccacgtgtattcagggagccccgaacctcacacctctgtccaggggagctcagaacccgccgtgttctggaaagcctacaccttccccggttttttagtgtctaggggagcccacaaccctcacagccgtgtctagtagcgctcagatccacacacctgtgtttgggggagcccagatcttctctacctgtgtccagatgagttcagagccccgacgtttgtccaggaaagcccacctctgtccagaagcgctctgaccaggacctttcctgtttcctgaggctcagcctagggggtcatcccacccaggtctgtgttaaggggagcttgtgtctccccaaacatgtccaagtgagctgagctcaggagctgaggcctccccatatcgtgctccccgcctggccctttggtgaatccctttctcagaagaaaccctcaggggccctagccctgctgcccttccctgcactgtcttcgagcctcctggcccaattggcccctcccccagtacactgttgagtcttagttaagacataatcccagcattcactgtcccccatcccccagctctcccgcacctcggcggctggccgggcccccgggagtgccgtcatcccagccggctggccacccgactggcaccaattaatttcctcctcggcctgtccacccagggcctcggcctgtctggttgccagctgctcaccctcagccagcccgccccctcgggctcccagggaattgccaacagttctcctccttcctgcaacccccccacccccaatccaggccaccccacccagcacagttaatcagaaaaagctgacagttaggacctggaggagtgatctgaaatcagatggaggaggggtgggatgttaaactttcggacccagggatgcttggggtggagcgggggcatggctggagggaggcagaggatccagttttacttaagaaccccaaatcaaaggcttgtagcttccagatggggactgcagggagggctgaccccctcccgcatacaccaggcgggcaaggtggagcgcccctcctcggaaattgccccccgcccaagatgcgtcagtgacagctgtgcctcctcagcccgcacccagccggtttccttttcctgtgcacactctcccgatgggctggccttcagcctggagagactccacggccccttggaaggggctccccagagggtcttcctggacgagggggaggggacaggctgaagaacaatggggcttctgtggctgcaggacgccaggcacttcctgttaaccctttcctcggggtgcagctgcagggagcacctcccaggtcccgccttgtgggaaggggcagaggcagcctgaggggaaatcttgttgcgggaattaactgttgtgttaattgaggcttttgtgagtgtacttaggaggggtgaggtgaatcacaccttttctcacttgatggagttacagggctttctcctctattgctgagggctgtgcagt

SEQ ID NO: 288 - DNA, 70849 bp, Homo sapiens
acctctccaggtctcagccacattgataacttcattgtccatccatccatccatccatccatccatccatccatccatccatccacctgttcattcattcactaaacatttataagcatttaagtatgccatgcactctgtagattctgaggataaacacagttgttcacagctatatcacagtatctagcacagtgcctggcacatagtaagtgctcaagaaacactgattcaaggaataaatgaacaagataaagtcactgcactcaaagagctgactgtctaatagagaaaacagacacttagaattacaatatactggacacctatccaatgtgcttcgggtaaacaggaaggagcttgtctggaaggctgaagaaggctccactcaggaagtcacaggccttcaaggagagggggatttcagcaggctgagaaaaagaggcagcacacagccagcccagggaatcatgtcaacaatggcacagaactggaggagaagaaattaatttttttttttcgagacagagtctcactctgtcacctaggctggagtgcagtggtatagtcttggctcactgcaacctctgcctcccaggctcaagcgattctcctgccttagcctcctgagtagccgggattacaggcacccgctactacacccagataactttttgtatttttagtagagacagggattcactgcactggccaggctggtctcgaactcctgacctcatgatatgcccgccttggcctcccaaagtgttgggattacaggcatgagccaccgcgcctggccaaaattaatattattaatcactttccatggaccagacattttatttttgcctttacactcttagaaaggactagaatttatccaccatgaaatcttggcatgcctagactccttctgcctcttgctctcccctcctctgggtctcagctctcacttaaattattgtgatgctccccgccccccaaacccatcagtcaatagttgtgtctccctctggttcaccatccgaatggctgccagagggattgtttcaaatttcaaggctgagcctctcgttcctttgtttggaatccttcaatggctccacatctcctgaaggctgtgtttaagaccttttgtaatatgaccatgaattgcattgcatgccccacccctggcactccctaaggtatacttgtacacctccaaactttgctcccactgctctttctgccttgggtgcccatctccccttctgcctccaatttgggggctatttttactctccagaggacatttggcaatgtctggagacattttggatgtcacaactaaggggatgcttctgcaatctgctgggtaaagattaaaaattctgctaaacatcctacaatgcacagaaagtcccccacagcaaagaattatctggctcgaaatgtcagtagtgctgaggttgagaaatcctgctttgacttttcaggaatggggagcttcagaaggattctcaacagagagtgagagatttagctttggaaactctggcagctgtctgtgatggccaagaggaaggcaggactgcagaccagtgtaaatcatgacctttcttcctcttttcttcctcctcctggaaatcagtgaggtaagctggcaagagtctattgctcttcagccagaaacactaagctctgtgggcactcctcccagatggcaaatgatatctatcgcaacaagcaaagtgaatatgtcacatctcttaggtttctgggagaggtttgtttctcctgagaaagtgtgctcactcacactcaacagctatgggatcttgagagagttactttcctgtctgtgcctgttctcttgtctgtgaaatggagctaataacagtacctacttcttggagttttgtgaggattaattaatatattacaagagcctacaacagggcctggtacgtagtaagtgtggttatatgtgttagctcttaacatcatcacatcttcctccccactatcaccatcatcatcaccaccactaccaccatcaacatcatcaccgccaccatcactatcatcatcaccactgccaccactaccattatcaccacgaccatcgccatcatcaccatcaacatcatcaccaccatcatcaccatcaacaccatcaccaccaccaccatcaccatcatcaccgtcatcatcaccacccccaccatcaccatcatcaccgtcaacatcaccaccaccaccaccatcatcaccatcaacatcatcaccaccaccaccatcaacatcatcatcaccactgccaccatcaccatcaccatcaacatcatcaccaccgccaccatcaccatcatcaccgtcatcatcaccacccccaccatcaccatcatcaccatcaacatcatcaccaccaccaccatcatcaccatcaacatcatcaccaccaccaccatcatcaccatcaacatcaccaccaccaccatcaacatcatcatcaccaccgccaccatcaccatcatcaccatcaacatcgtcaccaccgccaccatcaccatcatcaccgtcaacatcgtcaccaccgccaccatcaccatcatcaccgtcaacatcgtcaccaccgccaccatcaccatcatcaccgtcaacatcgtcaccaccgccaccatcaccatcatcaccgtcaacatcgtcaccaccgccaccatcaccatcatcaccgtcaacatcgtcaccaccgccaccatcaccatcatcaccatcatcatcaccaccaccaccatcaccgtcaacatcatcattttattttagagaaagtttatctgttgaacctgatttgccagaggtaagagggatatgactggatatcattcttccccaagggtggaagcaaggagtcaaccctcagcctctgcacaatctcctggctatatccacagagcttgactcgggttgttggcaaacccctgtgtcttcacccaccaaaaccagttgagccatgattcccaaatggctcccactctcaaaataattccattgggtctgatctgttaagttgcaaaataacaaaaaactcaataataggaacataaacagaggttaaattttctctagttacatggaatctggaggttggtcacaactggtgcggttcagctgctcaaaaatgtcaggggctgggtgcagtggttcatgcctgtaatcccagcactttgagaggccaaagcaggtcgaccacttgaggtcaggagttcaagaccagcctggccaacatggagaaaccccatctctacaaaaaatacaaaaattagccaggcgtgatggtgggcgcctgtaattccagctactcgggaggctgaggcaggagaatcacttgaacccaggaggcagaggttgcagtgagccaagactgtaccactgcactccagcatgggtgacagagcaagactccgtctcaaaaaaaaaaaaaaaaaaaaagatatcacggcttctgtgtctagaaaattcttcacctgacaagaattccagatattagctcttgctggggttgattcagttgttcacagatgtcagtgctcctgtactgcagttgtcttggccttctctcatggcggcaagatgtttcacagcaggaagaccctttcagtcaggaaagccaaccttatcccagaagcattcccctacacacagaaacttccatttgggtttcttcaacagaaaaaaagaaaagttacacagatttggaaggaagaaaccaaactttctttgtttgcagatgacattattgtctacatagaaaatcctaaagaattaaataaaaaaccctcttggaactaataagtgtgtgtagcaaggttgcaggataaaaagttaacatacaaaggtcaactgctttcccacataccagtaataaacaagtggcatttaaaattaaaaacacaatgccatttatattagcaccaaaaaagaaagaaaaataaatacttaagtataaatctaataaacatatactggatctttatgaggaaaactacaaaattctgatgaatgaaaccaaagatctcaataaatggagagatagtccatgttcatggagaatttttcccaacttgatcttacggattcagcacaatccctatcagaatcccagcaagttattttgtgagtattggcaaactgattctaaagttcaaacagaaaggcaaaaagcctggaatagccaacacaatactgaagaacaacaaccaagttgaaggactgacattacctgactttaaaactataaaataaagctacagtaatcaagacagtatggtgcaggtgaaagaagagacaaaaagaataatggaacagaatacagatccccaaaatatactgacacaaatacagtcaactggtctgtgacaaagaggcaaaggcaatccagtgggaaaaggatagtcttttcaacaaatgttcctgaaacaactggatgtctacatgcaaaataataataataaatttagacacagaccttacacctttcacaaaaaataactcaacataaatcgtggacctaaatgtaaaatacaaaattataaaatttctagaagatatcataggataaaatcttggatctcagtgtccttaggtttggcaatgagtttttggatatgacactaaaagtataatccaggaatgagaaaaaaaattggtggtttggagtttatgaaaattgaaaactatattaaatttgaaaatctttgcaaaacacatgtctgataaaggacctgtatccaaaatacacaaagaattttaaaactcgacaataagaaaacaagtaacccaactaaaaaatgggcacaacatatcaacagacaacaaataagatatacagatggcaaaaagcatatgaaaatatgttcaacatcatatgtcattaggaaattgcaaatttcctaatttgcaaacattgacatatgcatcttaagtcactaggaaattgcaaacaatgatgagataccactatacacttactagagtggctaaaatcctcaaactgacaatatcaaaagctgacaagaatacagagcaatggaaactctcacttgttgatagaaaggcaaaatgttacagctagcttcgaagacactggcagtttattgccaaactttcttacttttaccatatgatccagcaattgtgctccttggtatttactcaattgtgttgcaagcttatgtccacccaaaaacttgcacatgagtgttgatagcagctttattcataattgccaaaaattggaagcaacaaagatgtctttcaataggtagaatggataaactgtggtacatccatacaatagggcactattcagccacaaaagaaatgaggtgtgaagcctggaaaagacattgaggaacctgaaaagcatattgctaagtaaaagaagtcagtattaagagactacatactttctgatttcaattacgtgacattctgaaaaaggcaaaactatggagacagtaaaaaaatcagtggtttccagaatccaggaagaataggtagagaattggggatttttagggaagtaaaactattctttatttttttctttttttttttagagacagggtctcattctgttgcccaggctggagtgcagtggcatgatcatagttcactgcagcctcgaactcctgggctcaagggatcctcctgcctcagcctctgagtagctgggactacagtgcaccaccatgcctggcctgttttttgttgttgttgtttgtttgtgttttttggtagagaccgggtcttgctatgttgcccaggctgggaaactattctttttgttgctacatgtgtggatccatggcattatacattgttaagacccagaacttggctgggtgcattggctcatgcctgtaatcccaacactttgggaggccgaggctggtggatcacttgaggtcaggagttcaaaaccagcttggccagtatggggaaactccgtctctactaaaaatacaaaaattagccaggcgtgcacctgtagtcccagctacttggaaggctgaggagtgagaatcgcttgaacctgggaggcacaggttgcagtgagttgagatcacgccactgtaccccagcctgggtgacagaacaagactctgtctcaaagaaaaaaaaaagactcagaactgtgctgcagaggttaggcacagtggctcatgcttgtaatcccagcactttaggaggctgagatggaaggataacttcagcttaggagtctgagaccagcttgggcaatgtagcaagactgtctctaaaagtataaaaaaaaaaaagcctagtgtggtggcatgttcttgtagcccaagctactcagaaggcagaagcaggaggatcccctgagtccaggagttccaggctgctccagcctgggcaacagagtgagaccttgtttccaaacaagcaaacaaacacaaaacaaaacaaaacaaaacaaaaccccgagaaacagtgaaacaatgtatgctatggactttagtttataataatgtatcagcattataaggaaggcactacacactaatgcaagatgttgataaaagaggaaattttgcatgggggagagggatgtatgggaactctcagtactatcggctcaatttttccataatctacaatggttctaaaaaataaactctattagttttaaagaccgaaaggcttggaaacaagtaagcgtgttaggatataatgaggattgagcttatactgaggcaagacttgggaacccctagatgggggaacagaggttttactatcttggtgcctttggacctgctcccaggactgacggagcagtcacagataaagtctgggcatcttgggcaggaacttgaacagtgggactgtatgcaagaagacatttattatctctcttgcacccgagaacaatgccctgttttctttaactttgtaatttgacataatttcagactggcgggaaagttgggagaagagtacaaagaattcccgaagtctcttcccccagatttcctgaatgtcttagcctctgaccacagctgtgctttctttgcctgtcttctcaatgccacgttcatctccatttcacaaccaagcaacagaccaaggcaacaggcttcgactttgcttctttctcattttcatcctgataagaacagcaattgacattttgaatgcctaatccacgccaggcactattctaggcactgcgatacgtaccttgccatttcaccatttcatagccctatgaggtgggtctattattatccccattttacagatggggaaactgaagcacagggaggatgatctactttgcccaaagtcacatagtcaatacgtagcagagttggtatgccaatgccggcagtctagaggcaagcgaggaaaccgacgaaggatgacttgactgggaaaacaggatgggagcccagtttgggagtccaggaggggatatagcccaagccatacattcccaaaggacttcaaaggtagacttttgctgtcgtctcccgatgacatggggcacaaactcagaaacacagacaggacaaaggcagcttgcagggctgaactgcctgggatgaagcatcaaccgtgtgggtgtgcggatgtgtgagtaatgagtgtgagggagtatgagtgtggacgggagtggaagtcacacctaatccagaggattcctattcctcctgaaacccaagcttccaggaaagcccttcctgtggccttctctccctagtcctcttagcgtctgcctgggctgcccccagtacggggtttattacactcaattgcttacatctgttcacttcaattgcttacgtctgctcacttgtcagtgccccaaccaggtcctcagggctaggaagcaggggctggatctatttcttgctctccctagcccccagctcacgacttggcatatggaggcatccacaaacagatgccgaaggatgggagtttttccacactcccacgccacctccaggtatttgctcatgctgtcccttccacctgcatgtttttctgcattgattcaggcactggtcagaggtcacctcctccaggaagccatccctgaccccagggaactgacttatctttactgtcacttccgggggtgggttggtggctgtcttgctcacttggttgtaaggtctcagagggcagggattgtgtctgtttcatgtcttcaggtctgcgtcatcagcgcttgtcacaaggttagacacacagtaggaccaagacagaccaagtacatgaaagaatgattgacatatgggccaggcgtggtggctcacacctgtaatcccagcacttcgggaggcagaggcaggcagatcacctgaggtcaggagtttgataccagcctggccaacatagtgaaacctcatgtctactaaaaatacaaaaatgagccggacgtggtggtgcacgcttgtaattccagctactcaggaggctgaggcaggagaattgcttgaactcaggaagtggaggttgcagtgagctgagatcacccactgcactccagcctaggcaatggaatgagaccccatcttcaaaaaaaaaaaaagaatgattgacgtgcagtggcccctgccctgggaagccaaccctcaccctccaccacagcacttgatcccattgggcagtccttggcttccaccctcaaactgagagctccttgagggcagcagggggtcaaattactctctgggttctcagcactgcccagtgtgagtccaaatatctcccacctcccctgtctccgctctttcctcactcagggctccacagccatgccggccttcagcaattcctcctgcaggctgagctggttcccacagggcctttgcactagctcttccctctccctacacaagtcttcccccataggctcttcagagtctcagctcaaatggcctctactcaaaaagcctcttccagaccacctgccccactggtctaagaggtccctactttcttcttgggccctcctgacctgaaatactttgttgagtgttttccccccagtcatctggctgcatccgggttcttatggtgtccagacgttaatggtctatggggcctgtgttcgaatcccagctccacccctgctcctgcttacctgcagagtgattctgagtttctttcttttcttttttaaaattttataaatgtcaatttttgtagataggggtctcgctaacagggttgcccaggctggtctcgaactatggggttcaagtgatcctcccgcctcagcttcccaaagtgctgggattacaggcatgagccactttgcccaacccattttgaatttcttaaggactctgtgcctcagtttcctgatttgtaaaaccggtgatagtatcactcccttatagggtagttgccaggattgaacgagttaacatttgcagtgcccgacagattgtactagttactgattgaagggctgttttactatccaaatgtggctggagtaggagttgggtaaacatttattgaagaatgtgcaaccactctcacttggaagccgggctgttaggaaggggaggaggattccagtcgcccagccctcccccaccaaacgcaactgccccggcgcaaaagaggccgcggaggccaggcaggagcaggtcctggaggcctggtcggcgtgggcgttttattccgagaccaaggggatccactgcagagttctccgctgggcgtgacctcgggctacggcgtgggaggaagcgcgcggcaagacacccagcgaggtgctggggtcgcccccaggagaggacggcggctcggactgtccggcggcggcggcggggacagcgacaggggcgcgaggtggccgggacccgggccgggcgcgccgggcggggcggcgcatgcaaatctgccgggcgccggggcggggagcaggaagccggggcgggctgggtctccgcgcccaggaaagccccgcgcggcgcgggccagggaagggccacccaggggtcccccacttcccgcttgggcgcccggacggcgaatggagcaggggcgcgcaggtaggatccggggcccgcgcgcggatcgggttgcgaaggtatcgcccgggcacgccggctgagggcgttcgggaagggctcggccgccggcggggaccacggggaccaccccgactccgagcggggcccgagcccgcgactctcggtgcgcgcggagcagcgcccggttccgtccttgccgccgaacggcagcggaggcgcgaggcccggggtacgtggacacccagcgctccccaaagccggtgctggcagtgagacctccgccgggacggcctgcgggggtggggggcttggggttaggctgtcggaggccacgcagcccctcttctccgggcagtggcgcccagccctgcgctcaggaagtcagtgaggacttcggagagagaaagggtggggaaagttctgagaactgtaaatttgagtagtaggtcagtgaatcggggcggtctccgcctccgaatatcagatggacccaataatcgcgatcattgactgggacttgttttactgaaaggatgccaagtgaaacctcccactaacttctctgtggccggtgctgtgcgtcatggacattgtacagatgaggtcaccaagaccccagccgctttagtaacttgccctaaggtgccgcccacttgggagtccgtggggcagcaggactagagcccaggcaatcccacgccagagccagctgctctccatctctcaatcacgtttgaggagcccccacaataaccagaatctccgggagatttgcttaaaatgcagattcccaggtccttgccctgagattcagattcagtaaacccaggaatctgatctttattttatttttaaaaatttattttataaagatggtgtctcactatgttgtccaggctggcctcaagtgatcctcccacctcggcctcccaaaatgctgggatgacaggtgtgagccactgagccctgattttttttttaaacaaaatctggatttcttagacttaagcaagataggggaccactagtttgtctgcttctggggttcaaggaatgcccccaggccagcgctaaccctgctccagttctagtctctccccttccccagccctctgggaggcatgacccactgcacttccctgcccccagtagcctatgaggagcccaaggcatttgctgggacctcagtgcctttatcaaaatcccaaagtccaatggggaaacaggctcaggtgtaggtttggccagggtgtcctgcacattagggcattccagggtcctgcaggggtttcttagaactcggctagcccagcccatgaatgggaggtgacctgctaagccactcattcactcactagcactcattcagctcctgcgaggccctgggtggtgttctgggcactggtgcttgcctcaaggagcaccccctctgcaggaagacagacgtgagggctgggagggtgcggatgcaccagcggctgcaggaccacaagccagaggggatcagctcttcaaaggtcactgggccaggcttcccagcacccagggaccctgagctagccttgtgagtagagcaggggagtctggcaggtagaggatgggaggtaaagggaggcacagagtgggcggaggctgggaagtgtgaaagggcactgtgtacagaacctagggagtaagcagaagccagagatggatggaaagttgggctgggctgcattgtggaaagccttgaatgccatgccaaggaacttgggccagtgtattcaccttggcttgagttgtaaaagcaacaatgcagattcctgggccccaccctgggcctctggatctgaatctggagggagacgctggggaggcagcagggaggaaaacctgcagtcactcaccccatttacaacacatgcagttaccggcaggtccgagataacctaagggtttccaaatgctaggaagtgactcaatgactgatatgtttaatacaatacaatcccggttgcaaaatgcccagggcaagggtgggggtgttcagttttctaatgctcccagttcaaaaaggagctgaaatgaattgtcaaagaagtgacaagctgggcgcagtgactcacacctgtaatcccagcactttgggaggctgagagaggatcgcttgaacccaggagtttgagaccagcctgggcaacatagtgagatcctgttcctacaaaaaaaatttaaaaacttagccaggcgtggtagcaggtgcctctagccccagctatttgggaggctgaggtgggaggatggcttgagcccaggtggtcaaggctgcagtgaactatgattgtgccactgcactgtagcctgggtgacagagcgagactctgtctcaaaataaacaaatacataaatacatgagaagagagaaccttttctacctcccccatctccctgccctcttccacccaccccatctgggacgatggaggagagcgtttgggattagatgccccacctctcgactgccctcactggtacctgggagtgaggccaggacagaagccgcctaagtactgttcttcctcacatttgtaaaagtgaactttcttgagggttgatgacatgttttataagctacttcacacaatgtccaacacccagtgggtccacaatcaatgtatatgtctgttgttacctgtcaaaacgtatagctggggagtgacagtatggacttgagccagatcacccagtgcaaatgctggctttgctgcttactgtgtaactgacttcccagagcctcagtttctgcatttatgagattatagtgactatgccattgtagtgatgactaaatgagttaatatatgtcaagcatacaaaacagtacctggtatgtagtacaaactatgtatttgttaaatgaataccttttttttttttttagagccatggtctctctctatttcccaggctggagcacagtggcacaatcatagctcactgtagcatccaatacctgggttcaagtaatccttccacctcagcctcctgagtagctgggactacaggtgtgtgccaccacggctggctaattgtttttatatttttagagacaggatcttgctatgttgcctaggctagtcttgaactgctggtctcaagcagtcctcctgcctcagcctcctaaagtgttggatttatagatgcgagcaaacgtgcctggcctaaatgaataaatctttactgttgcctcctttgagctttattggttgggatttagtccactcattttgcaggtgagaactgagacccggagatgaatgcagtagccttgcctcaggtccacatctgagggacagactccatcctacttttcttcccatgtattctttcctgcttgtaccagttcactggggtgaccaagaaagacatttctgagttttcctcctggctggcacagtggagacatgcccagccacgtttagctagacttaccatggctgggctagaagagaggccaggagcttgtctggaggttgcacagacctgcccttggtgaatgtggatcggagcgccccggcagaggcttgaggtgctacagaggctgggggatccactgtcagaccgggtgcatcaccactgttttatgatatccagcaaattgctctgcgtctctgagcttaaggcagagagaagggcctgagcttgaagaggggatcccaggtttaaatcggagctggctacttcccagctctccactgtgtaatctggaggaagttgtttaacctctctgagcctccctttgttttgtcatgggtgtttgcagggagagcattcatgagatagtttgtatagacattttgcccttggaaggcgctcagtgattgctgtttttctctgcattttggaccgagtcccttctgcgtatccagcacctggcttcctcctgcatttcttcctcaggaatttattgagcacctatatgtgccagagcatcggaccaagtcctttgctctcctggggtttagattctagttgagcatacaggcaatgtacaaccaatacatatgttcagatcggcagctttatctgttattctgaaatccacgatttctgaaaaccgaaagtttttcataactcattttgaagctaaacttgaggctttttagagtcttcatcctcttcggtgtgatgctcagatgtctttctgcagagatattagtgcaattgatctttgggtgctttcccgccctgcatgatgggcatgtcggtgggtattttatacaaggtgacctttctacagcctgagtcatcctgaattctgaactatgtctggcccccaggattttacaggagagaacatggacctgcaatatcctatcaggtggagactgtgctaggaaggaaagcaaagctgggtgcaagtggaatcagggagggcttccctgaggaggtgacatttgagagggatgaggaagagagggccaggtggagggactcacagaggacggaagactccacttcctgactggcctgtgcttacccctcattctgcatgcacagttctgtctaaatgcgtccgttcttgcctttccaagaagtgctgatgtctcttacgtttcaagtctagctctgactgactcattctctctttaggtgcccccacaggcctcctcacctcttctcgtttgcttaagaaatctgaggtctgcgctaaagccagcctgggtgctgtaacctctcggccgaggatggtgcccagctgggcttgcatctggagttggaggaagtgggtcccgggaggggaagaggagccgtggggccttccaagggtttggtggaattgagttcctggtggggaggggctgtgttctgggtcttagagcctctcgcctgcaaagcaaagttgaacgtaacacgcgctcacatatctcgagtgccagcccggggctaggtgcttaacgcttgcttagccaaagtgccaggggctggggacacgggaatgagtgacccagaaatgagggccctcatggagctgaaagcattctgggcttggtgactttgaggaagtggcttttgaactgagacctgaaataccaaggcatgtggatatctggggaaagagtgatcctggcagtgggaacagagagtgcaaaggcccagaggcatgaatgagcttggtgtgtttgacccacagcaaggaagctggtgtggttggatggaaccaaacaagaaagaggtctaggagcagaggtcagggagggagctggggccagatacctgcattgtctcatttaacttgtgtaataaccctaccagataggagctactctcatgcaaatgttacagatgaagtaacagaggcacagagaggttcagtgacttgtccagggtcacacacctgaaggtggcagagcagggctgtgaacctagaagctccagagtcctcagtcctcaccatggtgtttaaacacaataaaatctatgcctgagtgctgaagacacacctgccatttagatcgatccacttttttacattgtcggtgtactccctgccatccatctgcccagaaatactgtgaatgtgggcagcgcaggactggttcctccaagccccattttacagacagtccaatcattttacatattattttatgaatgagcaccttcctcagtgtctcagaccaggggtccccacacagcagggccacacagcaggaggtgagtggcgggtgagtgagcgaagttttatctgtatttacagctgctccccatcgctcgcattaccacccaagctcggccacctgtcaggtcagctgaggcattagatgattctcacaggagcacaaacccttttgtgaactgcacatgtgagggatctgggttgcgtactttttcttttttttttaagacggagtttcgctcttgtcgcccagactggagtgcaatggtgcgatcttggctcactgcaatctccacctccccatgttcaagtgattctcctgcctcagcctggtggctgggattacaggcctgtgctatcacacccagctaatttttgtatttttagtagagacagggtttcactgtgttggccaggctggtgtcgaactcctggcctcaggtgatccacctgcctcagtctcccaaagtgctgggattacaggcatgagccactgcacgcggccctgggtgcgtgcttcttatgagactctaatgcctgatgatctgtcactgtctcccatcgcccttggatgggaccatctaattgcaggaaaataagctcagggctcccactgattctgcattatggtgagttgtataattatttcattatatgttaccatataataataatagaaataaagtacgtaatacatgtaatgtgcttgaatcatcccgaagccatggccccaaccacggcctctggcagtggaggctggagtccacatcacgctctgtgctgggtgcaggaatggagatgagtgggtgtcctgctcatttccctgaggaggaacctgaggctcaggctagagacttacctgggtgacacggctcctaagtggcagagtccagattcaaacccagggctacagacccagaagcctgtgcatttaaccacggttctgagctatccagcccaaagaggagagtttaaaaggattacatttcttcgttggaaatcagtgagcatagtcgcccagaaccatttttgaaaaactcagagaaggcctatgttttcctgaagcggccagggaagtattctgcctttttaaaagggaagactgaattctagggaggagaggcaccagctctctgggctgggcaggtctccaagctggcagggccacagcctcccgacggtcttgcctctagcatatttcttccagaagccacatttccacaggtgggcagctctaactgggagaaaatcttcctgagatttagccaaattagctttctttctttctttttttttttttgagatggagtctcactctgctgcccaggctggagtgcagtggcgcaatctcagctcactgcaatctctgcctcccgggttcaagtgattctcctgcctcaacctcccgagtagctgggatttcaggcacacaccaccacgcctggctaatttttgtatttttattagcaatggggtttcaccatgctggccagactggtctcaaactcctgacctagggtgatccgcccacctcagcctcccaaagtgctggtattacaggtgtgagccaccgtgcccagcccaaattagctttctaggagcttccactttctgagtctgtttctgcctcttggaggtagtgaccatctccctccaaactcggatacttctcttattcagactacacaactgtagttatttcaggtattctccctgactcaggaaattataagtttggcctgccttggcacatgagtcaactggttggagtcccacgcaaagactgtttgtttggtcaaagaggaaggagactattacctccttggatctagagcttatacttctgttgatgcaacctggaatcatactgtgtagcagccatatcccacttggagtgcatattgggcttgtcagctaaaatctccatgtttctcttctatatgagctgctgttaatccaagtttcttctattctgagagtccttgtctaaagctaagaggttccagtttttcatgctctctaataaatctacttcaggctaacatgctatcattttttctttgagtactgctttggtttctttccacaacttgttacacaatgttattcactgcccagtttagaatttcccttttggttcccattttaagacttatttaattatatgctttttaaatttttgagacagatagaattttttaagttatctttttattgttgatttctaaatttggtcatcatggttgttgtggtcaatatatgtggttcctataatatcagtggtagagaatttgctgagatctttataggattttctggtcatttttttcctcttgtgtttgaaaagaatgtatattttctgttgggtataaggttctagaaatgtatctatttgatcaagctagctattatattatctatatttgttatgtcactatgtggtttttttttttttacctgatttacctcccaccgtaatacaattacaattcaccataatagaggctttgttaagttctccttttgagtctgtcagttttttgctttatttttgaagctatgttgttaagtgcatagccatatgagtagaataagggttcaggatttttatacctttttggtgaattgttgcattttcccgagtagctgggactacagatgtgcactaccacgcctagctgatgtttgtgttttttgtagagatgggatttcgctatgtttcccgggccagtctcaaactcctaggttcaagcagtctgcccacctcagcctcccaaagtgctgggattacaggcatgagccaccgcagctggctgaattgttcctttaatcagtataaaagagccaacttccagcctgggcagcatagtgagaccccatctctaccaaaaactaaaaattagctgggtgtggtggcgtgcacctgtagttccagctacttgggagggcgaggtgggagaatcacttgagaccaggaattcaaggccgcagtgagctatgattgctccactgcactccagtctaggtgacagagtgagacattctcaaaaaaacaaaaacaaaaaaaccatccaccttctctcttctaatacttactcaagacatcattgtcatgaattctattttattgatgtcagtactcctgtactaataagccagatgagttaaaaacaacagcagccttgcaaccagccatgaagcaagtgatcttattctcatttcacagatgaggagactgaggctctgagtggactccagcctgccacggtctcccaccgagtcaggttggagcctgcacttaggcccagagttatgcttctgtgtctcagatgcttgggggtccctgcccacaaaggtggcccccatgtctgtgtgtccccacccatccaggaatggtatggggtgagacaacaggaagagctccatgggtagtccccacccactgccttccatatgccagtctgcaagcagaaaatgaacgggaagctcttacctgtgcccatgtgttgtcctggctttgggtttgcccagggggcaaagtcctggtcattgttgagacaagttcactgctgctgagggccgagcaaatggtgacaaaggccagattctaaattcctacctggttacttcctgctccgtcaccatcacctcgggcaaattctgaacctccctcagcctcattcctccatctgtgcttgcagggagaatattttactgtatcttccatagtgagctttccaggagaagcaaaaaagagtggtgtataaaaaagcaagtttatgactgcttctgtgccaggcactgtgctgtgcactccagagccaaaggcctgggttcaaatcccagcccactcactagctgtgcatccttaggcaggttcctgaccctctctgggcctcggcttctccatctctgcaatggagatgatattaattgtatctgcaatgctccttggattgggtccatggttaagtgagtgagtgaggctcaagggcttctttttttttttttagagatagggtctcactctgttgcccaggctggagtgcagtggcatgatcacagttcactgcagctgcgacctcgtgggctcaagccatcctcctgcctcatctcccttagtagctgggactacaggcatgtgccaccatgcctggcaatttttttttgtatttttggtagagacggggtcttgccatgttacccaggctggtcttgaactcctggactcaagtgatctacctgcctcagcctcccaaatggctgtgattacaggtaggagccaccgcgcccagccttcaagtgcttttttttgttagtgagactggtacaaccaatgccaaggctggtgagcaaagttgcacccagttggggaggggcgaaaccaagggcagaagggcccagggcatggcctctcatggctgaaggaagaggggacacgtggccagtcacagtgacctctgcagacctcaagaaggaggccagctaggagccatagctgtcactaagacagtcaaaatctaatcagcaccctggcgccaagaggccattgtccgctgctcaggacagtgagtgatagtcgataaccagctctctggaggtcagggccccgaggtggctgagatctgtgcctgcattaggacatttaaggggactccaagccaggatttgctagtgtttgcccagcagggagaggtggaaaattggggatgaccaaccaggcctccctgctcacagccaggggaattcatcctgtcgttcttccattcagcaaatattcatggagcacctgctgtgtgccaggcaccgtgctaggctctggggagatggctgtgagcgggatcgacactggccttgtgtgagctggccttgcagtaggggatatgagcaccaaacacataaggcccgagtgtgcaatatgccacaaagattgcagagaaataaagcaagataacaggttgcagaaagatggaggccaggctggctgctgttcctgggtaggtggcttctggacacagtttcctcaggctctgtttcctcctttgggcctctggaatcttctgaagacaggcctggcttccaggatcccggatggagttgcctgttgactgtgtggactcaaagtgtccacagtgcgccggagcgcgtggtcttccccagcaaatctgcttctcttctcggctctccatcgtgggaagggtccctgggatcctccccaccaccccagcctgaggccactttccctctgtccccgctctccccagcctgctttccccaccaagcgccaccaagtccctgctgcctcctcctcccaaacaggctcaaacctgccccctcttcgccagctctcagctcagcccgctcctctcctgcttaagagccttcactggctccccactgccctagagacagagtttgagtctactgccatggcttggcagacggtgttgtccccggcctgccaaccttccagctgccatcccagccagtccttctcccccttgctccagccaagggccccgcttgtagggtgggaagtgggccgtgccctccctcctgcctgcctattcgctgggtcttccctcattccctccctcaccccgccctctcataagaaccttcagaatctgccagacgcagtggctcacgcctgtaatcccagcactttgggaggctgaggtgggtggatcacctgaggtcaggagtttgagaccagcttggccaacatggcaaaaccctgtgtctgctaaaaatacaaaaaaattagctgggcgttgttgtgggcacctgtagtcccagctactcgggagactgaggcaggagaactacttgaacctgggagacagaggttgcagtgaactgagatcccaccattgcactccagcctggactacacagtgagactctgtctcaaaaaaaaaaaaagaaccttcagaatcataaaatgggtttaataattatacttatctcatagggagggcttaaagcacctaggccagtgtctggcaccaaggaaacactgtatacctgttaaaataagaataaaataaaatacacatgctcacttattgagtgcctgctgtatgtcgggcccctccccgagagaactctggtgcatccccgataaagaaacctgaccctctaggatgagggagggtcttccctgagcgcctgctaacagcctcctctgctaatctgaagtcctgcagcttgcccagcaggctggcttgtcacacgggctacccccacaggccgccatcttggaaaaggccaatggctgtggaatcattcttgactcctattagccttcctgttctctctcccgccccacagcatccatcctgtcagcaaatcctgtgggctctgtcttcaacacagatctagaattcagccccttctcaacctccccatctccgcagcctggtgtgagccctggcacctctctctggggccagtgtggtagcctcctcactgctacccacttctacccgtgcccccaccacccaagcaagagaggtcttttttaaagtctcatcatgtcacttctttgctcaaaacgctctggcaacttcttccttgctcaaatatttgttaaaagaagaaaggaatgaatgaatgaatggcctgtttgcatctgtaatagccagcacataggcagtacttggaaaacacccacagcaagaataaatgaggagatggctggacacggcagctcatgcctgtagcatgttggaaggccgaggcaggaggtttgcttgaggccaggagtttgaggttgcagtgagctatgattgtgccatagcactccagcttgggccacagagagagatccccatctctacaaaaatttaaaaattattcgagcatggtggtgtgtgcctgtagtcacaactacttgggaggctaaggcaggaggatcacttgagcccaggagttcaaggctgcactgagccgtgacggtgcgactgcattctagccacagaatgagaccctgtctctaaagcaaaaaagagaaggagaataagtgaggtacttgagcaagtgggtgaggatggttgagccacagcaggcccacagggaggctggtgggtgctgttggtggagggggccgatttgtgttcctggtggctgcagagccagtctgttgcctcccctccctcccactggctgggctggggacggagccaaccaggcagatcccgggccattctggggccctggcctggcctgccttactatcccagtggggccaccgacgtggctgccatttctggaaaccccagttctaggtaggttactgtcccaggaagaagtgcatgcctagcttcctgccagcccagcccagctgtcccagaagccagaggaagctctgggctggtttcttataagtagcatgactaactgattgcgccacaggagctgaggtttcaggccagtttctgtcgtggagtttcaggggtcagcggctccaaagccccagcccccacccgaggcccctgctgtccctggattcctctccacatgccacctgtcacagaggtgcttgcatcctgtctgcagaaccagcccctcctccaagccaggtttcctgcccagagggaagaagagcagaaggcctgtaccgccccctgtgcgcccccagtcctccgccccctgcccccctgccacccgctgtgggttcgggaagagtcctgctgggtcgcttccaggctgctgctggcttctgacatttcaaggcttaatcacttaatctcccccgagttttttaaaaaaagtgagtcaagtgtgttctcctggtggcgggcgtgttttcccaggcccatgcttctgctcatttcctggctgcggccttcactgactttgctgcttcctaactctgtgaccttggccttgtcacttgctgtctctgggtctcaggccaatgggtctcaggccagtggggctccccggacaaagttccagggttttggggactgcatttcaagggtcagcaaccacagtccttaaacacgtggattttggagtgacaatgcctaggttatggttctgtgaccaccagcaagtgctctagcctttttgtgcctcagtcttctcatcagtaaaatgggaatgttaatggcacctacctcatagggtcgttgggagaaccaaattgattaatatattgtaagtacttagaacagggccaggcacaaaataagtactgcatatacagttaactatggacaaaagcttgggacctggttcatgtttaaaaatgattattgaggccaggtgcggtagctcatgcctgtaatcccagcactatgggaggctgaggcaggcggatcaggaggtcaagagatcgagaccatcctggccaacatggtgaaatcccgtttctactaaaaatacaaaaattagccaggtgtgatggcgtgctcctgtagtcccagctactcaggaggctgaggcaggagaatcacttgaacccacgcggaggttgcagtgagctgatatcgtgccactgcactccagactggtgacaaagctaggctccatctcaaaaaaaaaaaaaaaaaagattgttgaatttattattgctgaatttttttttttttgagacagaactttgctctattgcccgggctggagtgcaatggtgtgatctcaactcattgcagcctctgcctcttgggttcaagcgattctcctgcctcagcctctcagcctcccgagtagctgggaatacaggcacccaccatcatgcccggctaatttttgtatttttgtagagatgtggtttcaccatgttggtgaactcctgacctcaggtgatccacctgcctcggcctcccaaagtgctgggattacaggcgtgagccactgtgcccagcctattattgctgacttttaaaccattcattcatttaatatatgtttattgtacacatgctatgcctgtgtcaggcactgtttcaggcactggggataaagcagtgagcacagcagacataaagctctgccctcatggggcttgtggtctctcagagggaggcaaacaatgcatttatagacaaatacataatttaaatttgaggttacctattatactcccaacttgaaaaactagcagtatattgaggtggctatttcacatctgatggaggaatatgtcttttgtgaaccatttatgttctttgcctatttttcttaaagggatgtttgtcttattgatttgtaagaactcttcatatattaaggccattaaccgttcataatgtagattgctacctttttctagtcttttgcttgctgatatagttgggatgtcatcctctctaaatctcttgttgaaatgtgatccccagtgttggaggtgggtcctggtgggagatgttgggtcatggggacgggtccctcatggtttggttctgtccttgccatagtgagtgagttctcacaagatctggttgtttagaagtgtgcggcacctccctcctctctcttgccctggctgtcaccatgtacgcctgctcccctcttgccttccccgtgaataaaagctccctgaggcctccccagaagccaagtagatacgggtgctatgcttcctgtacagcctgcagagccataagccaattaaacctcttttctttgtaaattactcagtctcagatatttctttatagcaatgcaaaaatggactaacacacttgagttctgtctttttcttatggcatattttaatctaggccagacacagtggctcatgcctgtaatcccagcactttggaggccaaggcgggtggatcacttgaggtcaggagtttaagaccagcctggccaacatggggaaaccctgtctctactaaaaacacaaaaaattagttgggtgtggtggcacacacctgtaattccagctactcgagaggctgagacacaagaatcgcttgaacccgggaggtggaggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgattagagatagtgataagtactgggacagacataaacagggtgctgtgataagaagtcacagggagggcccgcattagttgaggggggtcagagaaggcttctgaagtgtttctggtgcaaatgcttggaaaagggagagctgggagtgtatcccagggctgaggccaatggaggattgcagaagagggagaggggataggaggggaatgttagagggataagcaggggaattggctcttttcttcattttcttaaattaaactttttattttcagataattaaagatttacacacagctggaagaaatcatagagaagccgggcgtggtggctcatgcctataatcccagcacttttggaggctgaggcgggcagatcacttgagatcaggagttcgagaccagcctggtcagtatgatgaaaccccatctctactaaaaatacaaaaattagttgggcatggtggcttgcctgtagtcccagctactggggaggctgaggcaggagaatcacttgagcctaggaggtagaggttgcagtgagccgagatcacaccactgcactccagcctgggcaacagagtgagactccatctcaaaaaaaaaaaaaagaaaagaaaaagaaaaagaaatcacagagagacccctgcttctatgctgttccccccgagggcaagattgtagaaatctgtaatacagtatcacagctgggatactgacactgatataagctactgaccttattgggatttcccgatttacttgtactcatttttgtgtttgcgtacgcatgtgtggtttagtgctatgcaattttatcacggcataggtttgtgtatgcagccaggatccagcacagttctatcatcacaaggatggctcaaattctccttttatagccacatccaactcccttcctgacccaccccctcagcccctggcacccactgatgtgttttccatttccatggttatgtgatttcaagtatgttacataaatggagtcacggggtgtgtactctgggaactggcttttttcactctagggcttggattttattctaagtcagagatgcttctctaatgagctgtgaaccccctggggatctgtggcccctgtgaagaagccctttaggagccagggggcattggatgtgtgagctggccctggtctcatttctgattttaaaatggctctggctgtgatgtggagaagaggcagggtgagcctcatctgcagcaactgctaactgcccacatccccccagacttctcaaaaatttgccactcccctgctcaaagaccctcaaaagctgcccactgcttagaggacaggcctttgacctgaggtcctcacttgggcttcagggattctgtgaacccctaaaatggaatgcagaattaagtgtatgcaccttgccagaaacagggtttggggtttacattagatgctcagataggtcattgatccccaaaacactaaggtctctgacttctagacagatagtagttaagaaccaaagctttggagcttgagtgctggatttaagacccatgactgtcacagctgtgcaacctcagacaaatcactcagcctttctgtgccttggtttcctcatctgaaaatggagaaaataatattacctatttcatagattattaaatgcattcttgtatgtaaaagatgtaaaagaaaacttggcatgtggtaaactctgtgtgtttaagtgaatggtgaggctgcccagtataggagggcagagctttccaggtaaagactttctaggcctcctgggattatcaggccctctctgtgttggttgttgtcatacatgacagcagtattccttccaaagggatgccaagttgtggttgcacactgcacttagatccagttgattgacagcactgttcaagtcaactgtgtccttactgatttctgcctgctggatctgtcgattaccaaaagagttgaagtaatagtaataatactattattatccaataatagtattattcagaataatcacacagatttctctatttctccttgctgctctcagtttttgccttacatattttgaccctttgttgttagttgcctacacattaaggattgttatttacatcttcttggagaattaactcccgaatcattatatagtgccacttttttttaatttaaaaattttattttttattttttgagacaggatctttctctgttgcccaggctggagttcagtggcatgaacacagcccactgcagccttaacctcctgggctcaagtgatcctcctgcctcagccttcccagtagctggggctacaggcatgtgccacctctaataacttttctttaatttacaatagtattagtttgttctcatgctgctctaaggacatgcccaagactgggtaatttataaaggaaagaggtttgactcacagttctgcagggctggggaggcttcaggaaacatattatcatggcggaaagggaagcaaagacatcctttttcacatgacgtcaggaaggagacacgccaaggaaagggggggaaagccctttataaaaccatcagatctcaggagaactcactcactgtcacgaaaacagcatgggggaactgctcccgtaatctaatcacctcccatgaggtccttcccccaacacgtggggattacaattcatattacaattcaaggtgagatttgggtggggacacagagccaggccatatcacattattattaattagtgccttctctctcatttttttgattcgcctaggtagagatttatcaatttcattgatcttttcgaagaaccaatttttgatttcattgattttcctcgattaattttctatttttaatttcattgatgtatgctccaattttgtatttttttcttctgcttgttttagacatatattgcttttctgtttctagtactctagatggaaacagattattgattttagaactttctttctaagatatacattcaataatataaatttccctctaagcactgcttttgctacgtctcaccgattttgataggctatattttcatttttatttagttaaaaatatttttagtttctcttgtgatttcttctttgatccatatgttattcggaagtgtgtttttaaatctccaaatacttggaaattttctggctttcttcctgctagtgacttctaatttgaatccattgtggcctaagagcatatgttgtgtgatttctaatgttttcaatctcttaaggttgttttatgtcccagaatgtggtctgtcttggtgattattccacatgaacctgaggagaatgtatattctgctgttgtgagatgtaacagtctataaatggatacctctgttaatatgacctcgggtgactctttttttttttttaagttgctgcttcaccattggcttttggagattttgcagatgataaaatcctcaggacttttctgctgctcagtcagattttcttatcctacacttgcggaactgttgtttgaaattgacaagcaggatggccaactctgcccggctcattttatttcatcttattgggttcagcctgcagttttaggagatgagattgaaggaactggtatactggaatccacggtgggctcggaagcaaacaaacgtgggttctgattctagctctgaccttttaccagctgtgggacctggtggatgggttatttggcctctctggcctcagtttccttagctagacagttgggataacagcctacctttcaggattcttgtgtggattcggtgaggtaatacttctaaagcacctagcaaagtgtcaagtacaaggtaagtgctgggcaagcagggattttgttcacacaaagccttgactcaacataaggaggctgtttccaatggctctgcttaactgagacctgagagtgattgctccatctgtggtggcatatgggctgaaactgcctagcagcatgtcagaagtggggtgttcgcaggacatccttgtccaggttggcagttgagcttggcaggtgaccgctgagaccccttccaactccaccacttcaggaatctcttttttttttttctgagacagtcttgctctgtcacccaggctggagtgcagtggctcaatcttggctcactgcaagctccgcctcccgggttcaagccattctcctgcctcagcctcctgagtagctgggactacaggcacccgccaccacgcccagctaattttttgtatttttagtagagactgagtttcaccatgttagccaggatggtctcgatctcctgacctcatgatctgcctgcctcagcctcccgaagtgctgggattacaggcgtgagccaccgcgcccagccaggagtctcttgatttagaatgggaacttgaaatcatctcctcttgccgtgtacttgaacgcgataacctggcacttatctttttaattcttttactcacctgcatctttgttctttttgcctctgatgttcagggaagcctcttctcccactgcatctgtgatctctcctgaaatgtagcacccacacatccctgagaagctagctgcggcacgtgtgtgtgcacatgggcatgcgtaagtctgggcgtgccttccacaacagattaaggatatcaatcctgacgccatgctgggatgttttagtgaatcttgacagggttgttgactcccctgtttccctggaggactttaccatgaaagtcttctgctgtgtgactttggacaggcgtcttggcctctctgtttctctttattcataattgaggctaaagtgacacctttgccatctctgccacaggatactgtgggcatctgtgtagttgtgagagtaaaagttactaggacttgccaaggaaatcagtgtcaggaacccaccaccccattcccgcccctcctttacttgagactttacttttgtaactctcagcaaggaagacgagttcaacctttgagccgatacagagccttcccctagagagagctttgcagcctcatgctgagccagttaggggccccacatcatgtccaaaatgaatttaatcaacaaacagttactgaacacgtcctatgtgccaggcaccgttgtagatactggggactcggcagtgaatgggacagaccctggctgtcaggatgacagacaatttaaaaagggacagatgtcccacgctggcttgtcctttgcacccctggcacttcgtgaggagcagcggccagttcttgtatatagactggcccttggtgtacatttgtctgacgtttccaaatgatgtatgcatccttggcaggaacccaggaaaagacatgctgtgctcttctcaggaattgtttcagggaggtgatgttggggatttgtcccattcttgttggtgagtttagatcacttggtgaaggtggtgtctgccaggtttctgtattgtaacgttcattgatatgtattttcactcattagttaatatacaatacaagttttgcagggagttactttgaggctgtcatagtaaaatagagctttcccttcttccctgtttatttatttattagagatgaagtctgactctgttgcccaggctggagtgcggtggtgcgatcatagctcactgcagcctccaactcccaggctcaagccatcctcctgcctcagcctcccaagaagttgggattacaggcacacaccacactgcacccggcctcctccatttattgatctatgtcaatacagactcctggactttaactccaagggttacaagtggataccataatattcattttgatgctcaaaatgtgcctgttttgtccaggtcaggctagctgctgagtacttccttattgtctggcacaagaattccaagcctatctggtacttttccttctcctggaatcagctatttctctaaggcgctctggttcctttcagtacagaatagtatttagaagccaagacctggtcactaggaaggcatgataatcaaatgtgatgaatgatcttggattgcatcctggacgtataaagggcattattgaggcaattagcaaaacataaataggggccgtggatgagatagtggtgatgcatcactgttaatttcctgatttcgatggttgtattgtgattatgcagagaatgtccttgtttttctgacatgcacactgaggtattggggtaatttattcattatggagatatgtgagtgtgtttatgtgtctcatacacagatgtttcttaatgatggggttttgtccccataaactcatcataagttgaaaatattattaagtcagaaatgtacttcatactcctaacctactgaacgttatagcttaacttagctcggaacacttgcattagcctacagttgggcaaagtcatctaacacaaagcctgttttgttataaagtgttgaatagcttgtgtagtttatggaatactgagagtgaaaaacagaatggtcgtatgggtgctccaagtactgcttctactgaacacccattgattttgcaccatcataaattaggggaagagaggaaaagcacgcgtaagggaggaagggccgggtacagtggctcacgcctgtaatcccagcactttgggagaccaaggtgggcagatcgcttgaactcaggagttcgagaccagcctgggcaacataatgagaccccatctctatcaaaaatacaaacacttagccaggcctcatggtgcacatctgtggtcccagctactcaggaggctgaggtgggaagattgcttgagcccgggaggtggaggttgcagggagtcgaggttgtgccactacactctagcttgggtaacagagtaaactctgtctcaaaaaaaaaaaaaaaaaaaaggaaagggaggaagggaaggtccctccaggtggaggggacagagagagaaaaggcatggaggtgggactgagtttggtgtgtttaagaagtgcaggtggcagccgggctcagtggctcacgcctgtaatcccagcactttgggaggctgaggcaggcggatcacctggggtcgggagttcaagaccagcctgaccagcatggagaaaccctgtctctactaaaaatacaaaattagttgggtgtgtggcccatgcctgtaatcccagctactcagaaggctgaggcaggagaatcgcttgaacctgggaggcggaggttgcagtgagccgagatcgcgccattgcactccagcctgggcaacaagagtgaaactctgtctcaaaaaaataaaatgaaataaaataaaataaaatgttaaaaaacaaaaaagaagaagtgtaggtggcaggcgtaggatgcatgggtgctgggcccaggtggagagggaggtggagccctgctggggggagggccttcaagtgtgcccaagtcactcggagagcatccagcaggggcctagagctcctgaggtggccttaagttcttatgatgccccagacactgcacacagtgcttcagaggcaacacctccgttcctgtttgctgcaagcctgtgaggttagccttggaaccattcctgtgccacagaaacacagccagagcaccaaaagagaaatgctgttaatggcaaagaactactcactagcagaacaaagcctgggagctgcttttttgaataagatcccaggagagagacccaagcgggaagtgaaggatgggcacttgaaatgttgcagggaatataacccagcgcgtgctgttttctttttttctttttcttttttttttttttctctttttgcaacagggtctcactgtgtcgcccagcctagagtgcagtggtgccatctcggctcaccacaacctccacctcctaggctcaagcgattttcctgcctcagcctcctgagtagctgggactacaggcacgcgccactaccgcccggctaatttttttttgtatttttggtagagacaggtttcaccatgttggccaggctggttgtgaactcctaaagtgctgggattacagatgtgagccaccacgcccggccccagtacacactttttggagggtatttgacgttatgtaccaggagtgctggggaaaagtacacacttgactccgtgagattctgcttcttagcatttttttcttttcctttttttttttttttgagacagagtctcactctgtcacccaggctggagtgcaatggcatggtctcggctcgctgcaacctccgcctcctgggttcaagcaattctcccacctcggcctcccgtgtagctgggactacaggtgtgcgccaccacacttggctaatttttgtatttttagtagagacagggtttcactatgttggccaggctggtctcaaactcctgacctcgtgatccgcccacctcagcctcccaaactttctgttttcttttcttttcttttttttttatgacagggtcttgctggagtgcagtggtacggtcttggcttactgcagccttgacatcccaggctcaaacgatcttcccacctcaacctcccaagtagctaggattacaggcatgcaccaccgtgcctggctgattttgtttaatttttgtagagataaggtctcactctgttgcccaggctggtcttgaactcctgggctcaagccatcctccctccttagcctcccaaagtgctgggattacaggtgtgagccaccacacctggcttctgaacatttttttcttaatgataatagctggtgctatgggctgaatgtgttcccccaaattcatatgttgaaacttcatcccattgtagtcatattaagagatggggcctttggagaagtgattaagtcatgagggctctgtggttggtcatgaatggggttagtgccctcatgaacgggctgaaggaagtgtgtttgccccttctgtcatatgaagacacagcagcatggcatcgtccgtgaggaatgggctctcaccagatctggatctcctagtgtcgtgatcttggacttcccagtctccagaactatgcattagaaaatttatttatttattatttatttattttgagatggagtcttgctcttgtcgcccaggctggagtacaatgacgcgatctcgactcactgcaacctctgcctaccccagttcaagcgattctcctgcctcagcctccagagtagctggaattacaggtgcccgccaccacactcggctagtttttgtatttttagtacagacggggtttctccatgttggccaggctgatctcgaactcctgacctcaggtgatccacccaccttggctccccaaagtgctggaaatacaggtgtgagctactgtgtctggcctgaataataaaatttaaaacaatttttcaaaaattcaccatgaggtctcactatattccctaggctggtctcaaacccctggactccaagtgatccaccccaccttcccgagtagctgggactagagatgcacaccattgcacccaatagagcaatacgtttctgttctttgtaaattacctgctctaaggtatttttgttatagcagcctatatggactaagctgacttgtaacgttacttgagactttaaagtgttccggtcactgttggagggctctgtctgtgttagctcatttaatccccacaacacctcaatcagatggggctattcttagtcccactttatagataaggaaactgaggcatggaagcacagcttgctcaaggttcacatctagtcagtgacagagcaggtatttaaacctcaggaaataatcagagaaacatgtgtagagggttgtccaaggaaggccacatccagaagcatctcccaggacagttgttgtgtagctcaccctctggactttgtgggtctgggtgttgtttcatgattatagagagagctctgtgaacgtggaggacctgttgtcggcagagacacaaatggccagggcatggctgggcagccgcagtggctcaggcctgtaatcccagcacttcgagaagaccagaggggcagatcatgaggtcagaagttcaagaccagcctggccaacatggtgaaaccccgtctctactaaaaatacaaaaattagccaggtgtggtggtgggcacctgtaatcccagctactcgggaggctgaggcagaagaatcgcttgaacccgggaggtggaggttgcagtgagctgagattgcaccactgcactccagccttggagacagagcgagactctgtctcggaaaaacaaacaaacaagcaaacaaacaaacaaataaatggccagggcaggggagggttgcatattgaataagatgagctctgctggaagcacaggtcagcactaacctgcttcctctctctctgcaggtgccttggcatctcccaatggggtggctttgctctgggctcctgttccctgtgagctgcctggtcctgctgcaggtggcaagctctggtaagtcaccacttctcaatcattcatttgttggctattaatggcgtgccagggtcctgcagtatgtcacctggccttatggagattacactgcagtgggaggggacagccaatgacaagtggccctgattatcagtaaattctaaagattgttagaaagtgatgggagccgggtgcagtggctcacacctgtaatcccagcacttcaggaggccgaggcaggaggatcgcttgagcccaggagttcgaggtcagcttgggcaacatagggagaccttgtctctacaaataataaaatattagccaggtgtggcagtgcacgcctgtagccccagctactcaggaggccgaggtgggaggatcccttgaactcaggaggtcaaggctgcagtgaactgtgatcgcgccactccactccagcctgcgtgagaaagtgagaccctgtcaaaaaaaaagagaaggtgatggggaaagaacacagaacagcataagagggggttggggaagctgggtggagtgggggggattgcagttgaaagtagggaagtcagggaaggcctcattgagctgacttggaggaagcgggaaccgtgcagatgtctggggaaggctcattcttggcagagaggccctgcactgagcctggcgggagggttgagcacaggagggaatgtggtggaggagagtgagcagcaggagggagcagtgaaggtcagcaaggtgacagagtggctgaatcaaaaaagaccttgcagtgtttgagcagaggatccatatcatccattatgttccaaaggactcttcaggatgccgtgtggagaaaggaagagggtggaagccaggaggtctggagggaggtctggagtggaggagatgagaggctccggatccctctgggaggtagatttgaggacagattggaattgaggtgaaagacagagaaagagaagtggccaggatgactccaagatttctgacctaaactactgggaaggacgcggttgtcatttctgaaatgcagaaggatgccagaagagaaggtactttggggaggggcgggaatcaggagttagttttggacatgagataagcttggaatatttatttgctatctaagacagctccttaacatggtaagcccttatgcaagttgttgtcagctgagatgggcgtggcactgagcatgggagcatggaggcgcctgagtggtctcatgctcaggtggtttagcaaactcagtgtacatcctgccaattccagtcctgccatggccactgacaagctaggagggcgctgaaaggagaaggaccccgatgtctcctccagcccatccatctcctctctcccattggccaaacccaaccggaaactaaaggccaagggtacccggtgatgaagactgtggtatcagcctcctgagcacagagagggcagaaaggggtggagacaaagaggggcgcagatagtgggcaaatggggaagtggcacttcccctagctcgagggcagaggcttggtgtgatggaatggcactccttaaactgctacatattttccctttaatttggccaagaacaagttgtcaagtttgtgtgagataaaggtgcacttggttcgttcttgtctaatggcccccgcacccatgggtatttcttcagcttccacagtcatcccgacactagctgggaagctccagcagccctggtcctggccccagctctgtgggcgctggccctcaactttgcctgcactgtgcttttgtgctattccccttggtcctgtttgggtgcaagtccccctcacgcattgagttcctgggccgctcaggctgctcctgtgtctccccagggaacatgaaggtcttgcaggagcccacctgcgtctccgactacatgagcatctctacttgcgagtggaagatgaatggtcccaccaattgcagcaccgagctccgcctgttgtaccagctggtttttctgctctccgagtaagcctgcgctggagctggaggtttggggaggttgtgcccaaagggtttgccccaagagtgagctgggtccaggtggtgcgctggagtgcaggatgctgagtatggtttgctgctgtttatatggtgttagaggggaggtcccatctccagggacatgttatgtaagatacagtggagcgcatggtgggagtgttggtccacgtggcacatggatacggctggaatactggactagaccagcagttctcacactttttggtctcaggaccctttttcacacttaaaaatgagtgaggacccaaagggctttggtgtaggtaacacatcattctatgtttacctaattagaacttgcaatgaagaaatggtgtaatttttaaaaaattaaaacaattaaaaattttttttcttactgaaatggaggtctcactgtgttgcccaggctgctctcaaactcctgggctccagtgatcctcctgcctccgcctcccaaagtgctgggattacaagcgtgagccgctgtatccggcccaaaatggagaaattttaagtcccaacaacatgcaagcccgcattcaacaaatcttcagatcaattacatgatcacaggtcatgtagcctctagaaaattccactgtacgccagtgagagagagtgaaaaggcaaataacgtccctgtattatgatgaaaagagttttacctggtgggcccagaccacactttgagaaccactggactagacccttgattgaggagtacggtgttgagagtggagtcctctgtgatggtggatggaccaggacacatggcataggagtcaggtggttccctgggctactccatggtgcacaggatgcttcgttacactggtgcccaggacataatcacgtacacaagacacacagttacggggcagactggggatatacggcacaccagcatgcagcgttcaccagtaaaggtggtattccatgattattctaaggtagatgggctgtgctttgtttccattggcttagtccagggattggcaaactatggcccgtgagccaaatccggcccactgcttgtttttgtaaataaagttttattggaacacactggctgctgtagttgtaacagaaactgcatggccctcctttatgttttttgtttgtttgtttgtttgtttgttttctttgagacagagtttcgctcttgttgcccaggctggagtgcagtggcacaatctcggctcactgcaacctctgcctcccgggttcaagcgattctcctgtctcagcctcccgagtagttgggattaatggtgcctgccaccacacccggctaatttttcgtatttttagtagagaccggttttcatcatgttggccaagctggtctcgaactcctgaactcaggtgatccacccgcctcagcgtcccaaagtgctgggattacaggcatgagccactgagcccggcctcctcctttatcttaattgaaataattcagaaatggaaagtcaaatactgcatgttctcacttataagtaagagttaaataatgtgtacacatgggcattattccatgtaccatggaataacagacattgaagacttgggagggtgggagaggggtgaaggaagagaagttacttaatgggcatagtgtacaccatttgggtgacggacccaccagaaccccagacttcaccactaggcagcatatccagtgagaacagatctgaggcttgccatcaaaattgcacttgtaaggccgggcactgtggtggctcgcggctgtaatcccagccctttgggaggccgaggtgggcagatcacttgaggtcaggagttcgagaccggcctggccaacatggtgaagctccatctctactaaaaatacaacaattaactgggtgtagtggcgcacacctgtaatcccagctactagggaggctgaggcgggagaattgcttgagcccaggaggtggaggttgcagtgagccgagatcacatcactgtactctagcctgggtgacagtgagactttgtctcaggaaaaaaaaacaaaaacaaaaaacaaaaaactcgtaccccctaaatttatacaaataaccaaaaaaaaaaaaaaaaaaggaaattgtgtggcctttgaagtccaaaatattaactatctggcctgttacagaaaaagtttgcagacccctggcctagcccgtgagatgtgggttggctgttaaggtggaacattggaattatcttacgatggccaaactgtgcgatgcagagcttatgttgttctaaattaattagtgccaccggttcttccctttcatgggctttcaggaacaagctaagtcccaggaccagggccggcagctaggcaggtgtgaggagcatccttggtgcatgtggtaagaggctgtggccagcaagagaggcaaccctagtcggctgccccagcacaccctggccgctcccaagcccccagatctgtcctcacatccgtgatcgggaagctggaagagtctgatgcggttcctggaggcatgtcccggacacagctgtggggcccagccagcctacaggtgaccagcctaacccagcccctgtgtctgcagagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatggtgagcagggcggagtgcggcaggggtggctgggtgtgttcccacagctgcctgggctgagggtggggtgggcaggggaggaggtggggtcatagcaacagcaggaggaagccgcctgtattttcccaaatctgatgggattcctgcccctgcctgggcctcagtcctcccacctttgaaacggagctggtcgcagtagaccaccaagcccccttcagcccagctgtttccacccctgaacttaagtgcccaggaaggcgtattgagatgaggtgtgcttgctggaaggcatgcctgctgctgattgaaaaccgaactgggaacattccttccattctgtgtccactggtcagctgctgcggctttggatggtcttgaccgtggaaggctgaccttcttctggtacccggagtccctgcaggaatcccccttgagcttgctgggctgtggtgacaggagtttaaaacatgcgttgtattccagtgatgcatgatatgacatgcatcacaggaataaaaacctgaggtctcatggatatgattgcttcaaaggagaccaagttttaaaacagatgaatcaaaataaagaaaaatactcagtaaatcatcataaagtacagagatgtggccaaaggtgtgaaggatgcagctgtaaaagctgaagtttgaggccgggtgtggtggttcatgcctataatcccagcactttgggaggccgagcccagcggatcaccggaggtcaggagttcgagaccagcctggacaacatggtaaaaccccgtctctactaaaaatacaaaaaattagtctggcatggtggcaggcgcctgtaatcccagctacttgggaggctgaggtaggagaatggcttgaacccaggagaaggaggttgcagtgagcttagatcatgctactgccctccagcctgggcgacagagtgagattacgtctcaaaaaaataaaaataaataaaaataaaaagattttttaaaaggctgaagtttgggttactttggctcatacactttgccttcactgtagaaaggtggttagtaaagaccaggcgcggtggctcatgcctggaatcccagcactttgggagcccagcgcaggcagatcacttgagccctgggctattgaggctgcagtgagctgggattgtgccactgcactccagcctgggcaacagagtgggaccctgtctcaaaaaagaagaaaaaaagggtaattaataaacactaaagttctatgtagaattttagcaacattattgttattataatcttctttgctatggctctgaatctgtgtggtgctccagaagtatgctatggaggttttgtcgaccaaaaatctgggtggtggctgtggtttgtaggccggggctgggctgggtgatgggggagtcactgcatagatcctcacatagaggccgcttctcccgcagtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatgtgagtgggcatgctttgacgtttttctgtgacctctggggaacagggtgggtgaccagcagaggcccagtccctggagccaggagcctgggaggcaagccctggggctggatagcaaatcccaggagctagagacctggcttctcacctggctctgcactaggcaagtccctttgcttcctggccccccacccctcacatcagagaaggggagttatctctgcatgccgctcctcctctgtaaaggtagggctgtgggccacatctgtgtttcccagtttgggggacacaagtgatcgtaggtggcacattgacagctcacttgaataaccctattattgaagagaataatactgactcaagagacagtgacccgtgtcagttcccttttgaggccaacgggttaaggaggaagtccccatacagctgactcgtttactaattcctcttaatgaagagagcagaggccacaccccaggcttagactttcccaagaaaacaagatcagtttgttggttgttccccatggaagctggtcctgacattcccttcacagtagtgttggtggagtttttgttgttgtttgttttgagacagagtctcactctgtcacccagggtggaacacagtggcgtgatcttggctcactgcaacctccgcctcctgggttctagcgattctcctgcctcagcctcctgagcagccgggactacaggcacctgccaccgtgcccagctaatttttgtatatttagtagagatggggtttcactgcgttggccaggctggtctcaaactcctgacctcagatgatccactcgccttggcctcccaaagtgctgggattacaggtgtgagccaccgcacctggccagtggagttccttcttaagtacatgtattgacatctttaaaaagggcgagaggatttacaggaaactatcaggtcagtaatggcaggggccgtccacagtgggtggctgagtccccctatttttctgctggtgtgcagggaggtcatttcctgccacccatgtttccccaccctgaatccaccttcctcacattcccattggagggacaatctctggacatatgggacctggggtcccacagggctgcaatccaatgcctgctgtgccactcgccagctgtgtgatgttgggcatatcccataacctctttgtgcctcagtttcctcatctgtaacacaggagtgacaagagcacccgcccacagggctatgacagtacaaggtgtgtgatacagatgagctcccctgtttggcccacatgtgtcctaaaagccatgtgccctttctcttgagtgccccaggccacagagatccccatctgcccgctgtcccacacactggtctgtcatttgttccttgaggtttgtgagggccggctctgtgcatcccaggggcccaggctgggcctggttggctctcagggagcaggcacccgccaccttaagctcccatgctggtgtctgtcactgcttcctctcaatctggccaagccaggggtgtcgatttatatctctcaggtctggtttcccctttggcactgggccaggtatggggaaagagcaggaatggggcagttggctcacacagcagaggctcagaaagcggggggcatggggggaaggagtgcacagatgctagagagtggggcaagttttgtttggtcaataaatctccttctcatgccccaggcctgtgcaagacctacagagagtcccaaggatgggctggggggaagagaaaggtaccaccttcagagtccaaagatatgttatttaatattttcatatttctagatctgccttcaggcatggctggatccagcttctaggaacctgtccagctctgcgccctgctttattctgtactggcttcgtttttaggcaggctcttccctcatgtagtggcagatatgcctactagttgctccaggcctacatcccaaagccacagtgggaaaagggttttttttcttgacggttctaataagagtcctaaggctgctgctcagtggcctggcttcgatgctgtgccagcctctgaaccaatcactggctgtgggtggagagagggtgctggtggagggccctgcttgtccagggaggagtcacatacctgcctctagggctgcaggtgggctcagctccatccaaaccagatgaactgaaaataaggcaggagtggcttccccaggggaaactggggaagaggaagcaggactgtgctggctaaaatgccagccaggtttaagacgtggcaccagatgccagtcatgggattggattggtcagcatgcctgggctatggcttaggggtatgttggtgctcagggatgccacaggcctccagataccaggtctgaggcagaagaatgaagtccagcttctcttgtgggtggaacagtggcaactgagataccccatctctcccttcccaagaacagagctgaacataaagaatttagtgattggccagagcttggccacatgctcccctctgatgaatgataggccaggtgatgggattggcacaattggcttagactaatgagggttggccctggagttgcaggcagtggagttctgtcctaagcagtgggcacctaaacccgatggcataaaagctgggcgggtgtccacctgcatctgccacagcactataggcaccaactgtggctcatactgagtgggataaattccagaaagaaacattaggaacttactatagaattttggggctagagctactcattcattcccctagataatttctaggcaaggttccatagtggagggggagttttggcttgggcattgaaggatgcataggagttttctagatggggaaagaagggaacggtagaccaggcagagggaactgcatgataaaaggtttatgggtgtgaaaattcatggaatgtttgaggattatggggttgggggatgtgggaatatgtgtagcgataaagcaccaaacaaagccaaaagtttagttagagccctgaatgcctgcctcataatggtttccatattttatatgcctactatgtgccaggcacattgctcagggtcacacagctggaaatggcagggctgagtttttgttgttgttgttgttgttgagacagagtctcactctatcacccaggctggaatgcaggggcgtgatcatggctcactgcatccttgacttcctgggatcaggtgattctcccacctctgcctcccaggtagctgggactacaggcacaggccaccacgccaggctaattttttgtatttttagtagcgacagggtctcgccatgttgtccgggctggtctggatctcctggcttcaagtgatccccctggctcagcctcccaaggtgctgggattacaggcttgagccaccgcatccagcccagatctgagatttgcacccagtatttgaactcccaagcctgtgctctttttcctcccatggacatttctctcagagatggtctcccaaacacctgtccttcttgttaaaaaacagacaaaccgcaagtagttctttggaagctcagatttctcttttgtttcttagtaaaacatttcccagttcccagctcccttccagggtgtaagatttcttcggtaacttacatctagctgttgcttcttgtttgctcatgtttagaaagaaagacaaaagagagtgagaattttctctcccttccccagtctccccacaactcacaccccaccctcagctccctctgtaataggaaaatctctgaactctctgtagttgctccagcaatcttttggaactttgcttctttcttgtgaaaaaacctccccttggctcactttgcaccaggtttccccaaatgtgcttccaaccacaagcagaaatggagctgccagtaaccaggaagaaactgccgggggctgaggaagaggagagggaggtgcatagccctggatctcgcagggagaggggtgacaggatgagaactcaggttgctcacttgccatcagggtcagtcatgaatatagcgttcatgtatcactttttaaagcttttttggagggtaaaagtaatagttacacaaaataaaaatacaaatggtacaaaaggacttagaatggaaacatgtttctctcccgactccagcctcctgtttttcttcccagagactgaccactgctgtctgtctcttgccagaagggaaagggaggcaaggttagggcaggcagagggcatgtgcatcctttagagagagcttatgtctatacaagcaaatgtgtgtgttcagtcatcgctgtcttagttttctattgctgcataataatggtactaccagcttcacagctttaaacaacacccatttattatctcatagtttctgtggttgggagtctggacatagcttagccaggttctctgctttagagtctcgtgaggctataatcaaggtgtgggatggggctgcagtttcatctgaggctcaattggggaagggtcacttctaagctcatacaatattggtgacattcagtccctggcaggctgttgaactgagagcctcagtttcgtgctggctgttggttgtagttaaccctgaattccttcccatgtgccctttgcaaagccatcaaggcagagagacttgcctagcaagtaggatattacagtcttctgtaatataatcacatccatgaaatcctctatatatcccatcacctttaccatattctgtgggttagaaacaagtagcaggtcctgcccacactcgagaagaccagatgacacaaagatgtgattcaaagtggggatcatcggggccatcttaggtttgtctgcagtgatcactgtgccatctctctctctctctttttttttttttttttttccgagacgaagtcgtcactctgtcacccaggctggagtgcagtggcatgatctcagcttaccacaatctctgcctcccaggttcaaatgattcttctgcctcagcctcctgagtagctgggattacaggtgcccgccaccacacccagctaatttttgtatttttagtagagacagagtttcaccatgttggccaggctggtcttgaactcctcacctcaagtgatccacccacttcggcctcccaaagtgctgggattacaggcatgagccaccatgcccagccccatctctctttaaaaaacaaacaaacaaacaaaaaacataaaaagaagcagagaacacatacacatctgcatcttcccttgtttacttaacaatagatcttggaagtcacttctcagtagaggctaggttgggcagagcattggattctaggccagtgagtttggacttgaccatggagacactaggaagcccatgaaggacagagagagatgcctcgaccctgccagtcctttagaaagatcacccagtgctttttgtataccaaaccctatttgaaatacttacgtatattaacccatttccttatcaccacaaccctgcgggaagggagataggcacttttattatcttcattttgcagatgaggacattgaggtccagagaggttatgtcacttacttaaggtcacacagccaggaagtggtagtagggactcttacccttgttttacagatgagattgaattatctcacgaaaactcagaaaggttaaacaacttgcctaagtaacatacagctaattagtcgaggagcctgacgcatgttgctgtagcctggtcacagttacagaggtggcaagcaatggcctgaacaggacgaacaaccaaatacccaggctggtggctcttaaacatggtggggtcagctaacgacagcaaccagggtgggcactggtgcccctcgcccccggctggtgccctaacatctcccttttctctaccagttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactgtgagtatcaagaggcctaagcaatggtaatctccactctccattcttcccctgtggccagacacttcccctggctgagtctctgggcttttatatcataggatgcctctaatggcaatcctgccattagatacacctgccgtggtgtatctgccaggtaggcaggctaggctgcagtaacaaacaagcccacaatttccatggcttaacactatgggaatatatttcttgctcacgtaacaagctaacgtgaatgttgctggtttgtaggtggtttccctccctgtagaaatctggggagtgaggttctttccatcttgtggtgccgtcattctccaggacaaagattcttacctacttttgtgtcctggtttcctttggcagcctggtgaagcctatggacctcatttcagaatatttttaaatacataaaatcccagcctgggcaatatagtgaaacccccatctgtacaaaaattagccaggcatggtggcatgcacctgtagtcccaggtactgggaaggctgaggtgggaggatcacttgagcccaggagtttgaggctgcagtgagccgtgatcgtaccactttactcccacctgggtgacagagcaagagcccatctctaaaaataaataaatacaatgaaataaaataaaataaatagaactacagaggaaactaattgtattgaaatgcagttataaaacatttaaacacatttttaatctagagatatatgtgcttctttattaagatctataaataataagttctaggggtagctcgcataaatactgtaatttcaaagtagataagcataaataatactttatgatactgaaattgtgatgtgatatgagaatagctgtgagttttgttttgctggggacaggatcagtgatgctgtcattactggggtctcttccctccattctttttttaaaattgtattttattttatttttaaaattttaaaataaatagagacagggtatcactatgttgcccaggctgcttttgacctcctgggctccagtgatcttcccatcttggcttcccaaagtgctgggattacaagtgggagccagtgttcctggccccttcctccattcttaatggaaggagatgctaggtgtgagaggttagggaaagtaaagatgtaatttctttcccatccaagttctcagacccctgaattctacctgcagccatgttggtccatcaaccccaagtgaagaatccctgctctagggccccaccattgtctgtatccagccagcagaagaggcgtgattatggagatcacatctgcttcttgaaagcagacagcccggaagtgggccgcatcacttcctctcaaattctattggtgaaaatggtcacatgactacacatagccacaaaggaggctgggaactttctcacttggaacctacatcccagaaacaactcttttcagtgaggtatcccacaggtctttcgcagtagaaatattgattatctcacataaaatgaagtcttacaaatggacctactgggttttgtacagcagccaagtgatatctcttcccttctgctgtcttcccttctgccatccttcacatggtggcattgtatccttagacttgccacccatgccctcaggttggccgttgcacactgtcttacataaagcaggaaggaaaggaaaggctgctacgagagagtgtaccttgtgcatctcttttttaatcaggaagcaaacatctttctagaagcttccctagcaaaattccccttacatctcattggccaagactgttacatgttacatggttactgttattacttgctcattgcaaggaagactgggaactcaaatgcctggaaaaaggaacaggataatcgtgattggctcaagccttagggtgggcatggctccctgacaagggagagaggaaaaagctgttgagtgaagaagactgcttcagtttccccatctgtataatgggaggagtaagggctgtcgtaaaaactcaatgaaagaagattcttcaacgtggtaggtgcagtggcagctggcagtaccctgaccctgccaccgcacagccctctcagcattgctcatcctgcactgtggatatcagttgagccacgtgtctcctgccctgggctgtgagctccataggcagggtctccatggctgtatctccagaacccagcacagaaccaggtgcttgggaaagttttgaattgattctcatctgccattggcatggggaagggaactagcttgtatgaaacagataacaatgtatgggaccctcattcattatttcagcaaatatttgctgagttcctcctacatggctagccctgtgctagacactggggaatcggcgatgaacaaagcagatagaaatccccactcttgtggagctgacattctggagggagagacaaaaagcaaacatataaagaaagaaagaaatcacatggatctggatgacagtgagtgctgggaagaaaataaaagcagaggaaggggatggagcgatgggcagggggcaacggtagggagggtgtcggggaaaactttttggagaatgtgacgatgaaagtgaacaaggagaagtcaaccgtgttgagatgatggcagctaatgatgtggacaggccactctgttctgagtgcattatctattgattcatcatgtcatcctcgcaacagccctgcacgatcaattctgtcattaaccccatagtacagatgaggatgcggaggcacagagaagataagggacttgtcctgtgtcacacagcaaggagccatccggctcctaagttggtgcatttgacttctgtgcttccggaaagaaagagcagcaagtttaagatctggaggtggcactgagctttggaggagcagggggcaatgaggtggccggtgtgacgaggactcaatgtgcaagagggagagtggtggggagatgaggtggaggggtggtcggcggtcagatcgtggagggtctcggacgagggtcctgaccctgggtctccagtcctgggaagtggagcccaggctgtaccatggctgacctcagctcatggcttcccctcccacttccagcctacagggagcccttcgagcagcacctcctgctgggcgtcagcgtttcctgcattgtcatcctggccgtctgcctgttgtgctatgtcagcatcaccaagtgagtcctgggcccagtgctgccgagcagtccctctggagtgcagggtggcagggacttgcccctctagtctgcccctttgcagtcctctcagtcaataatacgcatttactgagcagctactacacaccttgagagtagagctgagaacatatcgacaaggaccccacttttttctttttttttttttttttttttttttgagacggagtctcactctgtcacccaggctggagtatagtggcacaatcttgcctaacagtaacctccgcctcccgggttcaagcaattcttctgcctcagcctccagagtagctgggattacaggcgcatgccactatgcccggctaattttttgtatttttggtagagatggggtttcaccatgttggtcaggctggtctcgaactcctgacctcatgatctgcctgcctcagcctcccaaagtgctgggattacaggtgtgagccactgcacccaaccaggactccacatttctaaaaccggcatcctactggggagactgaaaatacatatcaatcacaaacaggtggttttccatagtgacccactctctgaatgcactagaccagggtgcaggccagagatcttctggggtgctttttgcaagggggaccaggataaggctctccaaggagggaaaatttgaggggggccctgactggggagaatgagctggccagggataagcaagatggagtcatcccacatccccttacaacgctgggtgcctgggcaactgggggcatctgggggcatgtggtaggagccagaggaatttgcgacgattgccctgatggagtcaggagacctgggtttgaatcctggccttggagcttggtagctggcggccgacaagttgctgaaacccctgagcctggggttcctgctttgcagagtgacagtgatggtgagaacatatttcatcagccagaagaggccaaatcacagtaaaggctgagggaggagatgagtggcgagtggctgggaggtggtggaaggagcctcgtttccagagagctcttgccagcccttggaatcatggtgtctcagagcctcagtcctcccatctctgaaatgggactagcaagctcaacctcactaagtcaggattagaggtggctaaggattattaacatgattgatgaaagtgcccactcttggcccagcacacactaggtaggcagggaatgcaaattcccctccatatcttgtcactgatgcctccgagcaaccttggactgatcgccttgctctgagcctcagtttccccatcacctgtacctcttcccactccccatcactatatcccagcatgccagcctctttgctgttctttgtctttggtttcttgttttgttctgttttttagacagggtctcactctgttagccaggctgaagtgcagtggcgcggttacggctcactgcagcctccaattcctgggctaaagagatcctcccatttcaacttccagagcagctgggacaacaggcgcttgccaccacacctggctaattttcttattttaatttaatttaattttattttttgggacagagtggagtctcaaaaaccaagctggagtgcagtggtgcgatctcgactcactgcaatctctgcctcccgggttcaagcgattctcctgccttagcctcccgactagctgggattacaggcgtgtgccacgacacccagctaatttttgtatttttagtagagatggggtttcaccatgttggccaggatggtcttgaactcctgacctcaagtgatccacccacctcgttctcccaaggtgctgggtacaggcatgagccactgtgcctggccaattttcttacattttgtagagactggctgtcacttatgtagcccaggctgatcttgaacttctacccctttatctttattcatggcacttattaccatgaatgaatgacctcatataagcatttctttcgtttttttttttttttctttgagatggagtctcatgttgtcccccaggctggagtgcagtggcgcgatctcagctcactgcaacctccgccttccgggttcaagcgattctcctgcctcagcctcctgagtagctgggattgcaggcgcctgccaccatgcctggctaagttttgcatttttagtagagacggtgtttcaccatattggccaggctggtctcgaacttctgacctcaggtgatacacctgccttggcctcccaaagtgctgggattacaggcgtgagccaccatgcctggcctcatataagcatttctgtctccatttatcatccatctttccctcttgaaggtcagtttcaccaaggcaggcatctttgtctcgttcactgttgtggcctcagggccaggcacagtgagtcaaacatagaaggtgctcaataaatatgtgtttatttattgaaaccatgggcagaggctaattcagaagcggtctgaggaccttacctcccagtgatgatgcaccatggccccaggcaggccaggaagagagaagggttgtgtttctccgtaggtcccccagcttcccaggccatcccaggccattccctggtcatttgccctcagctgctctgaaaaagggattgttgaggggaacctagaatcctctctctgcagtttgagtctttcctaatcccctggggtctcattcccactgaggacataggtggcctcctcaggaactctgtgctgggtaacagaatgcgggagtgtgaacctggctctgccacctaccagctgtcactccacctccttgggcctcactctcctcatctgtagaatagggttagcaatagaatccatgtcaccaggttagaatgatgagtcagtggtttgacctccagaaactaatcagcctgatctctgatgccaaataagtattggtgataacgaccacttttatgggaggagcgttcacctgtcaataattcagagatcaacaccttttccttttgtttttcaggattaagaaagaatggtgggatcagattcccaacccagcccgcagccgcctcgtggctataataatccaggatgctcaggtaggagtaggcgtggatgaggacatgtgggactgtgtacatgaagaagtgtggttcagaacacctgggctgttaaggaccttcactggcttctggaatggcaaatagacagtcaggagggttgcaggggagacagagacagaagccgaatgaggtcattagcagaccagaggctttcccgcccttccccttggcaatcccagcctggggtgggcttctctggggttggtttcctgtttttttccctccccttgggagaatgacccttgggtcatcatcactgtgtcattccctggggaggtgccagtaccagggctagaggccagaaggagtggaggaaggagagggtgacaggctttctgtgtcttcttcttaagcataggaaactgcccccgaagcactagcaaatcccttccgggttctcattggcctgaaatgtatcccacccctaagccaggggtggagtcagcttccccaaggcgatggtcctgtgggtgagtgggtggggtttgcctgagcaagatgagagttctctaggtaggagaaagggggattataggtcctgtctagaagagaaggtctgagggtccttgcttttccagggactctggaatctagtggtgttggctttgaatcctgactctgccactcactggcagtgtggacttgagcaagttgcttaattctctgagcctcagtttcctcttgtgggttataacagtgtttacctggtaggacagatattggaatttattgagacaatacatataaagtgcatattccagcctcttgcaaataccaagtgccatttatgtatcagttagtgtttgctgtgtaacaaacgaccccgaaatgtagagggttacaacaactttatttagcttatgcttctgcaggctggcatttggggctgggctcagcagtgagggtggcgggggaggctgggctgggctgggctgggcagatctgaattgagctgacccgtccccgtagcctccctccgtgtctgacagttggctttttttttttttttctttttctgagacggagttttgctcttattgcccaggagtgcaatggcgtgatcttggctcactgcaacctctgcttcctgggttcaagcaattttcttgcctcagcctcccaagtagctgggattacaggcatgtgccaccacgccaggctaattttgtatttttaatagagatggggtttcttcatgtcggtcaggctggtctggaactcctaatatcaggtgatccacccacttcagcctcccaaagtgctgggattacaggcgtgagccactgcacccagcctagttggctgacttttacctgggacagtgcaggtgcctgagccatgtgcctctcactctccagcaggccggcccaggcttgtttacagagtggctcagttttcaagggtgggaagtcccaaggcttcttgaggcctaggcgcagcactggcatgatatcacttccatcacattctatgggcccaagcaagtcccagggccagtgtagattcaagggatgggaggagattcagagcactcctctgtggccacttttgccatcgaccacagtccctgtaaatattaggacaatgtaattaattcccaggaatctgaagctcagaaagcgtaagtgacctgttggacttctgatctgtgtgatgtcgaggcttgtaccccttcctgagcattgccgtactccaggccgggctgcaaggccactctgctctttcattggctgtctctgtattttaggggtcacagtgggagaagcggtcccgaggccaggaaccagccaagtgcccgtatgtatctgaacttaggtcacagcctgcatgcattgggaaggtgatagaattggagaggcaagcccctagctccatgtctgccttctcttccctgcattcggtaattgccctgtgacattagccttcaagggacggcaggaggaggggtgttctggaaacgtggactgctggccaagccccctgagtttcactggtgtgtcaggtacatggtgataccccttgggagtgctgttatagttaacaaccagagcagccgtgcctgttgttaaaatcttgacctaattgtatacttgtcggcaaatagccactatcctgaacactcccctccttttttttaatatacaggatctcactctgtggcccaggctggtgtgcagtggtgcgatcatagctcactgcaccttcaaactcctgagctcaagtgatcctcccatcttagcctcccgagtagctgatactacagatgtgcattaccacgcctggctattttaaaaggtttttgcctgtaattccagctactcaggaggctgaggcatgagaatcacttgaacccgggaggcagaggttgcagtgagcgcagattgtgccactgcactccagcctgggcgacagagtgagactcttgtctcaaaaaaaataataccaaaaaaagtttttgtaaagacaagctctcgctgtgttgccccgccactgtggcctccttagcttcttccctggggcctgctggacctttccatactccagaaactaaagggggtccaggaccctgcttcaaccctaggatcccgcatcttttttttttttttttttttttggacgcagggtcttgctgtgtccctcaggctggagtgcagtgattcactgcagcctcaaactcgtgggctcaagtgattctctagcctcagccttctaagtagctgggactacagtcatacaccaacatgcccagctaattttccttttttttaattcttgtagagatgtttgagacggcttgggctctgttgcccaggctgttctcaaactcctgagctcaagcgatcctccctcctcagcctcctaaagtgctgggattacaggcgtgagccaccgcacccggcttccatatcctttctaattggtcatggcttgggataatggtgttgcttttaattatcatcatccataaagactttttcttactcaacagatctgagcttgtatttggtgcccaggacatgtgctgggttcccgaaatcccaaagacacagaccctaccctcagggatttctcattctagcaacatagactgatcaattactgattataacgttagaaggcatgtctgaagtagacagccatcaggacatggtgatttcaggctgggctttgaagaatgaataggagtttttcaagtgtcgaaactgaaccctgaccaacctttgcttttgcagacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacgtggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctatgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctctttattttttatgtattaaccaaacatacctccagacactgctgtgagtgctgtgtctctgttaactcctggaattcacccatccagaggaaccaggatgcaagaggttaagaaacttgccatctgggtttgggttccccatacaaggattcaaatagttgatttaggaagtaatcccgggaaaccctgctaaggtagtggggaactgaggcagggaaggacacaaaccaagaaagtgttacctgaaaggggtccagatgcagaccccaaaagagggttcttgaatctcatgcaagaaagaattcagagcgagtccatagagtcagtgaaagcaagttaatgaggaaagtaaaggaataaaagaatggctactccgtagacagagcagccctgagggttgctggctgcctatttttatggttattgattaattatattccaaacaaggggtggattattatgcctcccttttagaccatatagggtaacttcctgatgttgccatggcatttgtaaactgtcatggcgctgttgggagtgtagcagtgaggacaaccagaggtcactcttgttgccatcttggttttggtgggttagagccatcttctttactgcaacctgttttatcagcaaggtctttatgacttgtatcggtgacgacctcctgtctcattctatgactaagaatgccctaacctcccaggaatgcagcccagtaagtctcagcctcattttacccagcccctcttcaaagctccagtttaaataaacctctgacaaaagggtgagttattcaacagattaccagcatgagtaactgatgcttacctgccggggatctctggaagaccatgcatggcacatgcccagttatgcctgcaaaggagagggagctggggtatttgtccaccagctcccatctgtcattggctgagagctgcttccaggagcattaattctccagcacttccagctactccaggaaaaaaaaaattcttcaactgagagttggaggtgttgagagactctggcacaccaagaagacaggaacaggacaccaacagtggctgatgatacactgccaaggtcacacagctagttagcaacagatctatagtggaatccagacagtgtctccatcacccaggctctctgtagtgatctgcgcttcacatccgaggcaggcagagggatggtgtgggccttagatgggaaggctgggaacctgaagctcctatgtctgtatcacttttgcttctctgagtagctgccctgatttcacacttgaggggcttggccattttagattccttcctgctctaggagcctacatactacactggaaatgatggggagctctctacctcacatgcagcctgatgtttgttagaaacacctccttgcgccaggcatgatggctcatggctgtaatcccagcaatttgggaggctgaggcgggtgtatcacttgaggtgaggagttcaagaccagcctggccaatatggtgaaaccctatctctaccaaaaaataaaaaattagccgggtgtggtggtgggtgcctgtaatctcagctacttgggaggctgagttggtagaattgcttcaacctgggacgcggaggttgcagtgagctgagattgtgccattgcactccagcttggatgacagagtgagaccctgtctcaggaaaaaaaaaaaaaaacaaaaaaaaccttgttctaagccaaaatcaatccctttagctgcccaaatcacacagtttacagatggagaaacagttttagagaggaaaagggacttgcccaaagtcacccagagaatggcagagcctgaactagccttctggacttcttgcctccaaaagctctttataataaaatataattttaaataaaaatagttatctgtttagggccaagcaatatgctaagtgccgtccagccactgtgtcatttacgtctccaaacagctctagttgggaggctcaatgattatcccaattttacagataaggaaacaggtccagagaggttgaggattagcctagaaccacacagctaggaaatcctggagccaggatttgaacccgggtctgacctaagagctcccagccgccgtgatatatcagcttatgtcatcctgacacctacgcagatgtcggctcgaatccactttgcctgagcattgtctcagagaaatctaatttaaaaattaggcagcaaatagaaaatatatttgactgctagagatgcaatgggactgggagcccaacaaaggatcttaggcaaaagaaatccaagttgttggcctcagcaactattactgaactggctgggctttgggaagctacagagggatgagaagacctggtggatcaggtgggcccaactcaggctggcccccaccctgcaggaagtaggaaaagtccagggtcataggcccagtgagatgccggctgcgggagtttcagcctccggggctggaccagagggcaggaggggacgcccctgggtagcagcgccagagtgggctgagtggcctgggcccctgcgggggagctttcagagatgttgatttgggggtactccctcagccctgcctttacacagaatttgtgggggatgaggggagggggaaaggggggaggaaggcagtgagtgcatctgaattttttttttttttttacaaaaagtggcttattgcatttttctgattactctatcagcacgtgcagaccttttcctattcagagaaagcctgaagatataaagaggaaagtgaagaaaaaccaccggaaatcccatccccgccccagcatctggcactgtgtgggcgatcacgaaatgagcgcttgtttttgaaggcgtagtatctccgtgaacatccggttgaacaacctttctgactttatttttcccacgaaagttattaattaaaaaacaaaaagcaaaacaccgaaaaaacaaaaaacccagcaagtgtttgagctcccaccacgagggaggcctgacgtcactggatcctcccggcagccgatgaggctgcatgggacttgcccacgatgtgctgttaccgagtggcatagccaggcttcaaaccagagtcctagctaaccgccctgtatataccatgggctcatcatcttccctggttccagctcagaacagagactcagaggaacaagggctctgcgctcaccctgcctggttaggtccagcctttccaattccaagctgtgtgaccatgggaaaagtgtttgcccactctgggcctaaatttcctccttggtaaaaggcacacaagagcagtactctgcacgccacagtggtggggtgagcagcagatgacgtggtgggtggaggccaggtgacaccaggctgctctcaagcttaacttgcctgtgatggtggcgggaccgtgtcagttcttccaccaaatcccacctgtttccacgacgtttattgacaagtcaggggcaccgccccgggtggagggggtgtgaagaggaagtcagctccctggtccctgctgccctctggtgaccacatcagcatcagcacctgctccatcccagcagctccaggtccaggccgtgcccagaaaacttggcctgggagattccccacccgccctgccccgatcccacctctcttccatctctgcattttccagaaattcccccagcaccagacaaaagagcctaatgtccattagatatgctgtgtggcgccaggccagcgtgtaacctctctgtgcttgattcgttatctgtaaaatgggaatcattataatatctgcctcatgtagctattgtgagaattaaatatgttagtacctgtgaggtccttagaactatgcctgcggctgggcacagtggctcacgcctgtaatcccagcactatgggaggccaaggtgggcagattgcctgaggtaggcgtttgagaccagcctggccaacatggtgaaaccctgtctctattaaaaatacaaaaatcagccagacatggtggcgggtgcctgtaatcccagctactcgggaggatgaggcaggagaattgcctgaacccaggaggcagaggttgcagcaagcggagattgtgccactgcactccagcctgggcaacaagtgggactctgtctcaaaaaaaaagaactatgcctgcaaatagttaatgccttaaaagtatttgctaacattcttcttcttcttcttttttttttttttttgagacagggtctttctctgtcacccaggctggagcgcagtggcccaatcccggctcactgcagccttgaacacctgggctcatgtgattctcccacttcagcctctcaagtagctgtgaccacaggtgcacacaccactaagcctggctaatttgttttttaattttttgtagagacagggaatcactatgttgcctaggctagtcccagactcctagggttcaagcaatccatccacctcggcctcccaaagtgctaggattacagatgtgagccaccatgcctagtctgctaacattatccttaatattacactgaatatgtctgtggattttgtgggaggtgagggtataaaacataattagaggaaataatgacattctaaatttaatttgactttattacaaaaagggcagaatggagcaacagtaatccaggacaaaaaattgtcccaatcccatcattcaacccacttgtgtttgtatctgtttgtgccacttctgtgtgttgtttacatgcagagtcagtgtttgcgtatttgcggttttatatcattcatttctcatcatacatacatatatttatattcctgacatttttctagggaatatctttatattcctgacatttttctctttttcccttatgttcttccataccgggacttataggaccttgcccagactcaacttccctcttccccatggacccaagttgctgagcttccaacaggtgtttacagcaaaggagaatgagacagagagaagcagagatgcagagagaaagacagacagagaagactaaactgattgatcccaactccattatgatatctgactccaaccacagaatgaccctgatccagccacagactgacttctgatcctggccacagtccacctcctgtcctcagccacagaacagctctgactcaagccaggaactgagtcccgacccatgttactgacttactcatgatcctggttgcaggctggccccagccacatgctgacccctgaccctcaccacagatggatctttgatcccagctataggctgatctctgattctggctgccctgaaccaccactcctatatactgatgacccaccttagcgtgatcccacccaggaactggcatttcctgggacaggctcttggccacctgctgctctgccctgggcacaccaggccctacgcatcctcccccttccaccaccatccatgatttcctgatttctagcagcaaatttagcttgagttggtcaacatagctgggctgcctgaccttcctctctgccatggaaccacagagcaagtcagcagttctccttcctaatcaaaaagcagcatggaggagaaggctcctttgccaccttcctttctgctttggatggtgcttttgcaatcatgaggagacaagcctggagatgaaaggaggcattctgaatatggtggagtggaagaagaagaaggcctgcctggggctttgattacatcaccaagtgatcaaaccaaccttaaattcttaaataaactgtaagtgtgcttttctttaaaccactgtgagttttcttttgcagtcataaagcaaccttaaaaattgtagtaggtacaataatgaaccccccaagatgtccatgtcccaatccctggaacctgtgaacatgttacattacatggcaagggggggattaaggttacagatggaagcagggttgctaatcaactgaacctgagatgtagagggagattatccttaattatccagacaggcccaatataatcccaaggatcttcataagtgagagatgcaggagaagccaagtcagagagagatttcaaaatattatgctgctggctttgaagatggagggaagggccatgggctaaggaatgcaggtgaccacttgaaactggaaaagtcaaggaacagacttccctagagtttctggaatgaacacagccttgttaacaccctgattttgagctcagtgagaccagtttcagacttctgacctctggaattgcaagatcataaatttcagttttaggccactaaacttgtggaaatttgtcagagaagcaatgggaaatgaacgtgcaggtgcattcacgcatccaactttaggctctggactcttcctcaagctccttccccaatccccatcctctccctctttattggcactcaatcttcacttccagaggatcctgccaaattcctgcccattccatatcggcatccaccctttcttgttagagtggacgtagggcaggctggctccacagctgtgcgccaggcagcagcccgtacccccctgctcggaggacccctactcttcagtgtcatgctctgaagtcccagttttgaaattcttggccaggcgcagtggcccacacctgtaatcccagcactttgggaggccaaggtgggcggatcactcgaagtcaagagtttgagaccagcctggccaatatggtgaaaccccgtctctactaaaaatacaaaaattagccaggcatggtggtgcatgcctgtaatcccagctactcagggaggctgaggcaggagaatcacttgaacccgggaggtggaggttgcagtgagccaagactgtgccactgcactccagcctgagcaacagagcgagactttgtttcaaaaaaaaataaaaaaagaaaaagaaattcttaaaaattttatctctgaagttgtgttttatagggaggtttaatgggaccaaggagcacccattgagggcttggagcctcagctcacacagggtcccacctcctgcctgcttccctgggacatctgccacctgcctgcttccctggtacaggctcctggccacctgctgctctgtccccagcacaccaggccctactcatcctccccattccaccaccatccatgaccattgctgccttctgcccttgaaggaggcctgggcacaggtgcaaaggatcatcaaggtcagtagctcacctcacgggaccttggggtggagcatggtgacagccattcctaccccagaggtatctgctgggcagccagaagccacaactcagcccacttctaatccaggaaccaagagtgaccatcttgatttctcagcccttttgttttttctttttgagacggagtctcgctcttgtcccctaggctggagtgcagtggctcaatctcggctcactgcaacctctgcctcccgagtacaagcaattctcctgcctcagcctcccaagtagctgggattgcaggcatgagccaccatgcccagctaattttttatttttagtagagacggggtttcaccatgttggccaggctggtctcaaactgctggactcaagtgatccgcccgccttggcctcccaaagtgctgggattacaagcgtgaaccaccgcgcctggccaaattatcagccctttttgaataagaagacctgcatttttattttgcacagtgcccctccaatgatgcagccattcctgatgcggggtcattccctctctcccaggctgagctctcttctccctctggaccctaaaacaccatcactcccctgtgtcttcacctgcctccctctgctggcctttcctcattgccacacatatctactcaagtctttccatcttcaaacagcccaagcttccctccaccccggctcctatttctctctcgccttctctcccccagccacagtgcttgtgctcaaaagctgtctcctctcttgggcttcacttccttcctctgcacccactcctctaccctctctgtgcagagtcggcctgactctgctactaaactactttcactgaagccagctccaccacccaagccaagtctcagtttcaatccctactactctgtggcactagcatctccctcactcctgaaactcggcccctcttggttctctgacactggctgtttgttcctgtccagtctctttttctttttttctgaggcagagtcttgctctatcacccaggctggagtgcagtggcgcagtctcagctcactacaacctccatctcccaggttcaaacgattctcctgcctcagcctcccaagtagctgggattacaggcacccaccaccaccacacctggataatttttttgtatttttagtagagacggggtttcaccatgttggccatgctggtcttgagctcttgatcttgtgattcgcctgcctcggtctcccaaagtgctgggattacaggcatgagccaccgcacctggctccagtctctttttccaaggtcttctcctctgccctctcttacacgttaggggtccgcagggcccatctggggccctccccatctcctctcctctttccacagagttaattacaaccttcactaaatctgtactggagtcgcatggatcaggaactgtgtggtccacagcccagcactgtgcttggcacatagagcatactcaataaacatttactaagtgaatgaatgaatgaatgaatgatgtcttctaaatatatctccccagctgagatctcttgcctgaactccagagttatacattcaactgcagttgggtatgtctcagtttccacatctcccacccaaacattttgcatgtcctagctagtagccattcctatctcgtgtgacatatgttattatatattgtatatattattaagtcttttatttcttatttctcaccaggtctcccatatctcccccaaagaaagtagactcatggtgggcagagatttcagtttggttggctcattgccttatcccagggcctagaacagtgcctggcacatagtaggtgctcaataaatacttcttggctgggcaccatggctcacgcctgtcatcccagcactttgggaggccaaggcaggtggactgcttgagcccaggagtttgagaccagcctgggcaacatggcaaaactccatctctacaaaaaatacaaaaagtagccaggcatggcggtgcataactgtagtctcatctactggggaggcttaggtgagaggatcgcttgagcccaggaggtcgaggttggagtgagccacgatcacgccactgcactccagcctgggcgacagagaccctgtctctaaataaatacacaaaaataagtaaataaataaatacttcttgaacagatgaatggatctccacagagacatccccacatctcagattcagtatatccaaacgagctctttctcatcctcgccaaacctcctccttctggttcctggttttgattgctaaagcaagagagcgggtgctcctcaattgactacctccttcctccctgcagaacttccggtactgtgagtctgtccctgggaccctgctctccagctcctctgttcagccatgtcagcctccctattgtaacccctgggtttatgccggtagtgtctttatcaaacactcccccatgccaggaccaggaccatctttgtgactgcgtccttccctgctccctggggtccctaagatgattttaggtggcatgtgggcatagtgagctgagaaaacaattcctttttcagttctctttctcttctccagattagcctaccacaggctgcagcatctagctggaagttaatcactcggttttggtttcaatgggcttgtttttacagttcccttctatttacagtaaaggatcctgatctttcatgtgtgatggtgacaatgtttcatttgacaataaagtgatttaaacaaagcgaggaggccaatatgaagaaaatgtaatga

SEQ ID NO: 289 - DNA, 115908 bp, Homo sapiens
tatttgaactgaggaaaattccactgagacagtaaacacttgaaagagtaaagagccaaatgctagtccactgggcactaaaaaggataaagattcaggccgggtgtggtggctcacacctgtaatcccggcactttggaaggccgaggtggacggatcacctgaggtcaggagttcgagaccagcctgaccatcatggagaaaacctgtctctactaaaaatacaaaattagctgggtgtgatgatgcgtgcctggaatcccagctactcgggaggctgaggcaggagaatcgcttgaacctgggagacagaggttgcggtgagcggagatcatgccattgtactacagcctggacaacaagagcaaaactctcgtctcaaaaaaagagaggataaagaatcaaactcgagtcaaccaaatccacaaagcagtgacaagtctaccacggtacctcttagagctacgcacatcttgttctaactccagttcccggcgctggcttcccccacagcatgtgtgaactttctcacacgcatccgctcctctccactcccaagttccaggactgtggtgatgcaatgagaatgagtgtgagaatggtggcaatgcaatgagtgtgaaacccacgtatcaaataccacgaatgcccgtgtcttcccatagttccctgtacacgattcggatccaatgcacagtcctacctgccttcccagctacacagtccccactgcacactcagcctcagccagcttggctcgtgggctttaccatagttttcagtgtccagcttccctacctttgcccaggtggatctctcctctgttcttcatggcttcgagggtcagcttacaggtgtctctctccttcatgaaggcctcctcaattgctgtcctcctccaaatgtccacacgataggatctgtaccatttagagaattcattgctttctccctcgctgtcacagttgggtacatatctgtcaagcaggaaaggccttcaacagtctgaccacaggacctgcatgaagtaggtagtcactgaggcttgtagaatgatgaacaaagaacgaatgaatgaaatttctaatcacccattagcctgtatacttgaagtgtctggggtagagtgactaagtgacttttatttttgtgtgtatattaatagaagattacttttttcttttttgagatggtgtctcactctgtcacccaggctggcgtgcagtggcacaatcatggctcactgcagccttgacctccttgggctgaggtgatcctcccacctcagcctcctgagtagctgagactacaggtacatactacacctggataatttttttttttttaagacagagtctcactctgtcggcaggctggagtgcagtggcacaatctcagctcactgtgacctctgtctcctgggttcaagtgattcccctgcctcaccttcctgagtagctgggactacaggcgcgcaccaccacgcctggctaatttgttgtattttagtagagacggggtttcatcatgttggccaggacagtctcgatctcctgaccccgtgatctgcctgcctcagcctcccaaagtgccgggattacaggcatgagtcatcacgcctggcccctgggtaatttttatgttttctgtacagacagggtttcgccgtgttgcccaggctggtctcaaactcctgggttcaagtgatctgcccaccttgcgctctcaaagtgctggggttacagctgtgagccactgtgcctggcccatagaagatttcaacagacgtaattccaccagagcagtaagttaaaattcgtctcctgaagtaacttactcatcaccaagactccaggtctgtgctgagtgcagcccattgacaaagtgtaaccagatgaacacacacactgatctcataattagcatctcacagggtgcggctcccacatcaccaccacctggagcacatgccgaaaaatgcggaggcccagatccaagccaagctagagcgtcagagccttcgggggtcggagcaaggagccagtgtgatctcggctcaccgcaatctctgcctcccgggttcaagtgattctcctgcctcagcctcccaagtagctgggactacaggtgcccaccaccacgcccggctaatttttgtattcttagtggagacgggttttcaccgtgttagccaggatggtctccatctcctgacctggtgatccgcccgcctcggcctcccaaagtgctgggattacaggcgtgcgccactgcgcccacctataatcttgataccaacagaaattgtatattcctgtcacattacagctaccgcaggtatctcaaaatataatgtaagctcatcaccactttggaagtagggtagttattagacctgctgctttaaggcattaataaagatatacaaacatctctatataaatttttaaaaacattctgattgttagatttcaatgtaattgatttttataaacttttattgtttaaaaataagctgatagacggttgggaaaacggggcaaaacaagcagaggaaaatgctaacagcagaaactaggtggtgggcagaccggtgttcactgtagaattcgacttttctgtatgtgtgaacattttcgtaatgcaacgtttgggaaaatacctgacaaggggttgctggaccaccaaaaggatctacagcccaccgaacagtcagaaacccctaacctagaggtactggtgtccttaaccagctagccaatccagtcagttcttcatccgggagccaaaagaccccaggcctgggtatcccaattccacttaggctggcagccttttgccagactaagaaatcaaaaaggtttgcagcaccaaagtgagccagtggtgttttctctcattcatcccagcactccaaccttagcctcagatctcacagctctaaagagaggaaagatcacgccgagaaaccaaagccaagagctcgaaaacgtctggcagttctgggaaggactagtccagacccccctctcggccctggacagaagatgaggcatccacagagaccacaccttcagtccccctgactactgtgcccccaggactgcaactggctgcggggtcctaggagatggttaaccaggaatctcggccagacgcggtggctcacgcctgtaatcccagcactttgggaggccgaggcaggtggatcacgaggtcaggagatcgagatcatcctggctaacacggtgaaaccctgtctctactaaaaatacaaaaaattagtcaggcttggtggcgggcgcctgtagtcccagctacttgagaggctgaggcaggagaatggcgtgaacccgggatgcggaacttgcagtgagccgagatcatgccactgcactccagcctgggtgacagagtgagactccgtctcaaaaaaaaaaaaaaaaaaaaaaacaccaggaatctcctcctcagggacagagggagggcaagggcagggcctctcccagaagcggaagggcaccgtggtcctgtcttctccctggtggtacttaggaagactgtttttcagacagaccaccaatgatgacggctgcttcctaatgcccaccacctcatctgtaagacttagctcccccactttggagagcacatggctctctaatcctattaaagtcaaatcacccttacttgcccaaaggctcagaagttcagaggtagaaatgcacctcttctaccccagaagcagggagcagctcagaaaaagctaatgagaaaataccagggtcatgttgtttgaactggacaagaaagaaaaagcatagaggaaaaaaaaaaaagtcatcttaattcatggaaaaatacatggccttgccaacagtcaaagaaaagtaaaactgaaactataattatatacccattaagcaaacaaattaagtaaaaatggagattccagaacaagttcacgctgctgataaccacataaagtggtccggtctttctggaaagcacttcggcactgcagagcaattacaaaaagtttttaattccactcttggaaaaagctaaaagggcttctttacaaattgtgattaattccccaaagattatgttagcccaagatgatacccttccctctattcccccacctgacccccagcatttagcagcagcatttagcttctgacatgcattccttgaaaacggtcacaaatggcagaagataccatcttatttatgcaacccccctcaaaaaaaaaaacctttgtacttagatataaatatatataaatacttagagatgcacagaatatggtttggttttctttcttttcttttttttgagacagagtcttgctctgtcacccaggctgtagtgcaatggcacaatcttggctcactgcaacatccccctcccgtgttcaagcgattctcctgcctcagcctcccaaggaggtgggattacaggcgcctgccacaacgccaggctaatttttgcatttttagtagagacagggtgtcaccatgttgggcaagctggtctcgaactcctgacctcaggtgatccacccacctcggcctcccaaagtgcccggctcagaatatgggtttggaaagatacacgttaaaccaggtcatctcagcctctgaggaagagcattgaatgaagcaaggttgcgacaaaggcaaattttcactttttactgatttcactatgagaaatgtacctattactcatgtactttacaaaatttgctcccactaataaaaaaacaaagcaagtcaaccgaagttgggaattgtcaatttaggtgcatcctcctgaactctgctattaggacgacgatgcttcctgaagtgattaagtttccctaagccaggcacagtggcacatgcccttagtcccagctactgcagatcacttgagctcaggagttcaagtccagcctgggtaacaaggtgagaccccagtctccaaaagtaaaagttaaaaaattttaatagccaggtgcagtggaggctcaagcctgtaatcccagcactttgggaggctgaggtgggtggatcacgaggtcaggagttcgagaccagcctaacatggtgaaaccccgtctctactaaaaatgcaaaaattagctgggcatggtggcgggtgcctgtagttccagctactcggggggctgaggcaggagaatcgcttgaacccaggaggcggagtttgcagtaagccgagatcatgctactgcaccccagcctgggcgaaagagcgagactctgtctcaaaaaacaaacaaagaaaaacaaaacaaaacaaacaaaaattaataaaatgaaagtttcccttgattccatatactgaatctgttcctagttcaagtaatggtaaaattctggtgccattataatataattatgactagaagacccagaaaatcttaaccaaatacccctccttgtaaatgtattagagatgtgcacagaataatgcagtagtgcagattatttaagactgcaggaggccgggcgtggcggctcacgcctggaatcccagcactttgggaagccgaggtgagcggatcacttgaagtcgggagttcaagaccagcctggtcaacatggtgaaacccagtctctactaaaaatacaaaaattagtttggtgtggtggcatgcacctgcagtcccagctactcaggaagctgaggcatgagaatcgattgaacctgggaggcggaggttgcagtgagccgagatcatgctactgcactccagcctgggagaaagagcaagactctatctcaaataaataaataaataaataaattaataaaatgaaagtttcccttgattccatatactgaatctgttcctagttcaagtaatggtaaaattctggtgccattataatataattatgactagaagacccagaaaatcttaaccaaaaacccctccttgtaaatgtattagagatgtgcacagaataatgcagtagtgcagattatttaagacagcaggaggccgggcgtggcaactcacgcctggaatcccagcactttgggaagccgaggtgagcggatcacttgaagtcgggagttcaagaccagcctggccgacatggtgaaaccccatctctactaaaaatacaaaagttagttgggcgtggcggcatgcacctgcagtcccagctaattaggaagctgaggcatgagaatcgattgaacccagaaggcggaggttgcaatgagccgagatcgcaccactgcactccagcatgaacgagagcgagaccctgtctcaaaaaaacaaaacaaaacaaaaaaaactgctgttccctccaataactgcatccaaagttcagcgggtcccagctcagtccttttctgggtagcagagtggccctatggcatgactcactgttcttggatctatgcaagctctaccatttcctgtcccaggcagagggtgaaaaggaaatgagaaaggcctagcacctaaaaggcagcttgtagaagaaagaccggctgggaaagtaccccatgtgctttctgttctcctttgccctggtacaggatagtgagtgcagattcgaataacctgtttctctcatgataccatctgaactttggagggatgaaaccaatgaaaccaagcaggtgtgaaaacctaaattggccacgttatttagacctcattcaattacgagaaaaggttactccacagggctgagcccagcactcattcttttttttttttttttttttttttttttttgagacggagtctcgctctgtcacccaggctggagtgcagtggcgcgatcttggctcactgcaagctctgcctcccgggttcaagcgattctcctgcctcagcctccagagtagctgggattacaggcacccaccaccacgcccagctaattttgtatttttaatgaagatggggtttctccatgttggtcaggctgctctcaagctcccgacctcaggtgatctgcccacgtcggcgcctcccgaagtgctgggattacaggcgtgagccactgcgcccggcctcattatttatttatttatttatttttttgagacagggtctcgctctgttgcccaggctggagtgcagtggcacgatctcgtctcactgcaaactctgccttctgggttcaagcgattctcatgcctcagcctcctgagtagctgggactacaggtgtatgccacagaccttggcccaagccatagcatatgaatttgtaaaatctaaccatgtcgcacttaaaagtgtcttcctcctcattaagtagttcctgatgtagttcccccgattacagctgccttgctctaacgccaattggatcagcacgactcagtaagtcaataacaaacaggcttcccagtgacgatggaagtggggtcttatttgcaattttaaaaagtataaaaagcaggggcttttatataatatgaaaacttggacacaactcctgagcacaacaggaaaataagtaagcaaacttacctgtgtgttttccctcaaaggcaaattccactgaaacaacccaagagttacaaggaaggggaaaagcctgtggcagcattggaaaacagagaacaatatcatcaagtgaccgatagcacagacggatttctgaacgaaatgaagatgatggaatcagatcaacagggaagcagatggtgcccaacagcctagtgatgtaacactggcaaggtacggggctccatgagaggtgaatgggctgctccaaccaagccctagaaactacccaaaggcagagcagccggggctgggataacaggcaggtgtgaggcaggcagaggagggccagaaaagccctcccattacaaccaggtacacggtttacttctcagagctctccacgtcctagtcaaagaagtaagggtagccaaaagtagaaatatcagaaagactccaaattgccattatttgcaaataaaattgtctccttagaaaaatcccaaagaatcaactaaagagtgatttaaaaacagtttggccgggcccggatttggctcatgcctgtaatcccagcactttgtgagcctgaggcgggtggatcacctgaggtcaggagttcgagaccagcctaacatggtgaaaccccatctctactaaaagtgcaaaaattagctgggcatggtggtgggtccctgtagtcccagctactcgggagggtgaggcaggagaattgctggaacccgggaggcggaggttgcagtgagcagagatcacaccactgcactccagcgtgggcgacagagtgagactccgtctccaaaaaaacaaaaccacagttcagtaaaatggccagataagataaacattcaaaaccaccaactgttctaagtgcaaactctaaacagtcgggggaaaaaacggtattttcacacagtagcaacaaaagcataataacaggtcaggcgcagtggctcacgccccaacactttcagaggctaaggcaggaggatcacttgaagccaggagtttgaaatcagcttggtcaacatagctagatcccatctctacaaaagaaaaattaaaaaatgagccgggcatagtggcttgcacctgtagtcccagctacgcaggaggctgaggcagaggacggcttgaacccaaaagttcaaggctgcagcaacctatgactgcatcactgccctccagcctgggcaacacagtgagacccccccaaaataaataaacaaataaaaatgcagctggaagtaagtctttataaattaagacccctttgaagaaaattataaaaccttgctgcagagtgtttttaaaaatctcagcattgccaggcgcggtggctcatgcctgtaatcccagcactttgggaggctgaggcaggtggatcacctgaagtcaggagtttgagaccagcctgaccaacatggagaaaccccatctctactaaaaatacaaaattagctgggcgtggtggcgcatgcctgtaatcccagttactcaggaggctgaggcaggagaatcgcttgaacccgggaggcggaggttgcggtgagccaagatcacaccattgcacaccagtctgggcagtaagagcaaaactctgtctcaaaaaaaaaaaataaagtaaaataaaaattaaaaaataaatcgcagcaagcggagtagaaaggaaatctataaagatatcaatgctcccaaacttaacctgtatgtttaaattaaaaccccaaagagtttcttctggaaatctgaaaaattgatacttaagaattatctgaaaggatacaatcgataatttttttttgagacagtcttgctcttttgcccaggctggagtgcaatggcgtgatcttggctcactgcaagctctgcctcccaggttcacgccattctcctgcctcagcctcccgagtagctgggactacaggcacctgccaccgcacccggctaattttttttatttttagtagagacggggtttcaccgtgttagccaggatggtctccatctcctgacctcgtgatccacctgcctcagcctctcagagtgctgggattacaggcgtgagccaccgcaccccgcctattttgtttttttctttttgagatggagtctcactctgttgctaggctggagtgcagtggcacgatctcggctcactgcaacctccgcctcccaggttcaaatgattctcctgcctcagcctcctgagtagctgggactacaggcacccgccaccatgcccagctaatttttgtatttttagtagagatggggtttcaccatgttggctaggatagtctcgatctcttgacctcgtgatctgcctgcctcagcctcccaaagtgctgggattacaggcgtgagccatcatgcccggccacaatctatcattttttaaaaataagaatgaaaacttgccctatcaggcaaaatgtactgcaaatcctaagtaatactgtatttccagattaaaggcactactgcaaagaaaagtgtaaatttatttaataccaaatgtttcctaagtttactttttgcacaatgcacagacacttttgggacaatgtatggttaaaaactaatattctaccaacagctccatgctgctctagatcatcctgaaggaaaaagtaatgcaaaggatgctgggtctccaagtcccaggactggctgatagcctctcccagtggatagcaggtcctaattctcttcttcgagcagattctctgatttcagctgggccttcctgatgctctccaagttcagttgttgatattttcttttaaaaaagccacactgaaacaaaggaaggaaaagtccagttacaggccaaagatagccatctgtttcagaaaaccggcattctggctgttgcctaaatagcccctatattcctctgcttctcatacttactactcccttctcctaacttactctgaatctctcctggagagtccaatccttcaagacctctggtgctcatccctcaatcagaactgactccaccttcctctgaaccctgctctcccgagcagctgaacctttttaacttattttgcaaagcatgataatttcggctgtactggatctaatcttatttatgcaaaaatactcagtatagcctatgatgctgaagacagaaggagatcaagtacagcttcctacatcaagctcatcatctagtaggaaaaagagataattacaacacagtgtgatgactgccatttggaagggtttctagaagggagctcacagcaaacacacagaagccagcacagaggactcaggagtctctagaccgctttcagggaagacagtgagtgaagtgagcagtcatggagggcattcctgacaagaaaagcagcctacgcgtacgcagaggcacgaacctatttagggaatagtttgacttgttgggagaaaaaagcaaggtcaggtgcttatgcctgtaaccccaccacttcgggaggccaagatgagaagatggctcgagccccggagtttgagaccagcctgggcaatatagggagacctcatctccacaaaattaaaattaaaaaattagctgggtgtggtggcatgcacctgagtaacagtcccagttactcaggagactaagatgggaggatcacctgagcctaggagtacgaggctgcagtgagcccttaactgtgccactgagctccagcttgggggacaaagaccctggtgtttatttttaaaaaagaggctgggagtggtggttcatgactgtaatcccagaactttgggaggccgaggcgggaggatcacaaggtcaggagtttgagaccagcctggccaatatggtgaaaccccgtctctactaaaaatacaaaacaattagccaggcatggtggcacattcctgtaatcccagctactcaggaggctgaggcaggagaatctcttgaacccggggtcagggtggggggaagggaaggttgcagtgagccgagatcgcaccaccgcactcaagcctgggcgaaagagcggaactccgtctcaaaaaaaaaaaagaaaaaaaagcaacacttaagggcagagacgggtagcggacagagaggagaggatcttaaatagcagtagaagagtttgcacattaagacaggggaaggcaaggaaaagatttcaacaggggaacaacagtcacatctgttttaaggccttaccgttaaggcctcttccaagtaagttataaatgctggcctagggttgaccttccaggccctattgaactcacaggtaaccgaacataacagtattaagttctgggccttgagaatagggaggtaccaaagaaatatatataaaatcactctttataactcagagttttctcttttcagacagatactgttttactcatttgtctaaatgggggtgtgcagttgaaggaggagaaaaaagtggccacgaggccagggcagctgctctaagtcagaggttggctgtcctaaggagttctgtgcccaaaactagagcccagtcttccctcactgtgatgccatgagtagaactgaccttgaacaggatgaccagaatcacgatcaacaccagaagtccaccaacgctgcctttaatgatgataggcaaagaatggtacttctcatctttcaggaagacgacagtgatctagacaagacaaagagatcgcccaataaatcaggtgaagcaaacaaggaaaaaatcctacatgttattttaaggagcaaaatacgaggacttggcaacaacccgtgtattgatcaaagctgatgacagtaaagcaaaaagctagatattccctgatgcagcattttagatcatctaaaactatccaatcacccaaatacttcgtaagaaactattctggccccttatctagaagggctaggtctgtcaggagattatgaccttctgttaaagatgctctgacagcttgaaagagggtcccacggaatccggtctcaacacaggactgtgaggctgtcacgccgctacactgctctatgtccctgagccccgtgcctatgctctttaaaatgatgacttcctttaaatgatctccaagtcctttccaactccgttctgacggctctttttgatcttgcacagatccctaaaggctttggtaatacactttccccacataaaatatgacaaaagtactggtcttcccctcaccagactaaaaagtgtgtattacctaagggacataataaatgcaaattatatccatgtgtactacttgcagagctcagctattagaagtcatccgcaggttttgttttccaaaggctctcccaatttcgggagtctaatctctcttctggcagggctcagctagaaagttcaggagatgtccttcctgagacccaggtatggcccttccaagttgtggccagaggaagttcccaggacttaggtggggccagagagccaacaagacttctctgcctgcccagagcaacccttcacgtgtatgtttaagcaccaaggtcaggggtgctttggagaggtttctgtacggggtgaagggctggacaaacttacctttaaggcctcttccaattaagttataaatgctggttgacctaaagttgaccttccagtcctatttagctcataggtagctgaactaaataggagtgaagtcctaggctttgagaatagggaggtaccatagcaacaaagagggaggaagaacagaaagagggctggaatattctacaggagaaggagggggactcaagaccctgggtttgggaagtgaaaggaagtcccaaggtgactcgggaaacaggccagatgtgagtagaagaaatgtccctatttctcaaagccacctccctttatcttcttctaaacccacagattcccaaaagtgccccaaagatgcccaagtagaggttaagggagaagcaaggcaccgggtactactgtttgcagcaaacacggatgctggcctgcccaggggcccctctctccttttggattttattcaggaatcatcgttggtctcaggtgatcatgacacagctattctcctttgccagtgactgacatgagattcagatctcactaataagatgtaagaggatgtctcctgggagcttttggaaactgtttcatccctgaaaagggaaggcacatgaagaaaaatccaacatccttttgctactgacttcttgcttcctgttttgtatcctgccatgtgaaaatacagcatttggagatgtggcaactttgtgctggccatgaaggaatgcgtcccccacacggcagagtacaaggaccaaagaagccaggccatcgccccaggccggcctccctcactggataaacagcatatgcccttatgctgcatgagctggattttccctttcttgtggctgaaatgcatttggatacagtttgtttatactcatagagtcactgtaagtcaggggcttattgtcaggaactacttaacactttgcttaggatattggatttaaagaaaggaattttggggaatccatgctatagaaataaaagtatcagtaagtaagagggggaaacatacaaatttaaaatgtgcacataagaaacttaatagtaactcctccctgctgggggcatgggaagggagaaatgaaggaacaattatttttcatttggtaccattctctgtatggcttggattttcttgctattatttttatttgttaaaatctgggcagtgcaataatggggcacttctatttcttccgttttctgtattttccatttccctctattttctgtattagaaatacactacttagccggacatggtggctcatgcctgtaatcccagcactttgggaggtcaaggcgggcagatcacctgaggtcagaagttcgagaccagcctggccaacatggtgaaatcctgtctctatttaaaaaaaataaataaattagccaggcatggtggtgggcacctgtaatcccagctactcgggaggctgaggaagaagaatcacttgaactggggaggtggaggttgcagtgagccgagatggcaccaacggactccagcctgggcgacacagtgagattcttcctcaaaaaaaaaaaaaaaaaaaaagaaaagaaaagaaaaagaaatacactacttaaaaataaaaggaaatgttatattggcatgtctagagaattgctcctttctcctcctccagggaggaaaacagaggaccttatatttagcaatccagcatcactctcctgacattccctctagtagagaatcatgcctaactaaagagctcagagctcacagatagatcacctctgaagccatgtccaggcaagggtcaacaagaatgaaaacacagggtaacacacaaagcattcagtccacaaatcacaggcatcagtctgacttctagtcatacttttgcaaaaagaattccaagagttccagtatctagtctaaatcttataaaagatttatgcattcctgagtactgtttaatactataactaaacactgatacagcacactaagacagttactggatacaaaaaacaatttctcacttaggtaattcattttttatttatttatttattttttgagactgagtctcactctatcactgaggctggagtggagtggtgtgatctcggctcactgcaacctctgcctcccagattcaagcgattctcgtgcctcagcctcccaagtaggtgggattacaggcacccaccatcatgtccggctaatttttgtatttttggtagacagggtttctccatgttggccaggcttgtgttgaacttctgacctcaggtgatccacctgtctcggcctcccaaagtgctaggattacaggcgtgagccacctgcgcccagctgcgaaatttttttttttaatcaatccattttcaaatcaaagtatatactgcagattccagcctagttatttcaactcagaactcctcagcttaggcctcttaattgccttatttcataagaagctgactcactcaaaggtcacaaaggcagcgatggcagagccaagatcagaagtgttaaggctgaaaacaggaagagggcaacagaatgtctgtggaggtgctcaaaggttaggcacaattttccttgggcactactcagaagccagccaggaattaccttagttctgtggttctctgcattcagtccctcatatagagatttgttgaaagatatttcaccaaggatctgcagttcagttacatcttttagtaactagaagatggggaaaggaatgagggaaacaaaacatattttagacatgaactcactgtgtttgaacagccttcaccacctttccctttaaaggtattcctgggcttagttaatggccctaacgtacacaacactacataaagttacccaaacaagacatctgcagttattcttcaacttcctttttttttttttttgagatggagtttcgctctttcgcccaggctggagtgaagtggtgcgatctcggctcactgcaacctccaccccgtcaggttcaagcgattctcctgccttagcctcccgagtagctggaattatgggcatgtgccaccatgccaggctaatttttgtatttttagtagagatggggttttgccatgttggccaggcttgtctcgaactcctgacctcagatgatctacccacctcggcctcccaaagtgctgggattacaggcgtgagctgccgcgcctggccttttcttcaacttcttttcccttgtgccatccaaagtcagttcttgactgactgacttatttttgagacaggatctcgctctgtcacccatgctggagtgcaatggcatgatcatgggtcactatagcctcaaccttccaggctcaagtgatcctcccacctcagtctcctgagtagctgagaccacaggtgcaccccaccacactgggctaatttttgtattttttgtagagatggggttttaccatgttgcccaggctggtctcaaactcctgggctcaagcaatccacccaccttagcctcccacagtgctgagattacaggcatgagccaccacacccagcttattcattttatttaacgtaagagatttttcctttttttttttttttttttttttttttttgagacaaggtctcactctgttactcgggccggaatggagtggctcaatcatagctcactgaagcttcaaattcctgggctcaaacgatactcctgcctcagcctcccaagtagctgggactacaggcatgagccaccatgcgtggctaatttatgtatttatttatttttaagaaatggggtttcactatgctgcccaggctgatcttgaactcctggcctcaagcaatcctcccgcctcagcctcccaaagtgttgggatgacagatgtgagccaccacactcacaattctttttttttaaattatttcttgtatctgtccctttcttttccacccccattgctacttcttcagttgagacctcacaaatgtcacctggatcactgtaaaacattaaacttgatcacttgatcactagttcccactttagaataagtgatcagggaaggcctctctaagaaaataacacgtgtggccgggtgtggtggctcatgcctgtaatcccagcacttcgggaggctgaggtgggtagatcatctgaggtcaggagttcaagaccagcctgaccaacacgatgaaaccccatctctactaaaaatacaaaattagccgggcgtggtggctcacgcctgtaatcccagcactttgggaggccaaggagggcggatcacctgaggtcaggagttcaagaccagcctcaccaacatggagaaaccccatctctactaaaaatacaaaattagccgggtatggtggcgcatacctgtaatcccagctacttgggaggctgaggcaggagaatcgcttgaacccgggaggcggaggttgcagtgagccgagatcgtgccattgcacaacaagagcgaaactccgtcttgaaagaaagaaaagaaaagaaaagaacacctaggtcgggtgcggtggctcacgcctgtaatcccagcactttgggaggctgaggcgggcgatcacctgaggtcaggagttcgagaccagcctggccaacatggtgaaaccccctctctactaaaaatacaaaaattagctgggcgtggtcgccggcgcctgtaatcccagctactcgggaggctgaggcaggagaatcacttgaacccgggaggcggaggttgcagtgagtagagatcgtgccactgcactccagcccgggtgacagagcaagactccatctaaaaaaaaaaaaaaaaaaaagaaaagaacacctgagctaaatttaagaagaaaccacctacgtcaggacctagaggaagagcagtgtcaagcaaaggaacagcaagtacaaagtcttgtggccagaataatgctgtactggcgagctagaagaataggacagaataacccgattataaaaggggcagtgggagagaaaggcgagtactaggagatgaagttgaagaattaagcagagaccagatcaagtactgccttgctctggccatgaaaaaagtatggattttagtctaagtgtgctcaagcatcagttttgtttgtttgttatttttaataagcaggggaatggcacaatctaatgtctgctcttagaagacggatagctgttacgtgggaattatttgtaaagaatgtgggaaaagcagaggcaagaaaggcaggccgaaggttattgcaacagccctggcaagaaagggtagcttgaattacaacggcagtggaaatggagagaagtgaatgggtttaggatatattttggccctgaaatggcagggcttgctgctggaatagacgtggggatgtaggaaagaggagtcacaggtaatccctcgagttccttgtactgtaactggagtatatctccctcctgagggtagctaaggaacgggttgggacagagggttggttttttgcaccaaaagatctattttggacatggacatgttatgcaaagatgctattatctcttctaggggcgatgcccgtgagcaactggataatcaaatctggagcatttcagtctcaaacacctcctcagagtgatcccaggagatctctgcagccacggtgacattttctttatctgaagcgatgacacagctcactgaatgccattcttccacatgctggaaaagcgaggtctagtgaacacaattcctttccgtgcggaaagtctgaaatctttttaacacttcggacacagagcatcgtaaggtcccagaatagagggtgtgagcaatttcagcgctcacctcggcccaagcgaagctccagcgggagcaattgagacccagggacgaagctagggagggcctggcagcccccggcactggccggcaggggtaacccaggaaaaacagtctcctggcctctcgttacccgcttcaggccctccgccctcccctggcctctcgggacggccgcgcttacctgaaccgaactgtacgcacaagcgcgctcctgactccaggtgcacaccgtggaggcctgaaacgagagccatgaccgcgacgcgctgaacaaaccaagccgccagttttccgtcccgtcccggccccggccctggcgaggtgcgcatgcgcagggccgggagctaggaccccgcggcaggcgggcgcgtccgcgtcgcacggaagtctcgcgatgtttgcgtttgaacctcttggcgggtgccggccatggcggcttcgctcccgggacctgggagccggcttttccgcacatatggggctgcggacggcaggagacagcggcggccgggccgggaagccgcgcagtggttcccgccgcaggaccggaggcgtttcttcaacagcagcggcagcagcgacgccagcatcggcgacccctcgcagtccgacgatcctgacgatcccgacgaccccgacttccccggcagcccggtgaggcggcggcggaggcgtcccggcggccgagtgcccaaggaccggcccagcctgaccgtgaccccaaagcgctggaagctgcgagctcgcccaagcctaaccgtgaccccaagacgcctggggctgcgagctcggcccccgcagaagtgcagcacaccctgcggcccgctccgacttccgcccttccccagccgcgactccggccgcctcagcccggacctcagcgtgtgcggccagcccagggacggcgacgagctgggcatcagtgcctccctgttcagctctctggcctcgccctgccccgggtccccaacgccaagggacagtgtcatctcgatcggcacctccgcctgtctggttgcagcctcagccgtcccgagcggcctccacctcccagaagtctccctggaccgagcatctctcccctgctcccaggaggaagcgacaggaggagccaaggacaccaggatggtccaccaaacccgcgccagcctcaggtcagttctctttggccttatgaactcaggaacccctgaggattctgagtttcgggcagatgggaagaatatgagagagtcctgctgtaaaaggaaactggtggtgggaaatggaccagagggtccaggtctgtcaagcacaggcaagaggagggccacaggccaggactcttgtcaagagagagggcttcaagaggccgtccggagagagcatcaggaggccagtgttcccaagggccgcattgtgccaaggggaatagacaggctggagagaactagatcaagccggaagagcaaacatcaggaggcaacggaaacctctctcctccattcccaccgctttaaaaagggccaaaagctgggaaaagattcgttccccacccaggacctgactcctttacagaatgtctgcttttggaccaaaaccagggcttccttcagtttccacaagaagaaaattgtgactgatgtgtcagaggtctgcagcatctataccactgccacttctctctctggatccctcctatcagaatgttcaaaccggcctgtcatgaacagaacaagtggtgctccgtcctcttggcactcctcctctatgtatttgctaagccccttaaacactctaagtatttcaaacaaaaaggcatctgatgctgaaaaggtttatggggaatgcagtcagaagggtcctgtcccctttagccattgccttcccacagaaaaactgcaacgctgtgagaagattggggaaggggtgtttggcgaagtgtttcaaacaattgctgatcacacacccgtagccataaaaatcattgctattgaaggaccagatttagtcaatggatcccatcagaaaacctttgaggaaatcctgccagagatcatcatctccaaagagttgagcctcttatccggtgaagtgtgcaaccgcacagaaggctttatcgggctgaactcagtgcactgtgtccagggatcttaccctcccttgctcctcaaagcctgggatcactataattcaaccaaaggctctgcaaatgaccggcctgatttttttaaagacgaccagctcttcattgtgctggaatttgagtttggagggattgacttagagcaaatgcgaaccaagttgtcttccttggctactgcaaagagcattctacaccagctcacagcctccctcgcagtggcagaggcatcactgcgctttgagcaccgagacttacactgggggaacgtgctcttaaagaaaaccagcctcaaaaaactccactacaccctcaatgggaagagcagcactatccccagctgtgggttgcaagtgagcatcattgactacaccctgtcgcgcttggaacgggatgggattgtggttttctgtgacgtttccatggatgaggacctgtttaccggtgacggtgactaccagtttgacatctacaggctcatgaagaaggagaataacaaccgctggggtgaatatcacccttatagtaatgtgctctggttacattacctgacagacaagatgctgaaacaaatgaccttcaagactaaatgtaacactcctgccatgaagcaaattaagagaaaaatccaggagttccacaggacaatgctgaacttcagctctgccactgacttgctctgccagcacagtctgtttaagtaagctaaatgtatcttactgccccgaaatgagaggagactggtcttgaagcctctggtgctgtttcaacctccatccccacaggagggtggaactcccattctcacaggtttccagtcagcttttcaaacaagaattttgtttccaaatggaaactgaaatatttgttgaaatgtttaaatttgctgataacaaatgttctgaaagaagtaaactagccgggcacagtggcgtgcgcctgtagtcccagctactcgggaggctgaggcaggaggatcgcttgagcccaagagttcatatctagcctggtcaacatagcaagacccctgtctctatttttttaaataaataaactacatgtgaaaacaaacgtttatatttataaaccctcttttttttttttttaattttattgagacagagtcttgctctgtcacccaggctagagtgcagtggtgcgatctcagctcactgcaacctccgcctcccgggttcaagcaattctcctacctcagcctcccgagtagctgggattgcaggcatacaccaccatgcccggctaattgtttgtatttttttagtagagatgggggtttcaccatgttggccaggctggtctcgaactcctcaccttgtgatccacccacctcggcatcccaaagtgctgggtgattacaggagtgagccatggcacctgacctataagccctctttctaattgtcagcagagtcctttctgtaaattcctttccgttttttgagccttaacacttatgtagtctgagcaaaaaaaaaatgcccaggcttcagcttcatactgagcagagcctgttgcttcaggtatcaaggctagctttgggaaccagactacagatgagacaactgaaagcaaagaggctgaggcaaagcagagaccaaaaaagagtctcaggggagaagaagggaagctagtaagcaacttatagggggcagtgtaagaaatgtcacatgttacatcgctcacacagagaagcagaatttatcaattttcaaagggaaaatgtctctgtctactgacaaggttttaatttttgcttttttttttttttgagatggagtctcactctgtctcccaggctggagtgcagtggcaggatctcggctcactgcaagctccgcctcccgggctcacaccattctcctgcctcagcctcccaagtagctgggactacaggcgcccgccaccacgcccggagaattttttgtatttttagtagagacggggtttcaccgtgttagccaggatggtctcgatctgctgaccttgtgatccacccgcctcggcctcccaaagtgctgggattacaggtgtgagccaccgcacctggccaatttttgcttatttttcctcaaagggaggaaaactgacaggttgctttaagagctgagtgattgagagtccttctgaacaggacttcgggaatttactcctaatcttttcccatggttaacttgtcttcactctgtttctagaactctggtttttatacttgagactctgtagtcactgtggaaagaggtgtgactgataaagaactgcctttaaatacctgagtcctcgtcagcttcttcactgctacaacctggagacctcgtaatttggttgggacgcaaatttgcaactggtattctgctccaaagaggttctccccatgtacctgcaaattaaaatcagagtaggaaatcaaagctggtattgctttgccatctacagctttacaataataagtacttacatggaagaggaattctttgtggtgagaaagcccctggcctgtgttcacgtacattatggatggtctgcaattgacaggacatgcgtcagcccttgaggagtctttctcccttttttggagacagggtctcactctgttgcccaggctagagcacagtggaacaatcatggctcagtgtagcctcaacctcccaggctcaagtgatcctccacctcagcctgggaaagtgttgggatgacaggcatgagccactacactcatccctttttttttttttttttttttttgaggtggagtcttgctctgttgcccaggctggagtgcagtggtgcgatctcagctcactgcaacctctgcctcctgggtttaagtgattctcctgcctaagcccccaagtagctgagattacaggcgcctgccaccacacctggctaattttcatattttcagtagagacggggtttcgccatgttagccaggctggtcttgaactcctgacctcaggtgatccacccacctcagcctcccaaagtgctgggatgacaggcgtgagccaccgcacctggccttctctttttgaatgaactcgactgctttcaactgaatacattaggacagagggcaccagacctttaccaggaatgaggccgggtgcagtggttcatgcctatcatcccagcactttgggaggccgaggcaggcggatcacctgaggccaggagttcaagaccagcctggccaacatggtgaaatccccgtctctattaaaaattttttaaaaattagctgggcctggtggtgtccacctgtagtctcaactactcgggaggctgaggcaggagaatcgcttgaacctgggcggcagaggttgcagtgagccgagatggcaccactgcactccagcctgggcgacagagtgagacttcgtctcagtttaaaaaaaaaaaaaaaaggaataaaagctgaatgtcaaaatataaagtggtcgtagcgcagttggggtgaggtggaatatttgaattctgtatcgttgggctggttcattttctaattatccctcaaatggccttactcatcccctccttacttcccagtcccacagctgccttcttccctccacagcgtcatattaattcccttttgtagcacgactagttggcaatacacctcctttgatgaccacagtggggtttctgtgacccaaatgttagcaccctagagatcaatatcagagcctgggttctaagcaggctcctctcagaaggacagtgtccacattcatcctgaccaccagctccatctacgagagagagcccaaagctgccccctgggcgatggagtcacaccgctgctggcctcttgggagtactcacttggacagaactgcaacgaagccatgcctgaattgaagggtgtgggtctcgttggccaaagaccgtctttcattggaactaggaataagagtgttagttcatagcacacctgctttgtacatagcaagtgcttcttaaaaagggcttcgctctgttgcccaggcaggagtgcagtgttgccgtctcagctcactgcaacctccgccccccgggttcaagcaattctcatgcctcagcctcctgagtagctggaattacaggcgtgagccaccatacccagttaatttttgtatttttagtagagatggggtttcaccatgttggccaggctggtctcgaactcctgacctcaagtgatctgcctgccttggcctcccaaagtgctgggattacaggcgtgagccactgcgcctggctatttttttaagttccagggtacatgtgcagatgtgcaggtttgttacataggtgaacgtgtgccatggtgctttgctgcagctgtcaacccagcacctagttactaagcccaacacgcattagctattcttcctgaagctctccccaaccctgcccctcccacaggccccagtgtgtgctgttcccctccctgtgtccatgtgctctcactgcagaacaggtgcttctgcacctggctccccagggtcactgggagtcagataagaaaaggctctcagaggctgggcgcggtggctcatgcctgtaatcccagtgctttgggaggccaaggctggtggatcacgaggtcaggagttcaagaccagcttggccaagatggtgaaaccccatctctactaaaactacaaaaattagctgggcgtggtggcgggcgcctgtaatcccagctactcgggaggctgaggcagagaactgcttgaacctggaggcagaggttgcagtgagccgagatcacgccacagcactccagcctgggcgacagagcgagactctgtctcaaaaaataaataaataaataaaaggctttcagagataagcaattggagttcagaattgtctctagaagaccacacttagaagaatactgattttaaaagggcttctcagcctccacactattgacgttttgggccagttagttcttggttgtgggggctgtcctgtactgctctgcgtgatgtttggcagtattcctggcctctacccaccagatgtcctactgaacacccccctccccaagtcatggcaatcaaaacaggcacagcctctggtgggcagaatcacctccctttgagaactcttcccagcagcgttccccaccttaccccccaacacagaggtcttgcaggtaacatagctatcccaagctattccaaagctgagtgaacgagaaccagaactccagggctcattccaccaggctgtaccacagttttactttgtgtgtgaacaaaagaacattttcattatctctggtaacaagaagagaaagtcgagtccctgcagggaaacagatgccttctgtgggctcactggggtttcctttctccctgggctgtaagggggccgttcctctcacagcgtgcatgtggcagggagatgtcttccggggtcatagcctgactctgctgtgacccaggcagtacttacttggtgacagtcacagtgatgtctgctgtcctgtttggaaaggcattctcctctagctgccaaacgactgaaacatgagcctattttaaagggggaaaaatggtcagttgattctctctatgccactcacaattcagaccgctagctactcgtggaacagacctaggagacgattcctcagattttcacattcctcacatttttctaacacagcatgtttcctttcccttccttttttttttttttttttttttttgagagggagtctcgctctgtcacccaggatggagtgcaatggtgtgatctcagctcactgcaacctctgcctcccaggttcaagcaattctcctgcctcagcctcccaagtagctgggattacaggcacgcaccaccacgcccagctaatttttgtattcttagtagagacggggtttcaccatgttggccaggctggtctcgaactcctgacctcaaatgatccacccacctcggtctcccaaagtgctgggattacaggcatgagccaccgcgcctggccccgttatttcagttaagcctcaaatacaaatatggagtaagcaaggcaggcggcctcattccccttttacaggtgaagaagccacttcagagatttcccacagcacagagatgacaagggacagatcagggttaataacttttcgtcttggccgggcatggtggctcatgcctgtcatcccagcactttgggaggtcgaggcaggtggatcacttgaggacaggagtttgagaccagcctggccaacatggtgaaaccccatctctaccaaaaatattttaaaaattagccgggtgtagtgctgcacgcctgtaatcccagctactcaggaggctgaggaaggagaatcacttgaacccgggaggcggaggttgcagtgagctgagactgtgccactgcactccagcctgggtgacagaatgaaactccatctcaaaaacaaacaaacaaaaaaactttttgtctgacacgccctccatactacccacaacttcactctgcttcacggaggtgagcaggcagttcacctagggctgtgtactggaaagctctcgtccccatcaccccctactttcagagccagcttagccactgtaagcactgctggggacacactgcagtcaagcgaagcgcaaagctggaaccgagagattgagatgagaccaagatgcagaagacgccaactgcagggtggtgagaagagcgaatcagtccaaaccgactcacagatgacctcttgaggacggggtgaccaatcctgcagttcatgatcaggacagaagcaaccggctgagggtcatcacactgaatgtttggagagggaggctgttaaaagagcagatgacattctcttaaagagccaaacaaaacaaaacaaaaacgtggtttcctcacagcaattcagcaaacattcactaatttttctgcctgtcagacaccctgccaggagctaaagaaataaagtccacttggtccctgtcttcctcacaagccggacaggcagggtcagcagtagatccccgaggaatttaaatacaaggtcgaaggggtgcttctgtgagggagctgcagagaacagcagtggagaaatatgaattccaactcggaggaattcgtaaggtcttcctggggaaggaggcatttgagctgggccatggactgatgcaaatataacccacagcctggctggaaggccggcacacaccagcactgccacgtagccaccagggctccccacctggacccccgaggggcaggtgatgactgcagtgagttttcttaattctcccagggacggtccatccctagttcccctctagatgcctaggagattgttttttgcttttgttttcatttttttgagatggagtttcactctttcgcccaagctgcagtgaagtggcgcgatctcggctcactgcaacctccacctcccgggttcaagcaattctcctgcctcagtctcccaagtagctgggattataggtgcccaccaccacgcccggctaattttttgtatttttaatagaaacagggtttcaccatgttagccaggctggtctcgaactcctgacctcaagtgatccacccacttcagcctcccaaagtgatgggattacagccgtgagccacggtgcccggcctaggagattgcttcattcatataatggatactgtcctagcccaaatagcctaagatgaccggggacaaatctacagtccaacaaattcaaatttattgactcactgcaatgaggaaaactacactttggttttgtttgtttgtttgtttgtttttgagacagagtcctgctctgttgcccaggctggagtgcagtggcgcaatctcagctcactccaatctccacctccgggttcaagtgattctcgtgcctcagcctcccgagtagctgggattacaggtgtacatcaccacacctggctaatttttgtatttttagtagagacggggttttgccatgttggccaggctggtctcgaactcctgacctcaggtgatccgcccgcctcggcctcccaaagtgctgggattacaggcatgggccactgcacccatccaaaaactacactattgtgtgtatcactgaacaatggaaaaggcggttattaaaggactccagggaagggtggagttcagatgaaatgtaaataaagtcctgttttgatggtaaagcagggctgagtgtcaaggagtcagtcaccagcaggccagcctgtgaatcagacccagggcccgcttcctgggaaaccattaatatggagtagaaagttgacagacactgtatctgaagctctctacctcaggtggaaacagactcttctcttggtcaaaatgacttacactctccaggcaagagggataggggttcataattaccgacgtaactacttcaaacagcaaagttttctttcttgttttttcttttgagacagactcttgctctgtggcccaggctggagtgcagtggcgcaatctcggctcactgcaagctccgcctcccgggttcacgccattctcctgcctcagcctcccgagtagctgggactacaggcacccgccatcgcgcccagctaatttttttttgtatttttagtagagacggggtttcaccgtgttagccaggatggtctcgatctcctgacctcgtgatccgcccgtctcggcctcccaaagtgctgggattacaggtgtgagccaccgttcccggcccaaagttttctgatctgtgattttagagaataaaatttctcagtgcagtgatacttgtcagccacagggtgtcctcgggaaacagactgtttcctagtatctgtgtctgtatccagccttgggaatggcagggcagattttcactttcccagtctaagctaatttttactttctcagtgtcttagggcattagactcacttctctctcagaaccctggtgaagaaagggccgcacatagggagggtggcactgcagcagaatatggtgcctcgggaggcatggagccggactggcggggatttatctagttattaaccatctgttggttggaccaggaggaggctggaggcaggggtgccagtgagggggccaccacagaaaagcaggcatgcagcgagggaggggcgtgagggacctgtttccacagccaccgtcacagtcaccttttgcatcctcttcaactgcaggtttctggggtaattcaaggccatgcttgtcatgtaggaatcttccccggagttagttaggttaatgttcagggtcagctcctttgtgagacccaccaccaactcctgcctgcacagggtacagataaaaatgttacagtttatttcatctgtaaaaacctcaacgcaatacaataggacattcaccgaggctagagcgtggtgctgtggtgcaatgatcacggctcaccgcagcctccacttcctgggttcaagtgatcctcccacctcagcctcccgagtagctgggactacaggtgtttaccaccatgcccagctaatatttttcttatttttatttttttgagacggagtttcgttcttgttgcccaggctggagtgcaatggcacgatctcggctcactgcaacctccacctcccaggttcaagcaattctcccgtctcagcctcctgagtagctgggattacaggcacgcgccaccatgcctggctaattttgtatttttattagggacggggtttctccacgttggtcaggctggtctcgaactcctgacctcaggtgatccgcctgcctcggcctcccaaagtgctgggattacaggcgtgagccacccagcctggccaatgtgcagctaatttttgtattttttgtagagacagggtctcgccatgtggaggcgggtcttgaactcctgggctcaagtgatccacctgccttggcctcccacagtgctgggattacaggtgtaagccaccgcacacagcccagaatagcaccttcttaagtaacttcttagataagttgcctaaggaatacgtttagcttagacattcttcctctcaacataagcaaacagctggactgccacgcccatctcagttgttgcatgagatgacgataatagctgccctttatttagtgcttaccatgtgccaaggactgcgtctcacacgctcaaccctcatagtaaccctgtgaaatagtacagctactctccattttatagaagaggaaacagaagccaagacaggctaattacctgtcatcccaacactttgggaggccgaggcgggtagatcacctgaggtcaggagttcaagaccagcctggccaagatggtgaaaccccgtctctactaaaaatacaaaaagtagccgggtgtggtggcaggtgcctgtaatcccagctactcgggaggctgagacagagaattgcttgaacccggtagggggagtttgcagagggctgagatcacgccactatactccagcctgggtgacagcatgagactccatctcaaaaaaagaaaaaaaaaattagccaggtgtggtgcaggcacttgtaatcccagctattcaggaggctgaggcaggagaattgcttgagcccgggaggcagaggttgcagtgagccatgagcacactattgcactccagcctgggcaacaagagtgaaactctgtctcaaaataaataaataaataaataaaaggctaattaaatgcctggagtctagtagtccaaagaattgagagaattgtacccaaatcctctttctaccaccaattcactgtgaccctaggtgaggtactctatgacacaaattcatccatgccacaatatttatggggcactgctgtgcactggagaacagtgtgcataagacatactgtcctaccccgtttcttggcctcagcttcctacccacaaaatcattcagacccttcccattaaaaggctgtggtttaagacatgggtccacatgtcctggaaaagagggtcctggggatgtgtgaaagggtcctccagaatgctgaggtatcacagggacccagagtgcagaaccactctcagtagctgagattgacagaaaaacatattagcaataccgagaaaactgttttccatctgaaatgtccaaagatgagatgtgcagatctaggaagtatggcctcccaaagtgctgggattacaggcgtgagccaccacgcccggcctaggaagtaatgtgaggtgtgttttgttcccattgtttggttttggtttggtttttatcccagctgagaagaggctggattgactggagggagagacaggaagcagagacagagcctgctgtctccacccgagagatgatacatgcctgaaataaggaaacagtagtggatgcctggacacggtggctcacgcctgtaatcccagcactttgggaggtgaggcaggtggatcacttgaggccaagagttcaagaccagcctggccaacatggtaaaaccccgtctctactaaaaatacaaaaattagctgagtgtggtcacgtgcgcctgtgatcccagctacacaggaggctgaggcaggagaagcacttgaagccgggaggcggaggttgcagtgagccaagatcgcgccactgcactcctgcctgggtgacagagtgagaccctgtctcaaaagaagaagaagaagaaaaaagacaacagtagtggagaaggaaagaagtcagagacagtaaagcaaatgaaacgaaaaagaggcaggggaggggggacagaggagttaagggcaagttctgagtttctagctcaggtggctgagtggtgccggtggctgagtggtgccggtggctgagtggtgccattgactgagggaggtaacatgggaggaagacccaagggtggaagaagatgcgttcaatcggggacatgacaagaggtgcatataggataacaaagcagagatgctgacatgtcagctggacacacatcttagagctcaggcgtgagacctcagtgtcatcagaatattaacagcgttgcctaatctgaggcctagggaccgtctcagagggcccggaatgccaaaatttatgtatgcacatgtgatcttctaaggagaggggtctgtagtcttcattagattcttttggggatctatgtcctcaggtcaaaaaccactgagacagctggacaccgacgaccaggctcactagcgtttttgaaagagaagcgtttgcttgctatgtacactagggggcgatgtagggcaagccatgcgtgctgtatctctactacccccagtagctggctgggaggttggttcttggctgtaattaattccctgctggaaacagctgtgcctgcttgttagcctggattccagagcatttgaaagtcttcaattggtcctgcaaatgtctatgaaagggctgaccaggacttggggaactgcgttcttccccatatacggcaactccagccagctggccaacagaatcacaatacatacacaacactagtcgccaaggacgcttgtttgttttgttttgttaccctccccccctccccgtttttggagtcttgctctgtcacccaggctggagtgcagtggagcgatctcggctcactgcaccctccgcctcccgagtttgagcgattctcctgcctcagcctgcccagtagctgtgattacaggcgcccaccaccatgcccagctaatttttgtatttttagtagagacggggttttaccatgttgaccaggcttgtctcaaactcctgacctcatgatccgcctacctctgcctcccaaagtgctgggattacaggcatgagccaccgcgcccggcctggggggcattctaagaccactacatgtctaaacccacactcatgtgcttggcaacactgtcattctggaattcagtgtggtccaatagaacgtctgcagcgatggagacaggcggtatctgcgctgcccaacaccaccagccacaggcggccactgagtctttgaagtgtggctaatgtgactgaggaacaaaatgtttcattgtgattaattttaactcatgtacatgtaaacagctaagcgtggctggtgtgttggacagtgcagtgccgcatgctggggctgtggccctctttcctccctccgcctccattctgtcagcacgtgctacgtatgagctgtcactttaaactgttactcccgtcatggcccagcccacaccgcctctcacctgagtggttacaaagggagcaagtgccgcttctcttctcagctaagcagcaagaaggatcctgctaagctgcatgagtgtgtcactcctctgacttcccagctcacagcaaaagcccttctgagggcttaagaagccccatggcctcttcccccttcctccccttccctcattacaccccgccccactccactgcagccactagctcctcaccctgccccccacccaccaggcaggcttccaacccagggtacctgcagctgctcttcccttagacacccaaccacatagctcgttcccctacctcctccagtgtgtgccaaagtgtcaccctccgtgaccaccccattgaaaacttcagcatcagctgccacccaacactccttcccaccttccctgtgtcttcaacgttcatctcatcaacatggaatttacctacttaccatcttctccccctaagagcaccaggagggcagggatttttgtctgtgttgttcacagaagtatccccagcacctagagtgcttggcacaaagtagatggtccagaaatatttgattgattagttaatttggccaagaggtgggccgggaaagaggttacctctaactgaggtagaggtcagcctggctgtgaagaacgctgggttctgaatatagcattgtccgggatgtcaagagacccaggttcaagtccaccaaatggcctatgcagggccctcggcgactgagtctgcttcctaatctagaaagtgggaagacagatctctgtcttgcctcccttctggggtagctgaggacatattgagataataagtgcagaagccatttgtgggccacggggagaggggaaggggatgtgcagggtgtcctaatgaaggaattgcccaggcaagcgttcgggagaaggttaatcgaggaaactgacggctatgtccaactcactgagagacggtggtggccaactgtaattctgcgacacaaaacagcttattcttgcaggccttctcatagggcagctgtaaccagacagagagtcccgatcagcccaggctccgccttccccagcagccctgcctccggctcttctccttataggaagttttgggctgtgcctcctgctcaccctgagaagtgcagttacagggaggtgaggggtgcaggctgggattgtccccgaagagcagggactgtgacattcctgggtgacattcctggatctgtcctataacatgggcacactgtgacccagtcctttgaccaaggtaaaaactggggtgaccttcacggaatgttaggggtgcccatgacatttacatcatgcgaattcagcagcaacacacagctcacgactttgagcattcagggagcagacacctacgcgaagagaagcttccttagtcctttcggatataggcagaacagcccgggcaggagtgggggatgcctagccaaatatcgtcaaggtccaggccttggaggttccttcctcatggctagtcatctgttttttcggttgtttgtttgtttgttttcagatggagtctcgctctgtcatccaggctggagtgcaatggcgcgatctcggctcactgccatctctgcctcccggattcaagcgattctcctgcctcagcctcccaagtagctgggattacaggcatgtgccaccacgcctggctaactttgtatttttattagagaaagggtttcgccatgttgaccaggttggtctcaaactcctgacctcaggtcatccacccaccttggccttccaaagtgttgggattacaggtgtgagccaccgcgcccggcctggctagtcgtctctgtaagctaactatttcccttgcctacacataatcgactaattctgaaagccacatttcaaaaggccccatggaggttgaaaagctccagttcgtgtttttaaaaattccagtgttctaaagtagctgggtctgtttttgtattatgaaggaaggcagccagctcctcggctggagagcctctgcacttcgcacttctctcccggtggccacctcggcagctgtctgcaggtctgttcccacggcctagagggggaatgacagcccagggcttgaaagggaactttctacttcctgcggaagggggatgccatttgcagaagtcaaagcgtggcgctctctctaagtgggtcaacagtttcatgcagggttttttgttgtatttttttttttttttttttttttttgagacggagtctcgctctgtcgcccaggctggagtgcagtggcgcaatctccgctcactgcaagctccgcctcccgggttcacgccattctcctgcctcagactcccgagtagctgggactacagctgcccgccaccacgcccagctaattttttttttttttttgtatttttagtagagacggggtttcactgtgttagccaggatggtctcgatctcctgacctcatgatccgccagcctcggcctcccaaagtgctgggattacaggcgtgagcccccgcgcccggccttttgttgtatttttaatatagccacatagcctgatctcttccacccagccccagtgaaagagaatggggttaagccatctaaactcccagccagaacgcactctctggtaacaccgatgtgcctaataccacgtggttttttcctcacccattttatacggggaataactttttaaaaatctctttgccatagcataatagtcatcactggttaaggaaagacacataaagagatgttaagcaggatacaatcgcaaggcatctcaccataaaatgagacgtgcttattaatgacacaggcaaacagcactaggaatggacaagtccacattaggtgcctcctgagatggtgtactgagaaggacacactttacttctgtgatattcctgacaaaaatgcataacctggccaggcatggtggctcacgtctgtaatcccagcactttgggaggccgaggagggtagatcacctgaggtcaggtgttcaagaccagcctggccaacatagtgaaaccccgtctctactaaaagtacaaaaattagccgagcatggtgatacatgcctgtaatcccagctactcgggaggctgaggcaggagaattgcttgaacttgggaggcagaggttgcagtgagccgagatcacgccattgcactccagcctgggcaacaagggcgaaactctgtctcaaaaacaaaacaaaaatgtataacctgaatctaattatgaagaaatatcagacaaattgaggaacattctacaaaaggactggcctgtacccttcaaaaatgttaatgtcattaaaagacaagggaagactgagtgagaaacccttccagattaaaggagactaaagataaataactgtagaacgctatgaatgatcctggaccagaaccttttttttcttttgctataaaggacattaataggacaactggcaaaatttgaataaagtttgtaaattagataatagtattttatcaatgtgaatttcctgattttgattattgtactatgttaagacaatgcctttgtttttaggaaatatatattgaaggtttgtggttttttttttttttttgagacggagtctttctctgtcactcaggctggagtgcagtggcacgatctcggttcactgcaaccactgtctcccggggtcaagcaattctcctgcctcagcctcctgagtagctggaactacaggcatgcaccaccacactgggctaatctttgtattttttaaaatttattttattttttatttttttgagatggagtctcgctctgttgcctaggctggagtgcaatggcacggccttggctcactggaacctctgcctcctgggcaaaggattcaaatgattctcctgcctcagcctccctagtagctgggactacaggcccatgccaccacacccggccaatttttgtatttttagtagagacagggtttcaccatcttggccaggctggtatcgaactcctgacctcaggtgatccacctgcctcaacctcccaaagtgttgggattacaggcatcagccagggcgcccggctgacaaaagtttcttatgacactacccgcctgtctaagctgcactgatgggcaccaggaggagaggctaggatacaggtttggtggggccattcagcctgaaggccctggcagggcatgaacaggcaggtgtgccaaagggcatcctctctgcagtgcaagacacgacagctccagtctagctcccacaaggaacccccatcacagcgtcatcagagccgcttgccaagtgaggtccccaggatgcaatgtatgcatgtgcctcatgaaagatgtagcaagtgcttttgtgaacataaagacataaaggaacaagccccaggggcagatggagacctgcgttacccatgagtcctcactcacggggacacattaacaccatctcagggactcagtttcaccatgagtacggtgaggggcccaaatgccgtctgaagacattgcctcccaactccaccattcttggaagttaggggagcaggtggtttctgtgggataggctcttaagagggctgggtactggctgtgggtagagtcacctggaagatggcaaagggctcagtgtagcggtccaggatgggctggggatggtccgtctgtccctcaggggtctggagctggtagctgactttgacactggcattggagaagcagtcctcctcacagagctgtggggtcaccacggaaggcagggttagagttggatgtgggggagaagatgacaacaataatgctttttttctttttctttttttctttttttttttttttgagatggagtcttgctctgttgcccaggctggagtgcagtggcgtgatctcggctcactgcaacctccgcctcccgggttcaagcgattctcctacctcagccgcccgagtagctgggatgacaggtgtgtgctaccacgcctggctaatttttgtatttttagtagagacagggtttcgccatgttggtcaggctggtctcgaactcctgacctcaagtgatccacccgcctcagcctcccaaaatgctgggattataggcgtaagccaccgcgcccggcctcttttctttttttttttttttaagataaggtctcactcactctgtcacccagtctggagggcagcagcaccatgatggctcactgcagcctcaaccacctgggctcaagcaattcacccaccttggcctcccaaagtgctgggatttccaaatatgagccaccgcaccttgcaagaatactttctactttgatgtcatcataagaagaaataaacaataaaagtggtgagtcagaagtcctaagcatcttccaaataagccaggctgaagggacacgtccttcaagcaagctgccaagtgctttgggaaaaatctccttcattctactacggttttgtgtctatagctgctatggttcttatcccagtcacaaaggggtaaagaactggctcagacagaagggaagagtcacagccacacctgggtttatcaagttctttctcttttttttttttttttttgagatggagtctcgctctgtcgcccaggctggagtgcagtggctcgatcttggctctctgcaacctctgcctcttaggttcaaggttctcctgcctcagtctcccaagtagctgggactacaggtgcatgccaccacgcctggctaatttttgtatttttttttagtagagacagggttttaccacattggtcaggccggtctcgaactcctgacttcaggtgatcctcccacctcggcctcccaaagtgctgggattagaggcgtgagccactgcgcccaaccaaccaagatctttctcaaagcaacatggaggacatattagagaggtaagagagaagataaggagattgcttagcataccatttgccactctctttgtttaaataagcctttctgcccctataagagcctcaagcccatgggagaaagtgagcatgattctctggtagagaatgtgattaagcctttatttaaggaaggctgtagactttaatccaattaacaatcactttgggggtaaatgtgtattcagaagaagaattcatgcatttgtttattggaataaacgatccatatagatccaaagttcgagatcctgtcagggtttgagtcccgacatactttttttaccccatgtctctgggcacctttgccaggagtaaacctttctagatggtcgtttctatctttttattcttccttttagttgttcacttttttgatgccaactgacattcaggccctcggtcctagttattatcaggtgaggtctgataacgcatgccaagaacactggcattcctgagttattaccaagaaaaacgtcagcaatgacagcatctccatcttccgtgccattacgtggttcttgatttattattattattattttgagatggagtcttgctcttgttggccaggctggagtacagtggcatgatttcggctcactgcaacctccctcccctggattccagcgattctcctgcctcagcctcccgagtagctgggattacaggcacccgccatcacgcccggctaatttttgtgtttttagtggagacagggtttcaccgtgttggcccggctggtctcgaactcctgacctcaagtgatccccccgccttggcctcccaaagtgctgggatgacaggcgtgagccaccgtgcctggcctgttatgattattttaatcacctcatttgtaggtctgggtatgtgcccttcactgcatcacctcaaatcctttctcaatgacaaagacccctcctgactcccatccaaactccgtcacttacctctccctctgtgggcatgagcaggaggtcctcacaaagctgggatccgctgctccactccctcaggcagcccagacagcttcttacgtctgaacactgcagccgtctcctctgcttccccacatccacatccagcgtgaagttgagaagtgcctcgcggaggcctgggaatgaagaccagaccttcccgatgaggtggggatgagccagccgcagacagaaggcccccagcctgcctgaggttccttgtggcccctcctgaacagtgtccccatgcaggtacttccctgcggctggactcctgcgtcggtttttcaaagatatttttctcaccgtcttctgacacctgaccagggtctctgagtgctcccgccccaaacccggagcagcacattcccaggactgagtcagccttctttagggaaggagggctcgggaaggggatcgagattgaagaagaaaataaggaggaagagagacaacaaagagaatggagagggaaagagggactctgcggagaaaaaccccaggacggcacagctggaagcaccgtggagatcccggggccgcctctcttactgtacagaacagaaccagctcagctagggagagacacttgcccagcatcgcacagcccatcgagctctgtgtcctggaagggacaggtctgttattttcttttttttttcttttttctttttttttttcctttgagacagagtctcgctgtcacccaggctggagtgcagcggcgcgatcttggctcactgcaagctccgcctcccgggttcacaccattctcctgcctcagcctcccccgtagctgggactacaggcgcccgccaccacacctggctaattttttgtattttgtttagtggagacggcgtttcaccatgttagccaggatggtctcgatctcctgaccttgtgatccacccgcctcggcctcccaaagtgctgggactacaggcatctgtcaccacacctggctaatttttgtatttttagtagagacggggtttcaccgtgttagccaggatggtctcgatctcctgacctcgtgatctgcccacctcggcctcccaaagtgctgggattacaggcgtgagctaccacacccggccaggtctgtcattttcaatccccaggtggataatagcctgctgctttgggaaagccaccccaccccaggagactgctctctgactgtgggaggcagagaccatctcagagattgctcctgagagattaaacctcggggactgttgctgaggaatcgttccaggggggagctcttggatgagcagtaaatacctgggctgtgaaagccatgcccaccacctcctttctgggaacagtctcctaatgagtttcaggtaaggaaagagaaaccaggcctccaacaggtgatccaatcccacctgggccggaggcacatagtgaggagggaaggggagaagacacaagtcagagagaaagaggagggtgtgtctcagaagcccccgcacacacgcacacacgtgggcatggagaaatggctgcctttttctgagtcttttttttttttctgagacggagtctcgctctgtcacccagcgtggagtgcagtggtgcgatctcagctcactgcaagctccgtctcctgggttcatgctattctcctgcctcagcctcccgagtagctgggattacaggcacctgcccggctaattttttgtatttttagtagagacggtgtttcaccatgttaggcaggatggtctcgatctcctgaccgcgtgatctgcccgccttggcctcccaaagtgctgggattacaggcgtgagccaccgcgcccggccttctgagtcttttttttcagaaactcaacccttcaaccctgaggaagggccccagtgtccctcttcccaacagtgtcagctctaaaccccttctgagtgtggacataacctcagaccaccctttcttgaggcagtttgcatttaacaaacctggagactaaggagctaagctctaatcgagggatttcaagcaccaggacctcagaccaacacccacccaccccccgccccagtcctctttccctgccccttacagaagccaaaaaggaaagaccatcacaccaggcaggggtcagctggaccatttttttacctgactcagaggctgtggttacagagctgatttcaaaacataaacggacattcacgacgccgttgaagccgatgggcagtgcgctgggggtgaaggccatggagaccttcaggcgaaccacaggccgggagctaaacaagacagcaaagaggatgggagaagtgactgctcagcctctgggtcagggcctggctgattggttcatgcattcaatggttctctatcaaacatgcccacatccaggtgatccctgagtctcagggtacagtggggaaagagacaagtttctgctttggtgggaaagcagacaacaagcaaataaacgagagaaacagggagatactatgtattggcaaggctatgagaaaaattaaaatactgttggccgagtgcggtggctcacgcctgtaatcccagcacttgggaggccgaggcgggaggatcacctgaggtcaggggttcgagaccagcctggccaacttggtgaaacatcgtctctactaaaaaactcaaaaattagctgggtgtggtggcgggcgcctgtaatcccacctacttgggaggctgaggcaggagaattgcttaaacctgggaggcggaggttgcagtgagccgacatcctgccacggcactccagcctgggtgacagagcaagactccatctcaacaacaacaacaaaaatacggtaataaggaccgagggctactgagactgggtggtcacagatggcgtggctgatgaggaggcatttcggttgagatttgttaacaagaaagagccagctgtgtgaggatctggggaagagcactccaggaagaaagcacagccagtgccaagggcctgtggcaggaacacttttggtttgtttgaggagcacaaaggtcagcatgcctggaatctaattagtgagacagaggatgggaggaggagatgggaatggaggggcgggaagggccaggccacgaagagccctgtaaagccatggtgaggaattgggattttactctaaataggagccgtggaggagtttcaggcagcagagtgaagggatagggctgctgctgtgtggagaatggagcgcaggggctggaagcaggaaaggctgtggcagcagtgtccagggagtgaagacagtgcctgcactggtctggaggcagagccaactaagacttgttgatgtggtggagaggaaggaaaagaggcatcaaagatgacgcctacgttttcatcctgaattgctgggtggatgatgatgccatttgctgagacagaaagcctgagggcaggatagatttgggggaatgaagggtggggggagataaaagctctgtttttctttttttttttttggagacggagtctcgctctgtcgcccaggctggagtgcagtggcgcgatctccgctcactgcaagctccgcctcccgggttcaccattctcctgcctcagcctcccgagtcgctgggactataggcgcccgccaccatgcccggctaattttttgtatttttagtagagatgaggtttcaccgtgttagccaggatggtctccatctcctgaccttgtgatccacccgcctgggcctcccaaagtgctgggattacaggtgtgagccactgcgcccagcaaaagctctgtttttagacgtgttcacttcgggatgactgtgagcagcagctcagggaggtgctgggtagacagcaagtctgcagcttggagaggacgggacagacgggcgctccatgagctcatttacagccacgggacttgatcattcactgagggatggggcacaaaaactctgcaattcttggccaggcatagtggctcatgcctgtaatcccagcactttgggaagccaagatgggtggatcacgaggtcaggagttcaagaccagcctggccaacatggtgaaaccctgtctctactaaaaatacaaaaattagccgggcgtggtggcagacacctgtaatcccagctcctcaggaggctgaggcagaagaattgcttgaacctgggaggcggaggttgcagtgaaccaagattacaccactgcactccagcctgggcaaaagaggaagactccgcctcagaaaaaaaacaaaaaacaaaaaactctgcaatcacagccatcgctgagcactgtgctaaatactttgtatatattcgcttgcatgatcctcatagctctgggaggtaggtgctcttataattcctaggtaaggtcttagagttaaataacctgcccaaaggctgagagggctgagagctgaggttcaaacccagacgggcagactccagagcctgtgcccacaaccacggtgctggctccctccctcagtgcctaatgtctgcatggagctatttagagcagggcaaatgggtgaggctgggcctgggaccccagaaagcaggacagaaccctaccggaacacaaccgcctggcccagagtgcccacggtgatgtcggcaaggccgtcgccactaatatcaaagccaccagccatggacatgccgaagtactggagtcctggggccaccgtggaggctctgatccgctgtggaggcagaaacacaaggcgtggggcgagggaagggagggaaacggggcggggagtcctttcatgatctatcccgatcagcatcgcaggcaccatccagccccagggagccccgagtctagaaccaggaaagagggagcaagctttcccagaggaagtggcatttggatggagcctcgaagggcaggtgggacttgacaggggagagtaagggaaagagtgaggcatggggaaagagcagggccttctgagaagcagccagggccagggacggggtggaccacaggggattggggtacaaggaggcttgatgtggggcttggggatggggggtgtcaacaaaggttctgttgttttgaagtgacataatcaggataacactttagaaatggcactgaagacatggggtggaagatggagaggaggaggaagctgggtgggctgggagtgggatggcaaggcctgagctgggaccgcaggggtggggatagagagaaggggctggagttgggagacagctagaatcatgaggacgtgggaactgacaggctgtgcaggctgtgagcgtgctgaggactgtctgaggtttccggtgtggggtgtggagggggatgaggtctcagaggagcatcagttctaggggaagcaggtgctctcagatgggccgtgtgggagtgagatgcctgggggccatccaggtggaggtgctcatgaggagctggaggtgggtggaagtgcctgttaatacatgcagtgtgagaggctggcaagggagccctggggaatgagagataaggcgcggaggtgctgggtgggagacaggagcgagggacagaaagagaggaagcagggacccgaggcaggtgggtggaaggagggggtataggccagggaaggagacaggtaccgccacaacctcccctgaacctgaaggggccgaggtgaagccctggtctggaacctccccccaacctgaaggggctgaggtgaggccctggtctggaagctccccctagcctgggggacttctttctttcactgggcattcccaacccccgagacctgcccagcacttaggactgaagccgacttggggcttgggtcatcatatctgagagaggtcagagccccagaggagaggaaggagagggccccatgggtcacctgcgaggggctggcggagaggccgtcccagtgtccattgtagatatacacactgccgaagctggcaccatcatctgccccaaaaccttccaggggggccccgatggccacatctgtgagcttatcctgactgagatcccccatagccgccatggcaaagccaaagcgggcattggtgaacccggggtgcccactcagtatgcgtgccaaggagaaagaaccatcctgtaaagcaaacaaacagctcagccctcaagaaggggtgctaggtgcccactccattgccaccccgatgcacgctcactgggccggtgggtgcccactccattgccacccaggatgcacgctcgctgggccggtgggttcccactccattgccacccaggatgcacgctcactgggccggtgggtgcccactccgttgccacccaggatgcacgctcgctgggctggtgggtgcccactccgttgccacccaggatgcacgctcactggccagggaccttcccaaggccatacagtgagcaccaggggaaagctggggtcctcctacctggaagttcaggagtcagagcccgcccccctctagttccatgggcaggggtgcattgctgcaaatgggaggcctgggtttcactcgtggctctgccacacacatgccaggtacacttgagcaagtctcggcatcactgaggctcgccgagccccagcttcctcacccgtaagatgagagtggcagctacctcccatagttactatgagaaacaagtgagatcctggactaaacgggctttgccaaccatgcagctgtaagagatgttatcagctgggcgcggtgactcacgcccataatctcatcactttgggaggccaaggtaggtggatcacctgaggtcaggagttcgagaccagcctggttaacatggcggaaccccatctctactaaaattacaaaaattagccgggtgtagtggcacatgcctgtaatcccagctacttgggaggctgaggcaggagaatcaacccaggaggtagaggttgcagtaagttgagattgcaccattgcactccagcctggacaacagagtgagactcagtctcggaaaaaaaaaaaaaaatgctgggcgaggtggcttacgcctgtaatcccaacactttgggaggccgaggtgggtggatcacctgaggtcgggagttcaagaccagcctgaccaacatggagaaaccctgtctctaccaaaaatataaaattagccgggtgtgtggcccatgcctgtaatcccagctacttggtaggctgaggcaggagaattgcttgaaccccggaggcagaggttgcggtgagccaagatcctgccattgcattgcagcctgggcaacgagagcaaaactccatctcaaaaacaacaaccacaaaaaaagagatattagagatattatcatcaacgatcacccttgggtaagaaagtgggtgcggagagcgatgccgctgccccgcccagccgccatccagcctgagcacctccccatcactgcccactggtgccaggcagggccagggcactcccagcctccatcacctctgtgtcaggctgagtgccacagcctcagcaagctcatgaagatggagactctcccacctgctcgctgagacggtacacgtagactctgccttcttctccatgaacgtggtaaaatggagcagccaccagcaagaagtccgtgcttccatccatgtcaatgtccacagggcacagctcagagccaaaataggaccccatctacagcccgggaggaactcagctcaccaggagccccgctcctgcacccctcagcaaggctacacccctgcccgcgtgcttcctggaccacccaatttgggtcgttacatatcaatttgctcactgagagtaacagaagagtggaggagcagcccaggccccacagcggaggaaactgcctagcaatcagacatgcagagctgaagcagagccctcgagctccactcaggagcctgagtttcacccagcccgggccctggcccactgtgcaccgtgggacccactcctttcccttgggggcctccagattccccatcggtcataaggggtggaggctttccccagcaggtacctgctctccctccagcactggcaggaagctggcctctctgccctccttctggagctcaaacacggccccatgatgtttgtaccgtggagcccccgcgatgtaggagaggctgcaggtcttgtgcagcacggccacagcgtaacctggggcaagggtggtgtggctgtgaacacaccgtgtgctcccacctggcctctctcttggccccggcaccttcccagtcaggccttcaaagtggcctggggaggggggcaaaataggagagactgtctttctcactatgttaaaaatcggcatcagcgagcactctcactttgccagtcacacacatccccatcacacagatatgatgcacacgctgtctgtcacgtatgcagctttgctcgaaatactcgttcgcacacattcactacccacgctcccacacacaccctaggaggacggagaagaggggtgagaggacgcccaccactattattatttttatttatttatttatttatttttgagacagagtctcagtctgtcgcccacgctggagtgcagtggcacagtcttggctcattgcaacctccccctcccgggttcaagcgattcttgtgcctcagccttccgagtacgtgggactacaggcatccgccaccacgcctagctaatttttgtatttttagtagagacagggttttgccatgttggccgggctggtctccagacctcagatgatccgcccgcatcggcctcctgggattacaggcgtgagctactgcaccactattattaatggagaggccccgccctcccctgggtggctgctgtgcctggtgtgtacctgacaggccttgtacctacccaggaggctgtagtactcagcctcacggtccctaaccaggacccgcccctcggcccatgtgactgaccaggtcccgcccccatccggaaacctcaagtgcagcctaatgcgcagcctcggtgtccccatctcggccccgccctcgcccaggtggcctctaggccccgccctcacccaggtggtctccaggccccaccctcctcacgtaacttccaggccccgccctctcccaggtagcccccaggccccaccctcgcccacgtggcctccatgccccgccctcacccaggtagcccccaggccccaccctcgcccaggtagcctccaggccccgccctcacccaggtagcccccaggccccaccctcgcccaggtaggccccgccctcgcccacgtagccctcaggccccaccctcgcccagggagcctccaggccccgccctcatcaggtggccccgccctcatcaggtggccccgccctcacccaggtagctgtactgcgcagcctccgcgtctgccgccgccgccgctgtctggttcaggaagcggccccggcggctgcgtgtgtcgtagagcaacgcccctccggaccagtcaaaggccccgacggcgccgagcagcacctgccgctgaaggggacggggatggggcccagatgagtgggagggacccaaggccgggccacggtggccgcgggtctccgggccagcgcggctaacctggctgggagcaggggggcgttcggtggtctagtgcccgcctggccagagatgcaggcgggaaggtgagatggccaacactgggctcctgcctcgtgcccttgcactccctcctccgggagaagcaagcagcttggttgataagctgacccaggccgagtcctgttgcctggtctgtattcaggggaacaactggatgtttgagcacacagaaaaaagcgacctcctgtcatcaatatggccacccttttgttgcagtgagccgagactgcaccgctgcactccagactgggcgacagagcaagactccgtctcaaaataaataaataaattaattaattaaaataaaatcgctcttttacaggaatcaccacaggtagggcagagccctggatgggaggcaggagtccctgaatcctaggtgtcctgggcccctcaccaatgggcaagcctgcctggtgctgagtcagccacgtacctcatccaggatctgagcactgaagccaatctgtgccagctggtagtgaagggcgtctccaaccgtgcctgcaagccaagaagcccagtgagactgctgtgggccgaggtgaagggagaaactgagtcaggggacagtccagcttggcctcactcccagaaggaaccatgcttggtgtaacaggaagagaacccggctgagggtagagacccaggttctccttgagcaactactatctgggcagttcactctttctaggcctcagtttcctcgtctgtgagctcctgggagaagggactatgccccagccatccttgtttctccagcaccagctcagttcatcagagcttcatggagattctgggacgcaaggaggcctggggatattgttggcctttttttttttttttttttttttttttgagacagtgtctcactctgttgctcaggctggagtgccatggctcaatatcagctcactgcaacttgtgcctcccaaggtcaagtgacctggtgccttagcttcccaagtagctgggaatagaggtcatgcgccaccacgcctggctaatttttttttttttttttttgagatggagcctcgctctgtcacccatcctggagtgcagtggcgcgatcttggctcactgcaacctctgcctcctgggttcgagtgattcttctgtctcgggctcctgagtagctgggatcacaggcatgcaccaccacgcctggctacatttttttgtatttttagtagaaacaggatttcaccatgttggccaggctggtcttgaactccagacctcaggtgatccaccggccttggcctcccagagtgttgggattatgggcgtgagccaccacacctggccccagctactttttgttttagtagagatggggttttgccatgttgcccaggcgggtctcaaactcctggcctcaagcaatccacctgcctctgtctcccaaagtgttgggataacaggcatgagccaccacacccggccattgcctttttagacatggaagagctgaggttcagggagatgatgggagttgctcagagaaaccacatgaagatgggacagaggccgggctggagcataggctcgggcctcctgcggtggcctgggtcccggagccctcaccttccatgctgatgatgttgtaccgcagtttgctcagcagcccatccagcgccatgtagttggtcaccttgaaagcatgggtctcatccgggtctgaggcgatcaggttcagttccctcgcagtcctagcactcttaaattcttctcccacctgcacagacagcctgggtcagcgagtcagcgctgcgtggattccccaggcccagggagagagctgagcccctccatctggcctctggggccctccattacctgtctccttccttcctttctcctcctttccctgctccctgttctacccatactctgggcaaaattccagttttaccaaagtacacctgttctcctgaatacaccaagctcctcctcacctctgcacatgctgttccctctgcctgcagggcccctctctgcctcccctgtgccctaggccagctactcccatttgtctggcaggactcagcttggcaccgcggtcctccaggaaccctccttggtgtgtttcctgtggctctcccaccactatttggccagtaagctgtgaccaccatggggaaatgagccctctctgggatgacagagcatggagagaagaggagcatttgcaaatagaacagggtctggataagctgcttacagaaaagcccccatcgacaaccctggcttctccccaccccaggctgtgcaggttcaggaggtgtctcccggctcctggctcttaccccaatggcaaagcgctcaacaccctgcattttgggggagttgatgactgtcgtaaggttgagggggtcctcgaatatgccaccatcggtgagcaccaccatgaccttggatgcctttctcctggagccgtggcttgaggtgaagatgctgtctctaagcaggggagagtaaatgaagaagagagctttgccagaaggatgaccgagctccaggagagactttattctctgacctgtattagaattgggagggttcacaatcctcccgaaagacccagagaagggggtgatgcccccttaagtcacgcagcgaggctgggcagagggagggctgcaacacaggtgttcttgcttctcacctgctcccagcaggaaggtactgcctggcagtccattcctcttgtgtgcgtacaggaagactcatgatattaaaacgatagataatactcacatggcacttatcatgtgccaggcactgttgtaaacactgtatattttaagccatccaaccatcacaaaatctatcaggcaagtgctattatttttctttcttttttagagacggcgtctcactctgtcacccaggctggagtgcagtggtgtgatcatggctcactgcatccttgaacttctgggctcaagcaatcctcctgcctcagcttcctgagtagctggaactataggcacaagccactgctccaagctgtgagtactattattattctcattttatttatttatttttattattattattattgagatagatggagtctcgctctgtcacccaggctggagtgcaatagcacgatctcagctcactgcaacctctgcctcccgagttcaagcaattctccctgcctcagcctcccgagtagctgggattacaggcacctgccaccacacccagctaactttgtattttgagtagagacggggtttcaccatgttggccaggctggtcttgaactcctgacctcaggtgatccacctgtgttggcctcccaaagtgctgggattacaagcatgagctaccacgctcagcctatttttctcatttttaaagtgaggaaactgaagcacaggtcacaaggtccttcagtttgcccggggtcacacagatacaaaccagagctgaggccgggcgcggtggctcacgcctgtaatcccagcactttgggaggccgaggcgggcggatcacgaggtcaggagatcgagaccatcctggctaacatggtgaaaccccacctctattagaaatataaaaaattaactgggcgtggtggtggccgcctgtagtcccagctactcgggaggctgaggcaggagaatggtgtgaacctgggaggcggagcttgcagtgagctgagatcgtgccactgcactccagcctgggtgacagagcaagactccatctcaaaaaaaaaaacaaaaaaaaaaaaccagagctgagatttgaacccagccagcctgtccactgagcactctgctctcctgcatctcacaagaggaagtctttggaagactttttggaggacagccttgaggtgtcatccctcacgttctctctcggccagggaaaggctggagccctaattctcttctcctgcggttctggccagccacttcctccatgagtgatgccacagagactctgggcatggccagaataattcctgcagcccccacactcacaagacgtgttgcatggctgaggcagtcttggtgacactccccacttgagtgatgttctggactctggcgagggaggccatcacatcctggctgtcccgaaggtcaaactcagtctggatcactcctccatactgcaccaaggcaaagttgcactgcaggggatgggcaggagggcaggaggttggaagaattgccacctctgcccctgaaatgtctcccgctggaagcagcagaaaaatccactccttctaccttatccctgggcagaaagagatgctaaggcagagcaaaatctctaagcgagtaggggtggagaagggtgcgatagtaaaggcccccagtgaatcacagacttctccccagctccctgtgtagtgccctccatactgacgatgggattggtcatgtgactggctttggccaataagacatcagcaaatgtgatgtaattagagacttgaaaaatacttgcatgcattggatctggccctcttagaatgttgctgccacgaaaaagttgggctggcctgctaaagacacatggtccagacaagtaagtgaggtcatcttaggccatccagccccagtcaagcaaccagacgcctgcagctccagggtaactccaggcaagatggacagaagaatcatccagctgagcccagcccaagtatgtgacccatagaattgtgagcaaatgtggtgattgttgttctgaggtagggtgattctcagcaatagataagtgttaaccagctcttagggaagcccacctcaaaacacttttcatagaagttcctcatcatgttggagatgaagtctttggctctctgaaagtctgggggatcaatgcttcctgagccatccaggatgatggcaatctcggtgcctggccaagacaaacaggtcaggagtgggcatgggatgtgaggcagatgtaagggtagcatgtgtagggcatgcacccccactgcagccctgacaaccagctcagttcagggaagaagttggagaagctcccaagagggaagctttttttttttttttttttttttttttgagacagagcttcactctgttgcccaggctggagggcagtggtgggatctcagcttactgcagcctccgcctcccgggttcaagcaatcctcctgccttagcctcccaagtagctgggactataatgcacaccaccatgcctggctaatttttgaattttctagtagagttggggtttcaccatgttggccaggctggtcttgaactcctgacctcaagtgatccgcccacttcagcctcccaaaatgctgggattacaggcatgagccacctcacctggccccaagagagaagcttttgtctcccccttcaaaaagagagctagaacctggtcaggctttgtgtgctgtgtgagccattcccatcactaccactctctgagcctcagtttccccacttataagaaagagtgggtggagctggtacaggtcaggtctgtaaagtccagccactgctccccatctctcagactgaggcacccctcacccttggaggccaccagcctaggaattggctctgatagactcagagcaacccagatctgcctcttctcaccagcttcctcctcctcctcgtcttcctcctcctccttgtcttcctcctcctccttctccagagcccggcgctgcctggctgtgttcacatcgtcttctccaccgccttctttgttgctgtagcagtctccagtgtccacacgtgcatctggatccaggagattttctttaaaaacacacatggaagagctcagagtcagaaaggctccatcctcgcctgagcacgctcacacatggttctgccctgattcctttcacgtgatgcctcaaccctgccttgctccactgtgggcctgcgtcccactgcatctgccgtgagctggtgccttttcttggagaccaaggagatctctttagagctatccaaggccagtgaatgtccaatccttaccaaggtcgaagaagttggcctgagcctggggacggaggtcagggcccaggaggctacaggtgcctgtgagttctgagctgaggctgtgaggccgccggaccagcacttgaatgcatatctgtgggagggaagagagggtggggaaacaccaggtcacctcccgattcccgagccacagccacattctcacccccattccagaactcagtggctcaaccaggcagggggcacaggaagagctggcccacccctcaccgggtgtaggagtcagtgttggcatcaaggccgaggccgacacctgcaggagtgtgctgggtcacagggaatacctaggtcagccctggtatcagggtggtcagagctacagtcagccctggggttggcaccagggagacgctagactcagcctcgggaacagcatggcagtcagaactggtctcaacaccagggtcaaccacgagggctagcaccagcctccctaaggccctccctcctctcgctcctgcactcaccaaaacaccgtggtggctccggacaacggtcactccccggtgcctccccttggggatggggacatgctctgaaaaagttaagcccaggtgaggaggaggaggggactctgggaggcagagacccgaagccaaggtcagagggcacagagccaccttggtcaggcccccatgaggaactgttggccactcagagaagcctctagaaagctagagcgggggccttcaaggtcaggactggacacgttcagggccgagtgcccatccccggggctcatttgctgaccctttcaacacgtgcccattgacgtctgctctgtgcccagccttgtgagcgtggtgatgggcgtccagcaacagcggatgcctgctgcttttcctcagtgggtttggtcgggcaggtgggtggagaagcactgcctggtgggtatgtaagtgccaaggaatgtgcaagataccgtgggactggctgtgtggaccaaggaaccccccagcctcacagacccatcctggggaatcttactgcccccagcctcaggggcagaaatggtagctccttcctcgtcctccccactgtcagcctcaggatactgtcttatttttcagtcatggaatcactcagtcaaccctgctggactgagattgagtctgttcaactcagtgcctctcagacaaggattttttttttttttttttttttttttgagacagagtcttgctctgtcgcccaggctggagtgcagtggcgcaatctcggctcactgcaagctccgcctcccaggttcacgccattctcctgcctcagcctcctgagtagctgggactacgtgtgcccgtcaccacacctggctaatttctttttgtatttttagtagagacgggatttcaccgtgttagctaggatggtctcgatctcctgacccatgatcggcccacctcagcctcccaaagtgttgggattacaggcatgagccaccgtgcctggcaggattttttttttttaaacagtcttgctctgttgcccaggctggagtccagtggtgcaatgtcagctcactgtaacctccacctcctgggttcaagcgattcttctgcctcagcctcccaaatagctgggattgtaggcatgcaccaccacgcctggctgatttttgtatttttggtagagatggggtttcatcatattggccaggctggtctcgaactctggacctcaaatgatctacccgccttggcctcccagtgtgctaagattacaggcgtgagccacggcgcccagcctcagacaagacaaggattctatttatttatatatatatagccaagaggttgtcagtaaatctgtgacctgagtttgactgggtaggatggatagagtttaatgagtgaatcaggttcattcattcattcattcattcattcattcaaatggcatttattgagtacctaatatatgtcaggccccatgctagttactagggtggccacagttagactgaatatgtagggggtgaattgcactgaggtgtgatgacttgcatcaggaagggctagagtttcgaatcagccaccaacactaaaagtgtgaactttgtcatactggcaaccaaaagacctacattctctgaactgtagcttcctctcttataaatggcgcggttttgaggatgaaaacagaatgactcagaggactgccgggcacagggtgggcacgcaatacgctgtaggtatcatttctgttgctaggactgtgtcaggaaaggtggctggggattaggattgggttggggtgggactgggcattgggatggaatcttgctgtgggttatgctggagtctaggggtgaacgggctggatgaggcagggctggggttggaatggtttgagtttagatgagggggattttgctagaaagggggtcctggggagcattccctggagttggggctgacttacctacaggatggcaaaggatttcatcctggacaagggaacatcgatggaggggccctggtgtcctcttggttctggggctggtgaccaggagcctgagtgggaggggaggttgcaaagctgagctggctgatgttcctcgtcttctccctgcctgcccagcacccttcccattccagttgcctgcactcacaagctccctgtctggccggcagattcctagcccagactctggattatggggaagacatttgcccaacctctgcttctacacagcaccaggcaggaaatggttaaatgcaacccctctctgcctgctgcccaccctgacaaagaaggggtgatactgatggttaataaaaactctgctctcttatggggacagggatggggaggccagaaaaccaccagcgttggggttggttctgttgggggcagtgctggcttcctcgtgggccacccagggggcctgccctgcctggccttagttcctgagaagagtacgctggtgcccctatcctgtgggtcagtcagaactggaggtttggaggccgggcgcggcggctcacgcctgtaatcccagcactttgggaggctgaggcaggtggatcatctggggtcaggactttgagaccagcctgatcaatatggtgaaaccccgtgtctactaaaaatacaaaaattagccgggcatggtggcgtgtgcctgtagtcccagctactcaggaggctgaggcaggagaattgcttgaacctgggaggcagaggttgcagtgagcggagatcacgccactgcactccagcctgggggacagagtgtgacttcgtctcataaataaataaataaataaaagaactggaggtttgggggtggctgcctcagcctgattaaggcagcctcaagagctgcgcctcctgactgcaaacttcttgcccccacccaggcccagtccagggagacggcagattccagggacagcctcaacattctcaccatccacgttacccaggagaactgggctgtcctgagacagacagtgagctccgggggttgtcataggggatggtggggaggggacgaggggcttggtggttaacagtgaaccaagtccaaggtctttctgcagagggcagtagaagtcatggaggactttataaaggggaagcacatgattagctgtgctttcaaaagctcatgatgaggccgggcgcggtggctcacgcctgtaatcccagcactttgggaggccgaggcaggcagatcacgaggtcaggagatcgagaccatcctggctaacatggtgaaaccccgtctctactaaaaatacaaaaaattagccgggcgtggtggcgggtgcctgtagtcccagctactcgggagcctgaggcaggagaatggtgtgaacccaggaggcagaggttgcagtgagccgagatcacgccactgaactccagcctgggtgacagagcgagactctgtctcaaaaaaaaaaaaaaaaaaaaaaggtcatgatgtggctacagtgggttgggacagactaaagagcacaggaaggtggggcagaaatgagataccgtctccacttcctcaactcctatcactctacattttaatacattatgaaatatattcacgtatcggcatggcttacagaataataagaaagtctgcacctgtgcgtccatccgcccacccacaactgaacccaccccaagctgacttcccaccctctgagtcagttcctgtgaaggtcaccaggggcccccacaatgccacatccaacggaccgctctctgtcctcatcttcctcaacctctcagaagccccaaacatgagtaaccatctccttcgaacacttttttctagatttctgcctactctctcctcattcctcaaggcttcgctggtgccttcgcggtctgacctctatctgccaccaggatctgggggctgggtcactgtcttccttgccggcacactctccctagtgatcccttccaagcccatggcttcaatacacctataacggctgaaattcccacctctccatctgctatcgtaggcagaataatggccccccaaagaaggccacgtcctaatccccagaacctgtgaatatgttgccttttatggcaaaagggacttcgtagatgtgagttaataaattaaggatcatgagatgggggggttatcctggattatctaggtgggctcagtgaaatcacaagggtccttctatgagggaggccccgaaaacggtggcatgggcgagccgcagggactcagggggacgttgaggcaggcagaggggagaagtggcgagactgcagggaatgctgggagcctcccaaggaggcctctcccatcccagaagcccccagggctgtcctggctgggctgtaaagccccagtgtaatcacaaaagtccttctaggagggaggcaggagaatcagagtcggagaaagttgtgaagcttgctatgctgcaggcctaaggaggaggaggagcccgtcagccaaggaatgcaagcagcttctagaagcctaaaaaggcaagaaaacagattctcccccagagcttctagaagggacccagccctgctgatagcttttcagacttctgacctccaaaactacaagataataaacttgcagctgggctcagtgtctcacacctgtcatcccagcactttgggaggccgaggcaggcggatcacctgaggtcaagagttcaagaccagcctggccaacagggtgaaaccccgtctctactaaaaatacaaacattagctgggcatagtggtgaaagcctgtaatcccagctactcgggaggctgaggcaggagaatcacttgaacctgggaggtggaagttgcagtgagctgagatctcaccactgcactccagcctgggtgaaagagtgcaaaataataataataataataataataataataataataataataataataataataaacctgtgttgttgtaagccactacatttgtggtaacttgttacagcgtcgataggaaacaaacagaacctgtggtctttcctgtcaagcctgcttcttctcatcttccccgccacagcaaatggcaccagcaaccactaagttctcaaggcaaaacccaggaggcatcctcacttcgtcgtgttttcactcatgccctacatccaatccacctgccaaccctgttggttctctctccaaattcttttttttttttttctttttttgagatggagtttcactcttgtcgcccaggctggagtgcaatggcacgatctcggctcactgcaacctccacctcctgggttcaggcgattctcctgccttggcctcccaaagtgctgcgattacaggcgcccgccaccatgaccagctaattttcgtatttttagtacagatggggttttcaccatgttggccaggctggtcttgaactcctgacctcaggtgatccactcacttcggcctcccaaattgctgggattacaggtgtgagccaccacacccggccaatttttgtatttttagtagagacagggtttcaccatgttggccaggctggtcttgatatcctgacctcaggtgatccacccacctcagcctcccaaagtgctggaattacaagcatgagccaccgtgcctgactctccaaattatttctagaaagcaactcttctccagatgctccttccatcatcgtcctgccttgttgatggtaatagcctcctgttattttgtggggtttgtttgttttttaggtagtgtcttgctctgttgtccaggctggagtgcagtagtgtgatcacagctcactgcagccttgacctcccgggctcagcaatcctcctacctcagcctcacaagttgctgggcctacaggagcgagttaccttgcccagctaattttgttaatttgtctatagagatgaagtctcactgtgttgcccaagctgatcctgggctcaagcactcccaccttggtcttccaaagtgtcagagaaagatgcaaagcttactatgctgcaggcttgaggaggaggaggccgtgagccaaggaatgcaggcagcttctagaagccaaataaggcaagaaaacagattctcccccagagcttctagaagggacccagccctgctgacaccttttcagacttctggcctccaaaactacaagaaaacttctatattaatagaagtgagccactgtgcctggcccacttatttggtttttaatttactcatgtaattttttttttaagacagagtctccttctgtcacctaagttgaagtacagtggcatgatcacggttcactgcagccttgacctcccaggctcaagcgatcctcccacctcagtctcccaagtaactgggaccacagatgcgtgccatcacacctggcaaattttcttatgttttgtagagatggggttttgccatgttgcccaggctagtctcgaactcctgggctcaggtaatcttcctgccttggcctcccaaactgctgggagtgagcctagtgagttacagtgagtttcaggcatgagccacagcacctggcccactcatgtagtttacaccaatgtcccttctgtcagtggcagccccagttcctgggtgaccagcgccagcatttcctgcctcaggccctccacggcgctgttccctccacggcactgttccctccaccgcgctgtttcctattcccagagccctcaccttccactctccccaaggttggcttattctccttccccagcctcgcctgtcacctcctcataaatgctttctctacccagccgtgcctcacaacccagttactctgcttcacatcaccctgtttgatttccttctcagaacctgccatcatctgatagtgcctattatctgtctccccacgagacagtaggctcccgaaggatcttgtctatcttcttcactgtgttattcccagggtctggagcaatgcctggcacagaacaagggctcagtaagtgttgagtgactattgaacaacagcccaggcaacagctgagggggctcatctggggcagggctgaggggcggagggctgggtgcagcagagagctgctcctctgttccggctctgcagctgagcccccaaattaggttgcttccttagcaaccctgcctctctccccagccccgacctcagccctagacccagcatctccttccctgctcccccaggaagggtggggtcaaaactgggctccaccgcagaccccgttttggtggggtaggtgcaggcctggacccgcctccagtctctctcctcctcagtcctctgcccggactgtttcctctgcctgcgatccctcctgctgcagagcaatcatcccaaaccccagctcctcaggaagccttcccaaaggaagtgcagcctgatcccctccaggccctgcagcagccctgactatagcaccccacccccaccctttcttcccacctggactgcgcgttcccaggaggccatcatgaacagctgtgcagggtgcgcactgcagatcccaagactgccattcatgccgccatcatgcaatgacatggcctggggccctctgagctgcctctgcttcccacaccttttatcccccactgccgggagtttgcaggtttgttgaccacgtggctgacaaaccattgacccaccagctctgacagaggactggccatcagctcgcagccacaggggccctgttacaccctgagctgggtacagcccagcaacccttgtccatctcctgcctttatttattgctttagtatgtttttcgttgtttgtttgctttttgagatggagtctcactctgtctcccaggctggagtgcagtggcgtgatctcggctcactgcaacctccgcctccctggttcaagtgattctcctgccttagcctctgcctcctgagtagctgggattacaggcatgtgccaccaccacacccggttaatttttgtatttttattagagatggggtttcaccatgttggccaggctgctcttgaactcctgagctcaggtgatctgcctgccttggccttccaaagtgctgagactacaggcacgagccaccatgcctgaccttatttagtattttgtatttaaatgtttaacaatctttttaactggtcactgacttgaagctcacatcttgccttcacccagctctaacctgtcctgttctcagggtttatttctttctttcttttttttttttttcttttttttgagatggagtctcactctgtcgcccaggctggagtgcaatggcatgatcttggctcactgcaacctctgcctcctgggttcaagtgattctcctgcctcagcctcctgagtagctggaattacaggcacctgccaccatgcccagctaaatttttttttttttggtatctttagtagagatgggttttcaccatgttggccaggctggtctcgaactcctgacctcaagtgatctgccggcctcagcctcccaaagtgctgggattacgggtgtgagcccccatgcccagccctcagggtctatttccatgtctgctgtctgtcccacccataccttctgtggcaaccaaaacccatgatgctgccagccctggtctcttacattttaagagagacaatgtgagtgagaggcacacgtcattctcaagcaggagcacagcccctgcctttttctaggcccgagttggccagccagcgcacttcctgccccatgcagcaggcccgtggtctcaggccccactctctgcagcaggaacccagaagtgcctcccaccacatcctcctccccagcgtgttcaagcctgggagcccctctctgcttcagcaggtgttcagggagccccgctgggccctcccccagcccctggtggactcagagccctctgcgacacgggctccaaactctctcctgcaccctggcctttaggcttctgagagaggggctgtgaatgtcggtgggacctggagctgaggcgtggggtcgctgggtattggtgggagggaactaggcaggagacagttacagaaaacgctgactgaaacctgctcacaccctacaaacagtatggaaaactgaatgcagaaccaattgcataacttctgacccagcaatcccactcctgagcacatatgccctccccaaaaatgagtacattctttgggatcaactctgagggattaaaaaaaaaaaagaacattcatccatcaaaaggaggtgcacatcagtgctattcatcacagcccaagaaaacagcccaaatgccaatcatcagtactgtcgacacaatgtaaccctggcaaccagaagaagtaccgcctggggcaacacgatggatgaaattcacaggccttatgtggagagagaggagcccgacgtagcggggcacacaccgtatgcctcgttgatactaaatgcaaaaccaggcgaggctaatccacggagatgaaagtcagctgggggttactcttggcagcagatgtgtctggaagggagtgcggggcttagagggggcctaggcgccgcagctcacgtgcccttgatctgcatgctgcttacacagtgcttcactctgcggatgttcactgcgctgcatgcttatgaggtgtgcatttttctcttttttttttttttttttttggagagacagagtttcattcttgttgcccaggctggagtgcaatgctgcggtcttggctcactgtaacctccgcctcccgggttcaagcgattctcctgcctctcctaagtagctgggattacaagcgcccaccaccacacccggctaatttttatatttttagtggagacggggtttcaccatgttggccaggctggtctggaactcctgacctcaggtgacccgcccgccttggcctcccaaagtgctgggatgacaggcgtgagcccccgcgcccagccgggtgtgcattcttctgtatggcacatgttgataaaattttacccaaaccaaacacaatcttgacctttaattcatcttcgtgcaacacaaaactccctgaaaacctcaccacccctcccggcttcagaccctctagttcctccaaaccctcagtgcctgggtgacgaggcaccaccacactctcccagcttacttttcatcactgtcagctttagccacacgtgattttctcagtttcctgaccttactcagccggcctccaggcttctgatcaagctgttctctgtgcctgccatccccttcccgttccttctcatgctaattcccagtcaccctgcaaatcctagtagacgctgatgaacacacctgcctcgatgcgcccccccgtacctcggacgtcccccaacagagctgttattcggtggggtcattgtcactcttgtcatcgtctagcttgtgtttccctcatgagcccgggagctccatgaaggcagtgaccatgtctccctcttattccccaaatattgcctggcactgagtaagtgctccatccatacttgctgaatgaatgaatgaatgaatgaatgaattggccccatccttaccacttaaatctaatggtgagcagacttttttttttttttttgagacggagtctcactgtcgcccaggctggagtgcagtggcgcgatctcggctcactgcaagctccgcctcccgcgttcatgccattctcctgcctcagcctcccaagcagctgggactacaggtgcgcgccaccacgcccagataatttttgtatttttagtagggacaaggcttcagcatattggccaggctgatctcaaactcctgacctcaaatgatctgcccgcctcagcctcccaaagtgctgggattacaggcgtgagccaccgcgcctggcagtgaccagacttttgactgcaccgatgaaaccaggatccagaaaggactctctaatgatgtaggaaacgtcgagctctgtctcccctgcagctctcacaacacagaacagtccagtgaccccaggtgggtggggttttccctccacacggggcaagcagtccttcggcaaccagctccagctgaaggtcctcacgttcaactcaattccgacatgctccacctggaggtagcatcagccctcacaggtcgaggtctcagtcccacaagactgctcctaacttccgaggcccatcaccagccgccggttatttcacctgtgctttcgaccaaacaaccatatcagggtttctgggaccctttccttgggcttaatttgctagagtggctcagagaactcagagaagcacttaccgacatttactggtttattataaaggatattacaggccaggtgccttggctcacgcctgtaatcccagcactttgagaggccgaggcgggcggatcacgaggtcaggagttcgagaccagcctggccaacattggtgaaaccccgtctctactaaaaatacaaaactcagatgggcgtggtggcaggcgcctgtaatctcagctactagggaggctgaggcaggagaatcgcttgaacccagtggttgcagtgagccgagagcatgccaccacactccagcctgggtggcagagcaagactctgcctcaaaaagaaaaaaaaaagatattacaaaggatacagatgaggagatgcataaggcaaagtgggggtgaggggcaaagtgggggtgaggggcaaagcttccatgccctctcgggggccaccctccagaaacttccacatgttctgctacccagaagctccccaaaccctgtccttttgagttttatggaggcctcattacataggcatgactcattgaatcactggccgctggtgatcaactaaaccttcagcccttctctcccagaagaggggtgtggggctgaaagtcccaaccctctgatcgtgcctggttctctccagtgaccagcccccattttgaagctatctgggggctgccggtcccccgtcaactcattaacaaagaaaaagacatttattactttggagattccagagattttaggcatgtatgccagataatgggaccaaatgtttattttgagaccaaatatatttttatttgttatattgtaaaatatatattcagtcttggaatgtcaaatatacatttcacagtatcacaggatccaagtctgcctggctgtcagggtcaaggcccaagtcccagggcctatgaggctgcttcgggagccaccactgcccacccatcctattcaagcaaagctcccgccctgcccagccaggaaccctggctcctcacctggctctgccccagtgcctgtttgaaccctgggctcacttgctcctgtgtgctgggtgtgaaggaaacccttgaccactgaccaggagcaaagcaatctggtgggctggggtgggatgaggaggtaaccatcctaggctgggcccgctcagtgggagagtatgcacaagaaaagccctatgaccacccagaaaaaaatgggggagaaatcactgctttggattgaaatcaatgacagagacataacagcaatacgtaatacataaaccttgaccagatctggctttaaaacaacacagcactagaagtcattttggggccaggtgcggtggctcatgcctgtaatcccagcactttgggaggccgaagtgggcaggtcatttgaggtcaggagttcaagaccatcctggccaacgtggcgaaaccctgtttctactaaaaatacaaaaaattagctgggcgtggtggcgggcgcctgtaatcccagctactcaggaggctgaggcaggagaatcacttgaacccaggaggcggaggttgcagtgagctgagattacaccactgcactccagcctgggtgacagagcaagactctgtctccaataaataaataataggtaaagaaataaataaaagtcattttggtgacacatgggaaattcaaatgagcctcggatctcatgaccctttccaccagagcttctcctaactgcagacacactcctacatcagcacgcggccaccatcgccatctgagggaatgcatattttacttacttgcttcttttttttttgagacagggtctcgttctgtcacccaggctgaagtgcagtggcacaatcgcggctcactgcagcctcgactcacccgcccccgggctcaggcaggtctctcacttcagcctcccaatagctgggacggactacaggcttaaaccaccatatccggctgatttttttatattttttgtagacagggtctcactgtgttacccaggctggtctcgaactcctgggctcatgtgatccacccgccttgacctcccaaagtgctaggattacaggtgagccactgcacctgccaacctttgtatattaaattctacaacttgcctttttcaactcacggtatgtttccagatggatccaggtaaacaaccattgcactggcttcattcaggggatctgcttttagtattgcattgcatgagtcatatcagtatttttcccattttcctaagaggaatattgccagtctttcatgattccaaacaatgctaccacaaacattttttgcttgcttttctttttctgagacagagtctcgctccgtcacccaggctggagtgcaatggcacgatctcggctcactgcagcctccacctcctgggttcaagcaattctcctgcctcagcctcccaagaacctgggattacaggcgcccgccaccacacccagctaattttttttttttttgtatctttagtggagacggggtttcgccaggttggccagcctaggtctcgaattcctgacctcaggtgatccaccggcctcggcctcccaaagtgctgggattacaggtgtgagccactgcgcccggcacacaaacatttttatatgtgtctgagaatttctctagagctgggatcggggagtggaagtgtcagaggccacgtgcatcctcagctttaccagatacggcaaaattgctctccaaggtggtgatcgcaattcacactcccacacgtccctgtttcaccgcaaccttaccagcaatgttggcagattttacattttgcttatctaataggtgggtatagatgatatttaaaaaatgtaaagtaatgtttattgagcattaatgtggccagaaattgtgctaagccctttttttttttttttttttttgagacggagtcttgctctgtcgcccaggctgtagtgcaatggcacgatcttggctcactgcaacctccacctcccaggttcaagcaattctcctgcctcagcctcccgagtagctgggactacgcgcgtgtaccaccacgcccagataatttttgtatttttagtagagacggggtttcaccatgttggccaggctggtctccaactcctgacctcaaatgatccgcccgcctcggcctcccaaagtgctgggattacaggcgtgagccaccgcgcccggcagaacctgtgctaagccctttacatgcattatctcaaatagtctttgcgacaatcctgtgaagtaggtagttccccacgctgactgcagagaagggaaactgaagctcaggcccgagcaccttgctcaggctatgcggcaaatccacggtgaagctgccactgaaccctggctgccagagccacagcctgcctcttaccagtacacgcttgttcctcatagtttcagggtttttgttctggagacaggccggagtgcagtggtgcaatcacggctccctacagcctcggcctccgggcccaagtggtcctcctgcctcagcctcccaagtagctgagactacaggcaggcaccaccatgcccagacagtttttggttttttttgagttgggggggtctcactatgttgcccagggtggtcttgaactcctggcctcaagaaatcctccagcttcagcctccctaagtgttgagattacaggcgtgagccacggtgccaggcccagttttttctttgttattttttgtttccaaatgttctatattgaacatgtgttacttccataaggaacaaaagagccttaatatgctttattttaaaattgtcttttttttttttttttgagacggagtctcgctctgtcgcccaggctggagtgcagtggcgccatctcggttcactgcaagctccgcctcccgggttcacgccattctcctgcctcagcctcctgagtagctgggactacaggcgcccgcctcctcgcctggctaattttttctattttttagtagagacagggtttcaccgtgttagccaggatggtctcaatctcctgacctcgtgatccgcccgcctcggcctcccaaagtgctgggattacaggcgtgagccaccgtgcccggccactaaaattgtctttaagtccaccctccccctgggcaatggagcagggagaggcccagtgaggcgtgaggctggggttccgtggaccccacagaccagcccgatgcccacagcctctctcacaccttctctctttctcctgcatgcccttctgaaagagaaaggagttcctctcctgacggtggggtggggtgggctgccatggccgtctctggggcccatctcagattgcctggaagcccctcagtctgaaggcctcttgcccaccggccctactcaccaggtctggttggtgctggggtcttggtgcagaagggagctgagcacgaaaggggcacctcccttgggcgtgagccagggccgggccacatccacattgaaagcggccagcagggccaggcctgtagggaaaagaggagcgtttaatgaaagaggccttttactcccgttattccagcaaatcctgtggtgtcatgaaccccgttttacagctgagaaaagtgagactgcccagggatctttatgtgtgtgtgagagagaaagactagacgcaggtgtatctgacccagagcctctgatcctcctactaaaccaagctgtaccagtacccgagcccccctcctccaagaagccgcccctagctctccccaaagaagcacttcccacctcctcacgcctcttactgtcatttctgcacctgacacacagcgtgtactcacgtcactgcgtcttgtactgaagttacagtagactgtgagccccaggaagagggcctgtgtatgttctatgtacccccttcaagcgacccacgagaaaacgtatccccaaaactgcctgcacaagaatgttttataccagctttattcggaagagccccaaactgcaaacaacccaaatgtccatcaacaggagactggaaaagcccactgtggtatattcctacagtagaatcctactcaggagtaaagaggagtcaacaacagatacagcagcgtgatgaatcccaaaaatcattatgctggccgcgcgccagtggctcatgcctgtaatcccagcactttgggaggccgaggcggctggatcacttgaggtcaggagttcgagaccagcctggccaacatgatgaaaccctgtctctacgaaaaacgcaaaaattagctgggcgcggtggcacgttcctgtaatcccagctactcagaaggctgaggcaggagaattgcttaaacctgggaggcagaggttgcagtgagccgagattgcaccgctgcactccagcctgagcaacagagcaagactccgtctcaaaacaacaacaacaaatatcattatgctgagtgacagaagccttaggtcttccttctttcttctcatttatgtgtgattttttttatttacagcagaataggctcatgaattctattttattcaatggttataatctgttatcactatattggttctcaaagtgtcccttatttggcctttccatgaagaaatcattggtactggactaattctttcaccataaacaactagaatactggacaaaacctataaaatgttttcagacatttgacaatgggcagagcaggacagtgatctctagaaaacatggacaaataacacgagccctgtcgttaccctcagctttctttctggaggaattttatgaccctgatgtagggaaagggaattcaaacagagcacagcagatttgttaagctaaggcaataaaaatcatattgtataactccatttatatgaggttctagaaccagcaaaactaacctatagtaaaaaaaaaaaaatgcttgagaggatgggactaactgggaagggactagaaggaactttctggaatgatgaaaatattctatatcttgataggtgtttgaattaccaaggtgtgcatgtgtcagaacacacgcaatgaatggtccacttagaatttgtgcatgtcactgtatgtaaatattaccttaaagaagaagcacaaacacattttgttgatatgtatgctgaaatgtttagagttgaattatacttaagtcagcaatttatttttattaatttcttttttttttttgagatggggtcttgctctgtcgcccaggctggagtgcagtggtgcaatcttggctcactacaacttctgtgtcccgggttcaagcgattctcctgtctcagcctcccacatagctgggattacaggcgcctgccaccatgcccggctaattttttgtatttttagtagagacagggtttcacaatgttgaccgagctggtttcgaactcctgacctcaagtgatccacctgccttggcctcccaaagtgctgggattacaggtgtgagccaccacatccagcgtgcaatttactttaaaatgcatcaaaatataagatggcttgctggatgggtagatagatatacgtgataaaagaaacactcaaaagtgttgacaattgtcaaatttaagtgtagtgatgtggttgtccaccatataatttttcaacttttctatatatttgaaatttttcatttaaaattttttggggaaaaatagatatcgatagattacctcccaaagaggttttgccaattcatactccaacgacagcatgggagaaggtttatctcccccagtgttgcctggactgactgtgaagacattttcatccttgttttaagagtatatcatcatcttgttccaaaattattattatttttttaagatggagtttcgctcttgttgcccaggctggagtgcagtggcacgatctcggctcaccgcaacctctgcctcccaggttcaagcgattctcctgcctcagcctcccgagtagctgggattacaggcatgtgccaccatgcccggctaatttttggtttttttgtttgtttgtttatttgttttttttttttttttggaaatggagtcacactctgtcacccaggctggagcgcagaggcgagatctcagctcactgcaagctttgcctcccaggttcacaccattctcctgcctcagcctcctgagtagctgtgactacaggcgcctgcccggctaattttttgtatttttagtagagagggggtttcaccgtgttaagccaggttggtctcgatctcctgacctcgtgatccgcccacctcggcctcccaaagtgctgggattacaggcgtgagccaccgcgcctggcctaattttgtatttttagtagagatggggtttctccatgttggtcaggctagtttcgaactcctgacctcagctgatccgcccacctcggcctcccaaagtgctgggattacaggcgtgagccactgcacccggccaatttttgtattttcagtagagacggagtttctccattttggttaagctggtctcgaactcccgacttcagatgatccgcccgcctcagcctcccaaatattttttactttttattttattgagacaagatctcactctgttgccctggctggagtgcagtggcatgatcatggttccctacagtctttacctccagggctcaatccatcctcccgcctcagcctctcaagtagctgggaccacagatgcgcaccagcaggcctggctaatttttaaaaaattttttgtagagatggtgtctcactatgttgcccaggctggtctccaactcctgggctcaagtaatcctgccatctcagcctccccaagtgctgggattataggcgtcagccaacaagctcagccccaaaactatttttaaattatgagtgaggtcaagtctctttttgtaagtttgtttactgcctactcatgtacattattcattttcatgaaacgatattactttcttatttatttgtaagagcttttctctatccaagagaaacaggcaatgtgttatagatgccgcttctcacgcagctgtttgtcttgcatatgctgttttcccccacaactacgttttttgatgttgtcatattgtttttcctttatgacttcagcttcgggtcatgctcctccactcaggctatttcttttcatccactcatgtttccttctatattttttttcttctttcatttcttttttctttctttcttttttttttgagataaagtctcgctgagccgcccaggctggagtgcagtggcgctatctcggctcactgcaaccaccatctcccgggttcaagggattctcccatctgagcctcttaagcctcccaaatagctgggattacaggcacccgccatcatgcccggctaatattgtattttagtagagacggggtttcaccacgttggccaggatggtcttgaactcctgacctcaggtgatccgcccgcctcagcctcccaaagtgctgggattacaggcgtgagccaaggcccggtctcttctttaatttcttatgttcgaaccttttgtccatctggattttatttttacatttggagtgaaatagggatacaactttacttttttcccacagttgaaatgtctcatcattatttgttgagtagctcctcttaacccatagtttggaaatgctacctttatcatcctcagaattcacatgcacatttgggcctctgtcaggactcagctctgccccactgacctcatcgtcttttgcttggacacgttagtctcctggcctctttcaagacttgtacttctggatacatcctctccacatcagatgctagaaagattttttaaaagcatggtctgggccgggtgcggtggctcatgcctataatcccaacattttgggaggctgaggcggtggatcacctgaggtcaggagtttgagaccagcctgaccaatgtggtgaaacactgtctctactaaaaatacaaaaattagccgggcatggtggcgggtgcctataatcccagctactcgggaggctgacaagggagaatcgcttgaacctgggaggcacaggttgcggtgaactgacatcgcgccattgcactccagcccgggtgagagagtgagactcggcctcaaaaaaaaaaaaaaaaaaaaaaaaaaagcatggtctgaccatgccactccattgcttaaatctctagtgtgtgtgtgtgtgtgtgtgtgtgtgtgtacttttttttttttgagatggagtttcgctcttgtcgcccgagctagagtacaatggtgcaatctcagctcactgacaccttcgcctcccaggatcaagcgattctcctgcctcagcctcccaagtagccgggattacaggtacacaccaccacccccagctaatttttgtatttttagtagagataggttttcaccgtgttggccaggctggtctcgaactcctgacctcaggtgattcagccgttcaacgtgctgggattacaggtgtgagccactgctcccatctctaatctacatttacatgggaaaaaagcaaggtgaagtccagtttacagacttacctgttcaattactgttcaattaacgacttttgccataaacactcttgaaaagctatacaacttcttggcaacactcctttttttggtttagtgactttttcgtctctaaatacactgagtaaacacgatataaggaatgacatttgacatcgcactctcacgggaagacacactcacccatttacttactatgtaacagtttctagtccaacaatatcatatggaacaaatctgcgttgcatgtcatgtttggataaatcccatatgcctgcttttgctgatgtatgtcgattgagatggctgaagattctatgattctgaagtcgatgagcgcacagcctatttccatgtgtttggaagtgcttttgggttcagtatttattttgccctcaaggtgtttctctgtaacttttgctatgactttattttttatttttatttttttgagatggagtctcactctgtcgcccaagctggagtgcggtggcgcgatcttggctcaccgcaacctctggctcttgggttcaagcaattctcctgcctcagtctccggagtagctgggattacaggcgcccgccaccatgcccagctaagttttgtattattagtagagacgaggtttcaccatgttggccaggctggtctcatactcgtcctgacctcaagagatccgcccgcctcagcctcccaaagtgctgggattacaggcgtgagccaccgcgcctagcccccactgtcaaatcttgtcttctccttttaatgaggccaataaaccttcatgacaatacattttatacggaaactgtatttttatattcaaagtattgtttttatttatctaaacttgttttattggtcaattaatacattttcctaacagtaaaagtcatttgagtatctttggttggctggaatgcatcacaatttttttaatgaaattgatgcaaatattttttccaattaatggctgtttactcagcagtagatttcaggaagaaattaaaatcactacatgaaggacaagtgtataaacgacactagcttctgtataaggaagggaaggagatatatgcacacaaatatgttgtttttgattcactaggaagatgtgacaattttaaatctgtatttatccaataacatcatttcaaaatataaaagcaaaaattgactgaattaaaaggaaaaatacaaaacactacaatgaaagtgggagactttaacactttaattaagccttttacgtcaactataaaagcagaccagcggggcgcggcggctcacgcctgtaatcccagcactttgggaggccgaggcgggcggatcacgaggtcaggagatcaagaccatcctggctaacacggtgaaaccccgtctctactaaaaatacaaaaaattagccgggcgtggtggcgggcgcctgtagtcccagctactcgggaggttgaggcaggagaatggcgtgaacccgggaggcggagcttgcagtgagccgagattgcgccactgcactcccgcctgggcaacagagcaagactccatctcaaaaaaataaaataaaataaaaaaataaaaataaaagcagaccaaaaattgagcaaggatatagaagatatgaacaacataattagcaaagttgacctgacagacaaaactctgtacccaacaatggaaaaagaaacatttttcttttttttttgagacggagtctggctctgtcaccaggctggagtgcagtggtgcaatcttggctgactgcaacctccgcttcccaggttcaagcgattcttctgcctcagcctcccgagtagctggaactacaggcacgcgccaccatgcccgcctaatttttgtatttttagtagagacggggtttcaccatgttggccaggatggtctcaatctcttgacctcgtgatccacccacctcagcctcctaaagtgctgggattacaggcgtgagccaccgcaccctcagaaacattattttcaagtacacgtgaaacatttaccaaaattgaccatatgctagatcacaaagctaaagcctcaataaatatcaatgaattgaaataactcagaatatgttctctgactatactagaatctaaaccaataacaaaaagaaaactagaggtccagcacagtggctcgtgcctgtcatcctagccctgtggaagactgaggcaggcagattgcttaagctcaggagttcaagaccagcctgggcaacatggctggtatctaacaaaaataccaaactccatctctaccaaaaatacaaaaaattagccaggaatggtggcatgcacctatggtcccagctactcaggaggctgaggtgggaggactgcttgagcccaggaggtggaggttgcagtgagccaagattgtatcactgcactccagcctgggtgacagaacaagaccccatgtaaaaaaaagaaaaaagaaagaaagggaagaaaagatggccggacatggtggctcatgcctgcaaccccagcactttgggaggccgaggcaggcggatcacttgaggtcaggagttcaaaaccaccctggccaacatggtgaagccccatctctactaaaaacacaaaaatcaggcaggcatgctgacagccacctgtaatcccaaccacttgggaggctgagacaggagaatcacttgaaccagggaggtggaggttgcagtgagccgagatcgtgccattgcactccagcctaggcacagagtgagacttgggaaagaagaaagaaaggaaggaaggaaggaaggaggaaggaaggaaggaaggaaggaaggaaggaaggaaggaaggaaggaaggaaggaaggaaaactagaaaaatctgaacctcgtgaaaattaagcaatgcatttctaaataacccagggtgaaagataaaattacagtggaatagcaaatcagacctaaaggaagtacgggaaggaataaagatatgaacacgtatcaatgaaacagcaaaccaacttacagtagagaaaactaatgatgctgaagttttttttaaagatttttaaaatgataaatcactagcaatactgaacaagaaaaaaaaaagagaacacacaaattaccaacatgaataaaaaatagaaaggggggacatcataatagatcctaagacatttaaaaaatagaggggccaggcgaggtggctgactcctgtaatcccagaactttgggaggccgaggcgggcggatcacgaggccaggagatcgagaccgtcctggctaacacggtgaaaccccgtctctactgaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggtgacagagagagactccatctcaaaaaaaaaaaaaaaaaaaagtaagaggatgttatatccaaccttatgccagtaaacttgacaatctgggtgaaatgaacaaattccttgaaatagaaatgcaccaaaactaacaaaaaaagaaatgtatcacctgagtaagatattttactcatgactaaaaatcttagggagatctctacgcccagatagcttcactgacgaatttttccaaacatttaaagagaaataatgccaagtttatataaactgttttagagaatagaaaatgagaaaacatttttcagtcattttatgaagccagtataacattgatattaaaatccagcaagcacaataaatgaaaggaaaattgaaacaaccgtctctctcgaacataaatacaaaaatgctgcacaaaattccagtaaatcaaatccagggaattataaaaagcataatacggccgggtgcagtggctcatgcctgtaatcccagcactttgggaggccaaggccagcggatcacgaggtcaagagattgagactatcctggccaacatggtgaaactccatctctactaaaaatgcaaaaattagctgggcgtggtggcgcacacctgtagtcccagctactcgggaggctgaggcaggaggatcacttgaacccgggaggcggaggttgcagtcagccaagattgcgccactgcactccagcctggtgacagagcgagactccatctcaaaaaaaaaaaaaaaaaaaaagcatgatacatcaaaacaagcagagttcatttcggaaatggaagagtggtttgacatttaaaataatcagtttactccttacaacaggaaataaaggattaaaaatcatatgattatgatagatgcagaaaatggcatctgataaaatccaagactaatttctgataaaaagtcctagcaaaccaggaatcagagggaatttttttttccttttttttttgagatggagtctcactctgtcgcccaggctggagtgcagtggtgtgatctcggctcactacaacctccgcctccctggttcaagcgattctcctgcctcagcctcccaagtagctgggattacaggcatgtgccaccacacccgcctaagttttgtatttttattagagacagggtttccccatgttggccaggctggtcttgaactcctgacctcaggtgatccgcccacctcagcctcccaaagtgctgggattacaggcatgagccaccatgcccggctgtgaatttctttaatctgatgaagaattaaagcggtggggtctagctatgttgcccaggctgatttcatacaccggccttaagcaatcctcccgccctggcataccaaagccctgggtttccaggtgtgagccactgtgtctggcctgctatgagtgtcttgcagacgtcttcatgaccatatgaacacattcctgttgggcatatgtctaaccgtggaacttctggatcctgttaagcatatgttcagctttagtggatactgacaaatggttttctctttttttttttttttgagagggagttttgctccgtcgcccaggctggagtgccatggcacaatctcagctcactgcaatctccacctctcgagttcaagtgattctcctgcctcagcctcctgagtacctggaattacagatgcccgccaccacgcccgggtaatttttgtatttttagtagagatgggcttttcgccatgttggccaggctgctctcgaactcctgacctcaggtgatccacccgtcttggcctcccaaagtgctgggattacaggtgtgagccaccacacctggttttaatttgcctttctctgacgtctgaagtctccttacaagattcctgactattttgataatctcttttgtgaaatgtcctttttctgtttgtggacatgcctttttcttattgatttgtagaaattctttacatattctgaagttaatcttttatcaatttgtgttgcaattattttcttattctgtggtttgccttttcactcacttacttttttttttttttgataaacagatgttcttaagtttaatgaagttcaaaaaaaatttttttagcccccaaggttgtacacagtatgttttctttcttttttgctttttgagactggctgtcactcttttgcccagcctggagtgcagtggtgtgatcacagttcactgcagcctcaacttcctgggctcaagtggttttcctgcctcagcctttcgagtagctgggactataggcctgtgccaccagacctgactaatttttttttttttttttttttttggtagaggcgaggtttcactgtgttgttcaagctggtcttgaactcctaggttcaggtgatcctcccaccttgggctcccaaagtgctgagattacaggtgtgagccactgtgcccagcctgttctgtttcttgatacgggtgtgacttaatatgaacatttactgatctaaatttgtccatttttctgtatgttgtacttttaaaaagtctacattaaaaataataattattaaaataattatttaaaaataataattattaaaataattatttaaaaataataattattaaaataattatttaaaaataataattattaaaataattatttaaaaataataattattaaaataattatttaaaaataataattataattaaaatattttttagaataagaattacaagtatgtgaaacacactgaatatataaaactttcataagttcatgatatttacaagagagagaaaaataaaaacaaaagaaatcaaggtgactcacgcctgtaatcccagcactttgggaggctgaggtgggaggatcacttacactcgggagctcaagaccaacctgggcaatacagtgagactccgtttctacaaaaaaattaaaaaattagctgcacacagtggagcctgcctgtggtcctagctacttgggaggctgaggtgggagaatcacttgagcccaggaagttgaggctgcagtgagccttgatcacaccacagcactccagcctgagtgacaaagcaagactgtctccaaaaaaaagaaacgaaaaagaaaatttgctaccaatggaagtaaaaagggcaccatctctttactctgaaaactgactgttaggaaaagtattaagcatttttcttgcctttcctacatgaagtgcatttcagggccatcaaatcatcctggttaatgagaaaaagtacttcttgtcttttaagttttccttccttccttccttcctcccccctccctccctccctcccttccctctctctctttccttctttttttttgttttttgttttttgagatggagtctcgctctgtcacccaggctggagtgcagtggtgcaatctcggctcactgcaacctctgcctcccaggttcaagcgattctcctgcctcaacctcccctgtagctgggattgcaggcatgtgccaccacacccagatcaattttgtattttttgtagagatggagtttcactctgttggccaggctggtcttgaactcctgatctcaagtaatctgcccccacttggcctctcaaatgctgggatttcaggcgtgagccacctcacccagccttaaatttatttttcatttgttcatctggcccttataaaaatggcatgaaaaacgtcttttttatggataaattattactaataaatgtaggaagaataatagaaccaaactattttgtgagccctaatgaaatacaataattaattcaggccaggatcatcaacaggtaaagcttctaaatgagagtctgatagactaactttacaattaggctgacaccacctgagcccactagtcaatcttagcatccctaggagtgggcctctcaggcatgtccttcttggtgtgacactctaggaaggatctaagggcccaagactacatttccaacaagattctaagggacacccacactgcaggtcttcagaccacattctgagtaccaaggctttaaaacacttcagcaaagaaaagaaaaagaagggccaggcacagtggctcaggcctgtaatcccagcattttgggaggccgacatgggtggatcacctgaggtcaggagttcaagaccagcccagccaacacagtgaaaccctatctctactaaaaatacaaaaattagctgggcgtagtggcgcatgcctgtagtcctagctgcttgggaggctgaggcaggagactcgcttgaacctgggaggcggaggttgcagtgagccgagatcgcaccactgcactccagcctggtgatagagcaagactccgtctcaaacaaacacacacacacacacacacaaaagaaaaagaggtgaaataactgcaggaagtggggcaaaatcctcacaactgcttagagtgtgctcgccacagaactgaaacctgacgttaaacttccagttttcaggcagtttggggaataaaaagacaaatcacaccaagaggaagcaaacacacaaatcctgaacatagatattctgcaacacacgtgaccaaactctgccataaatcaaaggcatgaaagcagaaaatggggatgggggtgcactccagacggagagccacagcaaccgcatgtcatgtgcggaccttgtttggatcttgctttgaacaaaccaactgttaaaaagacatttggaggccgggcatggtggctcacgcctgtaatcccagcactttgggaggccaaggcaggcagatcacgaggtcaggagatcgagaccgtcctggctaacacggtgaaaccccttctctactaaaactacaaaaaaattagccaggcgtggtggtgggcgcctctagtcccagctacttgggaggctgaggcaggagaatggcgtgaacccaggaggcagagcttgcagtgagcagagatcgcgccactgcactccagcctgggcgacagagcgagactctgtctcaaaaaaaaaaaaaaaaaagacattttgagacagagagatttgtatatggactaagtatttggtattagatgataccaaagaattaatttagttaggtggtaagaacattgtggctatttaagaaaatgtccacgttctttattattgagactgagtcgtactctgttgcccaggctggagtgcagtggtgcgatctcagctcactacaacctctgtctcccggattcaagtgattctcctgcctcagcctcctgagtagctgggattacaggggtgtgccaacatgcctggctaatttttgtacttttagtagagatggggtttcgccatgttggccaggctgatttcaaactcctgacctcaggtgatccaccagcctcagcctcccaaagtgctgggattacaggtgtgagccaccacgcccggcccttcatgttctttagaaatgaaaatgtccatgttttttgggagtgaaatgacacgatgtttggggtttaaaatactgtttctgaaacattagcgtgcaaatgagtcatcggagatcttgttaaaatgcagattctgactcagcagataatgaatcagaatggggctgggagtctgttccaacaagctcccagacgatgctctcactgctggtcctcaggtcacattttgagcagccaggctttaaataccttgacaacaaaaatgaaaaggggaacacaaaatacattcagcttgtgtggcaggatcttgatcattgtgtcatccgcttgatggacatattggctttgttatagttatctcgtttacctgtgtacatgcttaaaattttattatccaaaaatcaaccttccagacttgaggaggaggaggaacctggggagatggctctgaggccaggctctggatctctcatccctgcatttaaggccatttccctgagtctggcacaaagtagatatctatatttaattttattttatttatgtatttattttttgagatggagtctggccctgttgcccaggctggagggcagtggcgcgatctcggctcactgcagcctctgcctcccgggttcaagcgattctcctgcctcggcctcctgagtagctgggattataggcacgcaccaccacacctggataatttttgtatttttagtagaggtggggtttcaccatattgcccaggctggtattgaactcctcaggtgatccgcccgccttggcctcccaaagtgctgggattacacgcgtgagccaccgcgcccggcctgatatctatattttattcctttttcttcacatctctgcctcgcctggaatgatttgtggtgattcataaaaatacataatacaggtaagataaaactcgcttaaaataatggggcaggcaaaaaagaacagaaggaaaatgatggtttaaaaaaagagggggatacaacaagccaggaaggaggccaacagctaacatgtagatcacgcagtgccagcactttctatcacgtgccccactgttggctctgaacacagcgctggctcacagaagtgttcctaaaatcctttggcttaataaaatcatttgttgattcaacgcatacatgaatgaatgaagctttcttgaaggtgatatcaacatgaaaaagatcagttaatgccatgcggtgtccacaaaattcaaaaaacaaaacacttccaggcaaagcacaaccagtctggttattcaaatcagagaaaaaactgtccctaagggtcctttgtgagaacacaatgaagaaaccctgcaccccagcttttgcagacctgtgatttgtgtcctccctgccaatgccccaaagtagaaaacacaggaaacataaccagaccagacgttcttgtttgggggtaatggatccctttgagaatctttttcttttttcttttttttttagacagagtctcactctgtcgcccaggctggaatgcagtggcacaactttcgtctcactgcaacctccgcctcccgggttcaagcgattctcctgcctcagcctcctgagtagctgggaaaacaggtgcccatcaccatgcccagctaattttttgtatttttagtagagatggggtttcgccatattggccaggctggtctccatctcctgacgtcctgatccacctgcctcagcctccaaagtgctgggattacaggtgtgagccatcatgcccggcctttttttcttcattttgagttggagtctcactctgtcacccaggctggactgcaatggtgtgatcttggctcaccgcaacccccacctcctcagttcaagtgattctcctgtctcacgtgggccctggggccggagcccagactccctactgggcatcccttatctcagctctggattcgtgggggagcagcaggaacagtacagccttcttccctgcctaggggtcttgatctggaacctttgagagtctatgtaggctgtaagtggccactctcccagcacctaccgagtgtaggccaggactcaaaatactgggtctctggagtagctgggactacaggcacatgccagcactcctggctaatttttgtatttttagtagagatgtggtttcaccgtgttagccgggatggtctcgaactcctggcctcgtgatccaccaccttggcctcccaaagtgctgggattacaggtgtgagccactgcacctggccccctttgagaatctgatggaagcattggagcccttcctgatcccctgagtgcacatgtgtacaaaatcctccccttgcctgattgaagtgctctgtcctcagcctgtctcctggcttcctcttcatccttttttttttttttttttttttgagatggagtcttgctattgtcgcccaggctggagtgcaatggcacgatctcggctcattgcaacctccgcctcctgggttcaagcgattctcctgcctaagcctcccaagtagctgggattacaggcacctgccaccacaccggactaatttttgtatttttagtagagacggggttttgccatgttggtcaggctggtcttgaactcctgaccttgtgatccgcccgcctcggcctcctaaagtgctggaattacaggcgtgagccaccgtgcctggcctctaatttttttttaaattttttgtagagatgggggtcttgctatgttgtccaggctggactcaaattcctgggctcaagtgatcctccagtcttggcctccctaagtgctgggattacaggagtgagccactgtgcttggccttccttgtttccctattgccagtgactgccccctgccaccagtgagtccaagggggcacacactgcatctgcctcgatcgccacattatctcagggcctggcatggtggcccaccctcggtaggtgctgggagagtggccacttacagcctacatagactctcaaaggttccagatcaagacccctaggcagggaagaaggccgtactgttcccgctgctcccccacgaatccagaactgagataaaggacgcccagtagggagtctgggctccggccccggggcccacgtcacgttgagccctgtgcctcctggtcagtcactctggggaaaaaacaggacgtcagcaaactgcctagaggagaattaaaaagtgcgagctgccaacatgttacgaggggtgggtggggggccttcttccccccgtttcactgtcggtataactgaaaaggcacgagtggaggccgcagagcaaagtccagtctcctctcctgggcgtccgtggcacccccccgctctgcccggcgcaccctctgcacactcctgcctccaggcctcgacacagcggctccctccacccagcaggcctgctcagcactctccacctctgtctgcaaagcccgtcttttgtggccctgctcagccagccaggagccaggagccaatccagactcagtcagagtaactcccgggtccctgagccccctcagcaccctgtggtctgtctggctctgaccaaaccctgagccccctcagcatcctgtggtctgtctggctgtgaccaaattctgtctggatcagggtgatctgtgattcagtttgtctgccctgaactgtgatgtgatctgagtcacacacaacacccccagccacagagcccagctcagcgcagggccaggcccacccaaaaaaggtgctctaaaaaggtcagagtgggccagatattccctttcctcacgccaccccacccctgtgttcactttgttcaacagagatcttgttcaactgagggttccgctcccccagagcacctgttgccttccaggcaccacgctaggtgctgaggctcagagaggggtgtggtttgtgcatggcccgtcggaagattgaatatttgtgtctggggctcagattctgtgtttatgcccgatttcaaagcctttagtaatagctggaggcaccgaggggttggtaaacagagagaggccagggtcacaaatggcctcaagaagctgggcactgctcctgccgtgcggcggctcactgagctggagcagggctctgcttacagggctggtaactaggtcagcaagagcctgccgcagaggcacggtggcatgagactgtgtacgtgcgtgtgtgcatgtgtgtgcatccgtgtgtgcttgtgtgcatccgtgtgcatccctgtgtgtgcatgtgtgcatctgtgtgtgtgcatccatgtgcatccgtgtgcgtgtgcatccgtgtgtgtgcatctgtgtatgcgcatccgtgtgtgtgcatccgtgtgtgtgcatccgtgtgtgcatccctgtgtgtgcgtgtgtgcatccgtgtgtgcatctgtgtgtgcatccgtgtgtgcatccatgtgcgcgtgtgtgcgtgtgcatccgtgtgtgcatctgtgtgtgtgcatccgtgtttgtgcatccctgtgtatgcatccgtgtgtgtgcatccctgtgtgcatccctgtgtgtgcatccatgtgtgtgcatccgtgtgtgtgtgtgtgtgcatccgtgtgtgtgtgtgtgtgtgtgtggtggggtagttcgctgtatttgctgggctttccctgagagccagctggtgcccaggtctgccaggcctggctcagcttgtttcctcagactggactcgccccaggcccaacagtttgcctttgagctgcgcctccatcaggaaaccacctcctgttgcatttcccaccaggactcagaaaacagcattgtcttggtagatggtcttgagttcaaatcctcactgccttggagtcactgaaggaccctgggcttggcacctcgcttccgtctcccctctgggacatggggctgtgcagatcaaatggggcgatacgcggccccaggtctgacgcaggaggctcagcacgtggaggctgaggttggagagagttataaccacaggcgagggctggccctccctcccaatcccccctcccgtgttgtctgacttacagacatagctacaccagtgtctgtcaccacactacccacaggaccacctctctgagctgtccccagccacggaggcctgctgagtcagaccgagatccccctccatcctgtcagccaccactgtctcccctcaaccctctgtctcccccagcacaccgggcaatttcaactcacattctcacagtacaataagtaccacgattcccaatttaggaaaccgaggcccatggggcatgatttgcccacactgataccaggagctgaagaagtggggctagatgcaggggtcccgacaccccgcccagaacacccagcggggcctcgtgggaggactgtgcctcagagccatctgcagccagccgcagtccccccacctcgatcttctacacggagcctcatcaactccaccccaaacctcacagtcagctgagcccatctctctccctcacccttcatctccctaataacaagaaaggccaacaggccttgagcactactgtgtgctggaaactaaatatatatatatatatattttttttttttttttttttttttttgagacggagtctcgctctgtcgcccaggctggagtgcagtggcgcaatctcggctcactgcaagctccgcctcccgggttcacgccattctcctgcctcagcctcccgagtagctgggactacaggcacccgccaccatgcccagctaattttttgtgtttttagtagagacggagtttcactgtgttagccaggatggtctcgatctcctgacctcatgatctgcccaccttggcctcctaaagtgctgggattacaggcttgagccactgcgcctggccttttttttttttttgagacggtgtctctctctgtcttccaggctggagtgcagtggtgtgatctcagctcactgcaacctctgcctcctgggttcaagcaattctcctgcctcagcctcccaagtagctggaattacaggtgcgcaccaccatgcctggctcatttttgtatttttagtagagacggggtttcaccgtgttggccaggatggtcttgaactcctgatcacaagtgctctgcccgccttggcctcccatagtgctgggatttcaggcgtgagccaccgtgcctggccaggaaactaaacgtttctcatgagtgtgtcctcctccccacgtctgccttccgcaacagccgcagatggggccaaggcagcagcctcctcacgggcctctctgcctcccctctcccccagattccaactaacacacaacatacaattctgtcgccatcctggtcaagaccttctgtggctccccactgccctcagcaggaactccaagctcccccaggccggcactcaggtccccacgttcctcaccacctccaccgtgggcctctcgggactggatgcccgcattcctccacttataccacacctgccacacgaatgcaggcctcccagagaagggcagggatgtggggctcccacacggcccacactcccccagccagctctcccccacacactgcattccgggggcatttcacctttgcttgggctgcccctctgcctggagtgccccttccctacccccgtgctgtgacaccctgccggggccggggaggctactgtgtgcacaacctgccttctcttcacacaggggctgggataggggtggcctcgcctctgcccgcacctccagggcccagcatgtcccgatttggggcggggctggaagggaaagcaacaccagaggagacaatctcctgctcccactcacacttcgcctccatcttcctacaaaccagactcttcacaccccagggcttggtccctcctatcccccctgcacagaaggcccctctgctcacccccagcctgtacttgccaaggacctccccgtccttcagagcccacctcagatgctacagtctcccactccccaaggactgaggttttctatcacgcacaggcccggggtgatgccccggcacagcccctggcctcagcccgagtgcgtgccaccagcagagcgggccctggacttctggttccttcttcttcacccctgtaaggtgttgtaggctgacaggacaggcttcttcacgcaagggtggaaactcaacctctgagacccaggatggagaagtgagttgatgtgactgcagaatgagtcaggggtgaagactgacttggggacagcaggccacagggtaagagggcatgatggggctggtggtcagggtgtggacagttccagggtttcagtgtctgtctgcacccaatgcttctaaaatctcccttagacaactgctattattccgtctgctgccacaaataagaagtaggcatcaccagagtggctggcctggagagagtggaaggtcagggccaggccaggccagtcctggattctctccagcctaaggaggcccaacccggcacagggtacagggtgctgggcctggagccacagtctgagggagttcttcctcccagcatctcctggacattttctttctcagactctcctcagcccccaagactcaacgccacctcacctcctccaggaaactctcctggactggcccatcctagtctcaggacctcacagcatggagcagaactgcagcagcctcgtttccgccacccacaccggagctgcgggggccctgctctggtccccttcccgtggctgagctgagctgtgggctaagtggtctcatggcaagtctgctccatcatcgctctctgctgcccatcagcttgggaagggcctaggcctcaaaagaggtttgatcgatgccacctgctggaaaaggcactgaggtgatgggtggtggtctcagaggctaaaggagacagatgagccacaggagtattctggagctgggaggcaggacagaggcctgggcttgagcctcgtgtctattatcagttgcttgcaagcctgggtagtcactgcccgctctgtgccccagtcacctcctctgtactgggagagggtagacaagagtctagtctaagcatctgctccagatattcttggtaatgggagatcaaagccacaagccataaaaagagtgagactctctccacaccccacatgtaactaaaaacagagaagtctaaattgtaaaataaaaggaagttcaacaaactgttgacctttccatggtgactattctgatgtttttgaaatataaaatattaggccgggcaaggtggctcatgcctgtagtcccaacactttgggaggccgaggcaggtcgatcacctgagggcaggagaccagcctgaccaatatggtgagaccctgtctctactaaaaatacaaaaattagccaggcgtggtggcaggcgcctgtaatcccagctactcgggaggctgaggcaggagaactgcttgaacctgggaggcagaagttatggtgagccaagatccagcctgggctccagcctgggcagcagagcaagactctgtctcaaaaaataaaataaaataaaatgaaatataaaatattaaaatctgtccaaaaacgtgttccttgctggtaccctacacattgtggcctgcttcctgggtgatctggccccaggtgggatgctaatcccaagtcccctcccagcacagcctcagcccatctttcagggagaactcagctaccaggagcctttcatccacataagcttgatgcccatccaattctccggccaacctcctgagcaggggcaggagacccatgggaagtctgctcagatcactaggcaggaccaccctggcctccggcttaatcttagcagcctccaggggctcacctgaccgtgctgtctcatcacagggggcccccgaaaggactcatggcttggcttgcccagaggcttccatgggacagttaaaggctaaaatgggaccccccaggcagcagaagtgcctccccccaccccacattccagtttttaccctgggcctgacaacacaggaagcaggctccctgccaacactcacaccctctaccatacagacacttgcccccagtctctggtcaacactctctcacagggtcctcaccctcatcagcccaacccctgctctgtaacagaagggagctctgccaggcggagcctccacactcagagaacaaactacagagtcaaggacctgccccaagtgggtgccatggggagagggcctcggtggcggggggaggctggctggaggaggaacagaatggcagagccctggagtccaaaggccctggctgacagaactggcaacacgaagcctcagccgcccttcccaacaagcctggggccctgacccaccgagcaagactcctttcctggaggagctgccactctctaacctctggctctaactgagccccatcagagacagacagtcaaggctgtagtctgcagacacctggctggagctgagggcacagcagcccctcgaagcagcgggtgagaggacttactggctatgcagagcagagtgtggaagagccacatccttgctggagcagaggcggctgtgtgggagccgaggcgagtgcgacacatgggccgtggcccactcagcttcccctcagccaggaggccaggaggcggggacagaagcacacacaccagcaaggacccacagaccggcactttcaaccaaacagagacactccggctcgtacacaaccagccgtgtggcttcctcagttgtgggctggaccctaggagcttaggggccactgtcagccccactctaccacccacactttgacccacactttcatggaatagggagctgaggtttggccagggccacagttctaggtgtcctcagcagatgctggaggtgcaggagcaacgtgaatccagcctgccgttcgtatcatccatttgagtcggtcccctgtcctgcctcagaacctaccaccagacatctcagcccagcttccagcccagggtcctcggtggtggttgcctcagcactgagacaggcgtccccctcccataggaagtgcctccccagccaaaaactgggctcttgtaccagcccatgcactcaaggccctggggttctggagggccaggtgagtggaaagacccaacgcactgagtgaaatcactgcctcgattcaacttcggctgcgttcattctctttaaaaccaggacagcaacctgacgtggaaactgactgaacaggactctgagttaccagaataacagaagtaaaattctatacatcttccagcatacctgtgatgcatcccagcattccacagaacacgccgttgacagctggcagtcgtgtttaagtgctgatctgagatctgtactgtgtgaccaagtctgtgacacagaaggaactctcctgcacccctgctccccaggctgctggaagtgcagagtggcgccgtcaaacagaactctgcgcggggatggaactgctctaggtcgacgctgtccaggatggtactcatgagccacatatggtactaaacccttaaaatgccactagaacaactgatgaactgaattttgtatattttatttaattttaattaaacgtaaaaaggcaggacattccaaggctctctaacacgagtgtctgcagccccattcgctttgagatgtgaatgtgttaacccagggtggacaatggtgttgacttcattactagataaaaatccatgttattttgtttctcgcattgaaaggctgcttggctaaggttctgtgaagatccgatgacatttccaacactttgccttgtctgctttgctctgacaaagtgcttatgactactagatcttgctcggttatgtgagattacaattcaccggtttccatcctgtatgaaacagaagttaaacagttgtaaaagcaaaattccaggtctggtggttttcctgccaggtcatgatgaaaccatcctacttctgttgaacctcgtcccaggcaggatcggggcctgcggcctacagcctgtcttcccagcgctccagggctcgtgaccctcctcctcccctcacttcattctgcgctccaagggcactggggagagtcacagtggtctcctctcccccgcattggcctaaagcaggaagagagcagcccagtcactgagcagatccctgctagggcagggctagaacccagactgcagctcactcgagattcctgagagaagactttgtgtttggagtgtgaacgtcagggtgcctcgggaagccagggaaagctgatgactgggtgctggacagggagcagggccacttctgtacctctgcacacttctagaatgcggactcatcctgcatccatccagtatgtatttatccaagcgtcactgcctctagtcatgagacacacaggggtccgtaaagcccacctggcggtagctgctttccccacaaacccaaactacatccccaaggtcagggccaggctctgttgagtaatgctccccatcacagcacgcagcacaaggctggctgtttgacaaatacacacataaccaaaagacatgtgaatgtggtttcccaactcactttaaacaaatattccgggaccaacttcaaggacgttctacaacagaaactggactgtactcttcacaaacatcaatgtcatgaaagacagaaaggctgaggacctgctccaaacgaaaggaggctgcagagaggacaactaaaggcagcgcttgatcctggattggatcctggaccagaaaaacaacggctttcaaaatcattattgggacagttggcaaatttgaaacaggaactacaaattagcaactcctgggctgatcagagaatattacacatttcctgaatttgagaactgtaccatgggcatgtgagaggctgtccctgttcttgggaaatgttcactaaaacatcttacggataaacgagcatgatgtatacaaataatcctcaaatggttcatggttcagagaggataggaagaaacaggggtgagggagaagaggagggaacgaatgaaagagaaaatgtggcaaaatgttctttgttgtacccttcaaactgctgtgattttgaaattatttcaaaataaagttttaaatattttaaaaaatttttttctttctccccttgataccaggaagaataaagtttttaaaaaatgggcaggtgggccaggcgcggtggctcacgcctgtaatcccagcactttgggaggccgaggcgggcggatcacaaagtcaggagatcgagaccatcctggctaacacggtgaaacccggtctctactaaaaatacaaaaaaaattagccaggcgtggtggcgggtgcctgtagtcccagctactcaggagggtgaggcaggagaatggcgtgaacccaggaggcggagctcgcagtgggcggagatcatgccactgcactccacttgggtgacagagcgagactccgtctcagaaaaagtggccaggtgcacttgtagtcacagttacttaagaggttcaagctacttgggaaagcttgagcccaggagtttgagtccaatctagacaacatagtatgaacctgtctctttaaaaaaaagttgcaaaatgttcatggatggaggagacgtgctcggcgtgaggtgaaagggctgcctgtgggtcgggcgtggtagctgacacctgtaatcccagcactttgggaagccgaggtaggcggatcgcctgagttcaggagtttgagaccagcctgggcaacatggtgaaaccctgtctttactaaaaacacaaaaaattagccaggcgtggcagcgtgtgcctgtagccccagcttcgggaggctatggtgggagaattgcttgaacctgggaggcggagggtgcagtgagccgagactgcgccattgcactccagcctgggcgacaagagcaagacttcatctccaaaaaaaacagaaagggctgcctgctgtcttcagagtgagtcaaaagcactgaggcacagccttcagacacaggaaatggttctattctcccacttgccttctgactcttaggaagccagaaagagtgacggcattgctgagaccagagcccagggctgcagagcagtggtactcacgacctttgaacactcggtaggagtgccctgctcagtgccaaggcctcacatgcgagccctcatctgagcctctcagccacctacaaggtcaacccgatttctcagataaggatgctgcctctgagaggccacatagctagtaaggagcagagctgggactccaaacaggcctgtttcctccagaatcaggactctgaaccaccacaaactctcctgccttcagctcttttggtgtgtagactttttttatttttgtttttgagatggagtcttgctctttcatccagactggagtgcagtggcacaatctcagcttactgcaacctctgcctcctgggttcaagcgattctcctgcctcagcctcccgagtagctgggactacaggtgcccgccaccacacccggctaatttttgtatttttagtagagacggggtttcaccatgttggccaggctggtctcgaactcctgacatcaggtgatccccgcctcggcctcccaaagtgctgagactacaggtgtgagccacgtgcccagctaggtggtgtgtaaactttaaaaaagcagagatttcatcccacaaatgcagactgggatctccacatgaccaggtgctgtggactgaactgtaaatgtcctccaaattcatatgttgaagccctaacccccaatgtggctcttcttggacatatggcttttaggaagtaattaaggttagatgaggtcataatccagcaagattggtggccttacaagagccatgtgcaggcaccaagaaaagcctacgtgaataagacagcaagagggtgctcaccatgttggcatcctccggcctcagatctgtgggggactgcgggggtgatgggacagggagagaacaaggagtggattttcttgtcctttctaaggaaggggctgggagggcgagggctgcactgggtgctgggactaagggtccaggggcttggatctcttgtttacaaacccctacttctttcctgctatctagcccacacccctgatgctccccggaaaggagagcaaggatccttgaacacgcgttagcactagaaggaaactggagctcaccccagttgagccctccatttgacagacagggaagctgaggcccagggaggtgaggggacttgctcagtctttccaattgagtatgtggggcagaaggagtccccagagccccggccccagccaccatcctatttgactttccccaacaggcattctacctcagctaaagatgctgcctgcctctcacaggccctgaggagaagatggccacatcacaggatcgaacactaccacaaaactcctaggaagggacaggaaggtgagaatcctttcttttttttttgagacggagtctcgctctgtcgcccaggctggagcgcagtggcgcgatctcacctcactgcaacctctgcctcccgggttcaagtaattctcctgtctcagcctcccaagtagctgggactacaggtacccaccaccacgcccagctaatttttgtatttctagtagagacggggttccaacatgttggccaggctgctcttgaactcctgacctcaggtgatccacccgcctcggcctcccaaagtgctgggattacaggcgtgagccaccaagcccggcctgagaattctcttctgtcaatggtgtgggcctctcgacctcactaacctatattggcccagaggtgatggtgacaatttgagataacacaaagtctcaactatttacgaacctggtcatccagagagggccccggaattgctcaaatgaacagtaagaatcctgaggcagggtactgaccttggtaggtgaaataccgcctatactctcaagttttatggatagtgcagccaaattccactcggatgcctcacaactacttaaaattggctttttgaagcagcatttccctaactactcccaggaacaaagttctgtgaaatgttcatagagcttcattgaaaaaaaaaaaaaaaaaaaagctacaatatttttcttctaagatttattttataaacatgtaagaaaagttgtagatatttattgtgggtctggttatgcaagaacaatcttcctggacacagtgtgcgattctcagtatcaaaagcattctcttctttcagttcgtaaaagaaaaacatggtttaacttctaatttactgcttattataaggtttaaaagcaattactgtacttatgtatcgaacttatttgtgtagcaactaattcatctgtgaagccatggtttgctgtggcttcacagtaaattttgacttaagtctaaagcgtgtgttagcatctcaccgtaacttaatgcttcgagtgagaagtttgaggaatgctgctttaggcaaaagagccactggaggaatgagctctgctcttttcacctgctctggactgctctcactttcctcaccgacaggaccacaggcttaagaactggctcagcagtccttctttagggtctagcgcctgcctaccagcttcctctacttctatcccgggacagatgaatgcttttctaaaaaatattttggaccatctgcatgattccctagcaaatgctttagagagctggtaagcttcagctccgacatggccagatcatcaaaatttgaagtttactcaggtctatttaatgagatttttttttcttatacaaccatatgcacttctgaataatcttccctttttcgaatctggggctttcatctggaattagactaacctgcagacagtgatgccagaactgggctgggttaccataattcattcatttaccaaacactttcgaagcactacttactctgggctggcctgatgaaaggatacagagataacaccacaaagaaacttgctcattaggagcttgcttactggctagaaaggaaaatacaacatgaaaataaagcattgtacgtacatggcagaaaaatgactagcctgccagagggccccagagcctcagaggatggagccactcctgaggctggagggtttacaaactcatcccatctttacagaagacctgctagatgccaggcatgctggcaggcacaggggaaagcccactcaacaagcagacacggtccctgctctcacggagcttacagtctagcaagacaaactaggaacaagaaattacagtccagtgtagaggtgtgcagggttgtggggtacagtgatttggcattatacacacatttcgcttaaacacaatggtatttgtctgaaaaagatttaaaaaaagaaaaacaaatcagttgtttgggccattccgctggcccctccttcactccatgagcatagacaagagggcgggcccgggcaagctcatgcctctgctgcacctgcggcctgcctcagttcccaagctccccaaaagtgatcttctcgcctaaatgtggttctaacaccccaaaacaagtgatttttgcacaacacagccctaactgcaggccaatcacttcacctggtactcaaccaaacagtaatgtgttcccacatgggcaagaaatgactacatgggacctcaagatgttggtcttcaatagggcaccttccttagatttctaagaggaattttaattacactccatttttatcttaggcactgaccttagaactgaatcctggagagagctgagactcttctgtggcagtaccatgggacacatagaagtagcctataccctggctctggaagttggggactgcctcctagaagggcccctaagaccttaagttggtgaggggaagattgaggcgggagggggagaagcctgggcggaagcatgtcactggaggtagaaacagctctgtgcacagtctgtagggctagtgagatcaagatacatttagggaactggtgagcagagggcaggggagatggggagaacaggccagggatactgccagaggatagaccttggtgagcctcataacatgctatcaaaaagggtggaatttatgtatgtatgtattttttgagacaggtcttgctctgctgcccaggctggagtgcagtggcttgatcatagctcaccacagccttgaattactgggctcatgcgatcaggagtgtggaatttattctcggggcaatagtgaagctttggaaaacgttcaagcagaggaataacagaatcagatatatatttaagaaagttcatcctgaagcatgtgaaaaggtgcccgacatcattagtcattagggaaatacaaatcaaaaccacaatgagagccaggcgtggtggctcatgcctgtaatctcggcactttgggaggtcaaggcaggaggatcacttgaggccaggagtgctagacggcctgggcaacataacgaaaccccatctgtacaaaatgtattttaaaaagaaaaaataaaaacaaaaaactacaatgagataccacttcacaccagaaaataatgagtgttggtggagatgtggagaaactggaaccctcgcacactgctggtggaatggaaaatgatacagctgcttggaaaaaccacctggtggttcctgaaaaggttaaagataattatgactcagcaattccactcctaggtatatacccaagagtcatgaaaatacctgtccctgcaaaaacttgttcgggaatgttcgtagcaacactattcataatagccaaaaagtagggccaggtgcagtggctcacacctgtaatcccagaactttgggaggaagaggtgggcagatcacctgaggtcaggagttcgagaccagcctgaccaacatggtgaaaccctgtctctactaaaaatacaaaaaattagccagcgtggtggcacatgcctgtaatcccagctactctggaggctgaggcaggagaatcgcttgaaccccggaggtggaggttgcagtgggccgagatcgtgccattgcactccagcctgcacaacaagagcgaaactgtgtctcaaaaataaataatagaaatagaaatatatatatatagccctaaagtagaaacaactcaaatgcccattaaccaatgtggattaaaaaaaaggtggcatacccataaaatggactattatttggcaattttaaaaaatgaaatactgatagaagctatgacatggatgaacctcagaaatatgttaagaagccagtcacaaatagacacatagtatatgatcccatttatatgaactatccagaacaggcaaatccacagagagagaaggaagatcagtggtggccagaggctaagagggaagagggaatagggagaattgctaatggactcagggtttctttgggtgatcaaagtgttttaaaattgattacggtgctggtgcataactgtaaatatactaaaagccactcaagtgtacactttaaatggctgaactgtatgcaaattacatctaaattaagctggtaacaacaacaaaggttcatcccgctgcagtgtgcagaatggagacagggcagagaccagtgaagaggctgctgtacaaatgcagctggaaagggcagtggctgaagaacggagaggggttcacaggatcagactacaagggggccagaggaggagactacatcctgaggacgccacaaattatcctgggtacctggtaactctccagagaggagagtgggaaacaaatgaggtatctgcaattatcatcaagcagcaaacatgtatgtaaaatctcctacacataagactaagaggaacacacaaagtgtgcagccctgtgcccacatgtgtggggagtgtccagggtaaaatcacgcccagctgcctgccacgggcctgtcctgactatccattcttactcttaaactccaaagaaaaggcctcatcattcaggacacactcaagatgttgcaagatctgagtgactgagagtgggcaggagggttagagaaactaataaggccagtaactccgagaagtaaaaatctttaaagctgcctttctgggttctctctgtgtgtctgtgaaaactgtaaggttactcgagtgtgtatttctcttggttacatcaaagacccagttttgactgcacaccacctccttccagaatggcttcgctgatctgtagcaggagactgctgagtgctgaaaggccgtggaacaaatggacctgagctgctggtgtaaaaccaaaaggaaagtctgtgaaggagcatattctaaaccctgcagaggcatgccagctgggacgctgaccacaagacatctttgccccgtcagtagaagcagagactgtgctgggatgggaataagcccctgtctacacctcatgcgcgccctcagttgtctccctggcgcctcctccacctgcagtagaaattcatgctggcgagcccactgccgtcacagcttgggaagagtaaaccgccactgagatgcaccaacaaagccaggaattctggtaacagcccactcaactgctagacgggaaaactgaggcccaggtccatggagcagagccaggggttggcatccaggtgtccgattctcaggcccccgcactcctcactctaccaactccccaaaccctgacccttcctaagaacctggctctcagctgtatgcttcacagggaaagaaaagctgagaaatctcagatgtcttaagtctcaactggcagagaaaccagaaccatctctttcctagaatcctaataagaagctgaaatatatcatggttatatcctctaatctctctaaagggagggagaaaaagcaaggttaatcaacaaaatatgggacaatacagtttttgttgcagctctcaaatcttgcagccctttacttcctttattaataacagtgttctgcattaattcgtgccacagtgtaatcaactatcaatgtgaccattagctccgccacaagtaaagatcgacaggatccaggctgcactgtgtgcacaacagcccaggcaggtgaagagtcgtgacatcgcaaaaaggaccacggtttattaccatctctaacgcccatgttccagcaaaccgaagaaaaacactgtttcttaaaactgcagaggaatacaaaattaaatactacaaaacaaaaatcagacaggaagacgaaacaatctacctcctcctaatggtaaaataatctgaaaggagtttaaaaataaatgaactaaaatttttataactattatcttttctgccaattttgaagatgtcttcaggtgccacaacgtggggacagaaagaataaatatcaatgtataacttctagagtgataataaacaacaggaccccatctcagatggatggattttttttcctactggagccaaaaaacaagctgaactctatgtacaacagacagactatacaactaggagcatttaaaaataataagactcctctctctgccttcttccaaagaatagaatatatatttaacagcacaaaagacgacaccacttgagcttcccctttagccaacaggaagaatttccacatataaaaattaaaaatttaaactttcaaatcattcatgttttaaacataatacagacttaaaaattcttcaacattgacccataatcccaccccagcacaaaaatcaaccccaaatccagacgtcacagttttttgttcctaaaaatcccacagcactgaacttgatcttcacatcaagctgacagcacgtaagaggcccatgccatgagcaatccccgagggaagaacggaagcacagtcaatgctgcagctcttatctacctgggcggcactggtgcacctctgaggtcaggtccgtgagattcgccccacactagggtcccggaagggtgagctggccgcttccctcctcttccccctcgaaggatgtccaataagcacctgggaattgacttttcttgggaaaagggtgctggtaacagctgtcagggccaaggcaatagtgagaagttcagttctctgctctttggatgaactgtgtaaaacatttcttttaaaagacacaatgttaaaaatattaagaaaaatgtctacaaaatctggagggctgcctttttctcaaagggtaaagcctgtggggtggtgggaaaggaatcgagggcccagaactacaactctgcagcgaaagatagagatgcccttgaaaatgtgtcacattcttaagatgtcttgccgaagtagcaagagcggagggtgactgtgtgagcaggagcgagagggcgccagctcctgcgggggaggttcctactgcgcgccccaccctgtgcaagaatgtcaggctttagggcagctgccataggccccaggggcatcaggactctgcctctgaaccagagctgctttcccgactaacttcaatctggagagatggtaagttatctaaccggctcttcttttggcgagactgctctttctccttaatcagagccccccatgccctttgcagctcagagtcgtcttcctcagcgccaggcgccctgtgatccactttcttcgtattcttttctttggtcttgggtgcagatcctaggcgagtccataaattacctgtttggatgagatggcatttcactttcgcagtcagcgctaagaaccagggtagcactgagggggcagcagcactgccaacacctgctgtgcaggaaacgccagcagtctgtggagcctgccaccacagtgcagccttgggcaggcaaaatctcatttcccgggccgcagcccctgcccgcaaacggaagggtctggacccagcacgggattctcaccgtggggggacaggtcaggtccctccctgtcaccagacacatcagaatcacctgagaggccgtttcctcctactcctgcccttccctgctgagacaccaccctgtgtgccaatccattctgccagaagtaggccactcccagatcccttccattaatttttgaaatatattttatgaaaatttaacaatagagaaatacgtgtttagaattttgtagacggccacattataaggcaattcaaagttgtttttgtttttgtttttgagacaaggtcttgctgttgcccaggctgaagtgcagtggtgcaggcgcccaccaccacgcccggctcatttttgtgtttttagtagagacagggtttcaccatgttggttaggctggtctcgaactcctgacctcaagtgatccccccgtctcggcctcccaaattgctgggattacaggtgttgagccgctatgcctggcctaaaagttttatttataaagattataaaatgtggcaaacaactacgataaaatgctgtatgaaaaaactaggatttgtatgtgggcaaagaccagaatagctcacatgaaactaaaaagatttgtgccaaacagaaagagccaggagtgtgctatttttttctattttctaagcgttcctaactgttgggatgatgctgatgctgatgctgacgataactataatggaaaaggaataatcacttatatttggcgtgggctgtttcttgccttctgctaagaaagtatttctccaatacacccactgtcctctgctctcactgaatccccattcccatccgttttaagtgttaccaacctgatttcttctcccgagtatcggcgtagaggcctttactatcctgcctgggaacacctagcctactatgcacatcagaagagggctctctccgaacgacggggttactactaaaagccttttccggagaatgtggtctttttcctaaccgctggcgtatatctgaaaaaagagaaaaagtgcaccagtgaccgtgtgtgtgctttatgctcggcaccagccgcctgacacctctaacggatctggcgctaacccctgccccgaggacacagggcctgacaatcaggctgctaagtattcttcctttgtaatcagtctggatttccttaggaaaattcggacataggggctgtcagaggaaaaatcctcaactgattactccagaactatatttctgaagaaacaacctttttttttttttctttaagcagaatcaagaagactaagtaatttacaaaagtttcagcgaacaaaaaatcctgtgagctcctggaaagtggaaggcacaatctttgaacatacaagtagttcccaataaacttattacatttaaccagtaaatataaagagactggaaaaggcaaaggatcaaatgtgtttttccctcaatccccccagaaatcggcctgtcctcttgagttccccctaaccaccacagcaacaacagaaacacattcgttggtgaggccctgtgccgaggtctcctctcactttagcttctctcagagagcagcaccctggtctctggtcactgagacctgagctcctttcctccaacacttcctagcactgagtcttccttcacaagactatcctgttctttatccattctgtctccaccgacctagttcaggctcttgttacttttttaactctctaccccaccccactccaccctcaagttgtctttctaaaatagatgtaagatcaggttacttctcatgtaaaaaaatcaggtttgccaacagagatcctaccctctccaaggcctggctctaatgctactttctctaagaagtctttcacaacttcccgagtagatctatgacggctctgcgtcccctccaaaggcttctcacattcctagcacctagaccagggtctggcacatagcaggtacggctaaagacctgctgaatcagtgtttgaacatagaaattatctagttcaaactcttaactgttcagacaaccaccgaacttaatttctattattcttgtatataaagtataccagtgtcatacagaggaaaatatggttggccctcctcatccatggattccacatctatagattcaaccaactgctgatcgaatacatgtggaaaaaaagtaagacataagagtacagcaaaaaataatacaaattttacacaacacaggataagaatttataccgtattaggtattgtaaataatctagagatgacttaaagtatatgagaggatgtgtgtaggttatatgcagataatatgtcactttatataagggacttaagcatcaatggattttggtatctgtagggggcggggagggggtcctggaagcaagcccccagacataccaaggaacaactgtaattatttggaataaaaacatttaaagctagtttttcagaagtctgattatttttcatttcctcaatttccaacacctagcccacaatttagacatgatgaaccaggacagctaaatcagttcacacatcgcatgttttactcaggaacctctctctgccccagtctgctttccggagctcagaatccagccaggaatccaagtgaggaacagtacctgatttagtactgctgactggtggccgtggacgggagtgctgacgtttctcatctaatagatgtcggacatctgcaaatttctcaggtggtaatttgttaccaattcggtttttgatattgcttgaagatacactatctgccctcatggagttcctttaaaaagggggtaggatggggcacagttaaccaacttcaactgtgagacaagacccaaacaacaatctcatactttggaggaaacaatttaagaaatcctgtcttacatggccaacattcacttacaaatccataaacttataattatttgcttatggaaaccatgatctgcctgctctaaagagactggttctggtgagcaggttttcgaaggtggtttccacatgtgtatgtgctattacacagcatacaactacaagtcccccttttctgggacaaacgttaagtagaggcctacaaagagattggggcttccacttacacatgctgtgatgtggctgtagtcaacacacagtatagtctacagtctctctctttaaagggcagacttctctttcaaagagatatgctatcatgctaggtgccagcaccgttccggcagcattctctaccagaaagctctctgaaaaccaaaaataagaatgtgaacaggctcatgcctgtaatcccagcactttgggaagctgaggcgggcggatcacgaggtcaggagatcgagaccatcctggctaacatggtgaaacccagtctctactaaaaatacaaaaaattagctgggcgtggtggcctgtactcccagctccccgggaggctgaggcaggaaaatgctgtgaacccagaaggcggagcttgcagtgagccgagatcgtgttatcgctccactgcactccaggctgggcgacagagcgagactccgtctcaaaaaaaaaaagaacgtggtgaacaaggccatacaaacaaatcagcttgaatggtcttttcccctccccacaaacatactacgttacacagagcatccctagactctaacccttagaactgtggattctgcctgcacagaatctgctcacccctagtagtaatcaaagacatgcacattaaaataactattttttttttgttcatgaaactagctagcattagaaagaatggtaatagctaaggctggtgagcttgtaggtaacaggtggtaatgtgagtgattaaaacccttctgggattaaaacccttctgagcccgggcatggtggctcatgcctgtaatcccagcactttgggaggctgaggcaggtggatcacgaggtcaggagattgagaccatcctggccaacatgctgaaacccgtctctactaaaattacaaaaaattagccaggagtagtggcaggcgcctgtagtcccagctactcgggaggctgaggcaggagaatggcgtgaacctgggaggcggagtttgcagtgagccgagatcgcgccactgcactccagcctgggtgacagagcgagactccgtctcaaaaaaaaaataaaaacacacaaaaaacccttctggaaaaaaataaagcaatacttaccatctttttaaacacatattgttttgtgtaataactggactttgaggaatttattgagttagtgcaattgtaagaaaatagaaacctaaagtccatcaaaaaggaattcgttaaataaatcatgatactttcaaacaacagactatatacagttgaaaaaaataatgtctacaatatattaagtgaaaaatgcacaatgcaaaactataaatagcataacctcatctttataaaaagtatacttttatacaaatatatctacagcttttccctgtgccatacacacacacacacacacacacacaaatagctgaaaggttattcgccaaattgctaacagtagttattgttgagaaagaatgggaatacagatgattttcactttctatgttgtcttttgtttttataacaagaatcactgcttgtatagaggaaatactggatgcgtttattaaactcctacaagggactgaaatcagaatagataaaagatattataaaattaggaggaattaagaagttatactagtatttaaaatcaaattaaaagctagctttgataaaacaaatttttacctaatatttttcaactgagattccacttcgtcagcatacatagtcattttcatgcttttctttggtgaaggcgtggaaatcattttcagttctagatcatagtccatttcatctgagtctgagctgctggcactggatcgtctagacgcgctccgctcccggggctgcttgagagccgggagctcctcgtggtactctaccaccactctgtcatctgcatccatgtcctggtcttcttcttcctcttcctcttcctcctcctcctcctcttcctcctcttcaatgggttcctcgggaacattcactagccctgaagaaatttaaccagaaaacattaggaaaagcactaaaattaacaagtatgattttctactctacatcggtgacctttttaaaaggtggggttcccatccctgacattttattggagcactatctataatagtgccaaatggacattactctgatactgcaacaggaggatggctaggtaaagtatgatgcagcagcctaaccaaataccataaagtcatttaaaatacaactgacctttattattcacagattttgtatttgcaaatttaccaaatttatttgtaactccaaaatgaatacgtgcaatgcttccatggtcatttgctggcacgcacagagtggcaaaaaaatctgagtcaccaggcacacacactcccagtggaggtcaaacaaagcaacactccaccttcctgtttcatctcatgctgtaaacaagcgtctgtttcagtccaccgagtggcacatttttcacacttctgtgcctgctgctagtgatttcactgcttaaaatggccctgagtgtcgtgccgaagtgctgcctagtgttcctagatgcaagggggctgtgatgtgccttgtggaaaaataccatatcaggtaaggcattcaggcatgagttatagggctactggctgtgaactcaatgttaacgaatcaacaatgtgtcttaaataaggtgtcttaaagagaaacatatgggcccagcgcggtggctcacgcctgtaatcccagcactttgggaggccgaggtgggcagatcacgaggtcaggaaatcgagaccatcctggctaacatgctaataccctgtctctactaaaaaatacaacaaaaattagccgggcatggtggtgtgcgcttgtagtcccagctactcgggaggctgaggtaggagaatggcgtgaacccgggaggcggaggttgcagtgagccgagatcgcgccactgcactccagcctgggcaacagagcaagactctgtctcaaaaaaaaaaaaaagagagaaacatatgtaaaacaaggttacatattgatcaactgacaaaaatgatgtggccagaggctatgtacgattcagtatttgctacttcagtgttcacagtgactttatagaacataagcaccatgaataatgaaaatggaaaaatacaataaacgaaagaagtagaatataaagtacatgttcccaagagttatactatttattatgaaaacaaatgggaaaaatgtaagatgaactcagtcatcatacagggtactagaaataggggcaatttgctttttaatttccttaatatggatataaaaagtatatgatgaaaatattttaaagtaactcaaattggaaaagtgtaactgtgtaacagtaaagtatgtgtattattattattattttgagacaaagtcttgctctgtcgcccaggttggaatacagtggcacaatcttggctcactgcagccttgaccttccaggctcaggcaatctcagcctcccaagtagctgggaccacaggtatgtgccatcatgcctggtctggctaattttttaattttttgtaacgacaaggtctcactatgttgcccaggctggtctcaaactcctggtttcaagtgatcctcctgccttggcctcccaaagtgctgggattataggtgtgagccactgttcccatcctatgtgtattattaacatgtagatctcaaatatacaattttgtatatacacattaaataaaacatctagacttcatccctttctgtccccattacaatgataaatgtgtgtatatgttattttgtatgctgacttgactagttctattaggcatgtagaagattccatagattaggctcaaaacaagaacaattctttataaaacataaataaaatggttcttttacaataagcaccaaaaaaaggagaaagaaacccaagtcatgatatcccactcttctgaggc

SEQ ID NO: 290 - DNA, 30928 bp, Homo sapiens
aggacacattatggatgacagcagaaaactggcaatatctataaggccctttcctgccaggagtcctcccactatgacatcatcctctctgtgatcacaacttcctctactgcaaggtcaaagcccctctggtggctgggtgggcgtggtgactcacacctgtaatcccagcactttgaaaggctgaggtgggtggatcacctaaggtcaggagttagagaccagcctggccaacatggtgaaatcccgtctctactgaaaatacaaaaattagctgggcatggtagtgggcacctgtaatcccagctactcgggaggctgaggcaggagaatcatttgaacccgggagacggaggttgcagtgagcttagctcacgccattgcactccagcctgagcaacaagaacaaaactgcatctttaaaaaaaaagcccctctgctgttctacccttaaggggcctggttctatttagttgtttggcttttcttgtttgttctgtaaagacttaaaatgcagtttatgatcatgacctaatctgggtaccacagtcaaatattccttccatggaagagccagatagattttttttttaatatgggcaaaaaatcagagccatttgagcattaaaaagaataatgatgtgagattataaaatactgaaaaataaaaattcatgagtccaatttgacacacacaaacaaaaaacaagggaaaaaaatctgtcaccagtgaaatgactgttacagcaaacgccttactctaaaaattcgtatttaaaaggaaacaaacatttaccctttttaagaaggaactgtagcttgttcctagttgttgaggaaaagctcttctttatagacaaattctagccaatacacgtaacaggaatgacagaatcaaaaaatcaccatttcggccgggcgcggtggctcacgcctgtaatcccagcactttgggaggctgaggcaagaggatcacgaagtcaggagatcgagaccatcctggctaacatggtgagaccccatctctactaaaaatacaaaaaattagccgggcgtggcagcaggcgcctgtagttctagctgctcaggaggctgaggcaggagaatggcatgaacccggaaggcagagcttgcagtgagccgagatcgcaccgttgcactccagcctgggcgacagagcgagactctgtctcaaaaaaaaaaaaaaaaaatcaccattttgcaatccccaataaaaataacatgttcaggaaaggattaccagtggcttctaaaagcatttgatgaaaggctattggtagaaaggatattaatactaatatatagatacacaactggatagtatgtccccgtgatatgacataatatgaagtgcacatcaccgcccaagaagtgttcctgccacaactgtttaatctgagtgtcaataagctttagacccaattcctgcttcaaagaaagcacagggcagagaagtacttaacaccacaagataagaatcaggcaaatccagaatgtaggacactgcaaggtgagacagacagagagagaaacaaacttaacatctaagacccaaatgcaatgcatgaaccttgactgcattcttgttaggaaaaagcagtcattaaagttattttgagggtaatgagggtatcttttattgtagagagatcttagtcgatacataagaattactgttcaacttcctgactgtgacaagagcattctgattttagaggacaatatctttatccttagcaggtacacactgatgtacttagagataaaacgccatgatgtctaagactcttttaaatggtctgaaaagaaaaaacataccacatttacaattacaatgcaaatactacccatagtattaaccatttttcaatctgaatagtgtctatgagtgttctttgttctattctttcaacttccctatgtgcttaaatatttttgtaatcgaaaaagaaaaattacagctgggcacagtggctcacgcctgtaatcttaacattttgggagaccgaggggggtggatcgccaaaggtcaggagtttgagatcagactggccaacatggtgaaaccctatctctactaaacatacaaaaatcagccaggcatgctagtgcatgtctgtagtcccagctgctcgggaggttgaggcaggagaatcacttgaacccgggaggcggaggttgcagtgagccgagatcatgccactgcactccagcctgggcgacagaatgagattctgtctcaaaaaaaacccgaaaaattaaattcaggccaaaacagtaacaccactaccaccacaactgcactgagatgtcccagaagcctaaccacagtcaatttcaggaagagatatgagataaattggtcaggagagacctgggaaccagtaggccattcttagaactccaaaagttggccgggcacgtggtgactcacgcctataatcccagcactttgggaggccgaggcaggtggatcacctgaggtcaggagttcaagaccagcctgaccaacatggagaaaccccatctctactaaaaatacaaaattagccaggcgaggtggctcatgcctgtaatcccagctactctggaggctgaggcaggagaatcgcttgaactcgggaggtggaagttgcagtgagccaagatcacgccactgcacttcagcctgagcaacaagtgcaaaactctgtttcaaaaaaataaataaatgaattttaaaaagtaaaaacggccaggcgtagtggctcatgcctataatcccaacactttgggaggccaaggcgggcagatcacaaggtcaagagatcaagaccatcctggccaacatgatgaaatctcctctactaaaaatacaaaaaattagccgagtgtggtactgcaggcctgtagtcccagctactcaggaggctgaggcaggagaatcgcttgattcctccaccagggaggcacaggttgtagtgagctgagatcgcaccaccacactccagcctggcaacagagtgagactccatctcaaaaataaataaataaaaataaaaaataaaacaaaacaaataaaaagaaggctgggcatggtggctcacgcctgtaattccagctctctgggaggccaaagcaggtggatcacaaggtcaggggttcgagaccaccctggccaacatggtgaaaccccgtctctactaaaggtacaaaaaattagccaggcgtggtggtgtgcgcctgtaatcccagctactcaggaggcggaggttgcagtgagccgagatcgcatcattgcactccagcctcggtgacagggcaagaccccgtttcaaaaaaaagaaaaaaggtttaaaaaaaaaaaaaaaaaaaaaaaggaacttcaagagtctcaaaattctattggggtattggggaatctaagtgtgactttacttgacaagaccaggcctttggaaaacagcttaccctacctagtttcacaccataaaaagtccagtttatgaattacaagggctctgtccctgtccagtgagaagacacagggagatcacaaagccacataaggggtgcaggaattaggtggtgggaaggtatttggagatggtgtgcctaagctgaatggtcagcacatccctgtacagtgggactgctgccctgcccttgccctccagcaaccttcttgacaacattccagctgcctcatatctcattaggactcaggaatagggaaagctcacaatttcattcactaatagagtatatttgatcctaaagttaagagtcaaggaggacttatgggtagcctccttccccctacaacttaagaaggatccttccctcaacaacataagtctatcctcagctggctcctaacaaccaagcccctcttctagaaacctgaccaccccatcagcatccacactgtgcttcctctgtatcctctctccctatacactctatcagaaagtctttccttttgtcttctgatcttggctccctaggccctgggactcaccatggccttccggtcttcctcggccatcttgaggcgcttctgagcctcttcataagcctagaagaaaaaacaagaatggaggggtgtgaggccaaagagcccccacactgacagctgctcccctctagaatcacaaggatcattcagatgcgccctaacacaaaaaatgtcccctctcagtgaggaatctctctgattgcaggtacagcagacagttgtcttagccacaggatgcacagggcttctctcaccacagaggtgaacatctcactagagacagccccttgtcttcccagagatcactatctctgcactcacagccaacctcagatttcaccctgggatcttggggatttacagaacatgctgctcctattcaccttcttgtctgaccgttccaggacatttcgagtccgatccttgtcccgctgtcgaacccgctcagcaaaggcatcacgctcctccaggtcctgaaggcgttcacgctctgtccgttcccactcatcttccgactctggcttctctgtctgctgtttactccccctgcagcccatccaggggattaaataagggcatagagaacacttcagcctgccccatcctctctcaccctgcttctgacttaccctgttttcttcttccctttctcagaagcctcttcctcctcttcttcctcacgcttcttcctgaggtgtttccgctttttacgtttcttctggaggctgcttccagccctactcacagtctcctcactgctctcttcactgtcttccagtaacctataagatcggttcttctccagcagggcccgggcctctcgctctgctgcccgagctggcttttctaccactgcctttcgtggtacctgtcagtagaggggaagataaggaggtctgagcaactcctgatctctgccctcccacttagctctgttcctaatttaagcaattacttagtctttcctgcccccgcggcccggccccactgtcaggcaatggcgtgatctcggctcacttcaacctccgcctcccaggttcaagcaattctcctgcctcagcctcccaagtagctgagattacaggcacatgccaccacgcccgactatttttgtatttttagtagagatgaggtttcaccatgttggccaggctggtctcaaactcctgacctcatgatccactcacctcagcctcccaaagtgctgggattacaggcatgagccaccacacccgggcacaattacttagttttaaaccagctaaccagcattcattctctttcttcctcatggcttcaccccatcttcatcatcctgaatggggttttttatttttttttacagacagggtttcactctgtccctcttgggctcaagggatcctcccacctcaggctcctaagtagctagaaacacaggtgcacactaccacgctcaactaatttttaatttttttgtaggacgaaggtttcgccatgttgcccaggctggtctcgaactcctgggctcaagtaatcctcctgcctcagcctcccggggtgctgggattacaggtgtgagccactgcacccggccccctctgttaattaaacgactgaaaggaagttcagaagatgaggggggccgggcatggtggctcacgcctgtaatctcagcactctgagggggctgagagaggattgcttgagctgaggagttagagaccagcctgcgcaacacaccaaggcctcatctctaaaaataaaaataaaaataaaagatattagccgggggtggtggcgcgcgcccgtagtcccagctaccggggaagatgaggtgggagggtcgcttcaaccagggaggtcgacgctgtagtgagccgtgatcttacgaccgcactccagcctgggcgacggggcgagcgagactgtgtctctcaaaaaaaaaaaaaagaaagaaagaaatgcagaaactaagatccctactgaatcgcaatctgcattttaacaagaaccttggatgcatgttaagagttcgagaaacaccgttctattgcgcttaacccgacacacctaagccctcctcaatcttctccactgagctgggcgtccagcagctagcacagtacctacgcgacaacggacaaagaataagtgcttgtgaactgagctttcttaacttctcgatggaccgttaggccagcctcaccgggacaaatcacagggcccctccccacccctgccgacaccttgttccagagtctcagggcgaagtcccgggccggcccactgagatccaaggtatcagtgtctcgtaggcgctgcacgaactcctcggcagaggtgcagcgctgtgcggtaccgatcagaaactgggcgacgtgccgctcgctcagccccaacaccgagtgcagctcgtcctgaacccagcgctccagacccgccggcgtcgccatggcgactcacgctccctgctcccggccctgaagcgtcgggcagccgcgctcactgctgggccggtcagaggcctggagccctcggctggagcctcagcttcgcaagtcagctaccttgggacctctaggatcttccgacatcccaaagctgtcttcccgtaccgcggagcccggaaggggctgtactttttcggcctctaagcactacggtggccgagcgagttcaaacctcgcggaaccatacctgaaaactcggggtaattcttttttcttcatttcgcctctgtccagtttctctgacgccccctgatggtcagtctgtgagtgcttcgctcacgcattcattcaacaagtgaaattaatttaatggatgcctaatgtgtgctcattgctttccgtccctgggatatagcagaggacaaatcaaaagttccttaccaaatttacattttgcggtgggggagggacaggatacataataaagaaagtatggaaattttatagagccaaaaactatacaaagtaagggaggaatgaaattctatttcagattggaagatcgggtccatgctcataaaacatattagcattgttggccgggcgcggtggctcatgcctgtaatcccagcactttgggaggccaaggcgggcggattatctgaggtcaggagttcgagaccagcctggccaagatggcgaaaccctgtctctactaaaaatataaaaattagcctggcgtggtggtgtgcgcctgtagtcccagccactcgggaggctgaggcaggagaatcatttgaacatgggaagcagagtttgcagtgagccgagatcccaccacggcactccagcctgagcaacagaggaagtctctgtctcaaacaaacaaaaaagtgaccgttgctaggactggtttgcctgcagcaggagtgaagacaggtcaggtataagggaagacctctaggcaggaagaaactggggaactggggaaagttgttaaagacaaaatctccaaactaaggaacaggcaaactgtgttctgcatttttgcttaacagcttgagaaaatcactggtggctgcttatttaaaagtaagcaaggccaggtgcagtggctcttgctgtaatcccagcactttgggaggctgaggcaggaggatatcttgagaccaggggtttgagaccagcctgggcaacagggtgagaccccaccatctctacaaaaaattagccaggtgtggaggtgtgcacctgtagtcccagctactctggagactgagacaggagaatttttttttttttttttggagacagagtctcgctctgttgcccagactggagtgcaatggcacgatctcggctcactgcaacttccgcctcccaggttcaagtgattctcctgcctcagcctcctgagtagctggaattacaagtgtgacaagcacatgccatcacgcccagctagtttttgtatttttaatacagatggggttttaccatgttggtcaggctggtctcaaactcctgacctcatgatccgcccgtctcggcctcccaaagtgctgggattacaggcgtgagccaccgcactgggcctgagacaggagaatctcttgagcccaggagccagaggttgcagtgagccgaggtcaggcactccaacctaggcaacagaccaagactatgctcaaaaaaaaaaaacaaacaaaacaaaaagctgaatttgttactcgatgctctgctgtctgatttgtttgatcctgcatcatacttttgtgattaattgcagttaccaggcactactgttaggaaatgaaacattgttcttattaatagccacaagtggatctacatcactgacttttttttttttttttttggaaagggagtctcggagtctcactctgtcgcccaggctggaatgcagtggcgtgatcttggctcactgcagcctccacctcctgggttcaagcaattctcctgcctcagcctcctgagtaggcgggactacaggtgcgtgccaccacgtccagctaattttttgtattttagtagagacggggtttcatcatgttgcccaggctggtctcaaactcctcagatgaggcagtccacccgccttggcatcccaaagtgttaggattacaggcatgagccaccacacctggcctgacctcttgaatgcattgttttctgtttctgagatggactgtgagcacccctggcacctcggagcttcctaactctgttttcctgggtcacaactggaaactttttaagacctttacctaacaggctactaatataatcattctgtttccttccctacccagaccttctctgaactggctgagtcttttgacacctggcttgttctcttgctagtaaattgaaaacctttggcgtatgcttaagttcaatttgtctcatatattttgttttatagtaaaggtgtggggcctcctctgaccagtctgagaggagcaacttgtagtggtagaaggactataactattcaaccatatctttgttagcctggagagctaacaacaaacaaacaaattttcctgatgagtaaaatattgatgttccacatttgtataagatattctttgaaatgggaaaattccaaatatcaactacatgggcaccaaagccatgcactatcaagatggtttttaaacctttttttttttttttgagatggagtctcactctgctgcccaggctggagtgtaatggcgcaatctcagctcactgcaagctccacctcccgggttcatgccattctcctgcctcagcctcccgagtagctgggactacaggtgcccaccactatgccccgctaattttttgtatttttagtagagacggggtttcaccgtgttagccaggatggtctcaatctcctgaccttatgatccgcctgcctcggcctcccaaagtgctgggatcacaggcgtgagccaccgtgcccggcctttaggcctttaacgatataaaatccattgtctatcagaggggaaccttttccaggaaactgactcttgtacatacttacttcattttgcagcaatttcagatttagtattcgtagccccagctctttaagtaagtatccctggattagccacatgggttgtgtcatacactacctagctgccttcatggcagcaggcttctgaatactagaacccttcaactcaaagtgtcctctgtaatattttaacccttttcttctattcattcatttgttgtcattcattctagaaataattccgtgtctactagttgacaggtacaggatattgcagtgaatccagctgatgtagtcagccctcatggcacttccagtctagtggacacttcaactgccctttctcatgtcacctgcttgtcctgcgtgaaacccacgtgcagcttcccagaccccttttgacatgtcagtgccgagttcctggttcatcccccatcattttcctctcccccagccaccagagcctcccctcacataccctttttttttcccaaagaaggagaagcagacgagttgaagagaactccattttattatggaaagttaaaaaacaaacaaaacaaaacaggcaattgataaaggcggcacaatggggaaggagaggtgaggtgtctccttagccacccgacaccatctcaattcagttcaattgtgaaccactaggagaaacagaattaaataactatcaaggggtacagagttaagagttccagccttccctcttggggaaaactaaggcaaagtaatactgagaaaaagtggaggaagccacaccttcaggtcactccaatgaggagactggaggggacagaggagagaattccacgcagacacagcaagtaagcgtggcttgtaaacctgggactttggcaggtggggctgggagctgatggaatttgtaaaccaggctgtggtcaagggaggaggcaggagctgtaaacaaaggggcagtgacctaggaaatgaaggagatgtgcctataaatggagtggggtctgggcctcccagagagacgagtgcttaaatcccgagagtccccacgggatggtggggaggaaggctgtggggagagtgtaccctgccatggggggcaggtgctccatctccaccctccagggagttctgtgccccttctcaggacttggcgctcactcttggatgacctaggatgcaccagcacgtttaaccccacccacaccagggactttggattagggtagaaattgggcaattggctctgcccccagaaacagggtggggaaagcaagttacaagatgttggttgcccttccctgccaggctcattatcagggtctgtctgccctgaatcttccgggctccaggatcttcagttataagaaggagggaggtatatccctatgttggaagatggtcaccgccggcaggactcatctgtgggagagggggcaataatgttagagaatgagtgagagcctctgccttctgcccacccttcccccccacacaaattgaagggcagttggcatgcaggaagtcctataatatcttccatatctaaagcatgttaccaccagtaaccacatccatcactcatttagctcggactctgtgccaggcatccttataactgtttaatctcaccataactccaggagagattaagtaatatgatatccagctgtggctcttggtgcttcacaaaaaattacttaatcttggcctggagcacctgtaatccaagcaatttgggaggctgaggcaggaggatcacttgaggtcaggagttcaagaccagcctgaccaacatggggaaaccctgtctctactaaaaatataaaaactagccaggtgtgatggtacacatctgtaatcccagctactagagaggctgaggcacaagaatcgcttgaatttgggaggcagaggttgcagtgagccaaggttgtgccactgcattccagtccaggcgacagagggagacgctgtctcaaaataaataaataaataaataaataaaattacttaatattttctacaagtctaggaggtagtttttggtttctgtttttttgagacagaatttcactctgtcacccaggctggagtgtagtggcgtcatctcggctcactgcaacctctgcttcccgggttcaagtgattctcctgcctcagactcccgagtagcagggattacaggtgtccacctccatgcctagctaatttttgtatttttagtagagatgggttttcactatgttggccaggctggtcttgaacttctgaccttgagtgatccacctgcctcggcctcccaaagtgctgagattacaggcgtgagccaccgtgcctggcctgtttgtttcttttgagacaggtcttcctttgttgcccaggctggagtgcagtgggtggtgcaatattggttcactgcagcctccaactcctgaggtcaaacgatgctcccacctcagccttccaagtacctggaaccacagctgcgcactgccacacctggctaatttttttttttttttttgagacggagtctcactctgttgtcaaggctggagtgcagtggcacgacctcggctcactgcaagctccgcctcccaggttcacgccattctcctgcctcagcctcccaagtagttgggactacaggtgcccgccaccacgcccagctaatttttttttgtatttttagtagagatggggtttcaccgtgttagccaggatggtctcgatctcctgacttcgtgatccgcccgcctcggcctcccaaagtgctgggatcacaggcgtgagccaccgtgcccggcccacacctggataatttttcaatttttttgtagagacaggattttgccatgttgcccagggtggtcttgaactcctgggctcaagcgatccacccgtcttggcttcccgaagtgctgggattacaggcatgagccacaggaggtagttattattaacttcatttcataaataataaactaaagcaagagatcagatggtttccctgagatcacacaattaaagagacaagctggaattccaactcaggcctgtcgacccaccctgtgattttgaccagattacagcactcaggaagagttctcgttttgaaacctgaagactcaatgtgtacttcactgccggggacctcagtttgcccatctgttaaaggagcatgttgaaccagaggacccgccaagccccttccgagtgcctacatgtaatcctccctcctctctcctggaccacagcgcccgctctgacagcagggggcgccctcgggccggcggagcctccgcttacccacaatcagggccttggtgcgcagcccgccctggagctctggctgcagcagcagcagctcttcctcatcctcttcgtcgtcgggttgggctgctggagggttgggggcactggggacctcaggctccgggcccagctcctccagtaccgaactctcggaggggtattggtacgtggtctccagggctgtctcgctgaaggagatcttaagctgaaggagggagaaaaagggggcaggaggcaaggtcagcaggggagaagcccgcgggggttgagggagagaaagcgggggcggggggggcggagtctgcaagggagcaggtgggactggcggaacgtgggggtgggggctggactcaggtgccccactcactctccccatccactctgggatccagttttcctttccatactggctctccaattctagagtttccctcttcgatcatatcatttcaaaacatcagactttgccctgtacgttggcaggggcttgggaggcagaagtgaataatataagaccaaggtccctgctatttcgagtgtgggaggcagaggggtaaaaagaaattaaaatacatggcgataagtcttgtgatcagaaccgagtctttgggcaccttgggggcaatcgagtgaacttcccagaggagcccagcagactggccagtggggaaagaactggctggggagcgagtctcagacaaaagcaaggttttcatacccacagccccttgctgtcctatgcaaaacccaggaccctgggcacctgttccctcctactctcctcattcctctcctatccatagcaaagggagtctagggcctaggaagagatgggagatgaacagaaaggccgagaggaaccaagagactccagcaacacacaggggaaagatgagccgctgacaccctgaaggctgggggagatgacaagggcagaaaggaaagtccacacaaacctggggtgggggtccacagtgtgcccaaagggacaggcacagagacaaaataccagacagggcacagaaaacccttggtaatcacactgtcccaagagcaggcgagtcccagctgttctcactgcctttctacccttcccctttgccctattaagaagctcagggggaaggggcagggtgggattaagtctaggagccaaagggattagggagacagcaggaggattccatatgaactacttggaaaggtccaaatgatctactcaggccttccctggcatctgtttgggaagacttggggtcagccgtacatccctgagtcccctaatgaactgaggtatgaaaagagagaagccagaagggtggctgggcaggtggttgttaagagctgcatcaatatgacaccagtcaggcatggtggctcacacctgtagccccagcactttgggaggttgaggcgggaggatttcttgagcccaggagttcgagaccagcctgggcaatagagtgacactgtctctaaaaaagaaaaaaaaagaaaaccagatatgacacctgggtccccatgggaaggtagaactcaggaactgtatatgttactccttgttggctctgaaccctgcagtgtctccccatctcacttggagcaaaaagtctactccaggctgggcgcggtggttcatgcctataatcccagaactttgggaggccgaggcgggcggatcacaaggtcaagagattgagaccatcctggccaacatggtgaaacctgtctctactaaaaatacaaaaaaattagctgggcatggtggcgtgcacctgtagtcccagctactcgagaggacgaggcaggagaattgcttgaacccgggaggcggaggttgcagtgagccgaggtcgcgccactgctctacggcttgggcaacagagcaagactctgtctcaaaaaaaaaaaaaaaaaaaagtctacttgattgcccccaaggtgcccagagcctgaccaaagcctacagggtgctcccagtatgccaccctccccttgcctctctggcctcttcctccactccagccacactggccttggttccctccacgcactcctacctcaggaccagaacagtactagctattccttctgcctggaacactcccccaaaatatccccatggctctgaccctcctgatcaccctattttgaagtctccatattcactccccctacctcctgaccctctaagttccactgttctatttttttttccataatcacttaccaccttctaacttactagataatttactaatatattatactcatgtctgctgttgaaaggagcttggggccgggtaaggtggctcacccctgtaatcccagcactttgggaggccaagacaggtggatcacttgaggtcaggagttcgagaccagcctggctaacatggtgaaaccccgtctctactaaaaatactaaaattagccgggtatggtggcgtgcgcctgtaattccagctactcaggaggctgaggctggagaatcacttgaacccgggaggtggaggttgcagtgagccgaaatctcaccattgaactccaggctgggagacagcgagactgtctcagaaaaaaaaaagaaaagaaaagaaaaaagaaaggagcttagaagttggtacaatgcaagaggttagggtttgttcagacctcacatgaggtgccatcagaggaccaatgctggggaaacgatctgcgggtggtccagcctgtacacatttgacccccagttcatgtctgtggaactgctggtagaatctagtgacagcagccagactgcttatatcccaagttctcagaagggaccgcttaggtttctgtaactgacagatttacccacatttctgggaacccatttttgttttcttctcatatcctcttttggaataataacctctgtactttattttctactctgaaaatgacttattttatttgctctcggtctatgtttatatctccccccctaccctgcctgtctcctcaccccccaccaacttctgactgggcttctcagaaatgcacagcctgcatgggagtgggggggtagagagggggtgactcactcgctcctctcccatcagctatataaggtcacaatggggctggtctctcagcccaaccaagaggcctctggggtagggcaccagccacagccatcccctgggctccagtggcagggctgggatttctctcctgatggcagggataaatttgatggaattagcctgcaaacgagttatttagggaaggtgaagcgggggttggtggcagggtcctcctatctcctattcctgagccagtgtgttgcagcagagctgggacaaggcacccagtccctgaagaacaggttgctgacagggggtagagggtggagggtgaggcgtctgggtcagaggaactctgtgctgcctcctccccacccccacccaagcagcggctgcttccttattctctcaccacatcctgagcacagatctggcaggcccagggcccagggcccagggttccccactcagccccaccagccttccggcccccaccccaggcttcctgtttgggcgatctgcttccggctcccctgctctctggcctaggtatggtcaccagcacaggtcctgccctgcacttgcttcctggctcccctgggatgctccctgggctttgggccccaaagcttcatgcttccctctgctcattcttccccagaggcacaagcctctctcagtaggaagtgacttttctgaacacctcacccgggtagcatttccggacttctgtttttttcatctgcccagccctgaggggaacaggctggtagcagtcagagggctgagggtaggttcccaagaaccatggcttagaggtgggagcttacgcttcatgtgaagatgaattgggggatcaaatgaacccccctccacccaaggcttaacccgtatctttagtccctgtggttccccactgacactgaggacacaaaaaaatcaaatctgaggatgttaacacatgggatgagaatgagactgggcttcccaggctctggggagatgtgtgtgactggagggacttcctaagtctgagatgtctgagtgtgggacctctgtctccctagagattttcaagctggaaacagatggatgtgcacagggaagaagtgaggccagggccagggggagtcatcctggctgcccccactttcctgcaggtctttgttgcaagtctaacctctgaccctctgctggcctcagccccaacccctgtccagaactcccactgtgctccctggccagtgcctgttctcaaaactgtctccaaattcacttctctcttttgctaccctaaggggagggaaagtccaggatggcaggaaaagaggggaaaaccgatccctgagccagttcttgggagggaggggaaacccagggaggaaggacaggggagtgaggggcgggggtattttggaagaggagaaggcttttcttgtcccaagagagaagggagcactgtctgaagcagtggcccagctgggggtgtgcaaccccgaggtcacccacttcaaatggcctctctgtgtctctcccatggggcagactcggggttcaaaagccttctctctgatctttggccggcccggttccatctcccctctcccctccatcctaggatgtccctattcagctctgccctccttcccacggggcagttggacctttctccattcacttctccctgcagtttctccctagaacacaaacccaccccaccccctccaccaccccaggctccctatcccttctccccagaaaaactgcaagtgctctcaccctggtgaccctgccctcactgattcaagctcgtcactttaggctctcccactggatgggctggggcaggtcacactcaggaaaggaaggaaagaaaagggggttggaaactcagagcccaagggaagggagaatgagcagcctggcacaccctgaaagagacacacccagagacagcctttgctggggcaggatcttttgggctcaaaatggaaaaggagggctctgagaaggaagggtgtatgtgcagagcgaggaagggtggtggcaggaattaacaagaaagaatagaggaagacaagaaaacaggggtataaaaaagaaagagaccagagtccagagaaaattgacaagtggacttctaagaagtctggcttggctgcttccctacctgtttgtggtgtctttcgggggaccccttggcaaggcagctgcggctgagacggaggtagccccccagaaccaagatctcctcggcagttgggtaccgcttcttcccagcccccgggactgcagcatcaactgtggctggagaggttggggtggctggggtcgcagggggcacagaccgccgggggttgacggtgaaggtgtgtccactgcggcggggggcccccacccctggccctgccttcaccccatagaacaggcggctcatgaggggatccccaggaggttggggggcagttggggctgggggtgggggagacagaggggctggtggtgggggctggagctccactgcttcctcttcctgctgtctcaggcctccagtcccagcgtcctctggtgggaggggggagggcacagagcagcagttctgcagggctctcagaggcctgccctgagcccccgcctcctccttctcagcctccccttctccagcctccacaccgggagattccagaagcttctctgctgactctggaggttctggtttctgagtttgagcctctatgtccctgggtgtccattctcgagccttcccggagttcagggtccatttccacccttctgttggcttcatgcccctctcgccatcttccacaggcctctgctctgctgcctccactcctgcggaactgttgccttgggcctcccttgtcagggtctcggacagctctgcagtctcttttggagctacccctggaactggccactcttcttttctcccacattcttccgagtagtcttgtctttcttctcctgacctcagcctccactctgttgcctccagttgtaccaaactctgttcctgagactctctggagtcaggtctccatttatgggcctctgtcaggcccaacttctggtaggcagattcccctgggctcagtctactttccacctcttttctcctggggctttgctctcgagactctgctagtctcagactccgctctggagtttctccaggactcagcctccatttccatgcctctgacagtcgggagctcctgtctcccacctctcctgggctttgcctccagtcccgagcctccagaggcctcaggctcaactcttgggctccccctatccccagcctcctctctctggtctccctcggacttagtctctcttctcttgactctcttcccttggggctctgatcccgcatctccccagggctgggtctccgctcccgggcctccagaggcccaggctttctctctgctagcagctcttcactccgttgttgttgctgctgctgctgctgccgctcctgccggatgaatcggttctggtgcactggcccgatggcctccagaaggaccgcagactcatccgggtctggaggtccagcctctacagtccctagcacagggctaggctccccaggggacagcccaagcttggcccggcggcgctccaggagccctcgtttccaggctggcatctgggacaggcgctcccgttctgctttctctcggcctcgaacggacgcctcctcctgccggcgccgggctagcagctgtagcttccagtctgggatggtggccatggtcgtcttgaggtgagggtagggagcactggggacagagaacaggaaggagaggctccagagagtgagacagcccgggggtgagactgagggtgggaggagaggaagtggagggggagaggtgggacacaaagcagggcagaggggctaaggatgaggacagagggaaagacggaaggcagagaactggggaaatggaaaaagtgaagagaagttgtgagcccaagttgggggtggtgggggtgatgtgagaggaagagtccggattggaggcaatgagggcaggagccagatgtggcagcacagggttaatgcgtattaaagaccgtctctaggatgtgagaaagagagagaagggcgaaaaggaaagttggcgtgagggagaagagagaaatgtggcaggggtgaggggaacctgggtgcaggccaggctgcctcagcgataccccagggaggctagtgtgggaaggaaggaccaggaatccctgaaaggaccaggaggcaacgggacctgagggggtgttggggaggcaaggaggggcggagagcgaacaggtctagaggagaagggaaaccagggaagaggggaaaggagggcggcggcagcagccgggcgcgtctcagcgcgggccccaaaggtcccggctccgcttccagcaccgctcgggccacgcctctccccagcccccacccctctgccccgcactccgcccccgaggcgggtcgggggaaatagccacccccgagactttcggaacccgggcgtcagggctgccagcgcgttcccagaaccctggcgtccacccccaccctgtcctgtcaccaccgcctgcctcccccaccgactgccccacgcgaccccagagtgccaagggccggctccatgtctcttctccccggcgcctgcaagtcctgcgccccgtccccgctctcatgaagccgtgacagagccggccgtctccaccccgctgtagccgcacagactgacaatctcggcacaaagaggagacagccaaggtccgggccagggacgggagcaaggacaggggcgaggagacacccactccccaagtctgagcccctcagtcaactcacaggccgcgggacccccgggggagggggtgcggaggagccgggcgtccagagagaggaagaggaggagagagggaccgagggagatccggagactggagggaggggaggagggagggagaggaggagggaaagaggcagcaaaggaggagggacggagacagagaccagggggccgggcgggggcggcgaccgctttgtctaaggacaatgaggagagggaagggggcgcagggcggagccgaggagagggcggggcctagatccctcccaccccgcgtgggactcgctgcgggactgccctcttctcgccccaaccactggtcctccgctctgtccccaggggccctcaccagcttcccgcccggacacgccaggtgtccagatcccttcccccagctcgccgacccagggcggtggcccgtgactcaggcccctcgtgggactttgggaggaagcggcagctgctccgagcggggcccgcccttcccatctcctgccgctcctccctacgcttttgccttctcatctgggtctgtaggtccagcctctgaagtcctttgttttgcggggtcgagggcagccgccaggctgtggggggctttgtggatgggcggcaggagaggcgctcagaagccagaggttttggatgctccctcccctaccagagctgctgccccgactctttctagcttcaacctgtctcccttgggtctacaggtcggctgccgggaaaaaggggatttgaaggaatgggaatggggacccggccgctctggcaaagtgggggcgggtctgcgggggtggccgaaccccagcggttgccagagggcgtggtggctgcccagactccagttcggtgctcccaggctccctctggctttctttcccaaactcagccctgtagcttgggagacactgacagactgcatgccatatgtagaaaaaggctgacttttattttcctgcagagcatcttcctcgggagagcagggagccccaagtcatcgagttaagagcaggagaatccccttgactaggttggggtctgagcccagaggcagggcctaaggaggtgcagagactagggccgggagtggtgaggcaaggttggggcctggagggacagctatgaccgttgaacttgcagaccctggtccaccttcttggagtggaagccagcggtgcagaaggggacccctgaggcgcagaggcaagtaacagtgccaggggagtggtcagggcagatcctttccttctcaggaggctgttgagggggagagtgtcatgctctaaacagtgaagggacagatgacttccataccccactcttccttgctggtgagaagtggaccttggagttcagtggctgaaactcagaatttagggtatggagctggacccagagaataaagtctcaagtagtagaaggggcatctccttcagtccatggatttgggcctctggcatgaagcagccagggcctggatgttaaggatttagaattcagtgggagaggaagaacagggcttgtaaccagagtgagctcctcactctgcctccccatcctggggccgagagagcaggtggagttttctttgtagctgggcccggaggtagcggaggtcttgctgatcaagcccgtgagccaggcccaggtagagggtaaggaggaaagcaaggaggagacggtccgtgcccagggtaggcaccacccacagcactgtcagcagctccacacacactgggtggcgcaggtgggagaagagtctgagagcccggggagacttcagggccagaggctcgcccagccccagcacatggtagtatacctaagagagggagaagagcttagaaatggagtcaagcccttttctcatcttgggcacttctttcctcctcttccaggcaccacccttctagaactcaggcccaggaaccccccttctgagacttggatccctgatcctgacttctgatccatgtaccttccccaggcccaggaggcccatgcttgctgcccttacgagggaaagtcaaagggaagggccacgagggagaagcagggagacagtagaagagcatgggaggagggaaacccttgaaagggaacgaggagttctaaaatgggtcagaggtcataggtagggatctcggagcctcacctgtttgaggcccatgagctcagcatagtcaaagacgagaaggatgctaaagatgaggagccaggagatgacatggagcacaaagcagaggagcggcacccaggtggcccatggctcagcccgagcctcccacaacacagggcctttgggtatgggctcccagtaccgcatcaccagctgtggaaggataaggggctgggtatcccagtggcctagtctgcccgaccttgggagacccagacccagatctgcccccaccacaggctagcctgcaactctcccccacctctctcctaagcatcaccaccaaatattcaccatgtggagggtgcgtgctgggtgaggtcccaaagatgtaaggatggcctgtctctaccctgagaacttatagaatagatggggtgacctgatagctacgcaaagtagtagcctgtgccaaccacccagtgaaaagacagacaaggccttctcttcagacctagggaagtggttttgaagaaagggtaggactgaagagaagggatctcaagcaggacataaacaaagttgcagaggtgagaagcatatcttgtgcttagggaaggacaagtacacccttcttgataaaaagtaggatatgtgctgtggaggaatggaagctgagattagttcctcaattctcctcctgaacccatattttgcccctccaatccacggcacccctcccacacttggtctcccttggggactcaactgccaggatttcatacctgcaaggccagggcctcatacctgcaaggccagggcagtgcaggccacatacagtgacctctgaaggaccccaaagtaccgggatgtccatgccttcactctttcagctgccatgaggctgtgctgcccaacaaatagaagcaggagccccagatcccatgccaggggggcaaggatgctgcggtcctgcagggcagccagccatccctggcgggcatctacaggaagttgagggaaaaagagacaaaagatcgaaacagtggcagaatgtttcccccaccctcatctcctcttggatccccaggccatgtcccttactgctttcaagagccttaatgcttcctctctaggctgtgcccatctcacttttccatccctagtttctgccctcttccctaggcctcctgcaaacctggggaagaggatttatagaacaccacatgttaggcagttgcaaaaagcatggctggagaggccacgctggattgcccctcttacttcggttctccaaatgctccttctttttaacactctcctctcaacagtcctctctacaaaacactttacttagaatactccggtcaccgcccttttcggctccctcagtcctcactctcccgcctctccaaaactctaatccttgagttcctaatttagaactcaggtctccctcccctgtagcttctcggccgctttcaaggttcgagttccctctcttggacttcccctgtcatttgtttccaagccccgccctcaatccctctcctacggctccaccttcctcctcccagttcatcctcgatccctcccgctcacccggaccaccagactccgggatccctccaagaagtggccgaagggaggtaaagcgcacgaactccactccggtgccaaaggccaggatgaaagaggcgagggcagcagggatcaggagcagtgcaggggccatggcgagaaatggaggggtggggaaaggggcggggtcgggattcccgctgccacaggccccgcccgcggccccgcccccggctgaatccagcccaggagggcggggctcctgcacgccaccgccaggcttccggcccgcctggcgcagccttccccatccagctgtggatccgtcctgggatgcgtgtcccggcctgctgtctctccgtcacagaagggaatgttagaatcccgagagagagctgttaagggtagcggctctgcagccgctcacgtgggttgaatctcagctcgtctagttttcccatctaaaatgaaaagttactgttttaccacaaaataaattaatgtatggaatacattgtacagaatacaatatacagaataaattctgtaacttactataaagttgagttgttgactggccagttgctaagaatggcaaataacttctctgtaaatactgaaaggtttgttgtaatagtgccagagattgttgattagtaaccacgagaataaacatgttaaaatatttgtgatagtaacctttgtcagaattaaagatcatgcagctaaggaccttgtcacagtagacgtacacatagtagggaccttagatatcattagactaattccatcaacttatagatagaagaaacaggtccagagagataattgcctgagttaggaagctgctaatcctgtaggctaagggaccagataattgctgagcagcctctcgcaggctttacattccttctccgtctcctgggctcagtactcccaccctcctctgaatcaatgctgttgtatgctgtaccagacatcttatgttttcccttgaattcagtctccaccctgctttctgcttcagtaagttgtcccaaatggacggtatcaatgaaagtcacagtttttattgagaaagtcctctcgccgggcgcggtggctcacgcctgtaatcccagcagtttgggaggccgaggcgggtggatcacgaggtcaggagatcgagaccacggtgaaaccccgtctctactaaaaatacaaaaaaaattagccgggcgcggtggcgggcgcttgtagtcacagctgctcaggaggctgaggcagaagaatggcgtgaacccgggaggcagagcttgcagtgagccgagatcgcgccactgcactccagcctgggcgacagagcaagactccatctcaaaaaaaaaaaaaaaaaaaaagaaaagaaaaaaaaaaaaagaaagtcctctctacacgactgctctgtcctcatctttttgagcttggaggtgatcacaacagagctgtgggtactaaggcactgcactattctttctgatttccctacaccctgcctacttctttgtaattatcactttattaaactctcccccaaattatcctaatttcactgtgctattcatttcctgctaggaccatgaatagagacacttaccacacaaagcaatgtgctacaagctatggggttcattggaagtgtaagaggccagactcggtggctcacgcctgtaatcccagcaattcgggaggctgaggtgggtggatcactttagaccagaagctggagaccagaatggccaacgtggtgaaaccccatttctactaaaaaattttaaaaattagctgggtgtggtggtatgcgcctgtaatcccagctacttgggaggctgaggcaggagaatccactgggtgatggagcaagattctgtctcaaacaaaaaaataaataaataaaatacaaggaagtgtaagaaaagatccctaatctctagatgtttaacctgaggcatttaaatagtaccactcatgaagagggagtgtagctgagtgctacatggtgctctacagacagcaggtatggtaagaaatcaaggtctctggctgggcgcagtggctcacagctgtaatcccagcacttgggaggccgaggcagttggatcatctgaggtcaggagtttgagaccagcctggccaacatggtgaaacctcgtctccacttaaaagacaaaaattagccaggtgtggtggcaggagcctgtaatcccagcttctcgggaggctgaggcaggagaatcgcttgaacccgggaggtggaggttgcgataagctgagatctcgccactggactccagcctgggtgacagagtgagactccgtctcaaaaaaaaaaaaaaaggagctgggcgcggtggctcatgcctgttatcccagcactatgggaggcctaggtgggtggatcacgaggtcaggggttagagaccagcctgaccaacatggcgaaaccccgtctctactaaaaatacaaaaattagccgggtgtggtggcacacacctgtagtcccaactacttgggaggctgaggcaggagaattgcttgaacctgggaggcggaggttgcagtaagccgagatcgcgccactgcactccagcctgggcaacagaacaagactccatctcaacaacaacaacaaaaaaaaaaggagccgggtgcagtggctcacgcctgtaatcccagcactttgcgaggccaaggtgggtggatcacctgaggtcgggagttcgagaccagcctgaccaacatggagaaaccctgtctctaccaaaaatacaaaattagctgggcgtggtggtgcatgcctgtaatcccagctactcagaaagctgaggcaggagaatcacttgaacccgagaggcggaggctgcagtgagccgagatcacgccattgaacccagcctgggcaacaagagtgaaactctgtctcaaaaaaaaaaaaaaaaaaatggaaagaaagaaatcagggcctccgggacatggacaattttagagtatgaaagctttgagttgtgcaaggggactaatatttatctgggtcatactgtctgccacccccacaatggctgtgcttaatgtatattatgagattagatatgtttaatagccagcaaaatgcttggcaaatctcatgctatttctactacaccaaagttttccaaacttaagtattacttacatgcagaaaagtgtacataagtaatcaactattttttaaaaattgaaattcatgcaacataaaattaacctttttttttttttgagttgcggtccaggctggagtgcagtggtatgatcacagctcactgcaacctcgaacttctgggcaaatggtcctcttgcctcagcctcctgagtagttgggactacaggcatgcgccaccacattcagctaactttttattttttgtagtgatggggtctcactatgatacccaggttggtctcaaactccttggctcaagtgatcctgctgccttagcctcccagggtgccaccatgccttgcctaaccactttattgtatttatttatttatttatttttgagacagagtttcgctcttattgcccaggctggagtgcaatggcgcgatcttggctcactgcaacctccgcctcttgggttcatgtgattctcctgcctcagcctcccaagtagctgggattacaggcgcccaccaccacatctggccaatttttgtatttttaatagagatagggtttcaccatgttggccaggctagtctcaatcaaactcctgacctcaggtgatccacccaccttggcctcccacagtgctgggattacaggcgtgagccaccacacccggcctagcctaaccactttaaagagaataatataatggtatttagtacattagtatattagtaataggtacaaccaccacctctatctaatttcaaaacattttttttttgagatggagctttgctcttattgcccatgctggagtgcaatggctgatctccgctcactgcaacctctgccacccaggttcaagcaattctcctgctcagcctcccaagtagctgggattacaggcatgtgccaccacgcctggctaattttgtatttttagtagtgacagggtttcaccatgttggtccagctagtctcgaactcctgacctcaagtgatccacctgccccagcctcccaaagtgctgggattacaggcatgagccaccacgctgggccttcaaaacattttcatcacccccaaataaaactccatacccatgaagttactccccattttctcatctcccccaccccacagccactggcaaccacaaatctgctcttgttctctatgggtttacctattctggatattccttacatgtgtaatcacataatatgtgttctgtttctggctttccttcacttagcaaaatattttgatattcatcctcaaaatattgtagcatatatcagtatttcatccttttctatggttgaataatatttgattatatggatatatcacaattgtttatccactcatttgctgatgaatatttgtgttgtttccacctttttggctattgtaaaaagtgctgatatgaacactcacgtacaagaatttgtttgaataactgttttcttttccttttttttttttttttttggagacagagtcgtgctctgttacccaggctggaatgtagttgcacaatcatggctcattgcagccttgacctcctcccacctcagcattccaagtagctgggattacaggcatgtgccaccacacctggctaaattttttttttttttttgagagagagtctttctctgtcacccaggctggagtgcagtggcatgatctcagctcactgcaacctctgcttcccgggttcacgtgattctgcagcctcagcctccccagtagctgggattacagccacatgccaccatgcccagctaatttttttattattattattattattttttgagacagagtctccctctatagccaggctcgagtgcagtggcatgatcttggctcactgcaaactctgactctctggttcaagtgattcttctgcctcagcctcacgagtagctgggactacaggcgcacgccaccacgcccagctaatttttgtatttttagtagagagggggtttcaccatgttggacaggatggtcttgatctcctgacctcatgatccacccgcctcagcctcccaaagtgttgggattacaggcgtgagccaccaggcccagttaatttttttttttttttagacggagttttgctcttgttgcaacggcatgatcttggctcaccacaatctccacctcccaggttcaagtgattctcctgcctcagcctccggagtagctgggattaccggcatgcaccaccacgcccagctaattttgtattttttagtagagacgggtttctccatgttggtcaggctggtatcgaactcctgacctcaggtgatccaaccaccttcggcctcccaaaatgctgggattacaggcatgagccaccacacccggctaatttttgtattttttagtagagatggggttttgccatgttggccaggctcgtcttgaactcctgacctcaggtgatctacccaccttgcctcccaaagtgctaggattataggcgtgagccaccgcacctagcccatttttgtattttttgtagtgacagggttttgccatgttgcccagactggttgcccgtgaagtcctgggctcatgcaatcctcccactttggcctcccaaactgctgggattataggcataagccaccccacccagcctggacacctgatttaaattcttttgggtgtacacctaggagcagaattgctggactgttcggtaattccgtatttaactttcttttttttcctccaatttgagagcaggtactgcttaagtgcttagattagaaaaacaatcacagtagacaccttagctcattcttctaataagtctgttgatccggttctccctgttgccagcatgtccactttctacaaaatgggtggtctttttctttactctaccttgtggagaggataatttgaagggctacaggaagttatttgcttctttgaagcattttccaacagtatagatctcaagaatcagatcctccatgcaggtgatgccatatttaccaagagataaagcaatcaaagtgtcatctgtcaaagcaatttgcttcttattgatttttgccataaccatgctggtagattagttcatttactgacttcagctttgggtacccccatgccatatatggttctacaatcctcagcatgttcattgaagccttgttgagcttcacaaaggttccactgaagatttaacaaaggcgaagaagctgcaacacctttcggacctttgggttcacaccactgatacctctgatcctgatgacaaacggcaatttgggttttgcaggtacatagaagtt

SEQ ID NO: 291 - DNA, 409251 bp, Homo sapiens
ggagagctctctcgtgtatcacttagaaagctcatccgtggatgtctgcagggcttcaggcaggactgagtaactctgtagcactgagtatctttgagcagtctggacacagtccacaggtaatgacggttgttctaagggggacggaaacgaaggaaaagagaatggactatctgcatgggagaaggggatgaacgtagtgggccacagggacgtctgagatgggctggggtagagggagggatgaatcagccatcaaggtgccctccctccctcaggtcctgggcaggaagtgtaccaggctcactgtgggcagacactccattcatttatgaatgatctgttgggaacctactgtgcgctggggctatctgttgagactctaccatgttctgggaaagtcagccagcacagcttcctcctgcctttcctggctctttctctccactgctgcctctctactctcttctggtcacaccctcacatctccctcttacatcagtttttcacaaaccacccaagcccaataagacttcacctggctggggtttaggatagagtctttctcagaagcatgttcagtttaatgggggacttctgaaaaccctagggccacaaaagccacagaaagggcaacataatggtggactttgggggagatctcagctcaagaggcccacagactgtgctgtaggaactggggagcagccaggtttctggagcctcctagctttccaccagtagcctggcctgaccactctctactcgccccaggtgcttcccgtctgccgtttctctgccttggggctccactcctggctgacctcctggcatctggtcagatccatgcccgttgccctctgcttctttatcttggtatctcttggcttaaatcctttatggatggactaagtgcccaagagtgccttttcatggtggctactctacaggtgtctggtgggctgaggatggcccagccttggatcaaacagccccctcagctgacctgccccagcccaggggatgggggcatcacacatataggtaccacctggaaggcactcgccgtggcagatacggtggcctttctgtccaggacaagcaacaattgtttttgtaataaggaggagagaacaaaagagagactgcgagagagagagggagagcgagagagagaaagagagagagagagagagagcttgtagaagataaaagctctctgcaccagagaggatgttcccatcctgcctccctcgcttcctgccttaactcattctacacacactgactgagcgccctccatgttctgggacctgattcagctactcttcctagtccactgtggtcttgtgaggtcagcgcttggtcaagattaggagaaaaactgcagggctgcagagacctctctgtccaacatctccctacgtgggcactactctgctgtgagctctgggtggacaccaggcatgatttacaatccctttcagggaattattgctgctaatgggcagagccaatttatgcttcccaagggggagggcaaaatcaattaatggagagcctgacatggccaggcctgatgacagagtgtggcctgacatccggaggtgataagggactttctgaggctgaactaataaggagattggggaaaaagaagaaaaacaacaccccctccccatctgcccaatcgatttggtgtacaatgggcagagaatgcagagtaaacagagcagctgggcacgagcctctttccatctgaacgagcctggagataaggactggacaggccgcccatcccaccatcaacataggtattcgctatggagcccctcaatagacatatccatatgggtgaaaaaggacactttccaaaccagaacacaggggagaagataaggcccacctgccccaggtgtgtgccttgtagtagaaagggcaagtggagacagagagcactggttttagatgccagctccctaactgtgccccccagatagtttgcaccacgtggctggagcggcaagctttcgatgtgggagcctgggctcccggagtctcccccacagcgtcctacgtggaggcggcggtggcgcgggtttgtaggggtctttgtgtgtcctcgtgagtatgatctcagaggtgggccagctcgtgctgtgaccagcagacagaccagggaaagctgaagggtgattcaaggtaaagccttgaaacagacaaacaaacacacctgttactaattttgctcagaaactgcatctttcttttttttaaggagcaggattcctcttgcacatgaaatctttcccagagccccaatctgaagcctacttaagagtggagctctggttgaagtaggggcagagggctcccatttccaccagcccagagagtgtgatttcaagagcccttacccgtaattctgaaatggatgcccttgtctaagttggacttccctcagcgcaggtcccaagacacaatgcgggtgtgcgtggttcatctgggacctgatccaggatgcgcaagcaggggagtggggaacagaaggcagtcgattcagggtgtgttttcgcacaggtgactgttgcgggcaactggggccccatcccgctggggacctctgggagactgtgcagaacacactgtagagttgttccacagagtggcaaggaagctggggtgtttatctaccaactcttgtcccttgttaattgaagattgctcctggggaggttaactcctgcactgccagcctgccctgcctgtgggctgagagcactcctgcggccagagagtccctgtgggtagaaagatgcaggtgcttaggacagaatgctactggtatagatggaggctttccacaagtgctgcatgtgacctccaggcgggctggggggatctggcagagtactgacactgtctgtcacaggctctagttctccactcctttgtctgggtcactgtggttttgtcattcctgcagggaaattgctcttctgtgaaccttaatgaaggggtggtcagcttgtcctggcatattaggccggtgcccttggaagcatgacaagagtgggaagaccataccctcatctcttgatggccactcaaattgaaaaaagaaattgtttttattgatttatttattttgagatggagtctcactctgtcgcccaggctggagtgcagtggcgcgatctcagctcactgcaacctctgcctcccgggttcaagcagttctctgccttagcctcccaagtagctgggattataggcagccgccaccatgcctggctaatttttgtattttaagtagagatggggtttcaccatcttgtccaggctggtcttgaactcctgacctcatgatccaccctcctcagcctcccaaagtgctgggattacaggcgtgagccactgtgcccggccatgaaagatattgttaaaagatctgctggccatcccctgttaatgaatctccctacatcccctcacctcttcagactataagaaaaacccatagctttgagagtcattggagctgcagcagcagcaagaagcctgggctgctgtgagccaggatgtagatgaggggtgccgctgagacagggaggagcagagcgtccccagggcctgggagagatactgagcccagaaaccagaggagagacagggccagctgctcttggtgtgtgagggtcctggcaaatatttttttgtggatggacccctgtgtgtataaacaatttgatgaaaaaaacttagtaccaaattcatgagcccatgtgaggtataatgattgatttgtgtagatttagaataatgacagagaagaggcacttaggcatttgtttattgtctaattggttcacatgacgattctttgtcctatgatgttaagagtccatcaaatcagcatgttagcgcaggtctggtggcccaatcccaggtagtgccataaaagaaatgccacaccagccagcgggaatgatctcctcatcaggctgctttcctggaaccagggactgactaggaagccctaaaacagcttcataggcataagtcctagagcaccttgggacatctggtcaaccctatgcatgcactggagaacttcctgaaagaagaaaagggaactgagacccacatgaggcctggactatgttaggggtggcctgcatggatgacgttgttggtcatggctggtcccagcaccagagggagacttagaaagtttttagcaaagcatgtcaaagcacaggttacccccaaaacatggggctgaaggcatggggactgcttgcctcagtctaaagacagtgatggaaaagacaaacccaggagatgtttcggagaaaagaaaacaacaacatcccacacctggggccagaaggggaggggtgctggcctggggaggggctgccctcctgagatcaggagctgagtgaatggagagggaagagtaccagctggcatgctgcttgctctttgctgagttccctctcagtgtgggtgaaactggctcagccctgctggctggcacgaggccatggaaaacccaaataaagcagttaactctgaaaaggttgctgcttcctcctattccttgggagatgcattcagggctacactcagaggccacttttcgcaaggtgaggaggagcttgtattcaaggaaacactgctttttcctcccacatttgacacatatgttttcaacatccaacattcacagccaacctctctacacctgctctgcctcggagccctggcagtccctggacacgtgttatggaaggaacactgtctcccccacatgctcacatggcccaaatccccacaagtcccctttttgccaagctccacgtcctttgcctcttcccatcacccaatacccaacctgccatcattgtcctaagcttcccttccctgcttctctctttgcaccttgccgggttctcacactcccacccaccttgatagtgagtccaagcccatcctaccccacccccaactccttcttctttttctgagacagggtcttgctctgtcatccaggctggagtgcagtggtgtgatcacagctcactgcagccttaacctcctgggttcaaggatcctcccacctcagcctcccgagtagctgagactacaggcgcttgctaccatgcccagctaaccccaactccttcttaatcagattgtcttgcttacttgtttattgtccctctctttttttttttttcagagaaggagtctcgctcttgttgcccaggttggagtgcagtggcacgatctcagctcactgcaaactctgcctccagggttcaagtgattgtcctgcctcagcctccagagtagctgggattacaggtgcgcaccaccacacccagctaatttttgtatttttagtagcgatggggtttcgccatgttggccaggttggtctcaaactcctgacctcgtgatccgccagcctcagtctcccaaagtgttgggattacaggcgtgagccaccatgcctggcttgtccctctccttcgttagaaggttccaagaatgctggcactttctctgtctctgtcacctctgactcctcagaacttagcacaatggatggcacatccttgtcaaaacaatgaccagatgaatgagacatgcttatgtttaaggaattacaaggagcattttttctgcctagatttgaaacacacacccattgcattttaaaaaatgtttctgtctatttactctatcaactgtgccatgcctggggctgtttctatttgttttttcttttttttttttttgagacagagtttcactcttgttgcccaagctggagtgcaatggcacaatttcggctcactgtaacctctgcctcctgggctcaagcaattctcctgcctcagcctctgagtagctgggattacaggtacgcaacaccatgcccggctattttttgtatttttagtagagacggggtttccccatgttgaacaggctgttcttgaactcctgacctcaggtgatcctcctgcctcggcctcccaaagtgctgggattataggagtgagccaccacacccggcctctatttctattgatggttttttctcctctcatggcccatattttcctgcttctttgcatgcctgattattttttaatggacaccagacattgtggattctatattgttggatgctggtttctttttggtttgtttttcatattcctttagatattttgaagctttgttttgggactcattgaagttacttggaaacttactggaaacaatttgactcctttggggctggctttttaagctttgttaggtgggaccagagcaatctatcatctaggactaatttggccccacttctgaggcagtaccttatgtgtctctatacaatgactgttttgggaggtttctccactctggctgttggaaacatgaactcttcccaacacagtgttatctcaggaaattattccacctgcttcctcctggtggttctttcccctgccttgggtaatttcttcacatgcagatgttgatcggtagttagctgaagactcaagggtaaccctctgaagatctccagagcatgctctctctctttctctctcttttttctcctctctctctccttctctctctctcatccctgggactctgccttgcaaatttaagccactttgtcctccctggattcccagctccatttcctcaactcagggaaaccactgggctctacctggttcccccttcctgggctgcagcctgaaaactcactgcaggcagtaagttggagcaatcatagggctcccctcacttgtttcccttctcttgcggatcaatcataccctatattgcttgttatccaatggctgaaaaccattggtttgtatagaggattttgtctcatttttagtcatttaaagcaggagggtaaatcaggtccttgttgcttcatcatggctgtaggtggtggtcctgcttttccatatacaggatgctctcagtgcctttccacaggctgcatggagagacaatgaactctgcactgagaaatcctagatccagtcatatactgtctctgggttccaatttctgtgccagtctgctattgctacaattaatgctatataacaaaccactctaaacctcagtggtttatgacaagcagcatatattctcatgccaataggtctttgggtgagccatagttcagctgatctgggctgggcttgcctgggaggctctgctccaggctgtagactgggctcaggtctgctctctggatgttccaggctgaaggggcagcagctacccatggcatgttcatcccaagagagatcactggagcaagaggcaagctcaaccatgagagcacaattcaagcctctgcctggatcaggtttgccaacaccacattagtcaaagtgggccatgacaaagctttggatgtgtaattctatactggtggtgaagaattaaaatgatgtattcagtataccacaatttctctatctgctttctaaaactcctttttagcaagatctgggcaagctacattttaacttccctcctccaacctccgtccaccctacttcttgtcaagggattggtagagccagttgaattctagcagggactgggctggagtcactggctaggctgctttccagaaaatgtttttgaaaatcccacattttggcctagagtgaactcagatacttcttgtcatccgtggctccactgatcccaggtggattgctggaaagtcttttcaaaacattgcatcaatttctcccatttgcagaggccagtgaactctgggaaggtgcactgctgtcaagcatgtgtccatatcaaaggctgggcttccattaggggatgttcggagcaaaaggccccttggccagttgctgcacacactttgcatatgctctggacaccagtggccccagatcccatgttgtgtgtttttctgtcttcatttcctttcctgtcttagtgattgccccaggaggctggttcacaccccgcatggggccatgccacacatctctgtcagtaaggcctttggatccaggagatgatgtctcagtgggagatctaatgttgaaagactctggcagggtatgtggctcatgcctgcaatcccagcactttgggaggccaaggcgggagcatcgcttaaggccaggaatttgagaccatcctgagccacacagtgagaccctgtctctacaaaaaatttaaaacgagctaggtgtggtggtgcatgcctgtagttccagctactttggaggctgaggtgagaggatcgcttgagcccaggagttggaggctgagtatggcttgagcccaggagttggaggctgactagtgaggtatggtcgcaccactgcaccccagcctggctgacagagaccccccccatctcaaaaaataaataaaagaaagtaaaaataaaagaaaataaaagttagtagactctacccagctctagagggctgagggcactaaggcatgccaagaatactgctgctgctacataggggactggggcaaatgccatgccatcttcagggctcttgagagtgtgtgtgtgtatgtgtgtgtgtgtgtgcagttacatgtgtgttccatggactcttggggaggcttctagaatcagaatttggtcttcctctggttctacagactttacagagggcttactatgttccattgaactgtgagggccaggagtggaccagagatgctggcccctgtcccgatgggattcagtcagagcctgggggaagtcagagtgacaccagcctgagaaacacatctgggttctggctcgtctactcatgaactgaaggaccgtttactgaacagcgactctgtgcttgggacacagcaatgagcaagacaaacaggtccctgttgcattggagctcttagtattatggggggttgcaggtatttcaaaaataggcaagttcggaaggataacatgtcagatagtgatgcagaaaaaatggtaatgggataggggataactagggggtgactcgagatggagtggtcaggggaagccccctgaagaggggacatttgtcagtggcatagaacagcaagctgaatctccccttcactctggccttctaattatataaaataggggtgtggattagaggagctcgatgggcctgcctagcttagaaatgtaatggtttaatcttctcctgcatgatcctgttacccagtcctaaaaaacgaaaaagaaaatcaagccaattatactatattaccactctgctcccctccagggtcatcaggtcctgtatttataggacagagacaccaggagcagtggaccagcacttttatccagttagcttcatttccaggtgccactcctgctcaccctccgctgcccctccctggctgcagctgggttggaaccccctggcccagggggcagttcttcaagaacctccttgagggctgcccaccttcccttggatctgtcatggagagggcccatggagacaagacccccaggcagctatgtttttccctgtggaagtggggagtgtcagcccaaatcctcccaagtggctgggtgaaggttgtgaggcccaaggtacccacactgccctctctcaagctctcagcagagcccctgggagctgcccactgttctctgggtgctatgatgtccttagaccctgcagggcagatggctccctggagacacagctgttcaggcactgcctccaggtcatcctggccaagaggctgatggtgaaagatgtggtctgggagatcaggattggccttcaggatgccctgcattccactgccttgcctgtggctgggacatcctgcctggacctgtcatggccatttctgggcttccaaaccagagcacgggccaagggagagagctggcaaatcgttaaaaataaaaatattccccccacattccactggtgtgagcatcctctgacattatattttgatggtgctatttcacattctcaaaagcttataaagatctacacaaaacgtcactacaacagtgagctgaagccttcaccctgcccctagcactctggccttgcctggccctgccagcagctccagcaaccacaggaaggatgttgtggtcagccccagccccagcctctcggtggcctccaggtcagcatccttaaagaaacacagtcccctccatgggaatcaaagtcactagttgctcccagcagcccatagttcacttctgaagccagagcaagtgaggggcgctgccttcatctgtgcttcattcttgctggcataattcatggatggatatttcctggaaattcaattgcttcccaaacctgaaagggagacaggatgcttttggttaggctgtgcatgcagacactgacttttcccaggattgaatcggggggaggggaggccaccagccactccccctgggtcttgggcactgcatctgtgtcttgcctcccaggagctgcatttataccccaagctctgaaggaagaggccccctttgccctttgcagaagctccatctccctaggctgagactgacgcctgttttcctaccccaccgttttctttccttttctttctttcttttttttgatggagtctcgctctgtcaccgaggctggagtcttgtcttttccttccttcctttcttctgtccttccttcccttccttccctttcttccctttcttccctttctcttctttctttctttttctttctctttcttctctttcattctttctctctttctctccccttctttccttcctttcttccctccctccctcccttccttcctttcttttccttccttcctttttctttctttctttctttctctttcctttctttccttctttcctttctttcttctttcttctctttctttctttctttcctccttccttccttcctttctctttcttttctttctttccttccttctttctttctttctttctttctttctttctttctttctttctttctttctttctttctttctttttctttcttttctttccctccctccctccagcctcccctcccttcccctcttccttccttccttccttctttctttttctttcttttctttctggacggagtcttgctctgttacccaggctggagtgcagtggcacaatctcggctcactgcaacctctgcctccggggttcaagtgattctcctgcctcagcctcccaagtatctggaattacaggcacccaccaccacgtctggctaatttttgtatttttactagagatggggtttcaccatgttgtccaggctggtctcaaattcctgagcttaagtgatccttcacctcagcctcccaaagtgctgggattacaggtgtgagctaccacacctggacaaccccatggttttcattgatgctcctacctaatcctcagattctctccttgctttttcctccagatattaattatattccaggatggctcctcctgaccatgtggcccctatcctgtcatctcccatggctgggcatggagagggttctctggattgagaaccagggcccttgcgttctagccaggacagtccccaacccacggtgtgactttgggcaagtcatgtcagttctctgggcctaacatttctctttgctggagcagatgagatacctggaaaaagcaaggtggcttcttgcttcacaaaatgtggtccatggaccagcagtgctggcatttccagggagcttgttaagaaaggcagagtctaagacatggtccaccctggacttactggatcagaatctacagtttgacaaaacctgtcgattcattagcacattaaaatgtgagaactggtaagagtgatatgcagttattttgcttaaagtttggctaatttagtaagagcaagagagaatttctgagattcttggatgaagtaataaatacaatgtttaaaaaaatttcagtggacagagagcctgaggggtgaggctgctcagggaacaggtgagcaggcagctgcagccctccaggttcggccacaggaacctggtactgggtgacgagtgttagcttggttggcttgatattgctgtggaagaaagggtaattcttggtgatacattgaatggccagctagtgcggaggaagagattggaaataattcacggctgtgagcccttggtctttcagttctaattctgtgtgcaagacctctggcaggccttgctgtttaattaaacaaatatggtccttatttttaagacattctgatctgtctgaattgaattctagaacgggaagtaagaagacaagtacaccgagcctatgatggtcatgtgttcctgtcactctggacttgtggttcccagctctgctacacaacggaaatctctggagaatctctagacatcctggtgcccagaccacagcccagaaccattcagtcaggatcactggggtgggtccaggtgattctgaggcatggccatggctgaaactcactgcttttgtctctctagtacaaggactggcagggcaagagctgggggcccgtgggcacgtggctgctgatgagatctgggctctgatgtttctgctgcactgttgaaatgcagcctgggccaggattgtgaacgctgccggtggtagggagcatggagtctgagccatctcccacccaggatggtctctgagcccctcacacacttgcatgcagtaatgacagggggtgggtggggtggggcctgggaagaaatgctacagaataggggggagagcacgctctgccccaagacatagctccttacatgcacagacctcaacacaaaaggcaccatttcaaactcattcactttatgggccccagttaagtgatgaagctctgtctgtattggggttttgattaccgtgggctcccagaaaggagggcacactacagatgtaccattaagaaaaagcaaaatcacacctcatggtgttgggccagctctcaccacagaggccacttccctgttaataattccttggtgcttgggagttgataagggactttaatggagattatctgggaaaggatcagagcctgggcaagggtggaatctgtacatgacagacagtgagagggaggcttggggaggtgacctgcccagtgtcacgcagagcagagatggccttggaatttccgccttttccctcccagctcggggctctttctctttccctgggagggtttctgaacacagaagagagctggagggtttctctgagtggggctggagggctgggagaggcaggacctcttcctaacacctcttggagaagacagacttgtggttatgggggtcgcaccatggttcctttccagatgggaatacttccaaactcagggattaagcaagattaaaaacaaaaaggccctctagaaaggggttaacctcatttcctcagacataaaaactgtccttggcagttggaaacagcagagttgactccacggatgactgatgccccttacgggtgttatatacctgtccacgcctgcccctggcagggatttaaacattccatgctgttccatgaatcctaaatcaaatagattcatcctggcccttggtgaagcctaagagctggcgaggcttatgttaaattgccctctctgggctcctgctcctgagctgacagtcacaaattccccttaatgagcactcctgaagtaaccaaggcagcgctgtgagctaaattaagattcgagagcccaggcagggagagggaggtgtttgctttggctgagaaggtgcctgggccccggcctgtgtgtttgcctgggtgccctgataagtgggctgcatattaagtgccacatggtgggaccagaaccatctgctgtatgtctgagaggtcacgcctgctggccctttgggacctggtggcagagggaccccgtgtcaacctgtctttggcttcctttgtggccccgtggtcactgaaaagccagaatgaatattcttcctttcggaataaaaattgagctgtggaagttttgtttgctttgatgaattacttccaggctgctgtttatttggagagcaaagctccccagctgcagggtgggtagaggctgcggtcactcccctcgtcaatgctggttcctgttcctgaggccgagagaactcctgacagcagagtgggcatatcttggtagttgcagcttttcaagacagtgtggcccagtggggagagagcagaaaacctgggttatgctggctctgccatttatcagctgtgtaaccttgggcaagtgatacaacctctgtgtgcctcagtttcctttcctcacctgtccacaggggatcataatcttggccctgcatgccttacaggagcgttaagagcatcaaatgaaacaataaaaatgaaaacatttataaatggtagtttgccatacatattttaataaaagtgcctgcccttcaatccagctctctgcactgcctggggacagtgttagcaggaggacaccactctgacagggacctggacttccgcctcttctgtttggagagagttagatgatcacatctcttatatgtacaaaagcttagtgaatgtaacttaaagatattgcttgcttgtaggcttcttgaggggaggaatgatggttggtttctatggatttgttacaggggaagggatatctcagctcaaaggatatcctgcgtatccaagccttcctccacttgtgccccacacactgtcccctctactttctcaaggaagtttttcctgcagctctgctcccctctcccaccacagcatcagtttccctctctatgcatgtttcagcacgtgagcatgtcttaaagcatccctctgggctcctgcttccctttagctccagcccagttctctgctcctgtcactgctcaaccccctggaggggttgtatctgctcactgcctcagcctctttcccttccaccctctccccagccactcccagtcccctggctaaatggtgcttgtccatgatcaccctgacatgcaaaatggccagtggtccacattccatcctgccacactctactggcccgtctccccttggagcttgtgcttctccagcttgtgcttctccagcttgtgcctgaggccatacccacttatctgctgttccttttcgcaccctggcagtgccttctcagcatctctgcttcctctctctccgcaactgttggagaaccccagggggctgttctcagcaatttgaatacctccatctctggtcttcagaggacattgtactcagtcctgtggcttcagacaccaaccagacatgatgacttgcatatttctttttctagcttagactttctctctgagctccactgatgctcacctgtctactcgacacctcctcttggacatcaaatgtcatctgaaacttcaaaaagggcagccagaactctccatccctccagctccttgcctctgatggtcatgcctccctgcctttctcatttcagtaaatggcactgccattctcttcgctgctcagatcaaaagcccaggaggtgccctgactctcctctttctcttgcatctcatatttggtctactggtgagtccaagccacaatcatcccttgctggcactttcatggtagcctggtaactggtctacccttggcccctacaatctacactacatgtgacagacaaagtgagctttttaaagcatcaatcacatcatatcactccatggttaaaattattcagtgggcttccactctatccagaataaaatccaaatctctttcccctgtgcataaggctggtgtgacttggcccttgtgctcttgctccctgccctccagccactctagcttccttcccaccctgtggccaagcaaagcttccccttcaggcttctcgctttccgctctgtctgctaggactgtgcattcccagaacgcggcgtagctgctccattctcatgatgcagctgtcagtttaaagttatcttctccagcaaggcctccccaacctacccagctaaaagcagtcttcccagttactgtctacaacattacatagtttagctatttcatagcacttattatcccctcaaacaatcttacgtatttgtcgacgtgttcattgtctgtctccttcctccccctagaatgtcagtttctcacgtgctgggttctgtcttgttctctgctgtagcaccagcactagtagtagtgcctggcataagaaggcacccaacatatacagtgtttgctgactgattggctgttcattgctgttcagtgcctgatacctatcatcagagtatttggggcatagatggggacttggagatcactgaatccagttttttatttttttttatttttttttatttttttttatttttagacaaggaaactgagaatgagacaagatcacagcagaggtggggctgtctcaggcttaagaaaggacctgacagtgttgctgaggctgctggtcctggtggtgaagagaggatagtaaataagcaggctggcggccaagcaaggcgagtacaggaccaaggccggctctcagttgcggcgctccatccatgcacaaacctcttcctgcccaaactgcacacggctggtggagaagctgagtgcaggcgccacagggcaggcatcagtcattatacatcgaatctgccagcccataccatcacggtgggggcgcctttctggcaatgtgaaggcaatgttaagcctgcctagtagcctttgggttatggggaggaggctaagacaaaatgcaggcctggggtaaggggccctggggcttgccctgtgggtgtgttggggatggaaggcagaaagagaaaaggcccagccacagcagatgggagatgggcagctgccaagaggacggggctgggggtggagggggcagtgatgcagaccaagaagagccttcttctcttcctgttgtctgacacgccactcttacttcctctgtgattgttatggtgtcctcgggcctgggccttcaagcagtgtttacactcacagctctttggcaagaaccacactctgataggggagtgagactttaagccaggggttcaacgagttaccaaaacatcactcagccccttcctgtttgtagaagcctgagcagaggagacagctgactttgggaacagagaacaaaggagctgaagatctggaagagacagagagcaagctctgccaagagggacaggagcacctgggccgcccacccacttgggcctgtcttggtgtttctgatgctgccccttgaggctttctcgagaaggaatcagaggctgggcacatgtgactgacaggcaggccagtcctgtggcttcaggaatatgcaggaaactccctactcccctcccacctcactgtgtgctccccacaagtgttggtgacctgctgcccaggaggagccaccgagggaggtgcacttacattgcttctgcagaatgctctgtctggccttgatgaaggcgatgatgtccgagtccgtctggctgtctccggtgagagggatggacgacactggcctcttggggatgctggaggcaaccacgtgtcacattttactacactttacaactggactcaccacttatatttccaaaatgcttttccattttaggtgactgatctcactcagaaagctacatgacacggctggcctgcttctcactccctcctaccttctctgtgtggcagccacactaagcctcttgtcatgcaaattgggtcaagtcattccctgccatagaccctgatatggtttggctgtgtcctcacccaaatctcatcttgaactgtagctcccataatttccacgtgttgtgggagggaccaggtgggagataactgaatcatggggacggtttcctccatactgttctcgtggtagtgaataagtctcatgagatctgatgttttcatacgaggtttcccctctcacttggctttcattctgtcttggctgccaccatgtaagacgtgcctttcaccatgattgtgaggcctccccagtgacatgaactgtgagtccattaaatctctttttctttataaattacccagtctcaggtatgtctttatcagaagtgtgaaaacagactaatacagaccctttagtggcttttcaccactcatggaataaaacttaaactctgtcccatgacctaccaggctgtgtatgatatgaccccgggtcaggggctccagctgcccccttttctttcagtgacttgcatttaccaagccacttccagcctcagggcctttgctctgatgcttcctctccctggactgccctccccaccacccgtcacatggcggctgtgctttctctcgctgccttctctatcctcttaccaccaccactcttgtcctcccatccctgatttacccaaaccagcaccccttaacctggggcccatcaacttctgtgcccagcttagatgtcatatcattcagtgctgtgtcctcagagcaccctcattccccacgtggcttagctagttgacctcaaggcagagattactgttctcctgtctctccttaaaaacagaatcatatttagctaagttgccacaactaaaaaaactacctttcccagactcctttgctgcgatgtgtggccgggtgaccaggtgctggccaatgagatttgtaagtagaagtgttgtgtgggaatctccttagaaagggagggctgtgtgtgccctcccccatccccttttccatccagcttctccatatagcattccccttcagcaaactcagagcagtacacttgcctggccttgccaactttccgtccatcctcacccctgtgcctctgcacagcaggaggtggtagccacttccttagaaggcagtaaggacggtatgtaacaaggggctggccattcccgcaggtagtttgggtgttggctttcccgctgcaggccagccggaagcactaaagcagagtccaggcaggcagggcagaggctgtgctggtgaaagaggctgagcagccattctagccggaggatacaaatgcccatggtgctgatcaactctggtaagcctggaagcaaatgctgctgggtcttcaggccaggcttgtcagctccctgctctgctctgtggtggggctgccctgggctggctctttccctttctggcccccaggtacgtctattcacaagaagatatgaaacaactctgcccaacacagggccctggtgactgtgggagaaaacctccccgctttgagttggcctgtgtgagagattccagggaattcccaggggaccagggcagaggccagacctgggttctgtctgtgtggctactggacgaggggctttttcggggagtagactggagatggaggcccactccgcccactgcaggggctgtcacaggcataacaggagaagaccacagacctgtcttccagtggggtgctggtgctgctctgtttctggctgtgtggactggggcaaggcgagggcaggattttcctggcattcacatcactgcaaaacacaaacaaacaaaagcaaaaggaatgggggcaaatttatagaaggaaattcagggtttatatctaggagctgttatggactgaatgtgtcctctcaaaatccctatgtggacaccctaattcccagtgtgatggcattgggcagtggggcctttgggaggtgaatagatttagatgaggtcctgagggtagggcccctgcactgggattagtgtccttataggtataagaggaggatgagaaactacagtgctctctctctctctctctctctctctctctctctctcccccccctctccctccccccctccctctccctctccctccctctccctctctctctctctctctctctctctctctttctctcctatgtgagcacacaataagaaggaggtgccagcaagcgaggaaggaagccctcagcaggaactaaatctgctgtgctacggactggaggtttgtgtccctgaaaagtcatgtgttgaacctaatctccaatgtaatggtagtagaggtggggcctttgggtggtgattaagtcatgaaggtagaactctcatgaatgggattagagtccttataaaagagacattggagagctcccttgccccttccaccatgtgaggatgcgtcgagaagacagctgtctatgaaccgggaagggggtcctcaccagacatcgaatctgccagtgccttgatcttggacttcccagcctccagaactgtgaaaaataaacgtttgttgtttgagccactcagtctatagtattttgttatagcagcctgagcagactaagacaagagccaagagtcctgtcttggatggtttacacagtaattttctttttttctttttttttgagatggagtttcactcttgttgcccaagctggagtgcagtggcatgatcttggctcactgcaacctccgcttcctgggtttgagcaatccttctgcctcagccatccaagtagctgggattacaagcatgcatcacaacacctggctaattttttgtatttttagtagagatggggtttcaccatattggccaggctggtcttgaactcctgacctcaggtgatccacccaccttggcctcccaaagtgctgggattacaggcgtgagccactgtgcccggcctacacagtaattttcattgttagagcatgcatctgttggctgtagcagctgaacaacaaacgatggccacaactgtcattgatagacacgccaggcttcgtgaaagtgctctgcaaatatcatgccatttaatcctctcaatgacctaagaggtagatgtcatcgtctccattttatacatgagaaaactgaggcttagacagattaaagaaattctaaagttatccagctggtaagtggcagaatcgggaactactcaggattctttgaggcttcagaacctgtgctctcagccacaatgccttctaactgggcttgactctgtggcattctaggaacacacgctggcctacccctgaccacactgcctgcccctgggacctagcttcatgctgagagaggagtcagatccaacagctcattagatgcagctgtgcctgctcacctaggctgctgacatgtgcgccttgccttggattcctggccaagtgcagtggaacccagaagctcctcttgggaggtgaagaggcgcgtggacacggctggttggaggccagtgtattccacatgcctgtggttacaaggtccttactctaagttgtgctgtaaggagatcttcctcgcttcctgcctggagacaacctcagagctggaagaggcctaagaagtcacctgggtacaaccctccttttacactctggggacacttgggctgagaggcaggctagggttagagacaggtgagccggctccgcggagtctgcatcttcagtccaaggtactctacagacctgacaaactgcgtgtctcactcatgagtatggccccttccccggctctggccttccgccttccgatctcagccaatggcaaggctgcttccataggtcacgactgtggtcaaacaagcaagaaaagacaccagagcctggggaagccccccctcacccaccaatgtccatttcctagcagtggagagactttccacgaggtgcccttcatggtgggaaagcagagatccctgtgctgggtctagtgaggaccgatgtaggaccagaggtagccaccaggtggcaggctctgcacgcttttcttcagagaacagtaaccaattctcaaggctcctgctgagtggttcctggtgcagcctggagaagggaaggagaaagggctttccatcctgcaagtgctttcatgacaacgggtcaaggtcagtttggaagctgtagcaaatttgcaagaccaaggcactggcacaaaaatggctcattcactcagtggcttcccagtggagccttggctcaggttccagggagagttcacaggtgccaaactattgaaaggtgggagggggtggaagaggatggagagatggatggggcagggtagaagggcacgatcacaccgtggccaataggggcatctagtactctttgcggaggcccagctgccccacctcatgcaggagggcagtgcaatggaaggctgggggctctcgagggaaatgactcctcaaacctgtaagctgctcaagcatcctgttcctggatgccacagcttggtttctgtaattctggggatgatgccataaatgacctctgccctctccctttgcccaaccagcctttgacaccgaattaatttctcatgttgacgcccctctggagagagaacataccagccatcagaatgaagtatcttccttaataaggattaataagccatattaatagtaattaggccttctgggttgccaatcagagtgtttagtgggatcagcttccaggacctgagcatccctggggaagtgatgaatcaggtttctttcagaacctgatgagcagaagaccagcgccccgctacccccagttccccacctgcggcaattctcaggagcagccgctctggagctcgggcagcaacagccgctgggccctcgctctctcaccctggcggctctgaccgggcactgaccgggcaacatttatctgctcacagagtgaccgtgtcggagggacctttgcacatcttacagatgaggcaagggaatcccaaagtggggagctggcttgcccgagggtgtgctgtcggaggggccatgactgggattcatgtgattcaaatctcaataaaggggacttgttggaggtggtcaataatgacgtgacacacacctttgaagtccagggttctcgactgcagggttaaaggtctctaggcaagcacatccaggaatcatcttaagttggaatacctaaggaatctccaggaatgcccaaggccaagacaaggtggaaggagcactattctgatgggtggcacagcagacagtccctggaggccttgcccaggggctactccttagacctattccaccatggactctctcggagatgccggcggataaaggctggcagcggcatgatcaacaaacaagcagtaaagaggcagccctggctgcaagggagtatgacaaagggaatgaggcagagaggaggaagaaaaggagaagggggatgtaaggcaggaatagagataggcagagctgacagtggagggagggatgggagaagaggcgagtggaggagggaaggaggcaggcagagggcagggggagcagtgggtggaaggaagaaaaggcacttgccatggagtgtgaaggtctaggtttaatttgtggctcttttttttttttttttttttttttttttttgagacagggtcttgctctgtctccaggctagagtgctgtggtgtgatctcagctcactgcaacctctacctcctgggttcaagcgattcttctgcctccgcctcctgagtagctgggactacaggcacgcaccaccatggctggctaattatttttgtctttttagtagagatgagggttcaccatattggccaaggctggtcttgaactcctgacctcgtgatccacccaccttggcctcccaaagtgctgggattacaggtgtgagccatcatccctggcctaatttgtggctctttgtgttattaactacagagttaaagcatctcattccctttcggggcctcagtgtcctcatttacagaatggggaggctgaactctgggtttctcagctgaaatggcaagggccagtcacagggaattctgggtttccacaccttagaaggttggccttttaaggaaacacagctttaccctttaaaaatcctggcctcttgggaaaatcagacggtgtggacacattggaagagcggataccccaggcaggaggatctggtggtgggaagcacataaagaaagcgccttgtacaaaatattacaaaatgtgggctggtaaatgccaacacctactagataacattatggacatgtgtccctaaaaggcagtcattgatcctaaacacaactgctgtgaggaatgaggggagtgcacgactccgacaggcctgggtttgagttcaccactgattagctggtgaccctgggcaagctacttcatctctctgagcctgaattttttcacctgtaaagtgggggaccatgatagtaggcacagtgctcatgtattttgcacctggcccaggagggccctctacaaaggctacgagatattattgccgtcagaggagaaggccagtgctgtctcccttgggaacgtgggaatgccaacagcgaatccttcacgtgagatgttcacagggaatgtctgagacgccatgatggcctgagacagggttccctacctggcttaccgtggcagagttctgtaggcccgttactaccagcatctaaagcaagtggcaaggatttctttgtcagaggtggagcccctagagctcttcctttccagtctctggcggggttacttttcctctcacctgcctagtgtgaccgtcccatccaggaatgctggcactccaacaactgttggaggaggaaatatggggcagccagccactcaagttgaggtgttttaacaaacactgttcaggacactcagtgatctctgcccaggaattagagcatccaaccagctcgccggcagcaaccacaggggacagggctgaacagcgctctagggctggctgagagccatcttccccaagacccttctgccagcagtcaccgaaggggcttggggtgggggtggggactctgggagcaggatttttggaaaagctcctgtgggtgatctgatgcacacctttcaaattcaaggttctgaacactaggattaaacttttttttttttttttttttgcaagcacagtgtatttcttttctttcttttttttttctctttttcagacagggtctcgctctgtcacccagactagagtgcagtggtgcagatcttggctcactacagccttgaccttctgggctcaaaagatcctaccatctcagcctcctgagtagctgcgactacaggcatgtgccaccacgcccggctatggatttgtggggaggtaaggatattttcatattttgttgtagagacggggtttcaccttgttgcccaggctggtgttgaactcctggctcaagcgatccaccggctttagcctcccaaagtactgggattacaggcatgaaccactgtccctgggcaagcatagtgtatttctaccttgcatctgtcgggccccttgctgacacacctgcccctctctctctctctcacacacacacacatgcacatgtacacacttcaatgtctttgaagccaaaggaaaaatgagagacagggctttctactcgctgagcaggatattgctaccagtagaagctacccaagagatcagaaaagagggtacagaaatagccaggggttctgagcctcacagctgaaaggagagcttattctcatggggcagatacacaagggctcagcacagagccagagcaatgattgaggaagctgaatcctcctcgttgtgtttttcagatgtgctgtgtggagtcctggagtttcagcgagagggctccgtgtgtggaaggtgcaggtatacaggggttggaattcaaatttactggcctctagaggttggcaggtgcccaggtgaatgcatggagtgggccaggtgcagggcacaaatgctaagctgcctgcattgccatggcatagtgcagctgcctagttattctgcttctgcagttttaaaaatcaatagactattatttagagaagttttaagtttacagaaaattgagcagatagtacagagaattcccttatactcctcttccccacctttcagttttccttattattaacattttgtattagtgtgataaatttgttataactggtgaatgaatatagatacattattatgaactaaagtccatggtttatgcaggggttcactctttgtgctgtacagctctatggattttgacaaatgcatgacatcatctatgcaacattacaatatcatacagaatagtttcactgcccccaaaattccctgtgctccatctattcatcctttcctccctacaagtccatgacaaccactgactatttcactgtgtccataattttgcctgttccagaatgttatatagttggaatcatataatacatagtcttttcatatgagcatctttcactaagcaatatgcattgcaggttcatcacttttcatggcctgatagctctttttttttttttttgagatggagtcttgctctgtcacccaggctggagtgcagtggcttgatctcggctcactgcaacctctgcctcctcggttcaagcgattctcctgcctcagccttccaagtagctgggattacacgtgcatgccaatatccttggcaaatttttgtatttttagtagaggttgggtttcaccatgttggccaggctgctcttgaattcctgacctcaagtgatccacccaccttggcctcccaaagtgctgggataacaggcctgagccactgcacccagacttgatagctgaataatattccacggtttgtttattcattcactttttggaggacatcttggtggctttcagttttgggcaattataaataattatacaaaaagctactatgaacaatcatattctgtttttttttgtggacataagttttcacctcaattaggtaaataactaaaatgcaattgctggattgtatggtaagatcatatttagctttgcaagaatccatcaaactgtcttccaaagtggctgtgggagtgcaaaaccattttgcattccctctagcaatgaacgagagttcctattgctcaacatcctcactggcatttggaattgtcattttttgttttattttagccattctaatatgtatgtagtggtatctcattgttgttctaatttgtatttccctgtgtgacacaggatgttgtgtaccttgtcatgtacttatttgccatctgtatctcttctttggtgaagtggctgttcagatcttttgcccacttttaaactgagtggtttattttcttattgttgaatttttagagctctttgtatacttcagatacaagtcctttatcagatatatgttttgcaaatattttctcccagtctgtagcttgtcttttaattcttttaaaaatatcttttgcagagtggtgttttaattttaaataaagtccaacatcaattttttctttcatgaatctgcattgtcttccaaaacaccaggctagccaaacaaaacacatcatgtcagttattgaccctgggctcaggggctcacataggagatgtgtcctaaaaccagaatgtgaggcagtgagagggcactgggtctgggatggcggtgctgtagccctgggcagatggacccagtggctccttccctagtgcggtgtccggcatgcagcagatgctggagagatggacttcaggatggcactatgccagccacaatgggcactatgctgtgtgccagttcctactgctaagtggagctaagtgtgatgcccagacccatgggggtgccactgctctgcagcaggactgctactgagggcacactgacattgcatggcctctgttttcacatgggtccaagcccagattgatagatgacgatggcaatgaccagcctacataaggctcctgagaacggtcacgtggacatttgctccctcctgttgcaacatagcttagccctgaaggccatctgggatggaaggcatggctagcatgtgacctgctgccctgcaacggtgacctgctggctagctgagttgccaccctcctgtctcaggctgcccttgcagggtacacagaccaggtttttaagcccccatcttgttcagcatccatactgcagggcaggaaactgaggctagaagacccagggagacccccagtctggccactgtggaagcaagggagtaggtttggtggggctgaaagtgtttaggcttggacagatgatcatatcccaaactggctcacatgggacatctatccatttggaaaaaagaagttatgtccttacctcatcccatatgcaaagacacaatgcaagattaaagatctaaatgtaaaaacacacaatgatgtaggaactagaagaaaatatggaataggtgacaaaagctgctttctagctgaatgaccttggtacaagtcatttgacctacttctccgttgcctcatctggaagctgagaatggttataatagggcctggcctcaaagtcatggtggtcactaattgggtaagcattgggaaagcccttgagagagtggcccacagcaagcagcctaggacaggacccgctgccccaccatgcaatcagcacttgctgctataccatgatttcattaatttcaacagtctgataggtagaaaagtgctactgccttgttttagtttgcattgctaatgactagtgaagttgagcacctgtcttccatgaactgcctgcccatgcccatttaaaaaatgttggccaggtgtggtgctcacacctgcaatcccagcactttgagaggccaaggtgggaggatcacttgagccaagaaattcaagaccagcctgggcaacatggtgagactcttcctctacaaacaatatctatatttttaaattagccatgtatggtggcacgtgcctgtaatcccaactactcaggaggctgaggcaggaggattgcctgagcccaggaggtcgaggctgcagtgagccgtgatcacactgctgtactccagcatgagtgagagtgaaaccctgtctcaaagaaaaaaagaatgtttttcatttcattgatccataggagttgtttatattctgcatattgatctgttttatatatatacacatatatatgtatctatatacattaaacattttttttctttaagtataaaaacaaagtcactccaaaaagttagaatacaggctgaagtgctggcaccaacagccagattggaggatctgggaaagtccaaggaaaatctcaacctggttggtgttgagggctcactggctggccttttaattttaagaagtcttttttttttttttttttttttgaggcagagtctcgctctgtcgcccaggctggagtgcagtggtgcgatctcggctcactgcaacctccacctcttgggttccagcgattctcctgcctcagcctcccgagtggctgagattacaggcatgcaccaccacacctggtatttttgtatttttagtagagatggggtttcaccatgttggccaggctggtcttgaactcctgacctcaggtgatccgcccgtctcagcctcccaaaatgctgggattacaagcatgagccaccacgcctggacaatagttgttttttaagaatactttttttttttttttaaagaatagttttacatttacagaaaagttggaaagatagtgcatggagatcccatgtagcctgtacccagcttcccctatcgggcagttttaccttagtgtggttcatttgccacaatcactgaaccgatattgatacattgttattaactaaaggccatactttactggacttttcttagtttttccctaaagcctttttctgttccaggctcccacccaggacgccactttacatctcggtggtgtgtctccctaggctcctcttggctgtgaccgagtctcacacttggtttttggggaccttgacaatttgaggcatgctagtcagtattttgtagagtgtccttccattgggatgtgtctgatgttttcctcattctttgactgatgttatgggtttctgagagaaaggccacagaggtagagtgccactcttatcacatcatatcatggggactgtctgacaccttcttcttttttttttttgagacggagtctctgtcgcccaggctggagtgcagtggcacgatctcagctcactacaacctctgcctcctgggttcaagtgattctcctgcctcagccccccaagtagctgggattacaggcgtgtgccaccgcacctggctaatttttgtatttttagtagagacaggcttccccatgttggtcaggctagtcttgaactcctgacctcaggtgatccacccaccttggcctcccaaagtgctgggattacaggcatgagccaccgtgcccggccctctgacaccttttttaaagccctattttatatttctaatgtgagggctcagcaccccttcaaacccaaaggattgctccttggtggcagagacggaggccccacacatactatcctggcctctggcatcagatggacaatggcaggaggcgtgcttcctcggtgctaccccctgggttgtgtggttggaaagagacaataacatggttgtggggaagtagagtccctgctggtcatcccatcatgtagggagactggctctgggccatcctcatgtggtgtttttggaggctacctggatcctggctaggacgaagagctcccctgtgtctcagtaggcgggctacccactgtcccaccaccactgtcccccaaacccccttctcccatgctatgaccctgttccattcctgccaatcccttcttcccactcaggaggcaggaccagggcttgattgtgaaacctcttgtctcttgttaccatggcagtaggtctactggctgtcagagtgagggactgaaggggtgtgcactccaaccaacttgaaagccactgtcttgagtatctacgactaattaaacagtaaaaggaattaatcctgctggatcatatggcttatcaagagacatgagagccacaggaataggttaaacagaaaggtagggagccttttctgggaactctaacacctccggtgagttctcaccttaccttttgttagagaggagttgggaccattcatgctgggagtcagatgtctggagaaatggcttcgtgtgatcgagtgaattcactgctggagaatttacctgttggccccagaaggagtttcacagtgttagcttgaatctaatgacataggaagatgtttttgatgtaattcttttttttttttttttttgagatggagtctcgctctgttgcccaggctggagtgcagtggcgcgatctcagctcactgcaacctctgccttctgggttcaagcaattctcctgcctcagcctcccgagtagctgggattataggcacccgccatcatgcccggcaaatttttgtatttatagtagagacggtgttttgccatgttggccaggctggtctcgaactcctgacctcagttgatctgctcaccttggcctcccaaagtgctgggattacaggcatgagccaccatacccggccttgatgtaattcttaaggggaacaagccagctataaaagttagtgtacacaaggtgtatggccaaaaacaaatctagacatggtaatgaccataatgatggcttcaacatattgtctagggatggtaaagaattatgggtaatgtttaatttattctttatgctttcctgtgctttccaagttttccacgttgaacatgtattcctttttaaagataggaaaaaattgtttaaaatgttatcttcattcttcaaaaatactttctggttttgcttctccttgtcccaaagaccccctactaaagtcaggagacatccaccgagcactttgtgtaggggaacagctctgcaagctgcatgtccccacataggcctcaagagcaaggcatagatcacagctggtctaagtcttggcagaatgccctgtaagcctcctggaacgtgagtgcatacaggaagcttgtgagtggttgctactaggttatttcccacttgcttccctatcctcccagaaggctatcctagaagtttcttgtcacctctcttgttctaatgaggtttggagctttctgcctctgcccactgagggtacagctgcaggctatagaactgctcaggggcagcatggaattggcccctctgtaccagtgtatcccaccatcccccttgctgtcatctggtcccttttgtttcagtgacatcctgtggggcaggggacacatggagctgacacccttgcctactctggctttcgctgtctctgtaagtcatacactgtctgaatgtgtcagctttgcctggacacttcctgagtttcgctggtatgacccttgtcgaccggtcagtggtggactccctcgggcaccagctggggaaggcctcattcactgatgaacttgccaggaagggctcttaacctggagtccacagacagaatccaggggctctgccaatgtggatgggagccaatcacagctgcatttcccctagctgctacctgaaattatttctttcagtgataaatgcagacaagaaaccacaaaagtattagcaatacctgtgactttgtcaccaacggaaatcaagcatattttcatatcacctgacagttggtgtagagatcttgaaatattgtgtcatttcatcatgactttgaagttatgataaatattgggcctacacctagatcttattaattagtgcgttttaaaagtggtacatgtattactataccataactcaaaatattttgataaccgtatttcattctaactagttttctttgttatctcgtgtatttaattttatccaaatattcttctccattgtcctgccgcgtggccacttgctatcacactggttattgcttggctatgtccttggcaaatcatcttctctggctctcagttttcttgtccttaaaatgaagggatcagcctgtcagataatcagtaagcattctgccagccagaaaagggatctgattgtgcgtattttagcacttccgctgtgccacaactgaggtgttacatgaggaaaactgaaactgggattttgtgctaacacttatggaaaggtcattttagccttcatcaaacagaaaacttctaagaatttgtctaggaaatatgcaaaaaattatctgcaaatatgttttgagtaaaaaactagaaacaacctaaatattcagcgataggagattaaaacatatttacatgatggaacagtaacagccattaaaacaacgctgtaggataataacatgaaaaagtagccatgctatacaattaatttttaaaagccatttgcgatacttgaacagctatgtgatttattattattattattattattttgagacagggccttgctcagtcacccaggctggagtgcagtgggtctatcactgctcactgcagcctcgacctcccaggctcaagcactctgcccatctcagactcccaggtagctgagactataggcacatactaccacataattagcctggctaattatttttatgttcattttggtagagacagggtcttgccatgttaaccaggctggtcttgaactcctgggctcaggtgatcagccttctgaagtgctgggattacaggcatgagccaccgtgcccagcctgattctatttgtacaaaaacatatggatatatatgcatagaaatcaaggtaaaagaatataatcaaacatgttaatatcaattacatttaagtagaggaattatggtgatttttactttcttctttgtgtttttctgcctagtaaaatttctataattcatattcacatatatatgactatgataagaaaaacaataaatgtcagtaggaaatcagtggagaatatcacacaaagcattggtggcaaacccactgatttttgggagctgcatcttttatccctaatttttccattaatcaggcagaattttaggcatgacagcaaggaaacaatgaacccctgcccttttgtcatccttgttactacagtgagcacctgcttcatgagcaggggctgagaccatgggggcctgtgggtcaaagcccccactgtgtctcttgacagccccagtggggctgcatgactggcccctccccagcttccctgatgttccccaggccatacctgcaggttggtggcctcctctgcccaccagacttcaaactctttctgtagcttcaccttggctttgtccatgagcagctgcaagtgctcgatctccaccttcagggctttcaggcgagtgaacattgttttatacctgcggtggaatcggggaagagtcagggcactgctgtcttgaaagcacggcatggatgcagggctgtaaatgaatggggcccgtgcctcagaatcccgtcagagctgccctggtgctcagggactgggaccctataggagcttcggaggccaggctatggcaccagggtttgagtccatcacagagaagcagacggagacattttggtccagtaggcccatgggaatctgtgtgtgagatgaatagcctctcccccaagaatgagaactgccatttgctgagcacttactaagggataagcattgctgcaggcactcaacatatataaactcatttaattctcctcacaaccctatgaaggagatactatgattatcacctccattttacagattcggaacctgagacaggtatgaagaggttatataacttgctctatgggacagagataactgaggagccaggatttgaacccaggtggtctggttctagaaccacagtcttaactgcctcaccattccgctggctcaccttcatgctgaggaccaaaagtaacactgtgcttatgaacgcatacatatattggttttgagaatgctataatgaatcagaaattgtccaataggaaacagtccaatagccaggccgaagagataagttggcctctaaggtgacactgagattggaaatgtgggccaaggggacaagatgaagatggagtagagacacaagaagaatgggttggaggctgggtgtggtggttcacacctgtaatcccagcactttgggaggctgaggcgggtggatcacctgaggtcaggagtttgagaccaacctgagcctacatggtgaaaccgtgtttctactaaaaatacacaattagctgggtgttgtggtgcgtggctgtaatcccagctactcaagaggctgaggcacgagaactgcttgaacccgggagatggagtttgcagtgagccaagatcacaccactgcactgcagcctgggaaacaaagtgaggctccatctcaaaaaaaaaaaaaaaaaaaaaagcggggggtgttggaaagaaactaaggaaaatgaacagagcgagggagaaggtggacgactggcgagggccccaagggagtggagagcgacagcagcgtgtgtgctcaggtagacttctgtaggaagacacctgcacatctgccaggagcgacctgaagaccagcgcctggggctttgatctcctgggtgtgcgtcggggggcaggggcggtggtgcatgccaggtcagctgggggttggggtggggcagggagtgtgctgcagtgacaccaccagctccttgaggcagggaagatgactgtagtctctccagagcctacccatggcatggaggagatagcacacatgtgctaaatgcatcaatgaatgagtggatgcagcttgatcagcatgtggagcaagattcggtgaccatgctgtatatcaggaatggctacatgcctgtttatgcttgaggctcctcactctgtaagtgaagtcgtttggagaccccaaatgcctgcggctgcgtgagagtatgacgttctcaggactcggagggaagtggacttcagccataggcacgcggaaaaccaccgtggtcatatttcttggctcccgtaggtggcagcagtggacaagcccagctgcttcccgggcctggcttggcttgttctgcattctaacctcacactgcctggggtcctgcctttcacacctgcctgctcaaaggcagcccctcctcctcctgctgttctaggatccagctgctggacccacatccctgagtagctgcagccctgggaagctccaggacgacactgagaccctgggaggctgggctcggactgtgtgtggctaaaaggaagggcaccttctcttttcttcctccagttgtgatcgcagcttctcctcctgctggtctggcatcagaggcacggccatgttttccgagattcctgtagaaggaaggtgccaatgggatggtgagaaagaagggtaaaaggaagagtgtgatatttgggcagatgacagagttcaagggcaccccaagaagaaaggagcctctgtgagttccttctggggcctcttggtggcaacctctgctcagctgaaagccctgagaggagcagcttccagggttattgtccctctgctgtccctcccactgccaacatctgtcactggaagggaatcttcctctgtgtctactaatccttttactattgagctcattcatttcctgttgagtttccagggaagacgcaaaatagcatttccccatcctctgataaagagcccttcagggccaggcacagtggctcacgcttgtaatcccagcactttgggaagccgaggcaggaggatcacctgaggttaggagttcgagactggcctggccaacatggtcaaaccccgtctctactaaaaatacaaaaattagctgggcgtggtggcgggcgcctataatcccagctactcgggaggctgaggcaggagaattgcttgaacatgggaggcggaggttgcagtgagccgagatcatgccattgcactccagcttgggcaacaagagagaaactccatctcaaacaaacaaacaaaaacaaacagataaacaaaaacaaaagcccttcacaaaaaaaggaaacctctctaaaccatctgacatctttctctgcacaagtggaggtgcttaatttccagcctcagaatcgtgtctcctgtttttcactccctctgcagcagtggttctcaagcctgatgaacgcaggccatgttaattcacaaccagggatgagcccaagccttggcgatgggaccatcatgaggcccaggggagggctgagcacgtcagcagggatcagctgctgcgtgtgtctgcgtccctgctgatgccgacctctgtcttcccccacatgactgccactggtgcctggttgcctgctctggctagtgtgctcatctgaagctggctgtctcctagcccagagtgtggggactttttattcttctaggagtctcttcgtggttgccctgcttttctgagctccacagacaacatcctagaagtcgtacagccctgctttttactctatgtagggaagactctgctacagtccatgtgcttccagacatgctcagactgaatccttatagcatttatttgtggtaagtgttattatgcccattttacagataaggatattgaggttcaaagagggtaaactgcccaagttatgtggctaacttcaggaaacttggattcaaaaatccctcgtataacatttctgacagagggtcatctgctttctgctcaaatacttgcagggatgaggagctcactactttgcagggtagtgcatttcatggcggacagctctgtttcctcctacttttgagccaagacatttcccgctaacttcttttcacctctactttggctctttggagcagtgtagcatatctttcttcttaatctgatggtcccttaaatatctgaacaacaacatcaaaatatcacatgtgtctggaacttttttttttttttgagatggagtctcgcactgtcaccaggctagagtgcagcagcgcgatctccactgactgcaacctctgcctcccaggttcaagcgattctcctgcctcagcctcctgagtagctgggatgtagtccatcccagggtggtgtggtagtggtatggtgcacaccaccacgcccagctaatttttgtatttttagtagagatggggtttcaccatgttggccaggatggtctcgatctcttgacctcatgatccacccacctcggcctcctaaagtgttgggattacaggtgtgagccaccgcgcccagcccccttttttttcttagactgactcctgctcaatccctcacctgaagtctcagtgacctggttactttcccatttatcttaagtgtgaaggctaggtcttgacataatacttccatgggtctgaaaggtatagagtagagtagggctcctcttaccttttaaaaatttaagctctatatttttgtagtaggtgaattactaacaatgaccatttactggggactttctatgttctaagttctgccaaattctactaggcactgggctaggtcctccatgtaccctattgctaattctcaaaataacccttcaaggatggcattgccatcttctttcagctagattcttggtctcagagagggccatggataactcaaggttacatagctactaaatagcagagctgggatgtgaacccatttgtttttttctgattccaaggagctaaatgtttctaccagacagcctccccaacactgcttatgatttttagcagctctgtcgtggttggcccctattaagcttgtggtcagttttaaaacttgcattttttaaaaataagtgattgttaaaatgcgtcctgtttcagtgtgattgtccttttgatcccaaaggcaacacttcacatttattggcagcctagtctgctgagaggtccttattctgtcacgccattattcttcccctttgactcccttacccatttgttacctgtgtcttttgtgtcattagcttactgataactatgctaactggatcacgattctgtctgtcatcttccaggtgccattgaccccccttttccttatgtcaattgccaactttaaatcgacaggcagagcaagtgtcttatttcattatctaaacacaggacatgcagataccatcaacatcccacctgaagtccacactgtcatctgtgttggtgcaatttattggctcagatgaggcagcccgcctgtccacatcacccacagccccccaagtctcaggcacaggaagccctcaagggcagagattggggtcctcctgctcttagtgtcttcccccagtgctgtgttcagactccatgagtcactccatgagggtgactcagtgcctcgcatgtttgctggccttgccttctttgaaagtcatcagacatgataaactgaaggaagtatcttaatatgaaaccgacaatggtaggactttcaatggacaaacaattcctttttaaaaagtttcagaaatgggcccaggtatcttccagcctgctaaaaaagtaacactgtgaatttccttcctccttttaacacttttgtccccaccccaaggacacccccaagaaattcagtgaagccccactctgcggtgactggctagacgtcctgctgcaagcccagtacgtgagagactgctggaggcgggcggaggaagggctgctggactcacacagggccatctcacccggccagaagaggcagtctccaggccttggtgaacagacagcagaaggtaggggggacggccagggcggcctgcttttccatttaaaggctgcggtcaccccatgtgaacgcagagcccctctgtaggaggcaggctcttgcctcagcccatgactggttgtcttttccttgggcatcttgcaggttccctggcaggtcacagagtctcaggtgccctggaagtgtgtggggtgctcgggagccttaggcaaggagcacattctgaatgcagctgacacaagcacagaatgataacatcaacgccatctggggagtcgcttgagcccattccctgcgcaacaccactttcattctcaccacctcagctggcagacatgatcacctctgcttcacaatcaggaagaccaaggcttagggtgactgggtggcttgtgcgatgccacaaagctaccaaatagcagcgccaggctttggatccaagtctagtcactcatccgcttatttaacaaatgtttatcgagcattgactatgtgcctgcccctgttctagggggattccagtggggaagacagacactaaaaccacaaacaattgagtctgcaacatcatgctggggatcggaaggtgctatgaggaaagacaaagctgggtaaaaagacaggatgacagggtggaagactgccatgctaggtagggtgggtgagggcctctaagtggggggacatttgagcagtgacctgaatggaggaagggaacaggcatgcagaaatcggggcacagaatgtgcaacagtaagtgcaaaaggcctgaggtgtgagcctgcttgctgcatctaacaacaatgagaaggccaggagcggttgggaagggaaatcgtggtgggagctgaagtcagtgaagaaactgaggccagaccctggaggatcttgggagccatggtaaggacactggctttgagagagatgggagtattttgaggagaggaatgggctcgatctattcctttgaaagctaagttgagcattttttttttttttgctgatcaagacaaagctactccaaattgaacaacagttaatgtggaggtggcgccaggaagccgggagtctgttgaaagggtctgggaaagaaagctggggcaagggaccttgggaagccagaatgagggcacagcacactccacgacacaaactacccacgttgtcatgacaaccaaatgggcctgctgcccaaggtgatgtctgcttggtgaaatgcattgcagcctcaccaggagacagcctctggctgcttctgatatgttctgaggcttggctcatcagtaacctctgaagagaaataggggctgggaactcaaagggaaccaaataaaagccactgagcaagaacagaagaagagggagtaactacaaagggcatttgagttttgtaggtctccatccccacggggactctggccagggacagagcctcccatcacctgacaggaggcacagggagccctcctttcaaggacaggattctggctgggacagcagcacaggagctcacagtgccgagtggcctgcgaggtcacactgttcatctgtggggaggcagctgcctccaaagcagtacaaaagcaagagaagggtttcactcagtggctgtaggtctgaatggcacacaggaagaagccctgagcagtcaaacagtaactgaagcttcaagttgggaggacgcacagacgcacagtcccaggctgaccttatctctgaagtcacgggtgttttggaattagccgtgcaaggaccagaggggctcttgctgggaaggccagtcaagatgtggaccccctccttcctgacataatttctactggaaagatctctgcaactccttgtcccacttccccatgccctcctctcaaacgctctctctcccacgcagttatctgatatttgaaatgtgcagaatagtttttttggttcaatggttctcaactgggggtgcacatcagaatcacttaaggagcttgtaaaagcacacagacagctgggccctactccagacctactgagttaaaatttgtcaatagggtcccctggtgattccaatgctcaccccttgttaagaaacactgcttatggcttcaagcccagtttcaatgcaagtactctgtgcagaagttactgagaatacaggccctacagaagtttagataggatggtgtgtaggagccagcacgtcccctacatgcctgcctgctttccagacatttgggagccactgtgataaaagtaaatagggcttcaggggtttgcaaccaggaaagcacactctctgtaaggttgaaactgcctgcatcgggcccttgtaggtgcttgataaaatctgaataaccataaccatcgcacagctgctacatgggttaggaacttcatatgtattgtcttgtataatctacaactcccactccaagtggggaaactgagctttgatagaggaagtaatcgcccaggatggcactgctggtaagcagagctagtgggagaactggctctgtccgatttcaaagctggtgctctttcctctgtaagtgattccaataatgaaggaagccacagggcagattattgaagtctgtattgactcgtcgttggtatttgaaggtgttgctcttttccatgaatgcctttcagatctggggctggggctgagagacagtcttagtgtcttcccctggtgctggcctgtgaagtctgccctttaataaccgaaatccatgacctgtgccccaatcccatatggcatttgcagcttgcctgctaggtgtgaggagctatatacccactctccagggtcagcccacagaatgcccacagccagcctgttccatgcccttggctggactaggaatcctaaagaagatgatgttgaaatttccaagcattcaccaaagccaaaaggggccctctgggcctctgtagagcaaaggctgtggggcccacatggctgtcacctaaccagtgccctgcgtgggaaggggaagtgagttatgtggctctaccatggcagacaagacatcagagccaggaggcattccaggtggtcgtcttggccatccaactacccaactaatgattcatttgctgaatacccactctgggcctccttggggctcagctgtctcacacaaccatagatcacttcagcctcaccttgtttgagaagacaaagtgtctattcttacggagattgatggtgttcatagctcaattaccacaatggtcagcagctcagaggcaaagattctggcttcccaatcagaccatttcctgtttaatggctcaaatttactgtcagctggagccgtcacatgccgacgggtgctcagtgctgccatccatcctggtgctgattttgtaacaccttagcggacccaagcatgcccagatttaagggtgtgctgaatgaccctgcggacacatggctgtacctgataatttcttgggcacactcacccccactgccacagaccctgcgctcactgccactgccttcccctcaggaagagcagggcactctgtgagaagataaatggctgtactttattacaatcagaaacgtgccagatgcctgcttgtagcaaaacccaggccctgacagtcccctcatagaaggccatccaccatctcttcctgtgtgagtaatcttccctgctacgactgtgggcctctctgtccaaggttgtcccccagggatggcggcctctctccttcagatctgctccttctcaccagcatgttctctgtggaggaggcagactgtaaagtcagagggtcagcgtgtactagggtcagtcggcaatataaaggagaccctagggccatacaccatacacagggaagacattcctaatcttattactgcttgaacttggcatggatcctattcatggtcacctctgttcaaatgggagctctctctcatctctctccacgactccttctgctggaaccccagatccatcttttggttactggtctgcatttctcttatcaccaccactaagagcctggctcggtgatttctgggtctgacccacaaggttcccctttttccctggtgcacagcacctctcccagcctacccctccaggggcagccttccagtccactgtgactttctctctcctccattggaagtgtgcctgaagttctgaactcaggtttctctcaaagctctgagtaccttggcagttctccctcctgtcacttaagcctcatggactcgtggtgaccatatggctcagtgcagtggcttcttagagacattagtaggaaacttggcatgcctacagtccagctgcatctttattgcactggaccagccagggggcagtgttctcaggatgcatatgatcttttggggagagcagtttttcttgcacctataagagccagcacaggcattcttcctatgaaaacctctaatgaagatggttagtagggttccattgattctcttgactggctaattagagaaatttcaggagttttaaaaattgagttgtggatccttcatcaagctgtctccctcttcttttggaaaacatacctgctactagccaatttgtaaattaatcctttcatttggcaataatttatcatatattggagtcaaaagtgagttctgagacagaccacacagtagaactggcacattttcaaagtgaaatggcgagagctggctagacaacccaaacactcacatcagcatttgaaaagggccaaaataaatgtttgacaagaattcctttaaaaagagctagcagtttgcctaagcctacctcctctccctccttgggggtggtgtgtgtggagatgcttcttcctccctcaggggcagtgaaggagcccgagagaccacgcagaaagtttgctgagaattctcggggatctgtgtgggtgctgggggtggggggcaagaaggccagagtgcactactgtcgatttttattcaggagctctagagggtggggcatgggctgatgatctgctagtggcaagagcagggttactactgtgtttctgttgacccaacatgggctataagcacagaagagagggaggttaggggcattttggatcagtggtgtgctggtaagtgtttaacaaccagctctctggaagaaaaaagccctgattttcagtgtttgccaatttttggggtacaaatattcctgttcagtctaccaacatgatgttcctgaatttggagttgggaaaaaatgtacacgatcagcccttgtgagccagtgggagctggctccagcacgcctctgagctcctctaccacaacacttgacacttacattctttctcacggggccacctagaggggcaatgggaatgcaggagaaggaaacctggaggcgggcaacctgggggtggtatgctgggcctattcctagctcattgacttctccaccctcttttaccttccttacaccctctgccttctgtctgggctcctccagtggggaacagcagcaagtaactggagggtaggaggagagagaggccaagctgtttcttcatgggagacttctctgcgggggtcacaagctggacacatggcttgactgaaggtcacagctcgtatcagatggccagggcctttctgcacagccctgacagtctttaaattctagtaacttttccctgtcttgtccaggcctagggacagcaatgcttcctgccttgctgcagtgactatctctggggtgctctcccttgcagtttccctacactctgcttatgcctctgtagataggtctttatccaattctcttcacaacgtctcatctgagtgctgacatctgcttcttgttaggaccctgacccatatagattcaaattgggtaaggaaccgcccaataaggcacattccctcaagttaagggacctgctggtgagggatctccagagacccatgaaaccaccccaaattaggaagagtctgctttgaatatctaccaggcccagagagtccaaggccacattacagcagaaccattcaagtgagattttaccaatggcccttcctcccttccttctttcctctaatcccttcttgaggaaatcgagccttagcaggctaaggaagggagggagttagaaagagagatgactatttccctctcctcctcacagttggcctgagttggggtaagggagagaagtcttatctcttgatgaaattggaattattaagattgcaattactatataaaatgaccactctttttggtttgtaattaacaatgaatgaccaattcagttatggggttgatcaatttccatccaggggcagaggaagaactttccctcctatgaagatgggaagagacggtgggagaacaacaaaaaagtaaccttcagggcacttccctgtatcactcatgtcaggcacaccaccaacagctattaagtccctaccaaaaattacaatgcgcctggagaagaaaataagtggtaaattttctgttttcacctttaagtaaaatgatcctgacataaatggtagtaaggagaattaagattaatcagaattgaattgggattcactttttactaccacttctatcacaatgattccactaaaacagtaatttttatttgatctatgaagccttggaatctaatccttcatagagttctgggaattattataaaccattgcaaacacaaaaagttcagagaatgagataaataacacccatgtactgactatattttgaaatatctaaatagtttgctgcagtttcattttttaattttaaatagaatattacggaattggtagaagcatccttcacaattcactctaccctttctcctgggcaggctcctggctctttacaacagctccctaattatttctcaaatagatatcaggattttcaaaataccacttaaagctttctgttggttatttgcacccatcatttgtatttcagcacagccaaccttggtttcctgttggttgttctttcccaaactaatcatcaccttctctggggagatgggaaagtcttacccaactccattacacatgcaacagaactgttcctaggaaacaccgaggcctttcttggtccgagatttgccgagcacagatggcgattttcatcatgtgtaaaggaaaaagaggacagatagaggggccagccataatacattctagtctagcagatgagatgcagaggctagaattttgtcttctatatgtttggtcaaatgcctaatttgctcaaagcagcagccatgatttctgcacagttgcatgatgaaaaaaatggctctggcaactggtaacaagatcatctgggttcagcgcttaaaggaatagacagccccttcttggatgtgattgcgtttttttgcaagaaagagtaatcaatggtgtctgtgagtaaatatggctagagcagtgtagtgactgtgtcttgtggaggccttcaatgctgctggtggcccagagccatggtcagctctgtggcaaggagtctgaaattgtctctgtttgctgatgacttgagtttatatatagaaaaccctaaagactcaaccaaaaaacttttggttgataagtgagttcagtaaagttacaggataccaaatcagcatataaaagccagtagcatttctatatactaacaacaaactatccgaaagagaaattaaaaaaaaattccattaatgatagtaacaacaacaaaaaacccaaagaacaaacaaacaaaaattgggtgtaaatttaactaaggaggtataattgaaaactataaaacactgatgaaagaaatggaaaaaaaccacagataaatggaaagatatattgtattcatggatttgaagaattaatattgttaaaatattcatactacccaaagcaatatatagattcaatgcaatccttatgaaaactccaatgttatttttttacagaaatagaaaaaaaatcctaacgttcatctggaaccacaaaagaccttcaatagtcaaagtaatcttgagcaaaaggaacagagctggaggcattacactctctgtttttaaaatttactacaaagctatagtaatcaaaacagcagggcactgtgataaacagacacattgaccaatgcaacaggagagaaagcccagaaataaacctacatatttatggccagttgatttttgaccaaggtgccaagatcatacatggggaaacaacagtttcttcaataaaaggtgttgggaaaactggatatccacatgctcaagaataaaattggatccctatctcaaaccataaagaaaaattacctcaaaatagatgaaagacttaaatataagatctgaaactgtaaaactaccagaaaaaaacataaggggaatagttcaacaacattaatctaggcaatgattttctggctgtgaccctgaaagcacagacaacaaaacaaacttgcacaaattggattatatcagactaaaacgcttttgcacagcaaaggaaacaatcaacagactaaagagataacccagagtggaaaaaaatattggcaaaccatacatctgataaagggtttatattcaaaatatataatggactcaagcaactcaacagcaagaaaacacataaccctattaaaaaaatgggcaaaggacctgaacggagatttctctaatgaagacaaacaaatggccaacaggttcataagaaaatgctcaacatccctaatcattagggaaatgcaaattaaaatcacaataagatagcacctcacacctgttaaaatggctataagaaagatgaaagataagtgttggtgaggatgtggagaaaagagaacccttgtacactgttggtggaaatgtaaattggtacagttgtcatagaaagcagtatggaggttgttcaaaatactaaaatagaaccaccatgtgatccagcaaccttgcttctgggtatacatctgaaggaactgaaatcagtatgttgaagagatatctgcatttccatgttcattgtagcattgttcacaatagccacgacattgaatcaacccatcaacagatgaatggataaataaaatgtggtatatatacacaatggaatactattaacccttaaacgagaaggaaattctgtcatttccaataacatgaatgaaactggaggacattatgctaagttaaataagccaggcacagaaagacaaatagtgcatgatctcacttatgtgagaatctgaaatagttgaactcatagaaatagaggctagaatggtggttaccaggggtgggaggtcaggagagggagatgttggtcaaagggtacaaagtttcaattagataggaggaatgtttttgagatctattgcacagcagtgtgaacacaaggagtaataatggacatttcaaaattgctgggagtaaatttcaaatgtctcaccacaaaaaaaatcatgggtgaggcaatgaatatgttaattagcttgatttaaacattctacattgtatacacatatcacaacatcacaatgtacccccaaaatatatacaattatggcttttcaattagaaataatattaagagaagcaaacaaaaataccaaaaatggttgagtaatgaatggcaaatttcctctctctgcttgagctgggacatcgatctcctgcccttggacgttggcactctggcactcaggcctttggactcagactgggacttacttttttggctgccctggttcccaggcctgcaggattggactagaactacagctagactttcctgggcccgcagcttgcagatggcagatcataggatttctcagcctccacactgagtgagccaattccttccaaaaaatctctctccatatatcaatatatttcctattggttctgcttatctggacaaccctgaccaatacacagggtgaatgctctttttgctaaaccacagttgctattgcaggctggcaccagggctgacatagagtcttcctctgccctccagaatggttggtgcaggagccttaaaccactcaatgggtctgaacccttggcagttgggaactggcagggaaatggtgtgcaggctcctcctcactcccagcctctcccttgagcatggaaattcggctaaggacctcatgtcactgaggatggccctatattcacaagcaactgtggattagaattaagtggtgagacacactgttgatggttttacagagttacctgaattcttttggaaccaactgagatgttatctcagccttagagggcagctgcatcctttatatcctgccttatttcaaggagtcaacaattttatttctgagagggtgaaaacatctgtaatccatccaagctctcccatgtctccgcaccaaggttgcgagtgttttctgcatgtctgaaggaagcctgccttcacagaggtaatactgtgacacttgagggctgtggagtgctagagattcatctgttcattcaacaagcagtcagtgaaggccagctaagcctcaggaactgtgcccggcactgggctatcatctggtccaaccacgtcattttacagatgtagaaacctgagcgcagagcccctcagctgctggcacatctttaaggcaaaaatgtgatgcctaagtttcactcattcattcaataaacacttatggaggacctactgcgtgacagtcactgtgcttggtgttggggaaagaaagacaatctgtccagtgtgggagacacagactaatcatcactgtctagtgtgactagctgcatcacagagggatatgcagagttctgtgtgagcccagagggagctgagatagctctggggaggggaagtttggactatctgactttggaaatgttttaaacagagccatgatattggaagaaagaagatatattaaaagctgcagaactctttcttcaaatacaagcttaatggaaagaaaaaaaaagatctgaagttgttttggttgaatttgagtgggcgagaatcccaaagctgcgctgtttgcacagtggctgtcctcacccttgcctcgtggtcctgaaggggctgtggagaccatctaggctgcacagagcacattttgcagaccactgggctagaggatgctggaagatccccttccgttgttttctctttttcttttttatttttttaaatttgctgtctcccaggctgtagtgcagtggctcacagcagtcttgacttcaaggaatcttcccgccttagcctcccaagtagctaggactacaggtatgtgctgctgtacctggctaattttttaatcttttctagaaatgaggtctcgctatgctgcccaggctggtctccaactgctggcctcaagcgattctcctaccttggcctcccaaagtgctgagattacaggtatgagccactgtgcctgccctgccgtcccccatccccccccaaccccggtttcagttcagtctcaatcagtggctcctctccatatccttggattcccagtttcacacactggatcatgctaggtgctcagtgaaatctggggaataaatggttgacagtctggccttttgctttctcttaaatttgttgtccctaggtgcagaactgcaaaaagcatttcaaaactcagtctttaccaattttacatcaaatgggagaaagtggcatcaacagccgaggcctgtctttgaagaacaacagggatgccacaagaggtcactgcaggaatgctggttgggggaaaagagccctctcagaggactaaactagaacaacgcagtgaaacagggagccagcagcttcagagcctctctccaacccgtaaggcccttgcaggggactcagagctgcctctgcctgatttcccgggtcaggtagtgaaacaccagccagtggcaatcccagggctccacgtggcatcacagtcgaatggcttgttcttgggggctgcttttgttcaaggagatctttgttcctggggcagtgagaagagggaggagggaggtggaaagaggggtagtgcccaagaggtagtattcgtgggggaatctcagccatcctttggaacttgttgatcttaagtttaagatattttctttttttaattaatactatcagtataactatcttctataacagtatatgaaacatgctcgctgtcgaggaaatgggatgttccagtaagctctgttttcacagaagttgggtcaaggggtaaacgcagagaagcgtaaatgcagagaaacccccatcccgcacacaaacacacaaaccacacacacatataacatgtacaacatatccataccaccaacacaccacacacacacacaaacccacaaaccacacacacatacacaccacacacacaagcacaaaacacacatacaacacatacaacatatccaacataccacatacacacataccacgtgccacatatacatacaatacatacaacatacccacactgcacacataccacatatacacatgcatacaacatatatccataccacatacacacacaccacatgccgcatatacacagcacacacgtacatacacaacagacacacgcatacacacaccccaactaacccaaactatttcccactcttctctgtggttcagaatcctgcccattcctcaagactcagcccaggcctgtggtcttggtgacaaccccccagggccactccttctggtaagaacgggaagttctcatggcctgtccctctcacctgacacatttcacatgctgcttggtagtgtgatgtatcttttaaattttaaccacaggcacctgttaagggttttgattgtgaactgaacaagatccagccctgatcaaatattgcttagaagagatatttgagagagaggccacagcccacgttcctggggctggattcttccagttttagtcctgctctgtgtggccatcagaaagctgagtacccggatcctattatcttggccgctcacataaacgctttcagtgagctatgctttaatgtcaggcctctagcttttatagagggtcgatacaagaatcatctggttgaataacatttcggtatcttttgtaaaactgcagttgaagacatcgttcactgtgtcactcagtgtcctttatacaaggatccgcacgataaattctggcttgtatttagttccaggaagaaattctattttctgcagataaattagttagtatgcttcctgctgtcagaaaatgaaaactatgtaactctgggtgcctcttttttgcttagcagctagacaagagagagccaaatttattgcctgtgtgttgtaatttgctcagctgtggagtccaaaagcacttatgccttctacttcttttaaatgggcttattttattttatgctcaaatgtctcattgtgcttttgcaaaatgtgtgagtctggaagtcacctggggaagcattcatctggccattgacttggcctatttattgcttgtgctggctgctagggattcgaagatgaatttgactgcacccacctttcctggagcttacattttagcatggagaatatatatggaaataaataattacaaaatagggttggtgctttaacagagacccatgaggcggaggcaaaagcagattttgggagaaggggtcagggaaggcttcacagaggaggtcaatgttgaattggttttgtggctacagtgggaagaggacagtgaatggaagaatgtaggtagctgaatctgatacttaaaaaaaggagttgtctttttatgcacatgtcaactcatcctggttagattggaaactctttgagggcaggcactggatacagccctctgtggattccatgatgcctggcaaagtgctaagggcagtgcagcgtgatggctggaacactgctgtggacccaggctactggccttgcatccacagcggagcaaagttaggcaggtttccttaacccctttgggccttaaatgtaaagtgaggataatagtaacatctacgtcattgggttgtgagcattaaagaaagaaacacatgtagagaacttagtaacatgcctggcacatggtaaagtactcaagaaacatttgctgattagtctcatctgcattatcaacaatactaaatcatttggggtcgatagtacagtaaagtggtaaaaacacacacaactgaattcagcaaagcactctcagctcagctagctgaatctagttaagttagtatcatttccaactgacgcctaatttaaaaataacattgttctattgtttcctgaaatagtgtgtgggagtcagccctcctataagccctgatgatgttcttagagatggttattgatgtttgtcttaaaagacacccccagctctgactgtcacatctagggagctcacaaggtacaatgcttcttcagcctcctttttgtcttcattagttctcctgtccactaagttttaaaaggaccagggttcggtagatgtttatgtttcctgatgtatcttgggtgagttgtaaatgaagaaagaaccatagtcttgactttcagccaggaaagagagtaggaatccttataaaagcacatgcacagtcacgcgtgtgtgcacatgcacgcgcacacacacacacgcacacacccggccatgaaagggccatccatatgccattggtgtggtggcaaatgtttaacagccactctttggaaaaaaaaaaaagccacatttataatacttgccaatttccttggtgtaaatatttccagcatggctgatttgaagccaccagtatgatctcgctaaatgtggatttgggaagagaggcaccgcagcacctcgtcacacagtgttcccaccacacagatacagtggatacagatcacttcaaaagcacagataataacacaatgtagtaaattaactaggaagtggtgaattttgagtatttgttacctttgtttcttaatataacatttaattgtaaacttatctaatttaattttaataacatctttgtttaaaaacggctccccacattcctggagtactaacagtttatgcttttatggactgagccagctcagcacaccactgggaatggcttatcatcatccatgaatgatttcttccaaatggtgcctctcacattaccactaaatctttgttcctttgggatatgggattgcctttatagaaatttccctgggcacacatctacttacacatccagagacatattcttatgcaaaacatataagaaaaactctcctgatccaacttgctcatcacccttccccacgacaaacccaaaccgatcacacccacactttcatgaaaccataggaacatgtaggcaaaagaaagaaacaataacagaggaaatactgagaatggagagtgagagaaagtgaaaagaagcagacaaagggaacagaatgaaaagggtgatggtagtagaagatacacaaaaaagacagaaatgaaagggggcgtaccactgagtcacttctttactcttagatctgaagcctgaattacaaaacatcagggaatccaaatacaccgagtaggctgcctttactcttaccggagccctctgtcctagccttcagcccaactgctgggctgaagggcgagagttaaggttctataagcaatctgtcttgagaggtttctctcaatgaggagaattcccatctgaaatgcggccacctgggacacacaagctctggcagttccaaatctccatcagacaacctcctaaggagcttggacggcaacatggcatttaatctcagaatggcagctgggagatgttgacacttcttctctaattgggatagtatgcttttaaaataaataggtatttcaaatgctcttaattagacttccagccaaagtgctttctgtttgaagtttgctgattacttcaggcaaagctaggcgctactgaacctaacacctgctgtaattcagaagactcccagagagatgagcagaggaattaaggcacaagcctgtgattgaaaacatacagcagttttccaaaggcccaggaagtgtctgccccagctggaaggaccatccctgggaggggtggggactgggcagcagagaggatggaagatctcttgcccacaaagtcatggaaatggcttcccagaccgaagatgaaaattgcccctagagttgagtggtatttttcacatcattgtttgtttatttttaaatttccatttttaaattttagattcagaggtacatgtgcaggtttattacaagggtatattgcatgatgctgaggtttgggcttgtattgatctcgtcacgaaggtagtgaacctagtaaccaataggaagtttctcagcccttgcccacttcccttcctacctccttttggagtctctggtgtttgttgtttccatctttatgtctgtgtgaactcaagatttagctcccacttacaagtgagaacatgcggtatatggttttctgttcctgcgttaattcatttgggataatggcctgcagctgtattcatgttgccgcaaaggatgtgattttgtttttttttatggccgtgtagtgttccatgatgtgtaccacattttctttatccaatctgccattgatgggcacctagattgattccatgtctttgctattgtgaatagtgctgcaatgaacataagtttgagtgcctgtgtcttttggtagaatgatttatttttcttttggtatatagccagtaatgggattgctgggttgaatggcagttctatttttagttctctgagaaatctccaaactgctttccagaggaggtgaaataatttgcattcccaccagcagtgtataaatatacccttttctgtgcaaccttgccaacatccgttattttttgactttttagcaatagccattctgactggtgtgagatggtatctcgttgcgattttgatttgcatctttctgattattactgatgttgaacattgttttgtatgttttttggccacttgtatgtcttcttttgagaagtgtctgttcctgtctttgcccactttttaatagggttctttttttcttattgattcatttaagttccttatcgattctggatattaatccttcattggatgcatagtttgcaaatattttctcccattctgtaggttgtctgtttactctgttgagagcttcttttgctgtgcagaagttctttagtttaattaagttccatttgtctatgtttgattttgctgcatttgcttttggggtcttcatcatagattcattgtctagaccaatgtctagaaaagtatatcctaggttttcttctagaattttaacagattgaagtcttacatttaagtctttaattcatcttgagttaatttttgtgtatggttagaggtaggaatctagtttcattctctgcaaacggttagttttcccagcaccatttattgaatagggtgttctttccccattgtttatttttgttgactttgttggagatcagttggttgtaggtgtgcagctttatttcaggagtctttgtcttgttccattggtctatatgtctggttgtgtactaataccgtactgttttggttactgtagccttgtagtttagtttgtaatgggtaatgtgatatctccagctttgttctatttgcttaggatggccttggctatttaggctcttttatggttccatatgaattttagaatagtttttttttctaattctgtgaaaaatgacattggtaatttgatagaaatagcattgaaactgtagattgttttggacatttaaacaatattgattcttccaattcatgagcatggaatgcttttccatttgtttgtgttgtctatgatttcttccagcagtgttttacaggtgtcctcatagagatctttcaccttcatcattagatgcattcctaggtattttaatttttttgtggctattgtaaatgggttgcattcttgattgtcagcatgaaagtttttggtgtctggaaatgctactgattttgtacattcattttgtatcctgagactttgctgaagcagtttatcaggtcttggagtcttttggcagaatctttagggttttctaggtatacggtcatatcagcaaagagagataacttgacttctcttctgtttggatgccttttatttctttctctggcctaattgctctggctaggacttcctacgttgctattcctattgaaccagcaacatgaaggctgaagaagagggcagatgtttcagggccaggtggcagcccttggggacaactccatatccagggacctgccagggtgagcacgaagcaggatacagaggcccataaggtcaccttggtacagttttccagcagaggtcattctgccttcccaagcctggcccaaggagttagggccctggggcagcctggctctttgttgaagacacttcgcagaatctcaatgctaagtgtgtgcccaagtctctggcgctgggagggcagtgtacctgaccccagtcccagggccaacagtgggaagctcagagctccagttgccgtggcttaggtgcccttgttctatgttcctgatgtaatcagcagctattctatatcatcattattactactgaaacgaaacaaccaactttcctaataatacaaattaccaaagtcaaatgagccatcgtcatgactttagaggctctcctctatttccccaccattggccctgggtgctggatttctccgattacaggtaattgagggcccacaccatctcaaggggaactttttttgtctggaatacatgaatttcttatttaatcaaagttctccataaattgttggtcccagctagctggagaggaaatgaggaggttctacccaggatacccactccaccagtcctctgcaagctatactcttctcctaggtgacttcattgggtcacatatcaaaaaagggtgttttctgcagatgtccactgcttaaaaggtgccaagggcctcttagaatatgactgtccttgttttgtatttgcattcttcatgcgttaaagcgggttgatcattgcagtgggcagtaaatagcatgagggctaacagcaccaagcttggaacagaactgggttcaaatacttgtttcaacactcactggctacatgaccttgggaaggcactgcatctcccccatctggtaaatgcacttacctctttggactgctgtggatgaaaggagactgcatatgaggctgtgcaacagacacgggtctgtaaacaaatgctgttttcatcattaactatttctgttaggattagttagtagtggctctgaaaagctcagataggaccttgagaatctgggacacagtgggtgaatttaggtggggatgtggggtgggaaaggaggggaggatgaggcaacagctggaagagtagggtgctgggtgctgatggccaggcgcaagaacacaggctggggaaacagatcctgttagaggaggggcatccaaggaaagctgtgtggatagcaacccttgccatccttaacctcagagagggttttaaatgggttatcttttagctgggtttggattcctaaaatcaggtcagtttatattaccttcatcctcttcctgcagattctctttgtacctacctagggctacttgctgtatatgccgctgggtgatttcttccttcaggtgacctgccaaagacacaaaagaaaactaccagtgggtttccaatgggctggaggaagactgcctcagaagcatgtggcaagctacagaaaaaaaaaaaaaaaggtagagtaagggaaacaaaagcaggcatagcttccaagaaatgaccttccatgattcctagatcgtgttggaagaagaggttgcaaaggcctaggtgctggcacatcagtgcaaacacacatttcacccttgagttcaatcatcttaggattcaagtatcttagcctgtcacccataactttcactgaggcccctattctcttaaatggttctttctattattaataaagggaaaagcagaatttggtcttttaataatatttaggcctactttaaaatccacatctttatttaagctacatgaaactgtgtcaaataaaaaaagatggtggttttaactgacaataaccctaatagttggtcatttggtgtgaaactcatataattctagtttacattaataaaggtatgatgcacagagaacagtgatagttcccttcagggaggtgatagttccactctgctctacaagtgaggagacatcagctggtatttgttctgggagttactcttcataaggaacatttgcaaaatagaaaatattcagaagatggtgactggaatggtgaggggtctgaaaccatgccatctgagaaatatttaaggtgacatgagacatttagatgtgaagacaagacttggagaggaggaatggagataatggctgtctttgaatatctgaacattgtcatatgaattagaaacagctttatttttatcttgctcctgagggcagaaatcaagtctaatgaaagcagacttggggcttaatacaaggaagaaacaactcacaatgaggactgtctcaaaatggattaaatcttctggcaaagcagtgagccccttcctgaaagggttcaagcagaagctgggtgaccatctgttgggttgttagagtgagaattcctgccctgggtaggatctgggaggcaatgacctccaggcttcctccgtctctaaaattccatgatttcgtgcatgaaggaggggtgaaacagcagcccggagtttgtttatgtccaagggctcagcacacttgttaaaatgtcagtgctgtctgtatggcatgtcccatttgggggatgtgatcaggccactgggggattccaagaaagcctggaaaattcattgcttccttgtttaagatatttctttcctcacataagtacattctatacctccaaggctatagctgaattgagtattcaaaagatgagtagatgaggaagcagtcacaagagactttatcatttatggagagttttagggcacctctagaatgttataattgggagagatggcagaggtcattcagttcaactttgcagtcaatttaggaatcccttctacagaaggaaatgggcatttcccttctgacttgtatgtattcgagctattccattaagttatatgtaaggaattaattatgtggagttgcatctgcttccctataatcttcagctatgtgcctggcctgttttctggatcagcacagaaaaagatcctctgtcattggcataggatcttcacatatctgaggatgctatgattgatttctctacttcgacttgccctttatggaggtcaaacatcaccagtccttaggtaatacctcggaggccactatctccagacacatcattgtcttgggaaagggtctggggcacctgcatgtctgtgccttggtttccatgtgtccctactggagagaattatgcatagagagcgtggcaggcattgggactaaacaataattgcacccttattccatgtgggggaagggtgggaacttcaggagtgtgctgagggggatttggggaagtggaaacttgacccaatgatgagtattggtgaacctggatccaacaggaaaatgacttgacacctgagccagccacagccccaaatggatcttttccctactcagtgcaatttgacccttattgtccatataagcagagtaaagaagttggggacataaggctgctgctggactgagactctaggctgcatcaaacactgctgaattaaattttaagatgggatagcacatgcatgctccaaataaaaggagatattgctgtgacaaatgcaacacaccatttagaaacatctcttgatttagagtgagtcatcaaaagctttttaatcctgcagtatggagagtcagtggtgctttggtgccctgcctgtttcctgggtatccggcacagccttataccacgagcctctcatatgactgggtactgccttcctaatgagcctggacagtggcttgctcctttagagcacacactggtttgcactgcttcctggaaactacctccctgctaataagccttcccagtaataagcctccctgacaatgcgcctcctgacacatgcttcctcaagtctgtgcctccaaaccccatgccttgaccagagtaggtgtgctcaacctggtatgttacaatttcttcagcgcctattggaacgaccaagttcctttttcccaaaccctaaggaagtatttttttttttttggaatgaccaggtttaaggattctccactgcccctggtttgggaggagctgctcacgtaaataaagaggggattttgccaccacaagcataaatactcactctcagaacaacgaggcaccaccagggaacaaaaggtgggtctttataatgttacatattgataaaggttgttttacaatgccgctagtgatactcagttttggtgaattgactaacatctcccaccacatggcaagtttttttttatttcccccaaacaagcttccaaaaatagccttatggctgatacctaattgcatttctaacagagctattcttcatgtgcagataacagtctctgtaacctgctggatcttgcagctttatgggttttggcaaaaaaaggagttgagggggattgcagaattcactcagcatgcagcttgctgtcattaccacggtgataaatttgctggttttggcctgggttcctggacacatccccatccagaggtatggaaaagagatgaaatggaaacagagaactcccagcctgaggccggagacagtctgggagggaagtagggagcccagaatggggctgaaaaccaaaagggtaggggagggaaggaatgctctgcctgcaggagtgtccataattagtaatttttccttcagtaatttaccacagtacatgctagaaacaccttctctcccttttgatacattaattgatggattgtgggtggcagcggggagcagagcttacagcaatccacgggaaagctccagaggagacgggtgaccttaaatatgaccgcgagcagggtatgtggaggtggtgctctgtgtggtatatgggttttctctgttactgagtagttctagggaaagtattatcatcatgcagaagtgaaactgatttttttacatcagtattcagtcttctgaataaaaccattttccataagcttcacactctattttgcacgcatgctagtttgagattattcacgtgaacgctgcttggctggcctggaggagagctattcacttacgactccctgagtggctgtctgctgctcctgcaatttctgggatgctgtgcctcattcaacatgtttatgttgctatcaaacaataaatacttatctctcatctactatcggttaagcactatgttctaagtgctgtggaatatacacactcgtagaaggctctatcctaacctaggaaagtcagtgcagtacagggatcagcaaataggtggcccgtgtgctctttcttttaagtgctggaccaacggctggccttgctcctccatcagggatggtttgctttcctgctgagcctgagtttggctcttccacacagcactctgggcagctatagcccatcacttgaagttggacttgagatgaagcaaacctctttgctatttcagttattctagaaaataattacaaatctgggccaggcatggtggttcatgcctgtaatcccagcactttgggaggccaaggtgggtggatcacctgaggtcaggagtttaagactagtctggccaacatggcaaaactccatctctactaaaaatacaaaaattagctgggcatggtgacgggcacctgtaatcccagctacttgggacactgaggcaggagaatcacttgaacctgggaggcagaggttgcaatgagccaagatcgcgccgctgcactccagcctgggcaacagaatgagactctgtctccaaaaaaaaaaaaaaaaaaaaaggaaataattacaaatctggaggtagacgaagttgagttcaaatcccagttttgctacttcttagttgaatgggctaaccaacgtctctaacctcaatgttatcatttgaaaaatggaaaaatattataactgcaataatatctgctttgctatatctcaagatctttcagaggagcaagggataacgcaccagcatgtatgatatgccacactcgttttaggtattcaggcactttcagacatattggaaggatactacatggttaagatgacaggtcaagcggctaaatgtcaaatcaatggtagagatacatttagaggagggaaaggagacattgggaaaggcataattactacaggcgaattgagtaggctcagaaaagagcaagggtgttaaggtgcgcttgggaagggcacctcagtctgagagaactgctgggacaataatgcagaggccaagtatatactggtttgggacaggggcggcaagggaaggttgagtggaggactagggctggggaagactaagttgtattcatactggagtctggggtcctgggtaattactaagagctctggacccagataaatgctatttgtctgtttgactatactactagagtttctgggcaaaatctggttaatataaacatcagttgtagaactggggtgtggggagaatatgcagaatatgtttcctgcctgaggggcctctttgaaatggaaggtctagttagaggctccgaactctgagtgacaatttcagctgtcatgtgagaagcagtttttttggtactaacatggaggatcatgataaccaaaaggttagatccctaaaggctgtgtgtaaggctagttgtaaaaataatgggcctagaataaattgtgtaatccttacacggattcccaactaacaggaggatgtaaattctttgaaaccttaaaatcagacatattcatgtcccccttgctaatatatatttcatcaggctttatccaaacttgttggtatactttgaaaatgtattgagtcaggaactacctcttctcaccatagcagtggtggataaaatagaaaagagactatcaggaagacattgtgggatttgattatgagacatatttctgaagaccagaagtaggacggaaatgcaaaaatggtgagtggagctgaggccttgaacttgcaaagcactggttccagaagtaggaaggtaactaaaacagcgccatgcggaacagggtaagagtctggcacattgtttgaggctgcgggttgaagtgaggctccctaccacccaatctgtgagtgaaaggggactgatgaaacgtgcaccagatgttgcctggggctatggtttccaactcaatgcaagcccaaggaggaagaaacgtacaaactcagcccctctccagctgctaagcccagctgctcacgggctctatacagggtctgctcatctccagtactgttacggagcagtcactccaaattgtctttactggagttgattctggattgggggcctggagggtctgtcagccagagagggatgaacacaaagaaaaagagagtaagagaaataaataaaacgtgtttcgttaaaaatgggcctgcccagcaaaatgccaaaatatatgaataaatctcatgctaaaaaaaagatagtcaagttcaatagttggaacatgaattagttacagatgaaagtaattttctgggcaggcagatgaagacatttgttgatgcagaagcacagagggttgagttaattttactcttcagtttagggtacaccactcatcagcctgggcaatgcctctctggtatgtatgtttgtatgtatgtataggtgtatgtatacatatgcatgtatgtatatatgaatgcatgtatatatatatatgtgtgtgtgtgtgtatacatgtattttggccctgatacttcatgtctcatgtcctattcttattctcctcttcttccaacaggcaaccattctagttggtttgatgtatgtgcttttattgtaggtgttcttacaatttgtattaaagttttctgtgtagttttaagctgtgaaagtaatattgtgctatagatctcattctgtttcttacttatttattagtactgtttttgacatctgttttgctgtatatgcatctaattctcagtttctgactgctacatccattccacagaatgcaccccaacttttacttccattttttgatagttgaacaactggattgcacctcactcccactaacacaaacagtgctgtgatgaccatccctaaacatgtagtcttataagtctgtgagaacatttctctgctgggtctcagcagatttgcataattaatttgagtgctgccctccataatgattgtgctagtctatctgcccaaggcaaagaccttaaagtatgttgaggatacttaacgagattaatgaagggatacattttctttaaaaagaataagaaatatgtgacaaataggtataaatgatacaagaataggtggatagaacagaaattttgaaataaaaattagtcattgaaacaaataaaaagtacagagactaaggaaataaaccctagatggggtaaatttcaaaagtgaattagtgaattggaagacagttggaaaaactgactcaaacacagcacagaaagcaagacataaaaatggggaaagcggttaaaagtcacagagaagagactgagaggcttcctcatttgtctagaattctagaagagaatggaggcaaatggtaaagaagcaaatggaggcaaatggtaaagaatggtgaagagatagcagttgagattttccagcattcgagaaaaatataagcccttgggttgaaagtgcagtttgagtattgagcaggataaataaaaataaatccacccccacacatatcatagtaaaattacagaacttcagggaatcagaaccactattaacagcttccaggggacctgcaaaggaggaacttagatgaccgcccactcctcagtgacaaccacaggtgccgggagatagtggagggaaacaactgtcaacgtgaattttattcatacccaaactatcattcacaggtgagggcacagtaaagacattatcagtcataagaagacaaagagcatttaccacccgcaggccctctctccctaaaagaactcaactgaggcagccaagcgtggagggtgagtgcgtggactctggagccaacccccttgggtttgcatccagctgggccacttactgtgtaacctcctgcaagtgactgaatgtcagtgtgcctcagttttgacatctgaaaaatggggataataacagcatttgtgctgtgacaactgaattaggtcacatgtgtcaagtgcttaaggagttcctgacatataataaaaactgtgtaagtgtgaaagttgttatgatcagcaagaagaaaaataaacacaaagatgggggataaaagaagtaatagcataaaatgtaaataaaatatttaagtaaaaatattttattatttgaccattaaaaacctctgtgtgtatgtgtatgtgtgtatctgaaaaccaacattttaggcaataataacaaagtgaagataaagtagtgagatgttcagtggggagttaaaaccagctgtgaccctggatgtggttgggaggaggatatatttggaacaactacagacattgttatagttactttttaactctagaagaataaaaatatgtacagtagcagccaaatcaatagaagatcagaaaaaaaggcaagggatgggtgttgtggggagggaatgccaacattttcacaattcgacagaagccaaggaagaagaaaaaaggaatcagagaaaagaatggggtataaatgatcctgtgtttggtgaaacaaacaatggcaagagctttacatatacgtatgtaaataactgtgtgtttgtgtgtgtgtgtttgtgcacgcacatatgcccttgtgcatatatatgtatatgtatgatgctgtgaccatggaggttatgtgaatgaatatctacaatgctatgacaggttactgagggtggaagtggggtggagagtgaattgggtaggagaggataaagccgagcaagatcaaacaaaatagaaaatgtactttaataaaggcgcatgatttacgattcacataaaagctatatttgtatatatttataaaaagaaataaaaattaaatacccactgcacttccttgatagggaaatgtgatgttactatagcatgctggaaattgcgcttgagcacctgccacacatgtgatgtcatctgccatgtgtgctgactgaaaatattcataaccgaagtctcagcgacagggataggggaaataaggagggtttcagcatcggattatttggcagagctgtgttattcaccagcagcctggcaaagaagtgaaggtggaagacagagagtcccagaggcagcccaagacagcaagggatttccattggcttgggggccaggggtgggggcacctctgagaagccttcttcccttgttgaggtcagggcaacaggtccttccatgggttcctcaaagagaaaggtccagcaatggaacatacagtgggaggccaggagtggcctaaatgctaggcaaatgtttttaagctgccttattctaaactgacatttcatttctccagaattcaagattcttcttccatttagtatgctaaacatcacagttgataacataatcgagtcacagagagagggggaaagcagctccttataaaagatatcaatactttctagaaaaacatcaccggaacttgtcttgatttccccccgtggggattttctcaagggctccccatcacctcggccctatcttgtggaggaggatgtgcctggtaattaatgaacatttcagcttgggatgaaaacaccagacagtagtctgggcttttcaagacagctccttgcttatcattatgacggtacatgataatcacattttggggaatgctctcatttacaaaaaatgaccaaattataccatgtctgggagacccaatttcttttgctgtgggatattcacttgggctacccaagtaatcaaaataatcacacaagattagcacgttctgcctgaagctcaagcatttggctattgtatatgtgtaattaagctaagaagcttattgatatcactatttctgtatgtgatactattatataaacagattcagagaattaagtaagcacatttgttaaaagctcaaacaaacgtggagatgcaagtaggtgagcattaggaaaattttcagctcagcaaccagcatgaattattaaatactaaacatctcagggagctgagggctcatgattgtgttggtatctattcaaaagatgttactttagatgcttgaaagttcttctcagcaaagggggatataaccagcttccaaggcctgccctggaggagtagctgtagttcacaattgttctttctgtttgaagatgtggttccggttgccagaaatgttgtggggggtgagggcagggcccaggtagccactgcctctgatttccatccttatatccccagaagtagcccagggtacactcttaggagtacctgggggcattcaaatctcctctactccagtgtgggtgggacaggtatattccatctgttcccaacatgctcctacttgcactggaggctagtttgtaggacccctcactaactgggaggtagagggcaggttcactgaagggacataaaatcaaccccaagcactgagatgtttgattttgcagtgaatatagttttaaaaacttggattctaacatgaaaacagcaagttttacatggctctttgatataaataatcaactctttcactccaaaataaaacttgattctactcatttaattttaaatcagttagtgcttaaaaaaaagtcagtgggaaaaaacaagccccaattaaggctcactgctggacaaacttccagctggcctgtaaaataattgcctaacacagagttggtgcttcatgatgtgggaattgttctccatttgaagagactggagattaggaggaatgtgttagtgagtttgtgaataaaagacaaaactgaatggaaatggtttcagcttccaggttcaaaagtcattgttagatgttgcatatgcacgttgcgtctttctggtgcaatgggccaggcccaccattgaatctgtgaggctccctgtgctctgtctctgcactcacctccatgggagtggcatgggggtggatacattagtgcatctcaggaaaaccatccaagggagccaacgggggccgagcccagcaggtgcactgggaaactgtggtggagtggggagccagagaaaggtggctagccttcagagacaactgaacagcagtgaaggcccgtcagaggagagggagtggaaaacggcaggagaagttgcagagggaatcctgggcctacaataatggaaagagcatgggttctgggagcaggtagactggcactgccacctcctactgtgaccctaggctacttaatccctttgagcctcaatttcttcattaaaatagggtgataacaccaaccttgcaaggttgctgcaagaattagacccaaggtacataaagcccccagcacagtgcctggcacattgtaggtgcacaatgagtggtggtcatcatggtggtggtagtaataaaaagtaatgattatgaggtgggtggctctgattacaaataacactgcatggaggattgaagcaagctaacctattgcaattgtttctaaggtcttgatcacattcaaatatggcaggacatctgtattttcccctgttcccttttagaaaagcatctttcaggcctaaattaacaagttatcgtgggcccagcagactttgctgaagtgcctctctccgcctcggtggggaggaaggggggacagtcacatgtccttgcaattgtccaaatcagggtttcacaaagcagagctgtgacctttcagcactcgctgactccaactttttacaaatttagtttatctttactaaaccttctcccttctgatcagttatttaccctcaaattcaccatcactttagttagtaatggggtcttccatattccgttatagtcaaatatgattgatttctgtaattggaagtaaatgactttttaaaaagcttgcttgaaatgctggtggtaatggttctgttttcagagcctgggatgatttctatccccatcccgttattttactttattttattccagaaaaataacaccagagctctttctccttttgtttcctctgaggctaaatattttcaaagaggaaagaggaaggagagaggtggagatggacatcccaccattttacagacggtgcttttcaggagtgacatatttcaggaagaacatcgtttccccctccctgaacttgagttctgcctgcctgaaattccagtacgcatggctctgtttcttaccgatctcagtcctggtggatataagctggtcattttggggataatgcataataaggaaatctagggagttaggactagaaaaaagaggcaaagcagacaacataaccaaatgagaggtttttgcagtgaagctttgggagatgagggaagctgcagtacacatggcccgagaactacacttcttcagccaacaaaatgagtgagcagggggagcgggaaatcagaaggtgtgtaagaagggctgatggcacgattttgggtgctgtgtctctggggagtcaacaattccaagggctaatatcaggaaggcagtgaatacccagagagaagaaaaacagagatggagagggaattgccacaatatgcaaagataaaaataatttacaagcttcaggttgaatctttaggggagagagatcctgaaaaattttctgcgtccaagggatagtaaatggaggctaaatatacagagcccattatgatgaatgaaatgttattatgattctttagtgtattggttttaatgttttgttttggtgaatataaaaatatttgtagggacttttataggtttacttgtaaacttaatcttgcttttcacataaaggcgtaatccttaattatggctttttctatcacagggatgttcagttccttcgtggctagggacaggtggataactgtttcctataatgtgggagatgtgataatgtacatcccagagcacagcacttgtttctaatcctcatcgaagcagaagttgatttcatttcagctaatggagcatattgatcatcagctgctccagggtctaacaggtgccaggaggagaccaaaccttcacattctttgaacttgggaaggtaaaatttccagaataaggagcagcctttgccttctatgagaaagtctggatattatctttgagaaaaacatggctctgttggagacaagctaatcattttaatggggcatttgaggtttgtacatgtaaggtaaagatacaccattattttgggggaagctctaaaaatgaaataacccaaatgcaggtaggtgcttctaagtaagagttagatgttctatttagtattctgtcttcagaaacacagatcgggtgcttctttagcagaactataggtttgcagagctagagattaaaaaatatcttcatacagtttatctatgcctaaaaagtaatgcttgtactttggatgttgtgatggttagttttatatgtcaaagcgtataggctacagtgctcagatgtttgcttaaacactagtctagaggttgcttttagatgtggttaatgtttaaatcagtagccttcaagaaaaatagattaccatccataatgggagtgggcctcacccagtcagttaaaggccttaagagaaaaaagactgaagtcctccagagcagaatgaattgtgcctccagactgcctttggacttgacctgcaacatcaactcttctttggctctccagcttataggcttgccctgttcgagttgaacttgccagcccctacaatctcatgagccaatgcctcaaaataaatctctctctctctgtatctatgcacatccttttggctctgtttttctggagaaccctgactaatacagatgatgtggatgtgtccttgtccaagcacctgctgtagctctttgggaacagtgggcagtcaacggtgggatgaatatgtaggtctgatcttgtccccacctcacatgtgaatggagactttcatccaggtactcaatagtggtcacaacaatgagggaaagacacttttgtactgagtgagctgagccgggtcctgcgactaaagaaccgcctgtctcatcaggccaatggcacccccattgagaaacgctgcttttgaggaaagatggaacaagttgttggtcactggggggagtcccaccttgactgatgacatgcttgtgtcattgaagactgaatggcccagagttttggaaaacaaactgctataaactatcttgtgagagctatgggtccaggcagtgctctggagaaagtgaacatacaaataggctgttgggccctgtgtccactgcaggtttttcttggagcaggcctgcctgagggtgtgtggaagcctccatgaatgaggctggaagcctatgggtcaaagccctccaagaaaccagaaggagctttcagctgctctccaagaagcatttcttttaagcttaagcctccaacagtaccttgttcaagtttgcctcacctagtcagatgccatcgccagggccacagggtctttgaggcttggtagcagccaccagcaatggcaccattagaggatagcgtgcccagcaggcagcagcccctatagcacgagagcagataaggaagacagaggggaagggcctcaggcaggcgctccagagcagtgcttggaggcagtgcttgaagagacttctgggtacagtctggggacttgctttgatgggagtggattaatttccagcagtaaagccaggagggactttggccataatattttgggaataagaaggagacgcaccctgtttggctgtcacaggctggtgagtcctgggacatgtgggactcattgtgagaagtttcctttagtgctgtcacccctccaggaacaaggatgggtggcttataaaggcgagcaagaggcaagaaagctgtgcaaactggaaaagggcggcattctttcagacacaggctggatgattatattcctaactcatgccaatcctaactcacaaactgctgaagaaatgaaatctggttaaatgtgttcctttttgcccttcttaaaaatatcaaaagcaagtatttttcagacagctttataccggccacactggccaggccttgtgggctccaaaacaaacacacctgagctagacttggtcagcattgggaggccagagaggtggccaaggaattaataaaggaatctaaagatttttctctatccccaaaggctgccacttgagatagttcttgctttgggggagtcatgtgagtgtgtggcaaggagaggggaagagggttgtgggggagaagcttctgaatccattcagcttcatgcgacaggattttgactctggcctgtcactggaaacagatctgaccccttctccacggtgatatttgtaatcttttctctttgcagtcaagggtatcaatgaagagtgaatgtgtatgacatgcagtttttggtgagaagtttactgtgggccttaggatattttctgctggagacaatacacttgatgtaatgattttctgtaccacagaaatcacaggaatctgttttctaaggattgattacatgtcagctgactaacgtcaacagtcctttgtgggttggtattttaacaatgtggcagtgtttagaggaattggtggtttttacctggatcttaggaaatcaccaatgatgataatacaatgggtgaacaatgggtaagctaagatgttgcacgtacatgaagaagagataagtatctgaatggcaaataggtgcccctaattcctaatagtgtaacattatcaatgaggacagtgacttctaggaagttgttacagtggccggaggccagtagcctttctgcagttgctcaagtcactttggttgagaaagcctgcataatccagctcccattttcctctgtcttcttttcaccatctgagttatctcagaggtaacaccccataccccctatcttagtgtggtttctcctggaagcagaccctagtacaagtagtttatttgggaaatgatccctggaagcactggtaacagacaagggaagtgagacatggagggaaggcagccaatctagggggcaatggcaagccattttccactatgggcaattggagctcaatcccacttggagactctaggggcctgtagaggatacatgcctcagagctctcactcctgcagagggagggagctggggtacgtatacaccaactgccaacagtcattgattgagtcctcccggggcaggggattttaattccccagcaccagcctgccccacatatatctcttgagtaggtgaaaaatgctctcgggggagtgggtagtgctagcaggtgaagtcatgctagtgtgcacatgcctggcatgtggaagggatgcaggtggggctctgacaacatctaccctgttccttatttcttgtttttcattatccttgtctgaaaaatattactactgcctgtagttaatatagtctcttacaaacaaacctaattctttggcaacaaaactagcagagaaagaggcagaggaaatgaaacattctagctagtctattgcctgatttcttataggcctggctggtattttgggagtcaggtttgttttctggcctggcaaataggagtaactgtagcagcccttggttttctatggaccctattttaatagaatgcagactgcttagactttggctcacattctgcatgctgaggtgagctactctttcctcacttgctgcctcagtttccctttttgcagtgacacctcagataggaagctctgacatcagaagctcttcaattcagcttctacttggggcaatggaaaaggtacgatgtgttactgtgatggaaagcactgtcaaccaaccctggcagaggtgccaggggcatgagggactcaagccgtttcgaggactcatcctagaacaatgcaaacaattgtcctcaatcctgggtctatgggcctgtttactcactccgtgctgtgcccggcagaaacttgcagtgatttaggaagtcagggagagacatttctggctgtgcggaacctgatgaaatactgttttgtggagacagactaaaaaataaccaaacggtctttaagtggaacagagatcagaaaatctcctgaggcacatttaagaaacccatcaattttgctggcttggccatagaagggaaaattgcactgcaaatgattatctctgatgaaatgttcccaagtcttttacagggcacttatttgtagtgacctattactccaccaacgaggcctgactgagaagcccccactgggtggtttataaggggagtctgcagagtaattgcaggctcaatcctgagggcctcctgtgtcctatcttctcaaccaccttacaggtatcctgaggctggggactctcctatggatttgtgtgttttccacagggcctccaactttacagatgtacataaattactgaatgaataaacctgagaccaaggctttctgcccaaagtcctcatcgtagaagccctcaatttcctacttgccctgaccaaactgaggaaaagctgtggcaaaagctcctactgcgttcagcctgaaataattcaccacaacctgtatcatcaacccatacccaattacctaaagtgctctttctagagaaattaaaaaaaaaattctgttctccaacataagattcattttaaaatgacagctgaggtcatttcttttataaaagctgaggtgggttgtctgatattccctcctgtcttctttccttggtggattcatactgttttattttttatttattattaaatatggtaaaattgacttgggagcatgtgtgtgcatcatgggtttggacacacacatagatttgtgtagccaccttcaaaagcaggatccccaagagttctgtcacccctggactccctcacaaggccatgttggactcacacccttctcccacccctgccctgcattgtggaagttctcactttttcagaatgtcatatagctggaatcagatagtaggaggctttatgagactggcttctttcatccagcacaatgcctttgagagtcactcatgttgtcttatttaccagcagtctgctctttttattgctgagtaatgttctattgtatgcactctattgaagtctatcccctcactcactgaaggacatttgggttaccaccagtttttggcaattatgaagagaacccttacaaacatctgcatacaagtttgtgtgtgaacctaagttttcatttctctagggtaggtagttggcttgtatggtatgtctgttgaattttgtaagaaatggccaagttgttgtccaaggtgtctgccccattttgcatgctgactagcaacatacaagagttccagttgctccacatccttgctattacttggtattgtcagttaaaaaattaaaaacattttaagctattctaataaacaaatggtcatatctcatcattgtttagattcaaatttctctaatgctaatgagggggaacatttttgcatgcgttcatttgccatctgtacgtcctttttggtgaagtatctggtcaggccttttgcacccccaccatttttaaaataaatgaactgtttgttttctgagtgttgaattttgagagttaatatttatgtattttttatattctgtatagaagtcctttgtgagatatgatatctgaaaatattttctcccagtctgtcacttgtcttttcattctcttaacagtgaatttcacagaccaaaagtagttaattttgataaatctgatttattactttaattttattggttgtacttttggtatgatgtttaagaacatgttgcgaaaccccagacatgaagagtttctcatactcattcttctaaaattttatagttttacattttctacttagatctatgatctgttttgactcaatttttgtatatggtgtaagattacattgagattcttcttttttccttcagtacatggatatccaattgttttaatattgcttgttgaaaaaaaccctattctttcttcattgcctcggcagtgttgaaaatcaatgaaccttacaggtgtgggtctgtttttggactctgtatcctgttccattgatctacatatctattcttttgccagtgtcaacactgtcttaattacagcagcttacagtaagtcttaaaattgtgtggtgtgacttctccagctttattcttctcttataaaattattctagctattctaattctatggtctttccatacaaattttgcaattaccttcactatagctacacaaagttctgctgggattttgaatagaactgcattacatttaaaggtcagtttagggagaattgacatcgttcctatattgagtcttttaatccataaacatttttttgcctccatttatttatgtcttttttgattttttttattagagtttgttgggtttcaatgtagagatcttccatatgttttgatagttttatacctaaatatttctctctgtattttttggaattactataaattatatattagcatttaatatatatatgactataatatatttaaaagtataaaataatatttaattttggtaaacaattattactagaatgtaggaatataattgatttttatgtgtagaccttgtatcctacagtcttgctaaactcttttattgtttataggagcttttctgtaaattcttgaaattatctaagtagacaaatacatcatgtgtgaacagggacagctttacttcttcctttcacattctatgccttttatatatttttcttgcttacttgcagtgtctaggactttcagtactgtattaaacaggagtggtgagagtcaacaactttgtcttgctgccgatcttagagaaaagcattaagttattcaccattaattatgatgttagctgcaagttttaaatagatgtccttcatcaggttgagaaagttcctttgtattctagtttgctggagtttttattgtgatgaatgctaaattttatcaaatactttcctgtgccactttatacgatcatgaggtttttcttccttaatctattaacatggtggattatattgattgatttttgaatactgaaccagaattgtattcctgagataagcctcacttggtcatggtatattagtctttttatatattgttgtattcaatatgctagtatttgtgtatatttatgggggatttagtctatagttttcttgtgatgtctttgtctggtttgggatcaggataatactggcctaataaaatgaattgggaagtgttccctcttctgttttctggaagagattatataaaattggtgttatttctttttaaaatgtttggtagaatactacaatgaaactctctgggccttcattctttttgggagacttttaagtatgaattcaattcctttagtagatggtatgaaaccattcaggttatttatttcttcttgaatgagttttggtagtttgtgactttcaaggaatttgtctacttttatctaaattgtcacatttgtgtagactgtttataatattctcttatcctttcaatgtctgtaatgatatttcctctttcttatttatttttttttgatatagagtcttgctctgttgcccaggctggagtgcagtggtgcgatttcagctcactgcaacctccgcctgggttcaagtgattctcgtgcctcagcttcccgagtagctggggattacaggggtgtgctaccatattcagctaatttttgtatttttggtagagatggggtttcaccatgttgtccaggctggtctcaaagtgatccgcctgcctcagcctcccatagtgctgggattacaggcctgagccagcttgctaggctgatatcccctttttcgttcctggtattggttattttgtcttttctctttctttgtcaacctggctagatgtttatcaatgttattgatcttttcaaagaaccagtttcggtttcactgattttctttattgtgtttctcttttgtattttattgagttttgttcttatctttattatttccttccttccacttgctttggaattatttttgttctttttctagtttcttaagatggaagctaagcttgttgattagatcttttctctttgccactatatgtgttgaatgctataaatttccctctaaatactgtttcaactgcagcacacaaattttggtggattttatttttattttcctttagttcaaaatatttctagtttatcttgggactttctttttgagtcttaggtgatttggaaatgtgttgtttaacctgcaagtatttgttgtttttggagacaagttctcactctcttacccaggctggaatgcagtggcacaatcatagctcactgtagcctcaaactcctgggctcaagaaatcctcctgcctcagcctcctaagtagctgggactataggcatgtgccaccatgctcagctaattaaacttttttcttttttttggtagagatggggtctcactatgttgctcaggctggtcttgaactcctggcctcaagtgaccctcccaccttggcttccaaagcactaggattacaggcatgagccactgtgcccagcttcaagtaattttggatcatatccagaacatgttcagggtcttatttaaattctaaaaaagactcctgttttttttttgttgccgtttaagcagacaatcagcctgattaggttcaggtcacaaattccaataagccttctttgagctgtggttttttaatttttcctttttacaagattgcagtatttacttcaaaaaatacattgcttcataagcttcaaaaatagacctggctttgctttagattactgatgcaggcactttataaactttatatctttgatgtcccttgcctattaagatgccccttgatgtctttttgcctgttgagtttatttggtacattacccatttctgtagtcattccttaattatttgcttttgtcttccaacaaaaaggagggcccaaggatcctagtgtttgctaatgagttgctaggttctgctacattccagttatttattaggatgtcttctagacttcagcatcatctcaacatgtgttaatatgctgtttggcaaaacaactaaattttaaaaatattcatgcatcattggtaatgtcttcaataaggattaaattaataaaatcagtctttacctcattacgaaacatatattttcagcagtaaactcatcagacttgtggtctggtgcaagttttaaccatctgtatgcaggagtcatttattcatgtagtggttagtggttctgaaacaaatgatctgaaatcaccatctctagttttgatctggacatgtttttagtgacaatcagtgtagtgtgaccaaggttactttaaatatcttccttgggccagtgctatagtgaggtagagtcagtacctcccaatttaaagcaacttgaaaaacagaaaaaagcaactgtcctagggttcttccaaaaatcataagagaaaattaaaacaagtgacagactggaagaaaacatctgctacgtattctatagacaaaggcctaatatccagaggacacaaagagctcctacaactcagaaagagaaattcaactaaccaatgggcagagaatatgagatacatgaaaaagtattcaatttcaccagctcttagggaaatgcaaatgaaaacaataacgaaatgccatattttgctctccaaatggcaaaaactaaaatggctgatatgatcatgtacaagcaaggatgcagggaaatgagtactgtcacacactggaaggaatataaactaatgaagctctttgggaaggcaactggggagtagtcatgaaagttaaaaatacacgtatactgttgctccccctaattctacttctactcatctatcgcaaagaaacattcacatttgtacacaaaaatgcatgcactgtttgtaatagagaaaaactggaaaaaaaggtgaaatgtctgttacaagaaagtagttaatagtatttacatagtttatttcaccataaaaaatggtgagtttctcatttaacatactcactgttaaatgagaaaagcaagggggcagaatgatactttatggtcctatttatgcaacaaaacaagatatctttgtacataggtgcctctctctctctctctctctttctttctctccaaatgcacagaagaggatggaaggagatacatcaaattgttgaaagtggctactctcctctggggcaggggcatgattggtagtaggtgagagaaaatgtgtgggctgcttacattttgctatgtatattaatgtattgttcaaactatggcaaaatgtacccatgaatcacttatgcagttaaaaagagacaaaacccaccaccccaatgaatctatgactttctgaactccagattaagggagagaacctaggaaggaaggcctgtcctcccttgactaacttagtcctcttcccgttaacctctctgcctctttcctttattgtcagctccatcccttactagctccatcccttactagcaataaaggaatattgcgtatgaatatgagcaatattcataagtttcagtttcttcatctgtagtaggggtattataataataatagtgcctctatcaaagttagctattatgatgatgacggggactctacttctttgactcttgctggcctacggtctgtgcttagatacacagtcactggcagtgggcttctctgtttgccaccagtcctttcaggcaatcctatctctgtccaagcattgacacctgactttgggaagtccccatggcactcctagttgaagtccctggccacccttttggccttgttcaggtagctgccagggtcctgctgttactagttttgccaccgaaactgcctgggctgggcttttgttcatgagatgcctcatcagtgacatagcctagatgtgcttgggagcatctctgctttttcaatgttgcccagtggcagtcatctacctgccagaaggggagtgctgagtccctgaggatggacaagtgtctgcgtggtgtttcactatctcctctgaaggtctgtgctttaacaaacagcttgctgtagggctgcacatgcatacttttaggctggcttcaataagttctggtgcagactatgtgttagagagccagtctggtccacaggatcatgttaccacatgaagccagcaccaaactgaggccgtctccatgctgagtggaatggcggctgcgaggagggctattcccacccttgtgtgttctgcttttggaggctctcagtggatttcaacagggggactcatcagtgtttccagagtagttgacaagagacacagcaaaccttctgctatttgcaggtattccctgttcagcatcactgacaaaaccctcttccccacctctgtcccagctataaatgttcatccttctaatcaatacaagacaataaaacacacttttccttcttagaagtgaaacaacaaattaccaactatctgccctgggcaaatcagtcagtggagcacagttcctgctggtatatttaaagagagtctccttccttttagagagtgccgagagggcctcagcctggagggaccacacgcttaccaatatgcccctgtggctctgcatccaggagtcctggtttatatacagctgccacttttctgcagggttattctgatatctagataataatatctgctggcaaagttatttttgaaatacttgaatgaaaattatcatgtcaagaatgtacattactactacgatgagatttagaatgcatcagctgctttctgaaaatgtgaaatgactctcccataagggaaagaaatttcattttaaggcatttcattaaaatgaaataggtgttgagaaagttggttatttgaaagagattcaacttagagcctcagcttacataccatattctataataaatcctaaatgagttgagtgtgaaaaattgaacaatataaaaaacactataagtaaatttaggaaggtattaaacagatccctgacaatgaacaacctaccattattattattacattgactgtttctaaatatgaaagcaatggaggaactcataaaagaaaagatcaatggatttgactgtatgaaaaataataatgtactataaattataatgtaccttactaatcactattactactggtaaaacaaaggggcaatagtgagttgcttctttgagaacctggaaattaaggaattgatgtcacctaataagagctgaactagcaaaaaatcttcacacagctctccctgagataaaaccaagagcatatgcgatatcaattattgcacctgtcctacctataccctttttaaaagagagagcttcctcccctttgctgcctaggtgaccactttctgacatacaagacctcttttcctccttggtcatagtttcctggaccagaggtgggttcctgaccccaaagcagcacatgcttaagcctgccagcagctactgtcctaaaggcctagaaaacacaaattggtccagtcaaattctctttctcatacctttgagctaagaaataagcagataagtagctcattagccttggggactggatattaaaggatattttcaggtacagctgggaccagggaagaccaaagccatgaggaagtgggactatggtcagcagggccagccggttacaagagcagacaggcacagagggagcaagaggcgctgagggaggcctggaggcagaacgctgggctctaaggccaccctgggtcctcttggctctccaggtcctggttccagctcctattacagcttggaggggcctcagatcttatgatcgtatcttaatgggattcttgtcatcaccacacatgtatcctaaccctgagctagctcatcaggtttatgtttctaaaatcaaaagagccaaactagaagtgattgtttctgtgaccccaaatcctatgaaaagtgacttgcggttcatcctggagaggtaggagtgggataaaattatggtttagtaagaagaagcctcacaaatggtgctttactgtgtctggtgaaagaggtattgtgtgcagaaggaggctggtcagcctggagaacagatgagtcaggttggcaatggtgagtgagcactgtccagagaaggcagggattggaccaaggcctatcattgttgcaggaatgttcactgctgtgagcaatggaagccttgtgaggcttaattgtgaccatgggaacctatctctccaaactctttacttctcttagttttgattccctttgtgcttggagaggctcacttatcagcctttcaacaactaatctagcttgtttcctgggaggatgtgccatggatagaggtggtttaagagttcctggctataaaagaacatccaccatggtaaataaataagttgtccccctgatttgcagtccatttgacgggcatgggtcagcattcctctgttctcctagccaggtcgtggaccttggttcactcactaaggcaagactactctgtcaggactcttggaaggtagccatccatcttttcttggtggcattccaaccaaatcattgcttccttctctatatatgataattattagtgttcaatcttgctagtgaaggtacactacagccctccaacttgcttcaaatcattttttttgtttgatctccaaactatgacagcaaaacattaaatttcatgaagatatcagtcatactggttatgggttgttactcagataacttcatgtcttggaatattctgcaatttcagtgatacctgaactgttacagagagaccttaataagtcatctttgctcttttcgtctctagatacctgagtcatctcagaaagatgcttttgtgtcttgcttttcaagagtcccgtgatctctatcatttaataaccttcttgtcaaaatgttctttcacgtgatcaaatacattttcaatacaattgcaaattatttcttcctttttggagtctctttaaagctgaattataatttattggtccttctgtatatcatcaagtaatacacagtcggttctcttacaaccatgtttctttaacaggaattatctcatatgcaattggttaacagggaactgatgtcagtgtaatacatagtcttatttgttcacataggattttctcctcgtatgttaaaattttgcaccaccaagtaaaaacaactgaatacaaagtaagttggcacagctgagcccaggaagctgtggagaaatgcaggactgaactgcagcccccttgcctccatgttcctttttgtggtccagcgtggctgggtgctgtctcttagggggggcttatcgtgctgctgtcccccatctctgcacatgatgctcatgtctccatctctcagcagcctcaacccttccttaaatcctcttctatcatgataaccttattttggaaaaaaaaaatctgatgttttaataatagattgtgttgccttatgtattaggaatttagcatgccatttttatcattatttttaatagggttgtaattggttttgttagagttaaagcagtgtgggttctgagtggtctccctcagtcttaattttcctataatccccgagttttcagtgtgccattttgtatttgttccattatagcacctatacttaaatccaatctttaagctccccattcacagctttcttttttccaggataaagaagtctaactgttgtcttttctcataagaactacctcccattgctttacagatgtctcctatttcaggccatagataaatttctgtaaggtctgtagtaaacataatttttgtgtgcttagcatttcttcctttggagaaagatacctgctctattccttaaaaattttgttcagtttatgtggtgcagatgggctaagcacctgcctgaggagtggggacatgatctaggcctagtcagtcagagtgttttattcccctggctatagggattggttcagagatgggtacctgacttaagccaggtcgatcattcgtccctccaatgacttttgccagtgttgttgggcaaggtccctttcaacgaaggtacgaattctaaagaccacgtaaacttggagttgccaggggcatcttgccactaactggggagaggctgtcagacaatgtagtcaagcagaactgagacaaggagggagaggagaggagaggagagagagatgcatttgaagctagttgtactccttagattccccacttacctgagacaacacatttccttctattcttacagtcaaacattgtaaccaatgcaagttgggtacaaaaaattaattgaagtttttgataagcgtaattttaaaaatcagacaatactctagtgcactagcagagtgtgttattgaaaataaatgtggtgaatcatttaataaatcaaaaattactttgtaacttttaaatcatctctttacctgcttttctctgaaccatttctattcttgtagggatctggaattactgaggaaatgcagtataatgttgacatggaaatgctgggtagagggaagggatgacatcttggcttttatatttcttacttttgagaatataatatttttttttactttatggtaacacattttgattttctggtccccgatgactcctctgcctgcccttaatcaggctttctcgagtccttatttgtgctggttttggtacataagcataaatatttcattacacctattcctactaaaccacatctacgtttatgctttgaattcttttgtattttttgaagcatcagtaaacccactcagttggaattgtatacagcctgagaatacaacccttcaactctattctccaaaccactgaaaatgatagttgaaacacatgtgggacactgaatcctaccacggctgctgcaaacccatgggggacctttgtgcaaactagaaaaaggtgtgccttcctatgggcagatgtaacgctgagtggcgcacatgggatggagagcaagggcaggctggacttcagccccactcactgccacaactgggccccaaagtgccaaagatgacctgtcattaatcacgctacaaagagacttttaattttcgtgggctatgctcaaagctcctgagctagggtctagtttgagccttttgttaggcatatcgtgtaggataaaggccaaagaatcagggaaactgaataacaactgagagaaatttaaactcagaagacaatgtcaaagtcaggtaaatgtgaatttatggagatcatatatagtgttaaaaagttctggagttggacagaaattctagtctggccacttacaaaggccatttcactgcaactcattgaaaaaaaaaaatctggccaggtgtggtggctcatgcctgtaatcccaacactttgggaggctgaagcaggtggatcacaaggtcaggagttcaagatcagcctggccaagatggtgaaaccctgtctctactaaaaatacaaaaaattagccaggtgtggtggtgggcgcctataatcccagctactcaggaggctgaggcagagaattgcttgaacccgggaggcagaagttgcagtgacccgagattgcgctattgcactccagcctggatgacagagtgaaactctgtctcaaaacaaacaaacaaagaaacaaaacctataaaacagtgaaaataccatatttcatagaatctaagacaatgtcaactagaagaccaatcgccaatacagagatttttaaaatgtaaaaaaaaaaaaaaaaaaaaaaaaggccaaatgggacggttaaatacatcccgacaacacagatgttaagagtgtaaaaactgtgtccttagaatctgtgacatatatggtaaaacccaccttacaggtgtgtctcctccctgtgaggattaaatgagataacataggtcaagttctcaggccagcctggagtaagtgctcaataaatgctgaaggctgctgttactgctggtgttgtccttgtaatttggagctggcaacaaatagtaacaaaaggatatacttgatccgggtcatcataatctagcaaaacagcctggatgttgtcttttccttactccaggataagttacaagaagcagacatgcaggaggtaggtccaaaagtaaacctccaatgacgcttaagtacagaacatgcacagaactgacaaatagcaaaaacagtctggtttattctgccgacagagacccagatctgagaaatgattttcccaaatcccagatgtacaagagaaacattttttaaaagggcattggtcaaatggtgggttggggggttctttgaatttggagtagggggaaaaaaacttccagaatattttgctagcttttctagtgtttgtttttctctttctttgcctctcactaacagcttcttctattacattccccgtgatttttgaattgattgctgagtgcctcactagtgaaaacccactgtgcagcctcctgtgatgtgagttttcatttaggcctggaggggtctgtggagggatgaagaggtgccaagaggtgtcagtcaagctcttttacctgcctgcaaggcagctgtttcaggactagtctggagtgggccttaagccagtgaacagccattcattgtcctttgttgccaaagacaatgctgccagtggtaaaacagtgatgatgtaaaaaaactaatgcctggattctagtaagcaaaaccatgcctggcttatgccactgcctctaaagcagtctacttcttttcccagtttgggctcagtggcgtttttggagacatgacagatggaagcagggtgtaaatgaacatgtgcgaaaccccagcccatgtgaagaaaagcagccgaatgatcttgtatatggaacaggtagatacaataaaaatggctctccgacagaaacacagactcttattatttttcagggagattttaaattggttactcctcccatttcttatttcaacttatttcaacatcaggattgatgtaaatggcgtctagagaaagacaaaaaggagtttgtggcaagagtttatctacctagttgggttggcttcttttaagagaaggaaattatatggaagttcagactgattatgccatataaaaattagatattatacagccactactaaattgatagcctttagggagttttgagaaggaaggcagctcaagaggcagctgtggatcacaatgtcagagaaaaaacaaactacccgaggagacagtggcaacctgaactttaaacatgtgggctgactggtttgcagttcacaaatacagcttttgtttcttctctgcaggccaattacgtgtgtacccctcggcatctcaatcttgcctcagggtccagaggcaggatgtagcccagtttgggagtggagctgaggcaccatcccgtgcagacagggcaaattcatgtcatgctcctgcctcctgcctcctagattcactgaaggactccttggggactgcaaattccatttgatttcatttctccctaagaaaaatgcactcactcatatcctaaatttccagaaacttgtgtccttcaaggttgccttggaaattttaaatgtgtgtgcaagttccaccttcctcctccttagtcctaacctggtgtctgagatgtcgtgatggcaggctactccctgaggtcaagcaccgtgagggggtattcagtaatacggctgagtctcaatgacccactcacctgggccccttggattagagcacaatttgaaagatgggtggccaggaatgggtctcactgtggtatttgcataaagtgaagtgaagactggcattggctttataggcatcactgaattaactatgttcttggcagcaatggaagcttgaatctcaatattggtgtgaactatgcttgttattttctggataaaacaaatgtttacttgtccagatcttctcctagcatatctgggccctttgaacatgaattataagcagacatcttctctgggcagatcaaatgacagccctcagttggttggcccttggctcttgggcaggaaacacctgtgcagattttaaggcagcccccaacctgcctaatcttcagaatgtggcaaacttgctccaccaacatacacgattgcaccacagttatggggaatttgtagttatttccattgtactcagagtgaaaaaactaagtatattagtatagtcaattggtgccttccatcattagtctatttcattaatgttggaacggttttattttggtttacagagtaagatattttttaagagcaaaagtttatattatttcttagggagaaacagtttataaaaggtcttctctcttatccctccaaggatgaaaacagaccactgggtcccttgaggtaagaggatgctgacaaattggccctggctccactgaagtcagcttcctctttccctccttctccccttcaagccaagtagactatcactgcccactgtctgggactgggatgccccccagcagagtgtctgccttcccacctgaaggagatcagcctaggatcaatttccttattggtgtgggtgactgggccctctgagaatcagatgagctatggatggacataatcttcagaaaaatacaaacattcctaactcccagtttttctcatgcagttttaggatgttcaggaatccaggtcaagaaaggggtttgaaatctttttttgtgccagcgatcttctggcagtctgatgaccttacggaccccttctcaggataataatttggtgcataaattaaaatacgcaggcttttaagataaaccaattatattgaaatagttatcaaaattgtaaaaccttttgtgatacagaaatatctatgtacttttatataaatgtattaaataaaaagatctaatggtgagtctaataaccactgtaattttgtactgatagcacaaaagatattttacaacgtctgcccctctgtgatatgacatgcaggcctctgtgacttccactgggttcatcattgaggtggtgctaagtttcagttagaggttagtagaaatacaggggcatttctctcctatcaagatcctggaccttaggtcaagaactcctgagacacaaggattctgagtgtggctgttggctgtgtctctgggtctggctgcctcagccccttctgtctcaggccacagaggggactgtggggctcctgtttaccgaccgagacaaactgaggctatcgtgatttttatattctgttagaaaaattaaagggggcactcacagtggcttctgtcctgtcctcacttgtaggcggagaaaagggggtagtaagagagacccagcgggccagctgtgagccagtaactgctgccttctccagcacagaggtgaggcacagggatcgcctctgtgaagctgccctgggcctgggagatgggtctctgtggtatcttttagtttgggatgaaaaaaacattgtcctcttacttttaaaaggatttgaggctgggtgtggtggctcaccacctgtagtcccagcactttgggaggccgaggtgggtggatcacttgaggtcaggagttcgagaccagcctagccaacgtggtgaaaccccatctctactaaaatcacaaaaattagctgggtgtgatggcatgcacccatagtcccagtcacatgggaagctgaggcaggagaatcacttgaacctgggaggtggaggttgcagtgagctgagatcacgccactgcactccagcctgggcaacagagtgagactctgtctcaaaaaaaaaaaaaaaaaaaaaagagaattcgaggcacattttactgagttgcctcttgccttaacttcacctttgcaggggtactcacctaagtggggagccctccgtggcagcctccaccttgggaaggcacgatggcttgtttttgcttcttatccttccaccagcttattgactgatgctaaaatatcatacctgtgccaaatatgctaagcagaagctttgggaggtgtaagagtgtttccccatacttgaaatacgaaatgacgtctcactgtaaccgtgaagttatgattagctgagctactgctgaaaaacaccagggaaaagcacaactctctgattgggatgctggagctcaggtctgcctgaggatgaaaagttcaagttctagacaaaagaaagtgcttttcctgctgggtggtgggagggatcacacacttcctagggaaggctctcaaagcagcttccttggcaggggctctcctgaaactggccatttggggcttcatggccatttggaggcacatcatgacctgattttcaccaggaaaatggtttctgaaagaggctcacagaatatcatctgcttaccaattttacttcttgcttcatttatactttctcccagggccttggcttcagaaaatctggaggggaaaaaaatgaaaattgtagtttttctgttcatcctacaagatgttttaaaaataatagatttcttagaggtcactaaaatatgatgaaactttattgaaagacacaaaagaaaaatctaaataagtaaaatatattaggcttaaaaatagagagaaaattggtattaattataggtattgttaatttttactctatccagcacagaatttgtattctcatagtctctcatttatgacttttaatttatattatttcatgatgcaaagatatcagaataaagcctggctgtaaggtttctgtgctgtgttctattgattatgataccaagatcttataaccaaagaatatatacttacataacttttttctgattataaaataatatatcagaggttgtaaaactatggctggttatgagacaaatctggcctgctgcctgtttctgtaaataaagttgccctggaacaccgccactcctattcactgacgcattttctgtggctgctttcacgctacaagacagagtcgactagatgtgacagagactgcgtggcctacagggctgaaaatattttctacctcaccctttatagaagaagtttgctgattcctgttatataccgttattaagccagattttgaaaatacaaaaacaagaaaaaaattctcaagtactcctctacccagaaataagcacattggatacacgtatccaccccgtcttttatagagccagtttttatagggttgggatcataatacagatatgattttgtgccccgatgtttttttttcacttagcattgtaacataagtccttccctgtattatgagatgcatacctttgatggcttcatgctagtctactagattgctgtgctaatgtttagtgagtgattcctttatgtttctggcctatgtttgagacacccacgatgagccaactttgcgctagagaagcagacaggacatggcctatgtgagaacatgtagttcagtccctatacatagtgggccctcatgaaatgttagttgctttccctcctctcctttctgccatgaagttaaagagacaattgaaagcctatgaaagcaagcacctaatagatagctgaattaaatggctgtaccttggcggggctagtcatgccattagcgtttgactagggagtggcctgtccacgagtgagcggagagctgtcaggaaagcttcatgtacaaggtgggagtgacctgggttttgtggatccacaggagtttttagaaaatgttttattatgaaaatttccaaatatacacaggatagtagaatgaaccctaacatacccagtatcacattttattaattgtccagttttatttcaactatttcccctcctcctccgcactcttctcttctcacttccccatctctaatatcccggcaaatcccagatatcctattgtttcatccttgaacactttagttgactgggattgtgttggaggaagtgagcagaggagggcattccaggcaggggaacaacaaaagcaaaggccagagtgccacgactgctctgtgttggatggaaaagaagtgtgaattatgtcattgctattttccaaatctgtctgcttggcctgggactgtggacaggaggtttccagggaaggggactaaagtttttctcaatgttagtttcttgggactccgcccctggctcccttattaaggctgttcaggctcatcgtagattatgtatgttctctcctcagcgacggcctgtcaccttccagggagaagtacagttccacttgatgcaattcagacatttacatgatgcacaggtcactgtgctgggctctgtgggctcatatggcctctgctgctgggcaggcataaggcgacatttgctgcaggccatttggaagatgaggaccatcttcaactctccattctgccaagggagggcctatgatcatttcatcactgctctgtccatccctagtacctaggattcataggatctgacagtcacacgttgctcaacgagtgactcctcccatttcctgttccataggcttctggaagctttagactcttcggaataaggaaaatacaagagcaagggtgcaaaactgctgaaattcacactgaaattcacatcaatgctggaggaaaccagagtacagatagaaaaggaagacaacataagcagaagaaggactttccaccgcagtgctgcccagagaatccctgacaagcctgggatggagtcccccagccttggcggtgcccagatgtgtctggggggcctggcagagggagccgctgagtgctgtggtcaactctctccaaagagccgccctgctccagagctggcagaaactgtgtggaaagccacgagctgttcctgtttctctgttgcagcccagtcctgagctaaaaagggctttcccactggagaggtgtggtctgagggctgtgcagtcttcatgagaccattttcccgtcactctggaagttgtcaccactccaggccaccccacccacatgtgttcctgatccctggttgtcaagacgaactctgaaaggcccaaccctgagtgtgtagagggaaagagcaagtgtcaaaggagatgggagagatgagaaggctaaggactcggttaggaaagatgcgagaaagagggtgaccccatcagtgctgccacgttcttcctggcccacctgcatctccacgcctctccagccagccccagtctccctccctcctcacttactccctttcctcctgcccctccgtctgaattctgctcacctaaacttcaccagggggagtttcctgcctcctgattatctaaaaggcgcatcctcatccatgagatggctcagggagccaacttttggccaagggtatgctgcacccctgtacgatatcctaaggtgctgctcactgctatgctgatgaggctgcaccttgaggaggggcaggaaggttgtgtaactcagccaggaccactgatgagcgcccgagggtttctttctattggtgccaaagcattcctattagggcgtcgttagttgtgtggctggctttggggagtgtaagatagctgggtgcagttccagtgtggatgcaggcaggctgccatgtcacctgcacacaaaatcctgtgcaggggcaggggctgggcttggaagggagaaggaatgcgatgctctgctgttcttctactagcctggcttcccgtaacacccagccctcctcaactatggctcccactgtgtgccagacaggtacttgcagaccctggggaaatgctctgttattggcttccaagggccccggctcttctgtctttttccccctctctctggcacctccttctcagtctcctttgctgatgtgttctgcagcctgttccttgaatgttgataatccacaggattttgtcctaggcccactcctcattttccctactccctgtaggcattccctttatgccagcatctccttggctatctcaactgtcatctctcaaatctccacctcagccctgctttagttcctgactcaggtatccaacagcctgtttgataccttgaagataactaaaatcgactgtacccaaaaagaactaatcatctgccctgaacacctcccctgtttttcctgttgttcctgtctcaatgcacagcaccatcacttacggatggctcatgtcagtaacctgcacgccaccctttgcccctctctccattagcgccttccctcaatcctggagtctcagccattctctatcctcaatatctatcagagcattccacttagctccaactgcctgagagcagaacgctgccatctctcccagattattgcaaccactgcttgctccttcccctgcaatcgcactgcctgtccgcaggctagtccccacattttagcctgagtgattcttcttaatgcaaacctggtcctgttactcccctgctcaaaactcctcaagtgctccccagtgacctcgggagaaagtccggattccctaacagggcgaagtagactcttcacgctctggctcctgctgccttctccagcttcttctcttccatcccccacaacattcccaggcaggcttgaatcttagtttcgtcaagtgtcacactgtctctcatcttggggacgtcccctttacttggagcctgtcttttcctctgactaatttctgcctaaccccttagtttccacagtgatgtctcctcctctggatagcattccaggactgtgcaggtctacaatacatgacacccccaggtgctccccagcaccctgcacttctgccatcataagcagatggcatactatatgtgaattgcctgtttacttgtttgtttccctttcaatatggtaagctccatgaggacagcaaccacatctgcttaattcactcttttctctggggcttagaacaggggcttgcacctagtaagcattccataaatatttgtagaataaaagaagataagcacgtgagcaagtgtgtgtgccaaggcaacgtgcacaagtgaggagcgctagactggaagtcagagtaggaccaaatgcctacctcacctcttagcgactgggtctcaggctcttcatttctaggattagaatgagatgccgtcagggctgggttgatgtggaaagagcatgcatgcaaatatgttttgtgtgtcataaattcattatgaccatggcctggcagtgtaggaaccccccgtagggaatgtgatggactgtgaagtgggaatgtgtgttggaagcagtaaccacagacaatagtttgtctcagcaaaccaaagtattagaaaggatctctgcaagtcaatggtcaaggacactcaagatggttgctgagtttctcattttcaatggaaatgaaaaggatggaggaattgagggtgaatctgacgttaacttccaagatcagttccagaaagaatcccatcctgctgtggggtgtgtcaggcggagatactcatcatgactggggaagcagctggctctgccccacacaccattcactagggatcatgggcagtggctgcttttacccatgggccaaagagaggggctggtgttcgttcagcagccactcagtccccaagagcctctgcaaccagatgctctgtcatgccagctgagattgccttctgagaatggtgggccaatatgtgtttgagggcaaagggttcctacaatatctttcctacttttcttgtctagaacaactaacttaatatgttgctttttcatagagtgaacatccaatacccttccctgtcagagaggaggacagaagactgggcctatattttgccatttttttcctccataaacttgtaccttgtaccctggctgcctccactttattgtaataaagatccaccctttgttccccttatgctttttaaaaaatgctagtattcctttcccgtttcatctctcccactatggcctccctctcccgcctccagttgatcagctcctcccctgaccctccagaagcctgctgcatcctcctacttctcggaagctgtaaagtcttctccagccattttcttggctgccaagatttctcaaagtcaatttcaaattgtcattcacaaacaaaaaaagtgttttttgagtacctttttttttttttcctgtggccagcactgcttttaaaattgtggagaggctgagaagattctaatctaatctctgctctcagagtttatcattttagttcagcagaaaagatgtaaatacaaaaaaaaaaaaaaaaggaaaaatcataagggttaaaatgaaagtctaatgggagccaggaaactcctcctcaccatgggagttacctcctgatggtgccacacggtttctctccaccctcggtccggttttcctgttggttttagatggctgtttgattctatgttagaaggatccaactgagtgaaggggtgctttgctttgtttagtttacattttcaacaccttcatttccaatagcagttaatctccccatttatttcttcttttgttattgaatgggactctgagactgatggactcagtttgtatgaaaaatctgccacaaaagaaagcttgcagtgcctgggcactggtatttgccaagcatggggtttccagcctctcttcatattattgtatactatagggatgagtcatgcctggaaaatgtgattgtgaattgcaattgttctctgctgaaaaatctggcttaagaattggctcacatgctctagttcaccaaagggcgaacatcctattcatgtgccaacatcttatttctcttgtcacatacaggcagcacaacttcctcagactggagaccagagcttagagatgctagaaattccccgtgagagcagcaaagggtgcaggaaaaaggggaagaaaaacctttctattaagtaacatggggctgagtgcattggcttacacctgtaatcccagtactttggaaggcccagggaggggggaggatcatttgagcccaggagttctagaccacctttggcaacacagagggacctcatctctacaaaaggtaaaattagtcaggcgtgatggcatgcatctgtagtcccagctactcggtaggctgaggcaggaggatcacttgaatctgggaggttgaggctgcagtaagccatgatcacaccactgcactccagcctaggcgacagagtgagactctgtctcttcaaaaaaaaagtaacatggaatgaaggggatgggggaaccactcactgtcccctcctgcaactctaaatcaattcttatactctgggtcagggctgagagagtcagaagagattgtgggtcaccaataatccctacatttgtgcttagaacctacttgctatggggtagagaggctgaactcattcaaggcttttgcatgggggcaattagttccagcccctatttagtggcactttgccaacataatgtcccaacaccagcatggtcagaccacagaattagtctgatgtgagaagtctggggtgaaatgggagtccaggctggtgggtcctggttgctgaggtctattgggaagctgaggcttagagatgaggcaggaagccatcgctgaatttcaccctaagtcaaccccctccagtctgtgtctgtattcccagaactgcccatcttcccacagttgggccacatgagtccttcctgtcactagagggaatggaagcaaatgtgtggaaggggcccgggttactggaagggcatttcctaaagtaagggtggcatggaagtgaccctatgagcatctgtgaagccttcctttgatgtctgttgttgaaaccctgcttatgcagttatttgttttcatacaagaacatttttcttattccccttccttaagcagttatgaacatgtaatatctaataattcaatactctccatcaatgcaaataagagctccaatcctaagaaaggggtaggttctgggttacatcccctataccaaatagtcctttaatggttagtattacaggaacattagtcagatatagaaatttttaaaaaaatatgggctggtctcctgacttttcatttgatttaaaaagactgatttactgctgggaaaacctcttttcagaggaaaggttgtgtgagttttagttcccttgcactatggccacaaggaagatgggatcattggtattgccagcccatcctgcataacttaggtatgtttaaactcaaaagcacatttgtcacatgggttgtcagaactctactgtacagagttaagtgagctctatattagaaggctttggaagaccacaacatcctcatcccactcagccccgacccaaatccctgctgaaaatagacctaaactcaggttacaaaccagaaccagaaacaatgccaactttataataagaaagatgaagtactatgttctccctaagttagtggttctttgatttgagcatgtgtaagaatcacttggtaatttttttctaacctgtagtgtttgggggatcttaccttagggattctggatctcatggtttctggacactgtctaagccagtggttttcaaacctacatgctactggaatctgctttttaaaaagagatgctcaggttgcacctaatttaattagaatatctggggagtcagggccaggctttggtagcttttaaaagctctgttggttgttttaatatgaagccagttacgagtccctggtgtaagctaagaagcctctcgtatagacatggctgaaggttctttggaagtcttttggatgagacagctagcttaacatgcttatcttcagacagacaaggtatcctgccccaacacgtccaactagccatattaaaaattcatgtcttacaacatggataagcattagaaggcttgtgaaacccttggatttacaggctaaaatttgtgcagatgtgcatatgtccccctttctagggagagagtattcagcttcactggattcactttattttcttccctatccccttgttttattcgtttattcattcattcctttttatccccatgccctgctcccattcttgtgggtaaagtatgctaaagtatatctgggactcataaagtataccagggactcataaagtataccttttttgctaaagcatatctttgtttgcatgtttttctttgctttctgtggatctatttgtaatttatctgaatgatgtgatcttactcagtgctatgcttttaaggtctatgttaattggtatgcatacatctaatccatgactcccacctgctgcgtcctgcttcatggggcatcggcattattctacctgtctacttccccagtgatggatactcagcatgtttccaactctccttggccatgaatagccaaggctgctcacagcagcctggagtatgtccccttataaacatgcacgagaacttcttgggaaatagacccagaagaggaactgctgggtcacagcaggaagcaagtagttcttttgactaggaagggctggactgccgtccatatacagagccatgtactcccactcccttcactggattcctgaatgagctgagatctgccttctggtaaagtgtaaaagccaggatgatagtctaggctgggccttcgaccctcattgcggtttgcttttccgtttgcctttctttttccttcttccgggtctaccttctttcccattccctgtggctgctgtattaaaccttcatcaccaccctcaagtctcttattctacctcaacttctttttcacagagaaaacttaggtcatctttaattttctctctcttcttctcagtgtgccaatgtcagccccatcttgatttgtttttccattcttgctcccttccagggctaacctccactgagcttttattccctaccttcctgtcttccaggagccttgctgtgtcagcttttcctgttgtttctctacctttctcttaccattagcttattctgtggcctataatattagccaattctttcccatcctgaaaccaacttcccttttacttaagctacctctctttgttctttctaaaaatgtttttaggccaggcgcagtggctcatgcctgtaatcccagcactttgggaggccaaggtgggcggaacacgaggtcagcagatgagaccatcgtggctaacacagtgaaaccccgtctctactaaaaatacaaaaaattagccaggtgtggtggcgggtgcctgtagtcccagctacttgggaggctgaggcaggagaatcgcttgaacccgggaggtggaggttgcagtgagccaagatcacaccactgcactccaggctgggcaacagagtgagactctgtctcaaaaaaaaaaaatgattttcatctatcaccaactttttgaaggcaatgacatttcttctcactcgctcctccatgcccggcagtccagccaatggccttctagttgcaaaatctctgtacacttcccagttccctcctgcttatttctctgtcgcatctgacactactgacagtctgcttcttcttggagccggctctcctcttgacttggctatcaggacattattttctcctggttcgccccctcttctttatgcttcttctcagtctccattatggcctcctttctctctaccttcccttcaaactcctttcccttatggctcccctctttaggcctcagcactgccacatgttctcctgagagctcatctacttcttaggcttcctgagttgtcatatgattctcaaactcagatctcattttaattcaacaaatagttcttgaaaacttactgtgtgctaggatccacagtctcatgtgacatatgagagttcaccctttcttctgagctctagacccctacatctgatagagtttgtttgctacagtttgaggatatgcatatacctcacagactagctaaaagaaattatatacctctaagtaagcttcttttgaaggggtccagagcacagccccatctgacaacatgtcagcagataatcctgcctgctctaattttggcctggagaagacaccaaaggcttctgggtcacaagatgtgcacatattttctttgactaagacaggactgctctccagaacagctggagtgcctgcagttctaagaatataatttggtccatagactttttcccccctcctttgcaacagtaagacatggatagagtacaggctgatgagaatgaatgtatgatgtgagaattgtaaatcacgttgatactgtcagtaacagaccctgccctaaagttgcttaccccagtagtactgggatggtgaggctcacacatgaaggagaattgtaccaggctggacataattaaatgtgaaactgaataaacattatgcttttcttgtaatagttatgttgggcagattaggaaggacagagtaagcaaatctcttctaggctggcctggctgagcctcggaggaccagctgctctctgagacagccttacctctgtttcagaatctgtttgttgtcatcgatggtaacgctgtcagcgtggtccctcttgaagatttcaaaagcctcctggcatcctaatgacatttcctctctcattcctgtttggagacacagggaaatggcctcagtcacagcatcaggatcctattaatttcattgtcacttcagtcagaccacaaaaccagccctggctccaagaggcccacagcagagagactctgaccagacaggtggccccaggctcttccagctggctgacaacctgctgaggaggcccttccagtgccacccgctgcacccctcaggactgtgcctgcacagccatgtgactcgtggggggcggggtttggaatgcctgctcgggggaaatgaaaaccacagcgccaagccctggactgccgaggatgtctgcaaatgccttttcttaccatcgttcagtgccacatttctccctggtatgccctattttgtttttctgttaaatttccaggcatttagttaaaggaattataatccaaactgaaagatagcatctagaaaattctgctcttagtctctgtataacaattcattcttgtttcctgtggttagtgagggggtctcggctcttcttcaggagttaggtcctcagttacaagactcatgagctggccatggcaggggtccctaggtcatctctaacttcaatatcctgtatcgcctttgccaataaaggccaaccctcactgctgggcgctgttcagagttcaacttctgggacccacggtcagtacagccaggaccaggctctcctcctcaccacctcccggagtgagggtcagcgcagatgtatgcctgggacccctcagtgagagctgaattcaccgctggattttggatgcatctatagagccatttttttttttttaatgcttctgcccttggttcctttgcctgggaggccttttctcatgttttcctccagtaactctacctccgtggagctttcgtcaaagcccaggcagaacaaaccctcttttcaccatgttccttatcaatacacctataatatgcacagcccagtggacactgccacttcacatggcaatcctttctggtgaaatgtaagtttctcagggggtagagataatagttttttgtttgtttgttttgtgaatccttgtgtcttgttcaaagtctggcatttagaaggtgctcagcatacatctgttaaatgaatcaggttgagaatgaagctgggtggtgctgagccttgctgttattgctgcgggaacacagtccagggttagtgaggctcactctgaggccaagggttccgcagaggctttcatatgggccacataccacgtctcctcttgcctggaaaaaactctctgagtcccatcacccatcctaagggtgagtaactggactagcccatctgacaccaatttaatgattactcttgataaaaatagcaccgtgaagaatgtctaaatggtgaggcacaaaaatacaccccacccttttctgatcagaagcaaatgggcacgactcagctttgtctccacatctgccttgcacactctagaattgggtaggcctgggaatccgcttgtgtgagacgcagaaagatgatccctgatgcatgagagacattgaggggcacgtttcaccagcagagcccattaggagccagcggattcattccatacctttcccctgtccgggtctgcacccagttctaacagtgcatgccttttgctacataataaaataataacagacagtagagggcatgagactttggactggagatgggaagagaaaagctccacagagaccacactggagcctgcttgggggatctccaaattgctcccccccgcaggggagctgatgagcagccttccaccaacagaggtgtgggggtggtgggtgaaaggggtgtggggtgggagtgaaagcttgcttaagctgcagggaagaagggttcacagcctcttccctcccaggctctgctttttctgcagagctgactgtgaatggacagctgggtggaaaggaccactccagagcccacggcactgtggcggcagccactcctgggagaacttacaatgcactgagcaaccattgggactaactatattcccaacaacgaacaacacaaaagtaagtgacaatatgaaaacacgaaacaacatgaaacacaccttccctgaggtgcactggggcctgggccgtgggagcagaaaggacgtggagggcacagaggagacaagcgcaggcagtttgggatcgttgtgtacggtcttgaaggtcctactaagaaattcggggccagcagcataacatattctacatgcatcgccaactttcaaagacttacaatggaataaagtacacattatgggaaagttacactggaaggatttaatactcttggtggcttaaaaggcacttaggggtcctgaagtgccaagggcttatcatcaggaacataaccttggttttccttctgtcacggacaaagtattctggagttggagttctttgattgtggtgaccacaggtgaaggccatcagaatgatggctattatcttgtcagctgttttcccaaatgtccactcagggaggccaaggtgaggtggctgaagcatagctggaaggcaaagaggcaaggcaaggccaggatgcctgcagagacttcaaggccaccacttggggcaaggctgaggtccacagagggaggcacatgggaaggactcacgggcagctccagtgtgtgagcccaggtcccagcctggccctacccttgcccatccccattctgcttgttcagagctcatgcgcagctcctttggattgcactaatataccacttctcaccccattttgggatcagctgcaaagttaatgaacggcttttatttactgaagaaatcacttccttgtccctctgaggatttagaaaacaggctctttctcctatggcagttcccgtccctgagcatgcactgtatgcatttgaaagagaaagagcaaaggagcaaaaagagtgattaaaagctcaccttgctaatgagacaatcgtctatttattctctcaagaagtatttatttatattaggcattgtgctaggcatgtgacagagatgtaaagttgaacattaaagctttgattcttgatttaaagaatttggagtccagtaagggagaaagaaaaatgaaaaatggcagggcgcaatggctcacgactgtaatcctagcactttgggaggctgaggtgggtggatcacctgagctcaagagttcaggttcagtctgggcaacatggtgaaacccatttctactaaaatacaaaaaaaaaaaaaattagctgggcatggcagcacgcacctgtaatcccagctacttgggaggctgaggcaggagaatcacttgaacccaggaggcagaggttgcagtgagccgagatagcaccattgcacttcagcctgggtgacaaggtgcgactccatctcaaaacaaaacaaaacaaaaaaacaaaacaaaacaaaacaaaaacaagaaaagtgaacaaatatttacaatggaggttgctgcttgctgtagagaggtatgtgtccagcatgcgggagagggagggagggaggcagggactctcagcgagagtgggagaaggctgcaagcaggagggagcaagtgaacttcatctagaaggatctgaaggatgaagcagcatttcccaggtagagaagacatggaagaagtttccaggtggagggggcagagatggagtgtggattacaaaggcaacctgattaatatgggtggctctgccatccaatagaaatgatctctaggtgattaaaaaatgaatttcttatatactctataccaaggatagtatcatgtgctttcttatatattatttcagttaaatttctctatgatctccgcaaataagttcattttatagatgaggaaactgaggcttacataaataagtgattataaaggggtgaaaaatgcccagcttttagaggcagtcattgcggctcttagatcagtttttccagggaaagtaggcctgacagaaagggcaaggtggtggggctcaaaatgacctcgtaatattaatagtagatttacccatgagatcgtactcttattagtgcttctctatctaaaatgttgatttatttttacaatatcacagaaaaacagaaccatatatgttttttactacctgcatagtttacttcatctgttaatatgttttattattacttctagaatttgtaagctccatgagggcaggtatttaaaaaaatttttttatttcaatagctttagaggtacaagtggtttttggttacatggatgaattgtacagcagtgaagtctaggattttagtgcactcctcacctgaatagtgtacattgtacccaataggtagtttttcatccctcaccccccaaacctcccccatttgagctccaatatctattataccactctgtacaaatttgcatacccatagcttagctcccacttataagtgagaatatgtggtattttgttttctgttctcgagttactttacttaggataatggcctccagtttcatccaagatgctgcaaaagacattattttgttctttatggctgagcagtaatccacaccacattttctttatccattcatcagttcatggacacttgtgttgatttcgtatctttgcaattgtaaattgcgctgtgataaacatatgcatccaggtgtcttttttatataatgacttgttttcctttggggagatactcagtagtgggattgctggatcaagtggtagatttacgtttagttctttgagaaattttcatagcgttttccatagaaattatattaatttacagttccactagcagagtataagcattccctttttaccacatctgtgcgaacatctattgttttttgacattttattaatggcctttctggctggggtaagatggtatttcatcgtggttttaatttgcatttccctgataattaatgatgttgagcatttttgcatgtttgctggccatttttatatctttttttgagagatgtctcttcatgtcattttcccactttttaataggattatttgttttttttcttgcggattggcttgagttctttgtagattctggatattactgctttgtcagaagcatagtttgcaaatattttctttcattctgtaggttgtctgtttactctgttgattatttatttttctgtgcagaagctttttagtttaattaggtcccacttatttacttttgtttttgttgcatttgcttttagggtcttagtcaagaattctttgcctagtccaatgttcagaagagtttttcctaggttttttttttctggaatttttatggcttcaagtcttagatttaagtctttaatccatcttgagttaatctttgtatatggtgagacatagggatccaattttattcttctacatgtggctatccaattttccaagtaccatttattaaatatagtgtcctttccccagtgtatgtttttgtctgcattgtcaaagatcagttggttgtaaatatttgctttatttctgcattctctattctgttccattggtctgtgtgtctacttttacatcagtaccatgctgttttggttattatagctttgtagtgtaatttgaaatctggtaatgtaattcctccagatttgttctttttgcttaggattgctttggctattcaggctctttttttggttccatattaattttaggagtttttttctaattttgtgaaaagtgatattagtattttgataggaattgcactgaatctgtagattgctttaggcagtattgtcattttcacaacattaattcttctgattcatgagcatgggatgtttttccatttgtttgtgtcatctatgttttttttcatcagtattttgtagttctccttgtagagatttttcacctcatttgttacatatatttctaggtattttatatattttttgtggctattgtaaaagggattgagttcttcatttgagtctcagcttggtccttgttgatgtaagcagaactactgatttgtctacatttattttgtaaactgaggctttactgaattcatttatcaaatctagcaatctttcagagaagtctttaggattttctaggtataagatcatatcattggcaaacagtgatagtttgactttctcttttccaatttggataaaagcaaggatttttgtcagttttgtttgcagcaatatttctagaatccagatagtacttggcatacaagagcactatagcatatttggcacacaaaatatcttttgaatgaatgaatgaatgaaaaagtgctttagatgcttaacgtctttccttctggatagcatattgtgatggtgtgaaaaatgaggcatgtatccattgctctctctctctctgccaccatgctactggacagtttcatctcctacatagtatgattttagaaattcagcaccatcttctccccagtacatgtcaccatgcttactggcccaccattagagatgaattccaactccaagaagcttttataaaaatgcaactacagtcctgccccacataaagacgtttcaatcaatggtgaactgcatgtacgacggtggtcccatatggtgtcatagttgtcataatgtcatagtgcaacacatttgtcacatgtttgtggtgatgctggtgtaaataaacctactgtgatgccagttgtataaaaatattgcgtatataattatatacggtacataatacttgataataaatgactattttactgatttatgtatttactatactttatttatttatttaattatttatttatttttgagacagagtgtcactcttgttgcccaggcaggagtgcagtggcctgatcttggctcactgcaacttctgcctcctgggttcaagcgattctcctgtctcagccacccgagtaacagggatttgtccgccaccacgctcggctaactttttgtatttttagtagagatgagatttcaccatgttgaccaggctggtctcgaactcctgacctcaggtgatccacctgcctcagcctcccaaagtactgggattacaggtgtgagccactgcgcctggcctatactatactttttatcattattttagagtgtacttcttctacttataagttaactgtaaaaaagccttgggcaggtccttcaggaagtattccagaagaaggcattgttatcataggagatgagagctccatgtgtgttactgcccctgaagaccttccagtgggacaaggtgtggaggtggaagacagtgacactgaaggtcctgacactgtgtcttcatttttaacaaaaaagtctaaaagcttaaaaaaaatgaaaaatttttaaaatagggaaaagctgatagaataaagatataaagaaaaaaatatttttgtacagctgtataatgtgtgttttaagctaagtgttattacagaattaaaaagttaaaaaaattaggcttataagataaaaagttacagtaagctaaggttaatttattattgaaatattagtaaaaatgaatttagtgtagcttaagtgtacagtgtttataaaatacacatagtgtacagtaatgttctaggccttcacactcactcaccactcactggctcacccaaaccaactccgtccttcaagttccattcatggtaactgccctgtacaggtgtttttatttttatactgcattgttactgtactatttctatgtatagacacacaaatgcttaccattgtgttacaattgcctacagtattcagtacagtaacatgctgtacaggtttgtagctgaggagcattagtttatcccatctagcctaggtgtgtagtagtctatactatctaggtttctttaagtacacactatgatgttcacaaaatgatgaagtcaccttatgacgcatttctcaaaatgtatctcagttgttaagtgacacaagactatactcttgaaggtatcattatttcagtgctagcaaagaaaaattccacaatttattgacaattagctaagaggtactgcaaagacatacattttatcttcttcccaactttgtttagtctgtcagactcagctcctcaacagagctgaggaccttgggaacttgccatgctcatttctagagctcatttcttagttgtttgcttttagtgaattttaatcacaggttcccagcgctggatccctgaaatatgaatgattaagagaagcctgctggcttgctgagttacagaaccatttaaaacctaaaagagaggaatttctgagtctcattctccaaaagacgacattgcaatttcggttgtaagttggatggaaaatatttgcaagtcccaaaggtgtaatctcttctgaactttgatagtggtcaaagagcacataggtagaaatggtagtcaacaaggggctttcaacatcagcctcagggttgggtttctgaaacattaggcatccaaattcttgtgcgctggtcccttacccacttcttaatgctttctttttttttcaacctgaaattcagttccttattttgctaacgaatacaacttggtactttgggaagccctccccatccccaacacagggtcccatggaaaccaaatggaaaggaaaaacatcggaagtggagagtttatgctattgcctttgggcctgcggtctgatttcctttagtctggggtacatgggccagagcttattttcctggctgctcctaaacaacctactgctgcttaagctattgcttaaaaattgacaaaagtacaatgatggagagagttgtgttattcatgctgaaaaatgatttcctagtcggagccaaaaatatattttccttgggagatattcactcgcgtggggcctcggttccctctgactaaagaagagagggatgagaagaagaccagcaggggacgatgaacagtgagaaggggggtggattccaaggagatgggggtttggaacacactgtttgggactgaaagcatgagaaggctcagagctgggtggggagcatgtggtgctaaggcaggaaggaagctgatgattcacggtgggaatcgtattgaaggatgattatactctgtggctcaatagtggaagctctttaaattgaaggtaagggaacagctctgataccacagtatgatgaatacctacaacgtgtagaatctggaggtgcatacaagaatgagaagcaatgggcagagatcaagtgtgttttttgtatggtgcctgaaataaccttctatctgaagtgaaatttcttggtaagtgttgacttgggtgaaatagacaaaaatatcgtcacctaaataattagaagagaattccatttcagtgtgttccaaacccctgtctccttggaatccagcaccccctcactgttcatcgtcccctgttggtcttctctcccctctcttctttagttggagagaactgaggtccctgagtgtgtggagaaggtagaatgaacgggttgatgggaggaaaaggaaataaggatttagaagagagacaaggcagagctgaggaagggataatctatcgagctgtagcatgaaatataaaggtcaagagggataggaaggtcagggggaaggtcagtgagcccacactcttgggagtggtgctggatgtctccaggggcatagagaggaaatggtggcttcagccagaaacccaggtgcaggacaagccagcagctttgacgatggagagccaaggatgcactgacactggactgaatacatgcatggaatggggttgggggctataacagatcttataagagaaatgagccatctccaagaaagattagatggaacagtggagatagtgtctttaccttcctcccacaaggatgcttgtgatttaggaaggaggagtttttgaaaggtgcatgaaagacaaggatgttgaatatgcagaccctatgttaccgctttcactcttcatacccctagaagacatcgctgatcaatctcagcatctttcctgggaaactaatcatagcattagagttctcagcacagtttttcagcagcctctgccagtcaatcatccctggcatagaagctcttcctttaataggtggcttccagattactaaccaattaaatgacaactgccatttgataatagcaaatgtcatcatttactgttactgtcatcatgccggtgccacctggtcccatcgctttaggaactactgtgcagatggtctcccctggagagcagcatcatgccctagcatgtgtgtatcactgaggagccctccattcatgttcctccacctccagggtgatggaggtcaccacagtaagcagagccatctgtcacggttctgctgactttaaagggcctggtgtagcccagctacaatttgaggggttgctgcgctggtaccgcagggtatgaaatctgaggatgaggggaagaaaaaaagccacggccaaagtgactgcagatgtgaagaccagagatcagatcttttggggtgaccaaggacactcactcaacctacttcctcctctcgattgacaatttctggaatgggctagtgccccaaggctttgaggttaaagggctatgttcaactcagataatatcacctgggctaaagtcctcagattaggacttgccttagagtttcttaagtagccacatgaaagatgtcaaaggaacctttaattagtaggttctgagggctggcttggaccaggctgaagcatggtaggcttggcaggagctctagggaggagagcgaagggaaaatctgaagtggaaagccacataaaccttaggagacccacccaatggtggcaccacatctaaataaatcaaatgggttcctgactcctgatgccagaaatcacacatcccacgggcaacccacactggcccagcagtgcagaccacgcgggctgggtggaataaagggggcagtgctcaaggcaggttgtgttttccttttgtcttggtaactgcatctgattcacccacctgctgcggctgcctcctggactttcccttgagcaggtgaggaaagggctggcttgccaaaggagtggacaggcctggagcctctgaaaaaatggcagctgctctggggtagcttctgattgccagcaataacaaaagacatctaaacagtggtcctcaagagcatctgcagaaaacactcattttcctaacctagcatctctggggtttctattttgtaaatgttctcatccaggacaaagtgcccacatgggctgttacagaaatccgtggacagacgcaggcactgagtttggaaagccgcctgggtcatggtggcatttctgcattttggagccagcttaggcatctggaggccagcaacgtttccattaaataagacagcacgctgtggctcctgctgccaggccaaactggatctattgagtcttttctattgattttagcccgtagatgtggcagcactgaaaaagcctggatgtctaattccaggctcaatatttggaccaatcctgggaatctgagtggaagaacgcgtgtgtctgaattctttgtaggttgactgacagctccctgaacggaaaggcagcagttttcttcagcttagaaagaggctccagatcggctgggcgcgatggctcatgcctgtaatcccagcactttgggaggctgaggtgggcggatcatgaggtcaggagattgagaccatcctggctaacacggtgaaacctcgtctctactaaaaatacaaaaaaattagccgggcgtggtggcgggcacctgtagtcccagctactggggaggctgaggcagaagaatggcgtgaacccgggaggtggagcttgcagtgagccgagatcacgccattgcactccagcctgggcgacagagtgagactgcatctcaaataataataataataataataataataataataataataataataaataaaaataaaaaaaagaaagaggctccagattctacagaacataggattccctgagtctcacatgtccttgactgcttccaaaggccatggttcacagggtcctgttgagtggcttccaccctaatgagattagctcttgtgtgagcctgtgcttcagaggcagtggttaaagcattgttaacgtgtcctgttgtctgaaaaatgaggcaaattttctatctatgcctaaattaggaatggattcactatagactcatttattttcatgtatttaattttatttatttttattttatttaagacagagtcttgctctattgcccaggctggagtagagtggtgcaatcttggctcactgcaacctttgcttcccagggtcaagcaattcttgtgcctcagcctcccaagtagctgggaccagaagtgtgtgccaccacacctggttaatttttgtataactagtagcgatggggtttcgccatgttggccagactgttctcgaactcctggcctcaagtgatctgcccaccgtgacctcccaaagcactggaattataggtgtgagccaccatgcctggtcaattttcatacattttaaaaagagaattaaagaattgcattctagctaaggagcaaaaaataccccttccctgaaatatgtatggatttaagtaaaattctgtttccttagcttgtaagtaagtagatgcaaaatggagtttagatatgcttatgttcatgttttggggaaaaaaaggaaggggaaatttaatttttgtgtgtcttccatgtgacaggcactgttccatatttcacaaatattaattcaattaatcttcacaactctattggtagtggtggaaagctgatgcttattgagaactttgcatatactagaggcattacatatgttcttatttaattcttacaataaccgagtcaactaggtagtattgggcctagttggcaaggttattaaggttgaaagaggttaaaagtgactccaagtcaacagttagtaagtggcaaagccataactataccctaggtttgtctgactccaaaacccacctttctttttttttctttttttggaaatggaacctttatttctgcacaggccaccccggctttactgaggcataattgacaaataaaattgcatatatttaaggtttacaatgtgatgatttgatgcaggtatatgttgtgaatgattaccacaatcaagttaggtaatacatccatcaacttatatagttagttacctgtttttttgtttgtttgtttgttttgtggtgagaaaagatcttaaggtgaaaagaccttctgttaacaagtactgagaatctacgctattgacacccttaagatcttaagatctcttttagcaaatatcatgtatacaatacagtattattaactacagtcaccatgctgtgcattagagccccagatgttgggctctatacctcctcatttccccgaactccagcccctggcaactaccattctactctctgtttctatgagttcaattttttccaaaacgctccttttgcatgctatgttgctaagtgaaagtcatttgtcaactagaaatgatctcataaataccagcaaaccactgatatcagacctaagggtcagaaggtcagagatggttaaaaaaaaaaaaaaggaaatttttggagggttgtgagctggaacgtggaccaaaacccatcaatttgcagttcacaagagctggagatctctgtgaacaggaaactagggaaggcaccagacacctgacacctgggaggagccgcatcacctgagagcccagggtctgggttatggagcaggggaaagtgaagatctggctggcttgtagtgaatccttgactctgccattaaggactttttggttagagaactctgttaggttcaattaagtacggtaattatctttccccaatctgtacagcgattgtactctgaacagtctccacattaaataggttatacacttgaaatggtgattggattggagttgagttttggtgggggcactacagagaagatgaaggggcagggcccaggttctaataatgtgggctttgaggagaagaaactcccatcccccagtgaacagtggtgaaaagaggcaagaagcatccaggaggtgatcctttaacctctgacctctctgtatcctaatagcttcttctctggaaagcattttattgtttaaatataacattcgtttattcattcaggctgagtcaactggtgaaacagaccatctgttaataagcactgagtgtctacgctattgacacccttttctatggttagttggagataagtaaaagaaatattgtccttgaccatacaatttagctcagcactgagggcatgggaaggccaaagtttatgttaaaaggcaggtgaagcagatagacaaggcatcaaaggtcacgtggttcagaaggtatagatgactgggagagagcagagaagcgggtggtcagattgcagaaggatttctcagggaatgttcctcctgaggcaggttttagaagcactgagaagcaggagctagaggaaagggggtcagtgttattctgcacaggaaatagaatggcaaatccacagggatggggaggatcccaccaggtgaagggcttggcatggagactggcaggaccttggggatttcctttggttgccaggggcattcaagctcaagtggccactgggaccagacactgcaccctcaaccagttccctgtttgcccaaggtattcccaggcagagacccaatgaagttttccacaggcttgtcaggcaattttccctccctccttcagatgattgaagaagatttcctttagtgtaacagcaggctgctctgtgattcctgttcagtggtgggggaaaggagataggacttggaggcagaagccatgggttgagtgctggtttcgactactagctgtgtgccccggatctgccatttatattgctctaagtttcaggctccacatctataaaatgaaacacataataactgctatctcttaatggtattgtgaggagttaggagtgggcagtaccttgtgcatctctccattttagaactatccaatgcctttgtaatgatgtaatatttccatgatatctcacctctctgcctcccctacccctcaggccatgagcccccaaaggcatgtgactttagctccaagctcactgcctgggatacagtagatgctccaaacaagatttcttgactgaataaatgagcaagaaggagagatctccagtgaaattgttttcttttctttcctttttcttttttttagatggagtttcactcttgttgcccaggctggagtgcaatggtgtgatcttggctcactgcaacctccacttcccaggttcaagcaattctcctgcctcagcttcctgagcagctgggactacaggtgccaccaggcccatctaatttttgtatttttagtagagacggggtttcaccatgttggccaggctggtcttaaactcctgacttcagatgatccaccagcctcggcctcccaaattgctgggactacaggcatgagccactgagcctggccaaaattgtttttcttaaaaacgttatttgttaaactgtacttatgtctttaatgtagttttctgtgaatatattttatataaaaataaagaaaacaatatggcagcaatgaatcatttatttaaaagtctctgacagaatgaatgagtaaatgtggaatatactataaaaagtgaaagtgtaaaaatgttataattaccatcataagtaataatgagtcacctaaaaacccacccacagcaatctgttacgagtgaaagaattactttaacacagcaggaggattttaaggtagttacaaatgacgggttagcaatgtagggagagacagtggctgaaatggtcagtctgcctctactgtttctgtgttctctgcttcccaaccacaccagccaggctcattccacagtaacaacctcatctcattgagaaaatgaatgtgacaggacaggggctttccaccaccatgtcttccagtggactctcatgtataccagaagtccaagctttccctctggtaacaactaaacatcatccaccatcttatcaaagcccacccccttcacctgggctgtggctcccaaactcctctcctggccttcttccctgaacccttatctcctgcctgaacaatttcccccactggattatttccagcagcacaaagtcatattttaaaatgtatgctgaatcggttatagttaaatgtagctatatttgaatttgtaggtaccaaatggaaggttaaaacattcatgtttactggccttgatttcattgatggaagaggagaaaagataatctatttgtagtgtgactggcagcgtaggggacttaagaacacttagacacttgggggaggaaaaaaaaatactcttttaacaatatccttcctttaccccattaaccttccagctatctttcaatttctttggtcccttttcttggaaatgcttcaacagagctgtctacattcacctctcaattcccccacttcctgttctcgccttgctgtagtccaatggacttccatcccctatactccactgaaattgtcctttcaagatccccagtgatcctggattgccaaaaccagtggtcagttttctgtttttatttgagttggcctctcggtaaatggtacagcaataaggttagggaactgcacgtaactgctactggtcagcgggctgtgagcggcagtgatacgtttcttcctggctaaagcagtggagagcccctttgcgattcttcatactctctctttcctcactctggtgatgggggtcatcgcagatataatctccatcagcctcggtctctggggaccagagctcctacctctctggcccacattattcatgcaatatgaacaaaaagtacattttattaattttttttttgagatgaagtcttgctcttgtcgcccaagctggagtgcagtggtgcgatcttggctcactgcaacctccttctcctgggttcaagtgattctcctgcctcagcctcctgagtagctgggattacaggcacctgccaccacacccggctgatttttgtagttttcatagagacagggtttcacgatgttggccaggctggtctcgaactcctgacctcaggagatccacccgcctcatcctcccaaggtgctgggattacaggtgtgagccatcgtgcccggccaaaatatgttgtattaagtgacactgatattttgtgttcatttattaccagagcataacttagtctagtctgaccaatatgcagtcggtgaaacagctgacaagctccctcctgcctgaagcacttccttccctggctttctgtgacattactccctccaagtttttgtcctacctccctggcttctctttccaaccttcagatattgtttagctctggagactattctctttcaacaggtgatttcattcaggtgcatggctttacgatgtattacacacaaatggctccaaaatgactttccctttgagtgccaaagtgggacatctgacaggccactccactgggaatccttacttgaaggtttaattggcatatcaaacttaacataccccaaacagaactcttaatttcatgctccattctaagctctatcccaagctgttccccctaattgtttccatatcagtaaatggcaccatttgctcaagcaaaaaatcctaagattcttccatgattcttcaacccccacatgccatcagctctagcggcaactcctgccaacaatcccttcagaataatgccttacacctctctgcttctctttgtctcttttttagcctaacccaagtcgttgccatttcttctctggactgtctcctgatagccttgccagcttccattttgccctcctgcaatatattctctatatagcaacccaaatgatcttttaagaatatgattacgtcactctctgctttaaactctcctgtggcttcccatggacaaagccaaacctgaatataccccaacctcctcagcctaccaggacctcctggcgtcatctggtccctggctacatccctccctcttcatgccacacccaggtattctttgttcatgccttcttggctccctggccgcctttcagctgctcaactatggaagtagtgttcctgcctttggggctttatacttgctgcttgtttcactgtctggaatgttcttttctgggatctttatgattatcaactcactattcagtttgcagctcccttgtccccaacccaccacaatgattttctaccctctttttctgtttcatatccttccttagcacttatcaccctctgaaaccacatgtatgtatgtattgtatggaatgaaaactcctcagaggctaacctgtcctgttcagtgctccttctccagtacagtaggatgaaagagaggaaggaagggagagagcagtcgcagtcccattgtaaacaggtcctctgataggtaccagattggcacacctgcctgcccacatcaagcccaaactgctctcctatgaaggtgccaaccctggaactgagctttttcctctctgcccccacaatcagaattttttaaataacctttctgttctgggggacttggctcatgtcaacatccacaggcccttgctaacctgtaccctgactaacctcatcacctcactattctgctgtctctttctcactaggttttcatttttgggagtttgtggtttgtttgttttgcttttatttttattttctacattttaactccatgaataattctctccaaagggggccaaacaaaatgccacgtataaatggcaaggtggctagtgagagccactctcttttcctggcaagagtttccatttctgaaagtgacacatgagaatctttggagacatctatcatcatttcagaatgctatggggtcatccaagctaatatctgtacctgttgtacatcctcaacagacagaagtaattgaccattatggatggattatgttaggctatctaggaaagtttcagaggagttttgctttcatagatgcattatcctataggagctcagagagggatatagtcgatacggaaggcaagtcctaaagatgtcaacctcatctatgcctgaggaggtaagaatatgcaaaaggcattactttactttttctaattatcaaagtatggcttgcccattgaagaaaactggggtaacagaatgatgtaaagaagcaagaaaggccgggcacagtggctcacacctataatcccagcactttgggaggctgaggtgggcagatggcttgagcccaggagtttgagaccagcctgggcaacatggtgaaaccccatctctaccaaaaacacaaaaattagctgggcctggtggtacatgtctgcagtcccagctactcagggggctgaggtgggaagattgcctgagcccgggaggttgaggcttcagtcagccataatcgcaccactgcactccagcctgggtgacaaagtgagatgctgtttcaaaacattaattaataaaagaagcaagaaaaatcactcacaatctctctactttccttccagtttttctatgctttgttttactacatagttaagatgatactatatatacaattttgtagcctgtttattttacttaacattatctcataatccttttttcgtcagtagtgaaagtctttaggaatgttgctttttatggctggataatattcaccattgtagtccattctctaatgctggattttacattgctttatatatatacactatgcaaataatgctgcaccgagtgtcttggtgcattaataaattaattaattcaacaagtatttactcagtggccactatatgtcagttactattcttggagctgggaatatggtggtgagcaaaggcttatttcctttggagagcttatgttctactgagggcaacagacaagagaatcaaataagcacatgctattaattagttctatgaaaagagatgacgaaaagtaagaggatagaaagatatgaatgatggggcaggctattttactgagggagaatacaggaaggtctctctgaaaaagtgtatttgcacaaaggcattttggattatttctgtaggctggattctcagagggaggaattgaagttcttgctttctaggaagccagtttattcactgacagcagttctagaggaaagaactgttataaaaatgcactctactagggcataaccttgagaaaattacttaattcctctgctccttggttttcctgcctgcagtggaatcgattacacctgtatgtgtacatctatatgtatatgtgtgtggtaaggctgagggaggggcatggctgtgaggatggaatgttaaggttcttacatcccagaaaacttgggttagggagcaaacacatgtctgtgaaaagggaatggtcaggctgtgaaatgcatgcagggcattccaggtgataaaaaccctaactgaaaaagggttctggaaggtgtgacatgaatacttactgtgtctggcacatattaggtagtcataatatatactgaatgaaaggaagcacccaatctgtccagaagagcttacttaaaatgggtagctaggagaaaatgtcttgaatgatcacacagaggctcagtgtggcttgtgaatcagatactacaaagacagcccttcaaaatgggcgagcctgcaattcatgagcctgcagataggcggcatcctcagtttcctcatccatgaaatagggctaatgtctacttcatagggctgttttgggcaactgtttttgctgctcttggtttacaaatcctgtcttgtctttaatccagaagcagaactggattgtggaaaacaataccaagggcttggggccccaattgccctcatctgttacatgacaggaagaggagaaggaaggaaagggtgctaaaagttaagctgctaggatgaagaagaatctaaattggatttgcttaaaaactcagcttggcattcatctgtggtgaaaaatgttcactggcggatgctccaggacctagttaactttagctggtatggcttggtagtgaccatcctctctgcccaagcccaggaagctgcctttcacttcattgggttcactaatgagcttttggttgccttgagcaataatttgctctctggatataaagaatgcaagagtgggtaagctgaaagcccctctggctgggtttcctcttgttacaaacagttagtctctgaacttgtaattatgagtcatggggctcccagtctggcacaaaagtgactcattttaagcaaattatcagctttcgcccttaccaaatgctgtgatcaaccattctgttcaagaaaaaagggaacatttttattaaaagagcaggatgtgaaaaaggagagcaaactgcaactatgatttccagacgtatggatcaaagtcaagttcaggcccagtgtaagccaagcaacaaaataaatagtaaaaatggcacagaaagcaaatggtcaggaaaattcatttcagaacaggcgcaaaatcaacccttgcagtcaacagcataagattcctataatgctatgattcttggacattctcccctcccacttccaactcccttggacctactggaattgaggtcaaggaagaaacatctttctttagatgacttaacccacaactttgttaaagaatcagtgatgacggatgcctccaagttgcccaaagctagttacttagacagatgaactgatagacaaagcaatcaatttaaacaaatgtgatccagagatggatctacaatgtatgaagaatcccaaggccttctactacagagcattttcctgaggacacctgtttcattaatggtctttggctgaggaaacatttgaaatgatcattacctctttgtcagctgcaagagtagtaactgatctcaaaagacaaattttattctccgatgtctggggtgtattaacactgcccaggaccacagtaaagggaaatgggtccagggtggactgaaaggcaatgtcgtccgagtttgtgttttctggaatggtttgagatttccaattaatcttttacaatagctgcccattcatctatgtcactgaagaagataccataagctgcatgaggaatttggctctgggacaaattgtctgacttccaactgttacatcctttctaaattactttcaatttaatactgcttttcttatatcttgactctatcacttctcgtccttcataaaaaaacaatggctaccaaatggctatttttgtatgttccccaaaccctaaaataaaatccattaatcgatcacccaatatttcttgaatatttatcatctctgctttctggtaatcactgtagttgataaagaatcaataaaaaccacaaaaaaagggcagaatataacagtcattaatcacctcccaactggcaattcaagtgcacgttttgcaattctcatgcctcttggcctctctgaggtatttaaaaatattccttaattattaaaattttcttctctggcttcttggcatagttctctccatattccccttgtatgtctgtgactgccccttctgagcctcccttactgactactacactgccttatcatctaagtaatataaccaacaatgaggagtcagttggaatagaaaagcagtgttaaatacagtaatagaaatagaaaagaaatagaaagaagtgttaaatacagtagatatttctgttaaatacagtagatagaaaagaagtgttaaatacagtagataaatacagaacatgatgactaagtagcatggtgagtatgtattagaactcttatgttgcaatagtggaaacctaaactttaagcttcagacactttttgatacaaagactcaaaaagaaaaaaagaggaaatattaatcagagaaagtcactcaaaatgcagtacagtcatctaaagaaatggaaaagatgaaagagagattgagatgtgaaagagagagagtaataagatccaacacatgtgtaataggaagctccaaagatgtgaatagatagaatggaggaaaggcaatattagaaaagataatagctctgcattttccagaaataataaatatgtgacacccgatatccaggagcacaataaatcctgatcaggaaaaatataaacgaaactctttccttagatataatagtgatactgagagcatcaaaaaaaaaaaaaaaaaaaaagatcgagcgtgagcgacgcagaagacgggtgatttctgcatttccatctgaggtaccaggttcatctcactagggagtgccagacagtgggcgcaggccagtgggtgcgcacaccgtgcgcgagccgaagcagggcgaggcattgcctcacctgggaagcgcaaggggtcagggagttccctttccgagtcaaagaaagggatgacggacgcacctggaaaatcgggtcactcccacccgaatattgcgcttttcagaccggcttaaaaaacggcgcaccacgagactatatcccacacctggctcggagggtcctacgcccaccgaatctcgctgattgctagcacagcagtctgagatcaaactgcaaggcagcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcatagcacgcagctggagatctgagaacgggcagactgcctcctcaagtgggtccctgacccctgacccccgagcagcctaactgggaggcaccccccagcaggggcacactgacacctcacactgcagggtattccaacagacctgcagctgagggtcctgtctgttagaaggaaaactaacaaacaggaaggacatccacaccgaaaacccatctgtacatcaccatcatcaaagaccaaaagtagataaaaccacaaagatggggaaaaaacagaacagaaaaactggaaactctaaaacgcagagtgcctctcctcctccaaaggaatgcagttcctcaccagcaacggaacaaagctggatggagaatgattttgacgagctgaaggaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcagctgaaagaaagggtatcaacaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgcggagaatggaaccaagttggaaaacactctgcaggatattatccaggagaacttccccaatctagcaaggcaggccaacgttcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaataattttcaacccagaatttcatatccagccaaacaaagcttcataagtgaaggagaaataaaatactttacagacaagcaaatgctgagagattttgtcaccgccaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaattctccaattaaaagacacagactggcaagttggataaagagtcaagacccatcagtgttctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagagtcccacacattaataatggagactttaacaccccactgtcaacattagacagatcaatgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaaactctcctcagcaaatgtaaaagaacagaaattataacaaactatctctcagaccacagtgcaatcaaactagaactcagaattaataatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaacagagacacaaaaaacccttcaaaaaatcaatgaatccaggagctggttttttgaaaggatcaacaaaattgatagaacgctagcaagactaataaagaaaaaaagagagaagaatcaaatagacacgataaaaaatgataaaggggatatcaccaccgatcccacagaaatacaaactaccatcaaagaatactacaaacacctctacacaaataaactagaaaatctagaagaaatgggtacaatcctcgacacatacactctcccaagactaaaccaggaagaagttgaatctctgaatagaccaataacaggagctgaaattgtggcaataatcaatagtttaccaatgaaaaagagtccaggaccagatggattcacagccgaattctaccagaggtacaaggaggaactggtaccattccttctgaaactattccaatcaatagaaaaagaggaaatcctccctaactcattttatgaggccagtatcattctgataccaaagctgggcagagacacaaccaaaaaagagaatcttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagtcaaagacaaaaaccacatgattatctcaatagatgcagaaaaagcctttgacaaaattcaacaactcttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcactcaggcaggagaaggaaataaaaggtattcaattaggaaaagaggaagtcaaattgtccctgtttgcagacgacatgattgtttatctagaaaaccccatcgtctcagcccaaaatctccttaaggtgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatggtatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccattcgacccagccatcccattactgggtatatacccaaatgactataaatcatgctgctataaagacacatgcacacgtatgtttattgtggcattatgcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaaccatcattctcagtaaactatcgcaagaacaaaaaaccaaacaccgcatattctcactcataggtgggaattgaacaatgagatcacatggacacaggaaggggaatatcacactccggggactgtggtggggtggggggaggggggagggatagcattgggagatatacctaatgctagatgacgagttagtgggtgtagcgcaccagcatggcacatgtatacatatgtaactaacctgcacaatgtgcacatgtaccctaaaacttaaagtataataaaaaaaaaagtaaaaaaaaaaaaaaaaaaaaaaaagatcttaaaagtagccaggggaaaggcatattgtctactaaggaatgacaattacattgacagtatactttctgataacaactatgggaataaaaaagaacataatagtacttttaccatattgagagaaaacatgtatcaacctagaattctatatgcagctaaattgccacttgaatgtgggtgacaaaatactcacttctgcactttactcttatagaaagtgcaaactctagcctcaattccaaacaatctttaccccaggtacataaaaatttcagtgtccaaatgcggtttgtcttttcatacctttgtaatactgcttccttggcttagaataccctttccaacatggcaggcttcaactcattcttctaatttcagttcaaatgctatctcttctgagaaaccgttcatcactcctcttggaaaaattattaacttcattcttgcattccttcacattcatttcaatatataataaatgttttatgaaagtaagcacgcatgaatgaaaacactacattaagtggtcaaaagagagttttgcaagaggttagccttaagttaggatttgctttaagcccagctagatcttgtttaatgtccaacttaataacaatgagagtaaagttaacaataaatcataggtctataatgacaattatagcattcatcatattattggcattcatctgtaatagtctaaaatgactattatagacctacgagaggagaagtgttcttcatcagcaggtaacacaggcaatacaagtgaggtggaccctattggttgactaacctacaaatcatggccaattctcttcacctttaccttcctctcactctagaccagcagtggccaatgaaactatgatgtaagtcatacatataattttagattttctagtaatttttactagaaattaatagctttagttttaatttttacattaaaaatgtaagaaaaggtgaaattaattttaatatgttttattaaactcatatcaaaaatataatttcaacatgtaatcaatattcataaaattattgatatatttacatgtatttttatgctaaataactatactcatttgcatgttttattcttacagcacatcttaattcagacactgaatttacagtagaaaaatttgatctacatctgttttataaatttacaagtgtaaaatgtagccaaactgagtagtaaaaaattattattttttaatatttgtatctgtattgacaaaaccagtcaatgaagtgtttatgtgtaatacaaaaagtgtgtgtacctgttgacacatgtactataatactaatattttatactaaagtgacatgtagtcctttcaaaacaagaaagttgtatgtaatagagactttttattgcttccattttatgcttaaattaattaaaatgaaataaaattagaaattcagagataatttcaattgcactagccacattccaagtattcaatagtcacatgcagctcatggctatcatattgaatggtgcagctctggaggctggaaaagccatatacctatgtttccaggctcctttgaagcttggcatggctgtgtgatacatttactttatggccaaagaaaatgtatgagaacgtttggaggggtattcttggaaggctttttgctttcctgataaagagacaaactcaagaggagaacttgttggcaccattccttcctccttcctgccttaaatgtgaacattatgtaatgtctggagctataggaaacatcttatcaccatgaggcaaactcatatgaagatgcaaagttagtacactaagaatgatgaagtaataaagtgagaccctgatgacaatcactgagctgccagatcaacacgagatcacctaccttttgaacttcattataagaaatcagtgactgtccttataacttaagtcattaatagactgataacacttgtagctgaaagcatcctaatgggtacaatgagcatgatgggctgggaagagagccaatagccagcctgaggagggtagaggtatttactgaagaataatgaaaaatgagtctacagagatggggtggagccagataatggaaggctgacgagatatctgaaatgagaggcccacagcaaagcatctgtccttgtctcagagaccttatcatattttgtattttccatagtagtttgtatatatgtcataaatatatgcacatatatatatttgctactagattataagggctaggaacttgtacagagaaaatattcagttaattttcattagttgatgattagatatagagctggaggtatcaaggctggtttttagcattttagcatggatcaaatattcaacattaaagaaaattcagcaaactaaagcccttagtgagaaaatctattaagagttcctatattaacacgtcaaatagaatgtcttcagcctaactttgttccatcaacagctaagacaacagctaagatgaaatttaactacactgagttaaattttgcccaaccctctctactttcaacttaattactggtaataccttattcttcctaagacatttggcttctattttcatctctttgaatgggtaacatgtaatcttatggtgtcccttctgttattcctctgaactaagctcccccattttctctcctttatctcacttccacagtgtgagactaggcctccaactaacagtttaaatactatgtaagcctctattgtccaatctgcctccagcctcatcaatcccaacctactatccaatcaaatttctctgaaaatattcttaaaaaaacatgttattttttcagattttaaaataatatgttctttgtaggacatttgaatatttcaacaaaagagacgaataatctctaatctgactaccaggagatagcaaccataacattttagtgtattttcttccagacatttttctatgcatgtttagatctatttaacatcattgaaattataaaagtgtactcatcttttttacttctcatcacatcataaaacatttcctgagtaattaaaaattcctcaaaatcatctcaaaaaataattgtatgatgtcccatcagatggccactttttaaatcttatttaaacatttttcatatcaacacatctcttctgagtccccatagtgactgtcagttgtcttttattaaataaaaattccaaatcttggaccctttggatgctgtcattctaaatctgcccctatcttctgctggcctttcagattttaaccaaataagttggcttgctcctctctcctttgagtcatcattcattttcttcctcccacatctctgtcaaatcactgctgtctttaaaatttacctcgggtaatctcctattgtctctttctttatattttcaaatatccttgtttagtaggtgtacatatttattactttgagagtttgtggctgatcatatttatgtttctgctacatgtgtgttatggtctgatagactggcaggggccaggatgggtggtgggaccaaaagcagcaggagaagagcttgcagatggtggccacatctgaccgttgtcgtgcttgatgaggtggtcagcactgaaagggaggcatgaggcaggactattctcatgctcagagctgagcagtggagggtgattatgttggcccggctttgattaacaagatagtctatcaggcatttggagaccatctgcattttcagcctaaacgaaaacatatttattttggctgctaagtatctggaggatgagggaaccatgtgcataagggaggcttaccctcctcttggaaaaaatgatctcaattagatcaatgtctgctttagatcagccagcgtattaagcataaacctgtgcactaacttaagggtcccagtgaagtgtccctacttttggatctaatgttcttgacctcacacagccattctcttataatcagaaactatgagcatctgtttaaaagtggaatctggaatgcagagcagccacttgcctcctcctcctcacctagccaggccatcgcctggcagctcatctccacagcctggatgctagtgggctagggcagccaggtggggccagctggaatgctcataagcaccactgagtggagcaggattcacgctaacaagaccccacaggagcccactggactcttgactatgagagatcagcacaacttgttgacttactatagtgatatacctacaatggaaaaaaagccttccgagaactgctttttaaaaattgatcatttgactcttattaatatgcaacaaacattgggtcactgaaagcatggctgtcccagtttatggcaaaagaaagcctatacaaaagaaatctggttttgtgcttgttagccacttgagcaaacagttgaacaggagctagcagctctaagatgtatctgtaaattttaattggtcaggagttctttcctagtagcccacttttccaaatatttatggcaccaccagatgtccgtgcgtttctcatttccagaatagggcatggacaaactctgctgcttcggtaggcgggcggggatatcataccccatgtctgcacatgccttgaaagagatggtctctggttgcagcatcactggccataaggttatcaaaggagggcaagaagcatgggcagatgtcttcatagagcatggcaagatgcatctttggcaaatgaagactttttgacgtgtgactctggtctcaagaaatcaaagtaatgacgttattatcaagagacaatagcaggtaattgaaaagttgccaaaagtaaaacttcagaatcatcctggactcctcccttctcttcactggcatttaattggtcacacagaccttttgatttcctctcatctggacctcgcctatccttctcttctttatctccaacaccactgtctttgttcaaactctcatcatctcatgcctaaactgctgcaataccttcctatttgtctccctgactttagtctgtcttcctatgcacatcagaaacatccttccaaaataaatctgaagcttctctctgatgcttaaatactttcagaggttccccagtgtttatggcatcatgtcccagtcttgtgtatttaacaactgggccctaccctacgacttttcttctgccactccccaccataaagggtacattgtgttctaactacactcaactacttggcatcctctaaacagttcagacataccatgattttgcatgcctctgttctttttgatcatactattccttattcctcaaatcctcttctccttcacctctgtttgatgaatttacttcaataggcagctaaaatattgctgcccctgaagcccactttaattcttcctggcagaatgtcactcccttctttccaggcatagtcctcggctcttgcccccatcatcccttccatattacatggcaagtgcttctttatttttgtcagtctctctgacagacatctctgtgagctccttgaccacaggacattgcactccaggagttaacacagggtctcacgtgtgtagtgttcaatcaggtttgctgaatacataaatacggctgtgtaaaaagttgttctgataaagctttatgtaacaacaaggccaactttcctccccccttcctccttccttctctccttcttccttccttcaaacaccggctgccaggattcttttggactttctggaggaacacataacaatggtttctgagcttcaagcatcagagataaaggagttgctatttccaaaatggtggtgtagctcagaggacctcatcaccagtgacacaatcaaagtcagtgaaaattattaaaacaaagaacaacaacaaaaaccatttgaaatatctgaaaattgtctaaaggcacgcagcaaatggagaaatattcattcaaggaaatctactaaatctcagtaagaagagtaagagtccattggcatttgagccatgacttgctccttccccaccccccacctctgcatgatggaagctctactctggatgactgtaaattagaacatgaagcttccactccccctagctcccagtctaaggttatggtatctccctgggaaaagcaggccacccacatttctcatgacccctatctctgtattgcataagctgtaggccaggcaagagcaaatgagagatctggggcttccttcctccacccaggcccctctttgtaaggcagaagttctcttccaggtgaagcaggccaagaataccaggtctcgattgcctttgcctgctcataaagtgatggctccatgccaggagaagtaagctgagaaggcaaaaggctacttccccccttcccagcacctcactcataaagcagggtgttgcttccagagaagcagaccactgtccccactgccagttccagagcaatggcttagagatttgttccacaggacaaggcaggcataacaacagagagctttatagctttccccaaggaactgagggtacttggaacagagactatgaggaagttcaagcctgaaggtgctgtagaaaacaatggagattctggtggtagccaatgaaaaggacactcactagtagctccatgagagcaacaagctaaaccagtttaagtttagcaaagatcagctagatgcttaacagagagaaccagggaaaagagatagttaataagagcctttcctgggtttgaaacaaaactcaaagaatggcctcaaagactacccctgcaaataaggtgaatttaactgcatcaaactgtgaggaaatttatgctcagacactgttgaaaacaataaaaccatcaggtgtcaattagtgaaggctaatatttacacatgatatcaacaaaggcagtcagcttagcagagatatcagggaaaaaaaaaacacagagagaggcagccctgctaaaaccattgtcatcctaaggtgactgtgcacatgcccaaggctatgccctctgaggaacaaaatcataggctaacgctaagggaaattagacttcactgagatagtccatccaagccactagacgaataaacaagtataaacaagccccagaaaaggtgggtggggatcaatatctagagctgctatattatctaaaacatccaattttcaataaagaattatgataaatgcaaagaaagcgctacccatacacaagaataaagcaggcaatagaaactgcctatgaaagggcatatatgctagcttagcagacagacttcaaaccagtcatatacatatattcaaagaaccaaagggagcaatgcttaaagaagtaaaggtttggctctgaggacttgctgaaaatgaaaactaataaataaataaataaagaagcaaaggacactataatgcaatgcctcatcaaatagagactatcaataaagagatataaattatttttaaaaaccaaattgaaattctgaagttgaaaagtgcaataaccaaaatgaaagattcactatagggctcaagaggagatttgaactgacagaagaattagtgaacctgaagatagatcattagagattacatactctgaagagcaaagaaaaaaaaaagaataaagcaaacaaaaggaatagagcctcagtgaaatgtggggcaccactgaggacaccaggatacaagtaatgagagtacaagacggaggggagaagagagagagaaaaagcagaaaaaatgtttaaagaaataatgcaaaaacaccccaaatttgatgaaaatattaggttatagatccaagagtcttaataaattctaagtaggatcaatacaaagagatccagacctaactacatcatagttaaaatgttgaaagctaaagacaaagagaaaatcttgaaagcagcaagagaaaactaacttgtcatggacaataagattaaaagctgacgtttaatgagacatgatgaaggccagaagccaatggaatgacacactgaaatactgatgaagaaaaagctgtcaaccaagactcttgtattcagtaaaactattcttcaaaaattaaggtgaaagacattcttagataaataaaaatgggagaattcattgcaaacagatctgccttacaagaaatatgaaaggaatttcttcagtttaagtgcaagtgactctaaaggttaattcaattccacatgaaaaaaaaaaggacaccagtaaaagtaattatataggtaattataaaggatagtataattgcatatttcttttttaaactgatctaaaaagcaattgtatcaaatagtatgtatataattttattgtggaaactataacatataagtgtaatgtagttgttagtaatagcacaaaggagggggtggaagcaaagctgtcctggagtaatgaaatgacaccagattataacttgaatacatacatacacacatacaacaataatagcataaaaaagggaagcatgaatagagatatataggattaacctatctcactggaattaattagtataaatatgaagtagattctgatagagctgagatgtatattttaagccctaagcaaccactaggaaaataactccaaaataaacaataaaaaatcattagagggattaaaatgctacactagaaaatattcacttaatgtaaaataaagcattaaaggaggagacagataaaaaggacatgatacatagaaaaaataaaatggcagaaatgaatacaactatataaatactatcattaatgcaaatagattaaaaatccaatcaaaagtcagagattgtcacatgagatttaaaaaaaaccaagatttaactgtatgctataaaagatacagtttaccttcaaacatacaaattagtcaaaagtaaaagatgtatcatgaaaacagtaaccataagaaagctaaacaggctatgttattagacaaagtagactttaaaacaaaaaaaaatgttactagagatggagaggaacttttaaaacttttactttaaattcagggatacatatgcaggtttgtcatataggtaaacttgtgtcatgggggttcttcgtacaaattacttcatcacccaggtattaaatctagcacccattagttatgtttcctgatcaagagggacatttcatgatgataaaagcatcaatcaatccatcagaaagacacagaaattacatataaacaactaacaacagagttccaagaaagataaaggaaactaacataatcaaagagagaaacagatgattcaacaataatatttggagatttcaatactccacattcaacaatgggtagaactagggaaaagatcaataaggaaatagggaacttgaacaacactatatgccaactagacctaacagacagtgtagaacactgtatccagaaacagaagaatacagatttttcacaagcacacacgaaaacattctctaggataaatcatgtctttgaccataaaacaagccttcataaatataaaaggatcaagatcatacaaagtatgttcttccatcacagaatggtgggagggagggccaaagtggattatagagcagagaataggggagggttgagagttgggatatcagggcacagtcaggagcaggtaaagaggtagagtagggaactttgggatttaaagttcaaagttcagaggtctaggagcaattgcacatggtgaaaaaaccaatgcagtaacagcagctcagtctgacgggtagctgagccgtacaatgtgattaagtgcaactcaaatgcctgccttgcagctcctgcctgtgacgcaggaggtcacagacttctctgtaggagcattttggactggtcatagcagaacatccagtggtgtatcttaatgaatttatctctgagcactccaaaatgaaatctgccagttgactgtcctcaagattatctaagaaggatgcctgtgaaacccaggaggatgattgcgggggaggtcctttcatactccccgggtgatgtggagaatgttgcatagacacaggatcaggtttagaaaacaacatattttagggcaggaaagaggagtaacatgtcatgtttcacctaaatgtgtaaccatctactgacagctgtttccactattccccatcaatcaaagatttggagagaagtgttaactctgtcaggccagaaaaagacccctgagcaggactggccttcccagcatgcaaatgcactccaagggagtaataagcactcactgtctgtattcctctacccactgccctttataacgtgggctcccttatcatatttctttaagatgatcaggtttttcctttaatggaacaccacagagctctttttccccctgaccttttcattcatgttgaataataaaacttaacattgagctgtgatttgatattacaaggcctgggatgccaaagttaaggccttgagtttgccagaagtttgtaatccttggtccagcaaaatttaaggatgcaatctggaagtgttttaaatgccaaaagaaatgtgacacctctctgctaggttttcatttccttctctcctgttcttcttttcccttggtatcttttatagtctccatggttccttcctgaggcagcctctctagcacatgggcccacctcttcccaaagaaggttctactgaactcagtacggctgcatttgctgcgtgtcttgtgcttcctcctctctgactctttgacctttctttccatgatgcctctgcctgcaggcccacactcagccttctcactgccttcttgtctggccacgagattgaccattccctgtgccctgggccagctacctacatggatcttctctactgtttctgggcaaggacactggtcacagggccagcgctcgacactctacgtcttggattttatttaactgtggtctttttataggtcctccattcatgaggccacacctcttcagcaaatgtgtacccatgatggctgcaggctgtctacctaaagggtctcagtgtcctgatcctcaatgtcatcatgagctggggagagagtgttaaaatcatctgccagcacatctgaggactggctcaaggtagaaaaggtctaggtaactcctatttttgtaatcttcccagtggaactaccttagctctaggagaagggagttctttttacatatgtaccttggtcttgacagagctgcttgctgagcatctagatagagatgatatagcatgaccttctgaagaatgaataaacatcaaggaaaccatctggaatagagtaaattgtaaatacatgtcccttacttcttccatttttaaatgaagccattgatgttgctgattcaccaaagtattccaactgcagcctgaagtacccgtggcacttagaatctatgtctaagagcaccacgtcctcatgcaagaagcagcctaaatccttcccaggagccacccttccactcctttactaacttgcacctttcccttcacaagcaaactcctggaagagctgtcagcgttccttggctccatttcctcaactactcttcacctttcatgccctacagtctggtttctatcctcagcacctcactgaaactgctcttccaagctcacctaccaccaccttatcttctttgatactaacaaccaagcccaattcccttctctgtgtctgttcctcttcagttttcatgccaggcttctcttctccttaaatgctagctcttttttcttttcttctcctccagccagacacttccatgtctcggggtgaaaaaatcattcaaaaattagtacccttaaaatggcaaataatgaatgactccaaaagataaattgttgagacttttgccttttgtattatcagggaactaagcatagccacatgctctaaacaaaatctgtggtcagtgccaactgcaataggaaatcaagcagatttgtggggcttttgcagaatgaaaagtcaaaaccaaaaccaaaaccaacaataacaccacctcctcctctctcccccttcccacgaatataaaaacatattccaatgtgatactctagttttgttttgtttttctaaaggagctgcctgactttcttgaccttgcagaaaaataaaatactccaggttttgtgcttttacagatgagccctggccaagtaggccagtgggatttacacactctctctgacacatcaccacacaccttttgttttgatgcaactacagtgttaatgtcaccagattcttcaataacaaaagtgttgtacattttcttttttttttttttgagatggagtttcactcttgctgcccaggctggagtttcactcttgttgcccaggctggagtacaatggcgcgatctcagctcaccgcaacctctgcctcccaggttcaagcgattctcctgcctcagcctcccaagtagttgggattacaggcatgcgccaccatgcccagctaattttgtatttttagtagagacaggatttctccatgttggtcaggctggccttgaactcctgacctcagatgatccacccacctgggcctcccaaagtgctgggattacaggcgtgagccacagcacccggtcaaaaaaaaaggtgcacatttttcaatcacttactgggcttaaaagacttctacatcccaggcattcacaaaaaagcaaaagaaaagaaaaaaaggataatacaaaatcaatttaggtaaaaaaaaaataaggttttgctaacttttctgaacatgtgcgacaaaaccttttaagagctctgaggtttacactttttccctacaggttttccaatttaatggatgatctaggaagacttacttccatgtttatccagtggctttgagtcctctaaatcccctgctgctaacctgaggatatcaaatttaggaagcggggcccaatgtcattagaaagagactaaatgttgtataatatttaatactgctctgtctgcttctcctgacagagcagtatgcagtagatttttagaatgatatttctcaaacttggttagaatgaaaaagaaagcaatatgctttggggttttggaggcagggggctgttttttgtttttgcaagttttatttatctgaaaaacttcatttcctaccacaacaggataaatgattctacttgatatacaggtcaaaaatgaaatagagagcaggcttagaacactagatatatttgtctctaacttgacttctagctttattttcccctcttttgaggagcttcattgattaatttggtaacatgagtatggtagaaaactcaggacacatctttttcaatgaataattttctctgtaaaaattcatttgagttttgatctgggaccatgattctgaccatgacaataccacctacttctgttctttatttggtctctggaaaatccgatccccgaaaataaaatagatgtgtacttcctcagaggcttcctgttatttccatgtgactgtgtagaaaaattaatatctgaaaataggtaacaactggggagaggatctctgacagggaaatgtttaaagggacagttatttttaagagtttgaaacatttaaaatctttggttatctgtaagtcatgatatatgactaactgctaaatagggaaaacaattcatgaagatacctatttgaggtctcttcatcaaacagctaatcttcatccacagggctatttgaaatatcaagtagagtccccactcacattattttcctaggtccctgacaatatttgttaggattgtcttcagtcgtaggtagcctctattcaggggttaacatatttattctcaaatcaaattttcttcttagttgagaggtctgtttaattgcaggtatgcagtaactaaggtaactggcacatagtaagtgttcaataaatcttccttctttacttgcatgaacgaaggacatcttataaaccttgtatttcacatcagaatgccagactcaaatatttccatgggggtaataagtgatcacaaaaaaacataataaatgggctagactgccagcttctcctgtgaaggagctgtggtctgaagcttctcctccacctctttcagaggaactctgggtatgtggcaggctacataaatactcagtgagaactgtgtgtggtaacgctgtgatttgtgaattgtgacataacatgcttatctctggataagtggcaagcctcatacgatggttccaactctaatttgcagttgaactgccttgcagtgggcctactgcctgtggcataatcaccagggtggtcgtccagacatattgattactcatttattcctgtatggatttaggacgattgctatgacttcagattattacaaaaacaattatatgatggtcctgttgctgaaggtgagcataatgttctttctcttgcatttctcaatgctagaattcctttacttaaactaattttgcaatgagttaagaaacaaatgttggaaggagcttcatttgggaatttggaagccctgagtcaaagtcttggctcctttatatgaattgtgtgaccttgggcaagtcactcaacctttctaagcctggttccttcctgcccacaaaatggggagtgggtggagatggaaataattaccctccctgcctcatatgggtgttctggggaggaagtgacacaatgaacacagatgtattaaatcgactgttaaatgctgaacatatgtcaaagttgtttcttgttgacctgccattttaaaacacacgcaaacatacaagcaccaaacataacaacagaaaagaaccagtgatggaaagtttgcaagtatgcttattttaaacagcttatcttcatcaacagggctatttgaaataacaagtagagtccccattcacattattttcctaggtccctgacaatatttgttaggattgtcttcagtcatacagaatctgaaatcaggattctaacctgacatttcaatttctaccttctcattcttctttgcctgtccccttttctgcatacctgcagaaaagtgtgggctgttgctcctgactcagtcccaggcttcatgtgattttatattctgagctcagttcagcttgaacagccttcccatgactgtggaggtagctctcattctctaagcagcgagaggcgccttcatgagcagctggagagttttacacttcttttgaggtaggctttccttttgtagccacagctcagcttcagcacagctgttagaaaagtcacaccatggaatactatgcagccataaaaaggaacaagatcatgtcctttgcagggacatggatggagctggaagccattattcttagcaaactaacacaggaacagaaaaccaaacactgcatgttctcacttataagtgggagctgaacaaaaagaacacatggacacagggagaggaacaacacatactcgggcctgtggtgggggtggggaaggaagagcatcagtataaatagctaatgcatgcggggcttaacatctaggtgatgggttgataggtgcagcaaactaccatggcacatgtttacttatgtaacaaacctgcacatcctgcacatgtatcccagaacttaaaattaaattaaattaaaaaaaaaaaaagaaaagtcacttcaagtaccagggcaccatggagattcctgctgtgatcttaacagttgctcccatcctccacttaactagctgtggtttccctgtgactggagatggtctaaaacaagcagagggcaaatgtgctcctgaagaatggaatcccacaaagttcataaaactaacagacaatcaagcatgctttgcttgtggcttatggtattttgatgtgagagcatacagaaacaacagaagcgaagaaactcaagcttctaactccagccaatgatggcctgcaccatcagaaggagctgggctctgggtggactctaagaagaaatgaagctagaagtagcctgaggaacccagtgtgagggtcttattttatctctcttcctgatctactagttagttctatgaaaaccacttaaccataccagctccaaaccactctttaaataaacaagaactcatggaaaagaggtgtgggattcttcttttcccagtccctcacctttctgaggatgaataaggtatttcatgtgggattctccacttttcagtctaacataaataatttattcacccagaatactgtttgtaatctttgaacatctgtatgttgcttttataactgcactgtgagcttatcatattttatgcttcttgagggaaggatcacatataatttaagatttatagcttcaataacatcagcatttattcaatcatttaccaacttcttcatataaacatttactggatttacaaatcttgactgaaaatctactttgtagcgaggcatttgggaaggctctgggagggatacagaaatgatgaagtcagtcccctcagttaaagagtttaaaatacactgggcccataaacatatgaaaaggtgctcaacctcactcataatatgagaaaagcaaattagagctgcatgaagatttcacctaatagagcagaaaaactgccaaagtgagaaccccctgtgttgacaaggctacagggaatcaggcaatcccaggtattgtcggtgggtatgtaaattagtacagaaaaatccccaaacagggcaatttggaaatctctgtaaaacttataaatgcatgcggattttgatgtagtgagcctatgtgtggaaatttattttgtagacatacatgcacatacaaactgatataagggcaagttatgtgttgcagcatcacctataacagcaaaagattgttaaaaaagagataaggggtttatctagtgataaacgataaggggctggttctctgcataatggaatactatgcaactgagaagaacaatttggaaaaatgttgaagatctgtttttaaaataaattttattggctgggtgcggtggctcacgcctgtaatcccagcactttgggaggccaaggctggtggatcacaaggtcaagagattgaaacaatcctggccaaaatagtgaaaccccatctctactaaaaatacaaaaattagcggggcgtggtggcgcacttctgtagtcccagctactcgggaggctgaggcaggagaatggcttgatcccgggaggcggaggttgcagtgagccgagatcatgccattgcactccagcctgggtgacagagccagactctgtctcaaaaaaataaataaataaaaataaaaaataaattttattgtatatatttgaggtttacaacatgatatcatgggatatacatatatagaaagtgaaatggttactacagcaaaataaattaacatatatctatcaccaagatctttgttttttggattttattacatgattttattattttttaaaaatttttcatttccataggtttttggggaacaggtggtatttggttacatgagtaagttctccagtggtaatttgtgagattttggcacacccatcaccctagcagtatacactgaactcaatttgtagtattttatctgttacccccctttcaccctttcccccaagtccccaaagtccattgtgtcattcttatgcctttgtatcctcatagcttagctcccacttatgagtgagaacatatgatgtttggtcttccattcctgagttacttcacttagaataatagtctccaattccatccaggttgatgtgaatgccattaattctttctttttatggctgagtagtattccatcatatatatatcatgtcattatccacttgttgactaatgggcatttgggctggttccatatttttgcaattgcaaattgtgctgctataaacatgagtgtgctagtatcttttttgtataatgacttcttttcctctgggtagatacctaggagtgagattgctggatcaaatgatagttctacttttagttctttaaggaatcgccgcactgttttccatggtggttgttctagtttacattcccactagcagtgtaaaagtgtttcctgttcactgcatccatgacaacatctatttttttttttttttttttggtggtagaagtgttccctgttcaccgcatccatgccaacatctattttttttaaattttttgattatggccattcttacgggagtgagttggtattgcattgtggtttgatctgcatttccctgataattaatggtgttgagcatttttttcatatgtgtgttggccatttgtatatcttctttcaagaattgtctattcatgtccttagcctactttttgatgggattgttttttttcttgctaatttctttgagttccttgtacattctggatattactcctttgttggatgtatagattgtgaaaactttctcccagtatgtgtgttgtccgtttactctgttgactgttccttttgctatgcagaagctctttagtttaattaggtctcagctatttatctttgtttttgttgcatttgcttttgggttgttggtcacgaagtctttttctaagccaatgtctggaagggtttttctgatgttttcctctagaatttttatagtttcaagtcttagatttaagtccttgatctgtcttgagctgatttttatgtaagatgagagatgaggatccagtttcattctcctacacgtggcttgccaattattccagcaccatttgttgaatagggtgtcctttccccacttcatgtttttgttttgttgaagattagttggctgtaagtatttgggcttagttctgggttctttattctgtttcattcatctaggtgcctatttttataccagtaccatgctgttttggtgactgtggccttacagtatagtttgaagtcaagtaatatgatgcctccagatttgttctttttgcttagtcttgctttggctatgtgggctcttttttgtttccatattaattttaggattattttttctagttctgtaaagaatgatggtggtatttggatgggaattgcattgaatttgtagattgcttttggcagtaaggtcattttcacaatattgattctatccatccatgagcatgggatgtgtttccatttgtttgtgtcatctatgatttctttcagcagtattattttattatattttatttttttgcagctattgtaaaaggggttgacttcttgatttgattcttggcttggtcactgctggtgtatagctgagctagtgatctgtgtacattaattttgtatcctgaaactttgctgaattcatttatcagttctaggaattttatgggggagtctttaggttttctaggtatacaatcatatcatcaacaaacacctatagtttcacttcctctttatcaatttggatgccgtttatttctttctctggtctgattgctctggctaggacttccagtactatgttgaatagaagtggtgagagtgggcatccttgtcttgttccagttctcagagggagtgctttcaacttttccccattctgtataatgttggctgtgggtttgtcatggatggctttttattacattgaggcatgtcccttgtatgctgatttttctaagggttttaatcataaagtgatgctggattttgtcaaatgctttttctgtgtctactgagatgatcgtgggatttttgtttttaattctgtttatatggcgtatcatatttattgacttgcgcatgttaaaccatccttgcatccctggtatgaaacccacttgatcatggtggattatctttttgatatgctgttggatttagttagctagtatttttgttaaggagttttgcatctatgtccatcaggaatattggtctgaagttttcttttttttttgctattgtcctttcctggttttggtattacggtgatgctggcttcacagaatgatttagggaggattccctcttctgtatcttgtggagtggtgtcaaaaggattggtaccaattcttctttgaatgtctgatagaattcagctgtgagtctatctggtcctgggctttgttgtgttggtaatttttttattatcattttagtctcgctgcttgttattggtctgttaaggatttctaattcttcctgatttaagctaggagagttgtatatttccaggaatttatccatctcttccaggttttctagtttatgtgcataaaggtgttcatgggagcctcaaatgatcttttgtatttctgtcatgtcagttgtaatatttcccatttcatttctaattaagcttatttggatattttctcttcttttcttggttaatcttgcaaatggactatcaattttatttatcttttcaaagaaccggccttttgtttcatttatcttttgtattttttttctttcaatttcatttagttctgctctgatcttaaaccataatctatatttaagtgagaaaaccaaggtccagagaagcacgtatagcatgctatctttttttaaaaaatgaagaaagataagagcatacattaatattttcttgaggttgtataaagaagctccagaagtatacacaaggaaataatgaatgtgttcaggaatgatgggaggtgtgtagagtgtcaggtggtaatggaacagataggaactgaagtgggaacaaaaccctttactgtttatctctttatattgttctggtctaagaggcatgtggatgtattacctcttcaacatataaaataaatatgttttaaagattttataggaaagatatacatgtcccaataatatgtactatacacatctctgccttattttctaattaaatttaaaactccttcagggatgaattacataagagccttttaaacgaatctctccatttctccctctccaatttctcttataaatccttgccagactaatcttcccaaataccttgttagacagattgccagaaatgattccttatggtctctgcaccaaattcaaacatctctgacttctagggctccccacaaactcaccccacccaaccaatgcaatttaatgtccacaattgagatctccaacaagcatcatttgcttctatcagggtgggttcatcattgttcttgaacgtttccatccctgtgcctttgcttgagctatttcccatctgtggggatgacttacactttcccctctgactattctgaagttcactgtcttccaaggccgctcccttccctaaagtctgcattttgagcccattctgatctatcccttatgtgacctccatgatactgtcagtactctgtgcttaactcagattctgcaataaaaccgttagttccttagagataaagacaacgggacctttaggcacacacacacacacacacacacacacacacacaccccactgggacccgtgggaggcagcaatatcaaccacagataactccagctttctgggtcttactaagaagatgctttccaggtcacagctataaggaatggctagaccccaagtcattcaccatttcatctttcctaatggagttttagggacactgagccaaattctcagattcctgttaaccattttgtataacaggcaccttactttagatcaaactgaaattcaaacttcactgattctacctggtgaattgcagggaggtctcatgtaaattcttgctattactaccactatcaccaccagatgatggaagagctgtgaggacacttgagttctccaagagaaaagagggcaatatctgttcccagtccctttaggcccttgtctgagccctctggagcaagagaatgaggctgaacctgaagtgggttctacaagaggctgaggatggaagtgtctgggtagtgacaagagccagagaaatttgcattatttcttttcatataacctcattcaccctcccaaatacatgacaccttgagaaatttagcttatatctgatattcatttactagttcctcatgcagtattgggctcgtgatgttactgataatgaatacataatttgatgttagcaatggccaggaggttacatttggagagctgcctccctcccatccattggtaagggctgtttggagtctcactgagaaacattttgaagcccagtccagcccactgggagagagtaccataagccattgcagatgtctgccaagggctccgggtacgaggacacatgttctatggattggatgtgtcatccttgctcctatgcagacaaggaaactgggccctagagaaggggaggggcttgttcccaggtcttatgaccaacctagaaccagagcccaggcttcttctctcccgatccaggcttccctttcctgtcaggttgttttgctttttagatcaatggaaaagtaaggatcatcaaaataacaaataatccaaaactttcatttcagtaaagagtttttatctttcattccttcccttctctctgccaaagaagctgttttaaaagaaaatattcagccgatttgagagattttcctcctttctctcttgctccctgctgatcttttggggaaagggaacagaatagacaaaatataggcagtctgaaggaaaaataagtagggcactatttgttattgcataagctgtgtaaataatccagaatcaatggtgcctgtaaacttgcttggatgcaccaagattctttcctctccacaactgtgattttcctgaagtcccttcctccatctcttgcttgtgaaaccctcacccagctccacatttgatttctgcatctgggattatggggaaacagtaacttttaaaaagatttcccacctgacacatcatattatgagtcctcacactggggtgtacctttgtctgacatgccaagttttctctgttagcattttaaaaggctgtccctcgctcatgaaaacaacttgaaatccattgatttagagcaggttttaaaccagtgcatttcaagcatctgaaagagatctaaagtttgaccctaacagtaaaggtccaggcacttgaatgttttgctgctcttccaggcctttatccgagattcaaaggagaacctcaaggactgttactataatatccaggatatcagccctaagagaaaagggaaatggaagaaagcctaccagcatttcaggatcagtaaatgaaatgagacaggttctggtgaaagaccaggtatctaaaagtgacatttctcagtaactagctgttctattcattccaaaaacatctattgaattctggccgagggtcaggaaccagggataacaaaaatcaatcagccatattccatgctcttcaattcataaagagtgggagaggctatatacacatgtaaacaggtgacttcagtgcagtgtgacaaatgataatgaagatgaagacaaagcagtgctgtgagaacacttccaaaagtgacttaaaggaacttactgctgccatcattcactctgcattcgctacataccaccctccatgtgcacatggccgtttccatctcatctccctatcatgttgtaggggccatgtggtcaacttacttgttgtctttacagggcctgctccatggcagatgcttaattaacaaattagacccacaaatatttattgagtagcttgtacctggtgtgagacacaaagtagagaggaggctaataatgatgaataaattcatttccacattcaaggagattacagttcagtgaccatgaagatgtaatatgataaggtgtcataaaagcgacacaagcaaaagtgctaggaatgcagggccaggaagggtcaattctgttaggactgataaggaagccacaagggagaggaaagagcatggagtcctatggagcaggaccacaggcaagaaatggcgggagatggagtaaaagaagaagctggaaatgtagacaggccaatgccccttaaagactttgaactttatttttgagataagaaaaagtctattgttgattgatgaaaatgattactttcaagagtcccagatacgtgcaatattactgtagttaagcaattactgagagccacctggactataaaccttggggctatttttctccacattaagctacattcctcttcctaaggactgggcctgtatatataaaggtgtcactatcccttcatatatgggccaggctgtggtgcagtggagccacttagatgggaagcttgcatctgtgactatcatctctgcctctcctcaatctgggtttgcctcccccagggaagccactctaggcacctttctctgccctctcctctggattctggctgatcccatgggggttctttatcagcctctctctccccagcaattcattgtcatctcccccagggctctctccttggcctgcatatttctccatcttcaagatgaggaacttacatcttagtgaggttgcccattgtcccactgctagtaagcatagtgagtagaaaaggacctgcagtagtacttccagaactaggactctgtgttactttctggtagtgaagctggtgcaatctacacataacagatgagatcagccacctgcagagccatttcatagacaggatgtctcagaaaattaaggaaagaagaaagctctggaaatttaatcaagtatgatgaaatgtgaaaatgcacacagcttcttatcagcaagattgtccttgacaatttctttaaaaaccactatcccccaccaactctttatccccttattatgcttggcttttcttcacagcactcatgatgtatttgcttctttgattgctaaccatcttacccatttgaatatgagttccttaaaggctggggactgcatcttcatctaactttgatccccagcacttagaacagggcttgacacatagtaggccaggaatccataaaatctgtagtttagcgattctcaagtgaagagattgacaaagcatcttccattcttctgcctttccccaaagattctcattcttctacacattatcaatgtgcagagagccactgtcacgaaaggagcatgttggcctctcagctatgtcagaacacaacaaacagcaagccactgattttgtttgaacaagggatttaacacatatttagaaagaatgtgccaacacaggaaggaagggtaaaagaaagagcttgcacccatagagcacttactctaggccagtaaagctccgagtgctttatcctttttgactcattgaatcctcacaacatttctatgagggagataggtgtatatattatccccatttcatagatgagaaaactgaggcacagagaaactaagtaacttgtcaaggtggcacagctaggatgtgggattcgaattcagacagtcagcctccagagtccctgccaggcaatgaagaacaatgcttgtggcagatgaaagatggctgtgaacactttgacattttgtccatcaatgagtgaactctatgtcccctacctctgaatccaagttggcctgaggctgacttgattaataagatatcacggaagtatcactatgccagttctgggcctagcttttcagaagactagcaatttccatttctttcctctgggaaacttgagcttccatgtaaatggtctgactaccctgctggagaggccaagtggagaagccctgagactccacagagagacagagggaacctgcagggcccaggtttccagttgtcccttctagagcacccgtcatgtggatgggccatctggggccctcagcaatgcctagttgactaccactgggtaactccattggatgtcacgtggagcctaatagtcaccaagctgacctctatctaaattcccaatacacaaaatcatgagctataataaaatgattgctgctttataccaccaagttttggaatagtttgttatgcaattatactgtgttaattggaacagtgttcatcaaatttttcgactgagatgcacagaaagaaatacatttgccgcaaactctacatatgtacatactaaagaaaccctgaagtttagctttggatccagtctttgaaagtccaagtggctgaatgcctagttcaacatcatttctagaatttctgaacctgtgagtgatcagcaataacatgattgcaaaggttgcatgaacccagcaatgttaataatagaacaaggaaggctgttggatttataaatatctgaatattcactttgaaatattctagatataacccagaatgaaaatctatatctgcatcagtaagttgaattataaatgtacatttattactgcaagactaaaacagagccataacaattataatgctataaacaaaacaattaaaaaaatttcaaaataacaaccaaatgttgttaacagtaacaacaaataataccacagtgtgtatcagtttactttaaaaacagcattctatcctttctgagccaacacatttttctaaatttaaaaatagtaataaataaaaatagaaaattagattgattctttttacttaaatgaatttatgttttaataacttaattcaactgaggctgtaagtctgacaaactatatactacgttgctgtcatggatactgtgggtgtcagctatatccccattcaggacctggtctcccagctgctgggactgctgctggcccacagatgtcagaggtcagccctctctgggaattgccctctgctactgcctcatccaaagtcagattccctccccaggggcatccagcacccaaagactggtccatgtacctaccctaacatgggccagctctggaaggccaccctttagctttccggcttgctgtggagaggactgaggcctttattgagacagcttcacagtctagcttctctctgcctaggtctgctttctcccttcccccacaggtgtcaatgccaagagttctccctacaattatttttgttccagacgaggtaagaaatatacagagtattaagaaaagaagaaagtgttagagaaaggagaaactcagaaagcatctaaattcaccactgaatccaggtgagtgctattttgttttgcgaatgggcagtttagtggctgaaaaacagtcctatagatgacaatctgagatgtgattatttctatcttaaatgtcagacttctaaaaatccaagcagtaatttttcataaaatttcagatttattcctatatccccaaaatttatttcatcatggggttatgaagctttggcctccacttcaggtgaatattaaccctcaacattggccatttggcatttggccaagatatagtcagggcacctcaaactatatacttgcatttataggcatctatctatctatctatctatctaatcatccatccactcatctaaaataaaatctcatgaaataatacttgcccttattatacataatgtcctctaataatttctattatatttcattttttaaattgctcattatgacctacgaagttattttcttgacccaccaatgagtcgacacttagtttgacagaggatacccacttgccaagaattggcagcattctctaggagaagtaatgcttaaaatcagccaaccctgatattcagtttacttggcaggcagagtaggggtccagcctcatgacacaagggttaagatctcccatttcattgtcttgttctgatccacactcaataatcatcttagatagtttgccctgtggtttctgcatagtctgctcccctgtcttggacttgctgtttctgctttgccccactggttgtctgattacaactgctattcacttcaggacttggcagagatgcccttttctcccagaagccttttatgactctaggagcctgggttaggtctccttctgtgtagtcaaaactgactgtattggtcttgcttgtttactagatggtgggaactaagagcctacagactgtattttatttatctttgactccctaggacctgacatcgtgcttggcactcagtatgcaattggtaaatatctgctgaatatgcaaatatttgtctagccatgtacatattcctactagagagagacactgtcctgaccagccattcaccaactaaacattagaatttgggcttgtttggcaaatataaatgatattgtaaattcttgtcaattgatattttgggacttatagctctttctcctgtgggtttagtttgcatgagcccatcctcattaatttcattaactctggaggaatcacaaaatttagtttctagaatggcagagttgattcccaaacctttatgatttcacctaattaatgttgtcttccaaagtcttgacagcagccatctgatgtctgactgtgatatccctattttgcccccttgacatcaattttaagttcagggaaaatgtttgaaatctaaggctttttaaaatacagctaccctctatatcttcatgtcaattaaagtgatggccatagaaatcagctttaagctatcttctactttctcttgatttggtataatatctgttttctaaattgcctttgaatatttgaatttcttttgtgggatttatcttttcctttttgaagctcagttttttaaaggaaggctgttaacaattttccaaattttgtttttggtctcaaaccacattcattggtgctcaatgaacacatctgttcatttaaaaatcagagctggtcatcgcaatagactttagagatatcccaactggaacttaggtctgcatgggcctatggaattgatgttattaataaatcatcttgggttacttatttcttacttgtggtgagggagggataaagatgcaaatttccaaccaggatagaaaatgaagaatactagcacttgagcaaaaacctcaagcagaaaaatatgaagaacagaaaggagtgacaacagtggcaacagcagccatatttcagtgcctccaagtagcaacagtcttcaggatggagtgtgtttcccccagtgactggtttaatagaagcaagaaaacagctgctaaggagagctatgtgacaaggggtaggaggataaaggtcttataaatgagtaaaacaaaccttatgaaactactcgatacaaacctacaggctcaatgactttatattgttatcagtcatttcaaaaagaaaaattaaggtcttctttagagcagcgcacagagaattctccagggaatgacagagagcagaaagcagaaaatatattcagaaatgaactactgacggcatatttgacctgtgacatttttgttcttcttatcctctggctaaatttcacccttggatatatgtaaaagctcttactaaattaaatggaagttaaatgtgcatgctcataggacaaatttggcctgtagtatctttccaaggatattaataaagtacgagaagtgaaaatgattgttaggccatcagagttcctgcttcagataagaaatgctgggagagagaggagacaatgcattattttctcctttggagaggctccatgtctgtgctctctaacatcagtaccttctcactgacacttacatgagtccacagaagcatgctgtcttccaactaaacagtctgatccatgcagcagaaggctcccagacaatgtgaaagcagaatggattgtgaaatcgtcaagtaagggaaaatacggactttcattccaaggtaaaagtgtgagttatcacattaacacatctttattggtgagtgagataggaatgctaccggggaaaaagtactaggttgggaaaccaaacaagtgagtgagtctaatgtctgttagaaatgaggtgtgtatctttgtgaatgcagcaaatgacttggctacactaaccgttgggtttgtcgcctataaaataaaatggttgaggaattcgggaagggattatctagctagttctggcaaaaggctgctcatgttgcagactgaaggtagctggagcttgggaaagggtatgctggagaagtcagagcacaccctaggattaatatggtgtattctagctccaatattctgtggtttataaaatatcaaattatccattaaagtgctctactagccattaaagactatgataaaagtcataaaggaggaagaaagtcaaaacaaaacttcatctgagaagattctgacaatgttcaaaaaaaaccccaccctgtataataagagtaataataacgaactgagtaataataatttatttagtagctactacataaatgtagagctgtgttgcagatatgttacattcaccatccctaaccctcactacactctgcacattaggtgtgttagattgtattttttaaagatggacacaacaatatctcccattacacatgcttttctagaactttgtcccatcaccatcaggaggtggaatctaatttccttctccttgaatctgagtggatctgggactcatttgtaatcatcagaatgtggcagaagtcactctgcaggggttctgaggctagttcctaggtgtggctcctgtcttgttagctggaatactaactctcttgaagcctttagtgtctaaataagcaatctggctgctttgatgttggtaactgccatgttgtgagaacgctcacacagagaacacatggagaggccctgagccagtgtgaagagagataacagacaactccaacttttccagcaaattctcttcacattgttccaggtccagccaccattggactgtaaacacatgagcagcccaatgccagagctagctagctaatcccttcccaaactcctgatccagaaaaactgtcagagataataatagtagtgttattattttaaacgactatgtttggagttatttgttacttggcaatagctaaccagcagatttccgtacttttggtacctgaaattgggatattaccataaacaaaaatctgtaacattggctttgggaccaggcagcagtaagaagccagaagggacttgtagagtctgttagtgaaagcctgaaaagttttgaagacagtgttagcagaagccttgaggggcctattggtgaggcttaaaggaaagtgaaggaaatactacttgagctggagggaaggaaactctttttatgtagtagtgggaagttcagcaaaattgtcaccagcaataatgtgaaaaatagagactgtacctaatgaactcaaagatgtagctagggagacttctggaaaattgagggtgttgagggtgctatctggcttctcttagctgcctatattaaaacgagagaaatgaattaaggaaaagctattccatttttgagtggaagttggaagaattttaaaggatccggaacagccttttcagtcagcaaaaggttcttgagttaagaaatggcttcctggaaaagatgacacccacggcgagactgtaagattctttattaagacctcataaaaatctagggtagtacctctctgaccctttagacagaagttctccaaaggatcaaaagggcattcctcacagatactcacagttaaacaatagggcttctaacgactttaagggcattgctgcacagcaggctcacagggaaccaaagtggagaaggacttatcttgaagagatgcatggattttgtctaatggagtggattataaattaatatgcaggaagcccatacattttctaaggatattgtatcagtttgggctaaaggaacagagatggtataaagtgtaacgaagtctttggaacctcaaccttttacaattaggaagtaagctgagaagtttcctcagttgcaaatacagatcacttcttacggaacacaagggatgccccaaagactgcaaccaaggactcagagggcaaagccaagaaccatgggaaatgactcccaagaagtggagctgagttccagtgaaggacctggagatatgtgcctggatggattttgtaattgctgtgtctcagtgactgttgtgtgcctcccccttcctcctttttgtcttttgcagttatctaagtttggtactaggctcagaatatccattgtatgttatacatgtgtggggtggtaacttatatctgtaggtctacagttggggaaggatagttctcagggtaaagaacccaaggaacaacacctggacttgatttagatccttgaccttgagcctgatgctttctgcaagctcttgatttttatagaaaaaaatatagtcaaaaagcacagaacctgtcatatttattgttgtgacttccttttctcattgacatctaaagcactgacttaggtcttacttcctccatgaagctgactgcttcatgactgaaaataagcacctttggagcaggaaagaagcttgtgtttgcccagcacatgattcagggttttacatttattaaacattatatgcttgatgatagtgaaaaagccttacacctttcctccttctacagaacctagggaatatcctcctccttgctgcagaattcttagttccaacactgtcaatcctgaatgactcagaaactattcatgcatgataaaccatgtatattatggaattttagcactgaaaaagaccttagaggtccaatagttcaaccccttcattttacagatgaggacattgaggttttattggtcagtgggatgatttaccataaagtggttaagtgacctgcccaaggttgtgtaattaatgacagagccaagactagaaattcctcctgtcattacattccttccttcaacaaacttttctgagagcctgctatttgcaaggcatgtgacagattctttccttctctgtttccctttgtactcactagatgatgttcaacagaatcaggaagcagagaagcattcaagccagtctactgagtcccttcttagtagttctagaaaaggtgtgatgggtggaggtgttaaaactattgcccttggcacagtattgtctgtgaattggtactatttatgccatacactttgtgtaacaccttgccacagatcatcaagaactaggtaaattggctattttccaaacagaatatttttcttgctcaaggggctactttcaaattgtacacgatttcatttagttcaaaattttatagcaattgttcttaccagctgctctggcctatttcctaatctttcccaaaacctgtcactggcttgcagtaagatggagttcaactaggagctcctcctggctttcagagccttcttttggcctctttctatacacagtttggtgaggtcttggcatcttttatcaaaaatttccccactccttttgttgcacaactccctacaggaggaatattctccatttccaagaacattaagaagtttcttgatattcttggaaaaaagctcactgaagaacccacttcctctttaatcctttagggaatgcaagtgtggaaatgtggattctcccatccttaccactttcttttttgtctaatgtttattactgacttgatatatagcttggaaagtaaggtttatatctgatgagtgactctggtagtctctggtatgttatcacacactcaagagaacttaatacttatcttttgagtataaaatttcccactcatttagttagctaaatcccaggaacattgctcagttttagtcacaaggatgtttatacattaagaagtagatacatcctcttccttaagaagattttaaaattaagggtttattaaacaactgacagaaattaacactcaatgccaagaaggaaaatactgtattttaaaggttaaataaccataggcatttttggagctctagagaagaggtagatacttccaatagtatttttatgaaagaaatatggagaattacatcatttgaacaaaagcatatgttaaatttaaataacaaatcaatgcctctagaattctgaaatctttctctagaaagaaatcctaatgttccgacgtaaaagaatggggtattttattcatggagagaaaaactattgtgataatttattgttcttaatttttggttctttttaataggaaaaaaaatcaagataaatgaatggttaggtattcccactattttaaccaaataggtaaaatccataagaaatgtccttatgacaagttttttttttcattttttacagacaaaaaaaaagataagaaaaagtgtacaaatgtggtgaatccacaggtactttttaaacagcagggtagctgcaggatcatctttaatcagctcccaaacatactcttcacatcaggggagtttcacaggggaagtggggatggggacatcagaggcctcagaactgcccaatttatttagggaaaggaaatacaggtggaaaaaatctgtatccacaactcccactccatgttggtggtcactcccgagctaactagtcaccaacaacatttcctgcagatgagatagttgcattcccaaagagccacaaaatgggacaaattactgtaattaaaaccctgtttccacagagtccttgttctgctaaggcactggtggaggggtaactgtggaggactccgtctgagctctgtgtgccacgtcatcataccaaagtggagctagaatggggcagacacatgatgttgggtttagcgatttgcagcagcgagagtgcagcagcccatatgtccgcgtgtccctggaagaggaagcacttggtacaaacaaggcagcaggattgggctcagtgggaacttcctcagcagcatcctgctctcccagccccaccctagcttgagatatcagctccctgagggtaggtgaggcgattgccatcttaatatgtggtccctctttccccaggggccacctcttgccttatcccagctttccttatagtatattgcaaagagcagtgattctctggaaggttaaaggttttacgcaaataaaagaggtggggtggtgctatgatcaaataagcctgaaaaatgatggattaaacaaaacaaatagttgtatgggtggattaaaaagattaatttcctttcggtcaatctatgcagagtatgacttttttacggggaggatgtagtattttgcatctcaaacttttctgatcagagaatccctctctcactgagtttctgccaggactatacttcatggagaggagaaaaacagcttccggatgggggaggggatggaggagggagccctttgtcatgtataaatgtgaactgctttctgaaaactctgaaaagtaatggagggggataccttcaggggcctggggaccccagaataagaaagaagagtgagagccaaatgtgaaagccatttcatctcaggctgctgtggtctggagaaacttgagctacatcttcaaaagtctccctatcccaatcatttcttcaattctatcttttcctcaagctgccagcctgtttttcttctttcccttaacattaaacctctaaactgcctgctctgcttcttcgaatcccacataatcggcatcccattatgttttggctccagtgcccactatctaccgacagagatctacctaaagtccctcagatttcactgtcacatcacacttcatttgccacatgaccacaggacggatggatgtcaacaggggaggcagaaccttccaatctagactgagtttcgaatggctcaattggctcccataatagtggcagtgatagaattgctaacgttttttgactacttattctgctcagccactattttaggcacttcatattaacactaaatattaacacattgaagactcacagtacccctgtgagggcataagtaacttccttttttccttgagtggcagagtccagcccctacactgttattctccctgctcatcctcactggagggaataaagtttagagaaaagtgactacccccccaactccatctgcaagcctgagatggtcgtagggtaagggtcatctatttttatgagaaaatcttgtttacagggaaatccccattacactcaatgtctaaagccaacagaagcctcttgataatagtaaattatcaacattttcacatcaaaccagggatgatgaatataaattcgtaaacttattatatgactaaaatgaggcaaatcctgggtgaatataagtttatgcttcaggaactcatctttatattttcaagacccttcacaaaattaacaaatttaggaattccactttgatttatagcacttaatcaagttacttaaaacgtctaactcttgtacagatttacaaaactgccaccatgctagattaattgcttgggtcacaaaagaaagattccacactgatgctttacaactttatatttaggtgccttgcccgcctttgcaggcaggcttcagtgcaggagccgtgtggccatgtgcagctcctctgtggggcagcagctggactccactaaaagtggaaaactgctcgttctacattagactctctttcgcaatttcggtaagttcttcagtgacaggagccagcctgccaaaatgtcagcaacaggatttggtccaacataaacacccagcattatgtggctaatgcactgaattagagttacactgctaccctctattcctgctcaaaaacgactttccagatcccagaaaaacagatctgtcagcatgaagattgggatagctgtcaaatagagaagtcaatgctgtttaagtcccttgtcattagccaagtctggggaaggccgtaagagtttcaggcttctgatgcacccctcgcttgggttcaccagatcttatttttaacttcccaagatcctaggcagatggtttgtgtggaaaggaagaaattgatgattccatgtgtttaccaatcaatcaactgtagcacaaagcccagtgttcaggggtcctaaccatcagtctaaggcaggctcagaacccaaacctggtccatacattacaacgtgagaaatttcatccacagtgacagatcccatgaggttcgatggggccagacctctagggacaatactgaagttgcttttgacaactcttcactctcctatcatccctccccccatcacgaagtactcaagcttcctaagttttctataatgttctgacagattccatctccttgtcctctttaccttgcagtccatcccctgttctgttccacttcatgtttctgtaagtgaacatctaacaaacagattataaactattggtaactagagagccaacttaattattttggaaacttattcttgttgttcatctttaaagaaacgttctgtcctataaactaggaatctaggatgtcttagagaaaggagaattccataattcccaaactttaggttgcatcaaaatcatacaaagaacttgtaaaaatgcagtttgcctgtagtggggcccatgttcactaattgtctgcatgcagcttgggatttggcactttgagaaacatgggcctatacagagaccaaaatttttcctccttcccaattcctggatcctgcacaatctacattaaaaaaataataactcttccaatgattcagatgcagctgagctacagaactcatgatgaaaacaccagtctacgtagttcccttatctccctctagaatatctccctaatcagctgttgataattttaaagctcaattttaaagaaacagaaatccttctcccctaggtgacagagagttgcgggtgaggagagctggtcatttagaaggtgaagaaagaacagcacaatgaatgttagagcaattgtagctataacagaaaaaagaagggtggatggctacaaattctgactgcttcacaatttcttccagggcaaactttttttgtgaagggcaggatagtagattttttttcctttgtgggccatatggtcagtgttgcatctactccatctattgttgtagtgtgaaagcagctatagacaatatataaacaagtaagtatgactgtgttccaataaaactttatgtataaaaatgggggctggcccacagggtgtgggccacagtttgttgatgcctgttgtagagtcaatataataaatatttttaaataaaattatagaggaagaggagatgataactttttaggttctaacagcattttaaaaattgttataaaaaacagctagtaagggaaaatttgactagcgtacttactgaaagtgaacccccctttgtaggtaaatgagagtggcatattaaagccacctggcctttcctgtgggcacacagaaggggaaataaatagaaaaagggaaaaatatgttaatttaaaaataaacagttgataaatgctttggaaagaatgaataataacctgtaactacagggtgtgatatggagatgctgtggaaagagcaaagaatctgtagccaaaagacctttactcattattcaagtaagtcctaggcacaacctgtgggctgagcactgtgctgggcagtgggaaaactgagacctggcccttagaggggttagagtcccatagggtacaggcccctagccaggtggttaaaactgcatgtataagggtagtagagagccagggcaggatgacttgtcatagcctggaggtgcaagagggcttcctggaggtggtggcacaggcagtgtcttaaagaatgaagagcagttggccagattttttttttttaaagaaaggggagggagaaaaggtattataagaagaggcaaaagcatgagccaaaaatatgaagataagaaagagcaaaatagttagcccaagcctggggaggggagaagccttgggccaatggggctgtgtatcccactgtaggagtatggcatatctgatttacttccaagtaggacatagtaccccagtatacccagttcgtttccttaacccctgcatacaactctgtaagtagttccttccttaaaaaacctcttcaaaaatcccagctgagcatgctacctgtcttctgttttcctcctaggaccaaaatgtttggcttgagaatatgggtaagcacatcctcccttcccccttgagctatcagtaagaaagtcacaggtcaccagtaacttaccaaataaatccccacgtctgtcctcttcaacctccctcatataccttcaaggtaggtggtgatgagctgaagatagcaaaattggtttcagcttttcctgaaagagcttatgatttagttggtgagctagatatataagctccctatcacaagaaaggataaagtaactgctcaacagaggaaggtataagcaatgtactgtggtccctgggaaagaaggtggggagttgtagctggtgaggtcctgaccccacccagggagtggtggagatgatgtgtagaggtgtgtttgaagtggagcatgacatctggagtggccatcatcagggaaagacagagtaggatgcacacagatggggctagagaaagggcttggcgctgtgctgtacttgaagtataaacgttaatgtgtcagggatgggaaggcatagaaggttaactgaatgggtgggggatatccaggcagtgccaatggcatgaaaagtgattggagaagttaagaatggacacaaagaaaccagttgcaagaatacaagagagaaattattaaacggaaagacaggtacacttcacatcgggaaaagaaagtccccagagtccagagggagaactggcaagaataaataagcaattcagctgtgggagactaggggaaggaatctgaaattaggtgaagctttcccacttagacaactgcagatatcactcattgaggtagaaaatataggaggaagagctagggaaatataatgcgtgaaattggaggcacattttattaaaggtgctaattgaggcaccctgggggttttgctacttactaatgttacaatctgaggcaagttgcttaacctttctcctcctgggttctctcatctacaaaatgaggacaacaatgttactacttcatagggttctatgaaggttaaacggtaatgtaagtaaagatttagcactaagcctggcacaaagtacttgacacatgccatcgttgttatcatagggtcatctctatagaaatgggagtttggagttcaagagagaagcagagagccagaagtagagaggtggaagctctctgagaagcagagaggtggaagctctcttagaagcagagaggtggaagccctcagagaaggtaagcaggttctgagaaggacagaaatcctttggggagagaggggagtggcatataagaaatgtagcaagatggccaattagaagcagctgcagtttgcggaactcatggagaggaatggaaggggcgagtggatacagcaccttcaactgaaatatctaggttgttgcattgggactgatcagggaaacaactagacccatgaagaatgaagaaaagggtgacggcttactcgggagcaacacagagccaagggaattcccacccctagccaaaggaagcaacttcaccagtgatacctccaggtatgggaagaactgaggcaaccagggtctagagcagactcccagcaaaccacagcagacctatgaagaatagtcaggctgttaaaagaaaaacaaacaaacaaacagaaaataacaacaaatcacaaaaaccctatccaaaggtcagcaacctcaaagactgaaggtagataagcccacaaagataagaaagaatcaacacaaaaatgctaaaaactcaaaaagccacagtgccccttttcctccaatgaccacaacatctctccagcaagggctcagaactgggctgaggctgagatggctgaaatgacagaagtaggcttcagaatgtggataataatgaactttactgagttaaagaagcatgttgtagtccaatgcaaagacactaagaatcatgacaaaataatacaggagctgacagccaaaatagccaatttagagagaggagcataaccgacctgtaagagctgaaaaacatattacaagaacttcataatgcaatcacaagtattaatagcagagtagatcaagtgtaggaaagaatctcagagctggaagactagcttctggattaagacaggcagacaagaatggagaaaaaaagaattaaaaggaatgaataaaatctccaagaaatatgggattatgtgaagtgactgaatatctgtgcctgattgatatacctaaaagagacagggagaatggaaccaagttggaaaagacacttcaggaaatcatccaggagaacttccccaacctagcaagatgggccaacattcaaattcaggaaatgaagacaaccccagtaagatactccatgagaagatcaaccccaagacacaaacttcagattctccaaggttgaaatgaaaaaagaaaaaaaatgttaagggcagccagatagaaaggccaggtcacctacaaagggaagcccatcagactaacagtggatctctcagtggtaaccctacaagccggaagagattgtgggccaatactcaacattcttagagaaaagaatttccaaaccagaatttcatattgaccaaactaagcttcataagtgaaggagaaataagatcctttttagacaagcaaatgctgagggaatttggtaccacaagacctgcattgcaagagctcctgaaggaagcactaaatatggaaaggaaaaaccattaccagccactaaaaaaaacacacacacactgaagtacacagaccagtgacactatgaagcaatcacataaacaagtctgcgaaataaacagctagcatcatgatgacaggatcaaatccacacataacaatactaaccttaagtgcaaatgggctaaatgccccaattaaaagacatggaatggcaagcaggataaaaaacctagacccattgttatgctgtcttcaagagacctgcctcacatgcaaagacacatgcaggctcaaaataaagggatggaggaaaatttaccaagcaaatggaaaacagaaaaaaagcagggttgcaatcattgtttcttacaagacagactttaaaccaacaaagatcaaaagagacaaagaagggcattacgtaatggttaaaggttcaattcaacaagaagatccaactatactaaatatatatgcactcaatacaggagcacctaaattcataaagcaagttcttagagacctaccaagagacttgggcttcacacaatagtagggggagactgtaacaccccgctgacaatattagatcattgagacagaaaattaacaaagatattcaggacctcaactcagctctggatctagtggacctgatagatatctacagaactctcctccccaaaacaacagaatatacattcttctaattgccacacagcacttactctaaaattgatcacataaattagaagtaaaacactcctcagcaaatgcaacaaaactgaaataataacaaaccatctctcagaccacagcacaatcaaattagaactcaagattaagaaatttactccaaatcacacaactacatggaaattgaacaacctgctcctgaataactcttgggtaaataatgaaattaaggcagagatcaagaagttctttgaaactaatgagaacaaagatacaacgtaccacaatctctaggatgcagctaaagctgtgttacgagagaaatttgtagcactaaatgcccacatcaaaaagctagaaagatctcaagttaacaacctgagatcacaactaagagcaaacaaacctcaaagttatcagaagataagaaataaccaatatcagagctgaactgaaggagacagaaacacgaaaaccccttcaaaaaaaaatcaacaaatccaggagctggttttttgaaaaaattaataaaaatagacaactaagctagaacaataaagaagaaaagagagaagattcaaataaacataatcagaaatgataagggggatatcaccactgaccccacagaaatataaactaccatcagagaatataatgaacacatctatggacataaactggaaaatccagaagaattggataaattcctgaatacatacaccctcttaagactgaaccaggaagataatgaatccctgattagaccaataacaagttctgcaacagaggcagtaatagcctaccaaccaaccagaaaaaaaaaaaaaaagaaaaaagaaaaaagaaaaagcccaggaccagaaagattcataactgaattctcctagaggtacaaagaagagcaggtgccattcccactgaaactattccaaaaagttgaaaaggagggactccttcctaactcattttatgaggccagcatcatcctgatgccaaaacctggcagagatacaacaaaaaaagaaaacttcaggccaatattcttgatgaacattaatgaaaaaatcctcaacaaaataatggcaaactgaatctggcagcacatcaaaaaccttatccaccatgatcaagtaggcttcatccccaggatgcaaggctgattcaacaaacacaaatcaataaatgtgattcatcaaataaacagaactaaagacaaaaatcatacgattatctcaatcgaagcagaaaaaacattcaataaaattcaatatcccttcatgttaaaaactctcaataaactatgtattgaacctcaaaataataagagccatatatgacagacccacagacaatatcatgttgaattggcaaaagctggaagcattccccttgaaaactggcacaagagaaggatgtcctctgtcaccactcctattcaacatagtattggaaatcctggccagggcaatcaggcaagataaataagtaaaggatattcaaataggaagagaagaagtcaaactatctttctttgcagatgacatgatcctatatctggaaaaccctatcatcttagcctaaaagcttcttaagctggtaagcaacttcagcaaagtctcaggatagaaaatcaatgtccaaaaattgctagtattcctatataccaacaacaggcaagctgagagccaaatcataaatgaacttctattcacaattgccacaaaaagaataaaatacctagaaatacagcttacaagggaagtgaaggacctctttgaggagaactacaaaccactgatcaaagaaatcagtcatgatacagacaaatggaaaaacattccatgctcacagataggaagaatcaatattgtgaaaatggccatactgcccaaagcaatttatagattcaatggtattcccattaaactaccatttacatttttcacagaattagaaaacactattttaaaattcatatggaaccaaaacagagcctgaatagccaagacaatcctaagcaaaaagaacaaagctagaggcatcatgctgccagacttcaaactacactacaaggctacagtaaccaaaacagcatgatactggtacaagaacagacacatagaccaatgaaacagaatagagaacccagaaataagactgcatacctataaccatctgatcttcaataaatctgacaaaaacaaggaatggcaaaaggaatccctacttaataaatggtgctggaatcactggctagccatgtgcagaaaattgaaactggacccactccttacaccacatacaaaaatcaactcaagatggattaaagacttaaatgtaaaaccccagaactataaaaaccctataagaaaacctaggcaataccattcaggacataggcattggtaaagatttcatgatgaacactcctaaagcaattgcaacaaaagcaaaaattgacaaatggggtctaattaaactaaacagcttctgcacagcaaaagaaactatcatcagagtaaacagacaacctacagaatgggagagaatttttgcaatctatccatctgacaaaggtctaatattcagcatctacaaggaacttaaacaaatttagaagaaaacaaccaaacaaccccattaaacagtgggcaaaggacatgaacagacacttctcaaaagaagacatacatgaggccaacaaacatatgaaaaaaagcttaacatcaatgattattagagaaatgcagatcaaaaccacaaggagacaccatcttacaccagtcagaatggctgttatcaaaaagccaaaaaacaacagatgctggcaaggttgtggacaaagaggaatgcttttacacggttggtgggagtgtaaattagttcacccattgtggaagacagtgtagcaattcctcaaagacctagaggtagaaataccatttgatccagcaatcccattactgggtatatacccaaaggaatataaatcattatattgtaaagatacatgcatgcatatgttcactgcagcactattcacaatagcaaagacatggaatcaacttaatgctcaccaatgatagactggataaagaaaatatggcacatatacaccatggaatactatgcagccataaaaaggaatgaggtcatatcctttgcagggacatggatggagctgtaagccattatcctcagcaaactaacacaggaacagaaaatcaaatacctcatgttctgacttacactttcaagtgggagctgaacaatgaggacacatggatgcagggaggggaacaacacacaccggggcctgttgggggttgggcacgaggggagggagagcatcatgacaaattgctaatacatgcagggcctaaaacctaggtgacagattgatagctgcaggaaatcaccatggcacacttatgtaataaacctgcatatcctgcacatgtatccctgaactttaaataaaagttggaaagtaaaaaaaaaccaaatgtatatttggtctctgcccctggttcctgacacagagctcctaaaaccctcggaatttcctgagtgataaggatgctaggaacatcttttgttctaatattttatttttgaccccagttcctgatacagagctcctaaatcccttggaatttcctgggtgacaggtgtatctttcattctaatgaggtgactcttggtgggcttctggatcacttcaggataggaactggccaccagaaagagcaggccatgattagagggttgaaactttcagaccactaccctcatcttcacaggaaggggagaagggcttagagattgagttaagagcttctgggctggtgaatatatcaaggtgctgggagggcagtgtgcagagggagggcctggaaactccaggccatccccatgccttgccctgtgcctctcttccacttggctattcctgaattgtatctttataataaaccattaaatgtaagtgaagtaacttcttgagttctgtgagccattctaacaaattattgaacctgaggaaaggttcatgggaatttgtgatttatagaaggttaattaatcaagtcacaagtacaagtggcaacctgggacttgtgactggcatcagaagtggtggcagtgttgtgggactgagccctttaacttgtgagatctgatgattactccaggtagacagtgtcagaattgaattaaatgtaggatgctcagatggtgcccagagaactggagaattgctaggaatggaaaaatcccacatatttgggggttagaagtgttgtatgagtacagaaaaacagtttttttcttttaggatagaaggagatgacaaaatatttgggagccaaggatttgtggagctgttgcaggcagatgcagaaggtcctgaccttcctaataggcctaatctggtaattttttttggaggcccttggtgggctgttcctccatcacatgggacatatgcaacctgggggagggcggtatacgttttttccccacaaggccataacctaccatataactgcttgattctgtcacaggaagcttatctcctttcctttcctttcctttcctttccccttccttccttccttccttccttccttccttccttccttccttccttcctaccttccttccttcctccctccctccctgcctcccttccttccctccttccttccttccatcacactgggtgtacgtaacctgggggatgcctatatataatattatttccctaaaaggccatctcctaccacttgaccacttgattctgtcacaggaaactcttctttttctttctattctctttctttctttcctttctctctctctctcctccttccttcctttccctctttctttcctcctactcccctccccccaccccttccccttcctcctcctcctcctcctcttcctccctcacaaccccatatccctctcccttcccctccctcttctcttttttctttcttcttctgtcctcttcctctgcttttcttttttttgttgttgtgcagctaggtatcatgaaaaccctcatagttctaataaaaattggagcaaagttcacaaagtgtggtccatgtgttagcaatgcatggtcccaggtatcacccacaaagattctaacaggggagttctacgtgcattaaaatttgataatcagggtcgcttccaagatggctgaatagaaatagctctggtctacagctcccagcgagactgacacagaacacaggtgatttctgcatttccagctggggtaaattgttcatgtcattgggactggttggacagtgggtgcagcccatggagggtgagccgaagcagggcagggcgtcgcctcacctgggaagtgcaaggggtcaggggatctccctttcctagccaaggaaagctgtgagtgactgtatttggaggaatggtacacttctgcccaaatactgtacttttcccacagtctttgcaaatggcagacccggagattccctcccgtggctggctcggtgggtcccatgcccacagaacctttctcgctgctagtgtagcagtatgagatcaacctgagacgctggagcttggtggggggaggggcttccgccattgatgaggcttgagtaggcagttctatggtcacagtgcaaacaaagcggcagggaagctcaaactgggtggagcccaccgcagctcagcaaggcctctatagattccacttctgggggcagggcacatctgaacaaaaggcagcagacagcttctgcagacttaaatgtccctgcctgccagcactgaagagagcagtggctttcccagcacggcatttgagctctgataacaaacagactgcctcctcaagtgggtccctgacccctgtgtagcctaactgggagacacctcccagtaggggccgacagacacctcatacaggtgggtgctcctctgggatgaagcttccagaggaaggatcaggcagcaatatttgctgttctgtagcctccgctgatgatacccaggcaagcagggtctggagtggacctccagcaaactccaacagaccttcagctgagggggtctgttagaaggaaaactaacaaacagaaaggaatagcatcaacgtcaacaaaaaggacatccaccccaaaaccccatccgtaggtcaccaacatcaaagaccaaaggtagataaaaccacaaagatggggagaaaccagagcagaaaggctgaaaattccaaaaaccagaacatgtcttctcctccaaaggaacacaactcctctccagcaagggaacaaaactggatggagaatgagtttgatgagttgagagaagtaggcttcagaaggttggtattaataaacttctctgagctaagaagcatgttctaatccattgcaaggaagctaaaaaccttgaaaaaaggttagacaaatggctaactagaatagccagtgtagagaagagcttaaatgacctgatggagctgaaaaccacagtatgagaactttgtggagaatacacaagcttcaatagctgattcgatcaagtggaagaaaggatatcagtgattgaagatcaaattaatgaaataaagcatgaagacaagaatagagaaaaaagagtgaaaagaaaggaatgaagcctccaagaaatatgggactatgtgaaaagaccacatctacatttgattggtgtacctgaaagtgacggggagaatggaaccaagttagaaaacactcttcaggatattatccaggagaacttccccaacctagcaaggcaggccaacattcaaattcagaaaatacagagaacaccataaagatactccttgagaagagcaaccccaagacatataattgtcagattcaccaaggctgaaatgaaggagaaaatgttaaggacagccagagagaaaggtcgggttacccacaaagggaagcccatcagactaacagcagatgtcttggcagaaaccctacaagccagaagagagtgggggccaatattcaacattcttttcttttctttttttttttttttttgagatggagtcttgcactgtcacccaggctggagtgcagcggcatgatcttggctcactgcaagctccgccttccgggttcatgccattctcctgcttcagcctcccgagtactgggtctacaggcacctgccaccacgcctggctcattttttgtatttttagtagagatggggtttcaccgtggtagccaggatgggctagatctcctgacctcatgatccatctgcctcagcctcccaaagtgctgggattacaggcgtgagccaccacgtccggctcaacattcttaaagcaaagaattttcaacccagaatttcatatccagccaaactaagcttcacaggtgaaggagaaataaaatcctttacagacaagcaaatgctaagagattttgtcaccaccaagccttccttaccagagctcccgaaggaatcactaaacatggaaaggaacaactggtaccagcaactgcaaaaacatgccagatttaaagatcatcgacgctatgaagaaactgcatcaattaataggcaaaataaccagctagcatcataatggcaggatcaaattcacatataataatattaaccttaaatgtaaatgggctaaatgccccaattaacagacacagactggcaaattggataaagagtcaagacccattggtgtgctgtattcaggagatccatctcatgtgcaaagacacacataggctcaaaataaagcgatggaagaagatctaccaagcaaatgggaagcaaaaaaaaaaaaaaaaaaaaaaaaagcaagggttgcaatcctggtctctggtaaaacagactttaaaccaacaaagatcaaaagagacaaagaaggccattacataatgataaagggatcaattcaacaagaagagctaactatcctaaatatatatgcacccaatacaggagcacccagattcataaagcaagttcttagagaactacaaagagacttagactaccacacaataataatgggagactttaacaccccactgtcaatattagacagatcaatgagacagaaaattaacaaggatatccaggacttgacgtcagctctggaccaaggtaatatccagaatctacaaagatcttaaacaaatttacaagaaaaaaacaacctcgtcaaaaagtgggcaaaggatatgaacagacacttctccaaagaagacatttatgcagccaacagacatatgtaaaaatgctcgtcattactggtcatcaaagaaatgcaaatcaaaaccacaatgagataccatctcacaccagttagaatggtgaccattaaaaagtcaagaaacaacaggtgctggagaggatgtggagaaacaggaaaacttttacattgttggtgggagttcaaattagttcaaccattgtggaagacagtgtggtgattcctcaaggatctagaactagaaataccatttgacccagcaatcccattactgggtatatacccaaaggattataaatcatgctactataaagacacatgcacatgtatatttattgtggcactatttataatagcaaagacttggaaccaacccaaatgtccatcaatgatagactgaattaagaaaatgtggcacatatacaccatggaatactatgcagccataaaacaggatgagttcatgtcctttgaaggaacatagatgaagctggaaactatcattctcagcaaaatatcacacaaggacagaaaaccaaacactgcatgttctcactcataagtgggagttgaacaatgaaaacacatggacacagggaggggaacatcccacacccaggcctgttgaggggtgggggactgggggagagatagcattaggagaaatacctaatgtaaatcatgaattgatgggtgcagcacacgaacatggcacatgtatacctatgtaacaaacctgcacgttgtgcacatgtaccctagaacttaaagtatgattaaaaatttttaaaaaaattgataaccgatggactacagggaatggttccagaggctgccggtataaagaatcagaaataaaagaacctttgcctctgccaagagactgaagggtagtggtgatgttttgaaacaatatttttttaaactatattattttcttttgtcctgtgattcttttttgttatctaatataagaatttgtgcatgttttaattgctgtcctttggacatcttctggagatgctggtggcccctaaagaagggaggtatttccgggttttctgaaagttgtcagttaactctcttctccagtcctgtaagatctggagtctccaaggcctcccacctgcagcccatacctgtcttgaccatggtaggctgcacatcatagccttggctgcttaggtctgaggctagtcttgctcctcccaagtcagggttcttaaattcccagcagtgagcctaggcttgtgtgtctctctgtcacagtctttcccttactccctctatgctggcacaggttatgtttgagagttttcccccagtttctttgctaattgctttcatttcccatcagaatacaggcccaccctaagcttcagtcaccttggctgcgtccctgacatctatcctggctcctgcagatcctttcaaccagaggcctagattctctttcttgcacctctagccacagactatggtcttattgcaaattgactgattatgaggatctatatgaattcgaatgctccctttctgactttgagttttgcttgccttctggaaagaaatccactaaaacttggtaccatgagccaggcacgtctatatgtgtgttacccctgcctccaattagctcctcaataacccaaagaggaaagtaccatcttcagtttttatgtgaataagggaagtagggctcagagatgttaaataatttgcccaaaatcacacagctattgaggggatacagatgattctaacccaggtcttcatgactacaaacttcatgtttgttgttctgttcataatacctggccttctgctagtgttcccatctgagtttgccatgacatttgagatcctacagcaaatggtctgactgctcttctgggctagctagcctgcagctaggttagtttctcccagcacctgtggcatctgcatcagcttcctccttttcctcctccctagtggacccccacgtgcctaagcctgcctaagtcatgcaagtaggaggtaatggcaggctgattacttctacatgctcagtccccactcaccacaatccacaatatgttgagacattgttaccttgaagcaaaggaagtttaagcatcagggccccttactttcatgggcccctgagagggtcttagtagtatgggcacatggtaaattaggtataatcacaattagtcaaaacctctggatcttcccactcagacttccctctccatcacgtttccatctagtctggaagtgtggagtgctgagtcaccatgggcatttttaggatctggctaaggggagcatttaatctgggcttggggtgatatatttgtgtagttcttagttgcttctgttcatgcttaagtcactgctagtggtacaatttccacccactgtgccttctcccctggcattgcaacatgccaggtctagaggtctgttatgatatgaacacaccttatggcacccagtactctaggattctggtactggaataataacaaggtttgaatgtgtgggtttctaaacaacttttggccaaccacactagaaaatttgagcaatctttctatcctctctatggaaaataatattacaaaaaaagtttttacataaagtggtgatcaaagatttggcaacaaaaaatgttgagataaagtgttatagagatgtatcaagcagttaattaaatctttttctggatttggttatttgttagctttttacaatttgtaatttgctgtgattgatttcttttttcactattttcattatttacataagaaccccaatttcatacctacttttgaattcataattgtatattatttttcttaaaaggggatccccaaattgcagtccccacaagatcggatcttcccctgacagtgacatttataaaatgtctagatctaggcatgtgacttgtgaaaagtcgaagattttaagaacagctttattgttattagtgtttttctctttcctttgggaaattaaatggctcaaataaagaacaatctctgtcctttacctccctggtaccagctgtaatctagcagtgcccatccagcgtccatcagcatttaagcagaaaggaggacatgtgagatcgaaacggtcagaaaaacctctttaatgtagggcacagaattggaaaataatgcaaatgagttctctcaatgtctattagttacatacatacatgtacataaaatgtgtaagatttagtttttgcattctggggaataaccttgcaatacaaagacataaaattactcaaactttagtatgcccactaatattttctttgctgacaaacatatatagaagctgtatgtaacagtcatatagggaaaaaagatgtaatgacatctttaattatctcatttataaaactacttggatgaaatttccaaaagtaatcgttcaaactcaaggctttttttcccccccggggatgattttctctactatttggtttaagtgttttcaggttaaatgaatggatggacaaatggaaaataatataacacttgtttgtggatcaaaatttgattaatgatagaaagaccagcattgttttcactgatgattaaagtgaacaaaccaaaggaaagcttaagtaatgtgtttttacattaaattgtgatgaagtagacctataataaaattaatgctctgaaacctcaactggaaaaagaaaattatgaaacctactaatttttcaaactatatgaaaaaccttttatatataatgcacattaaattcatgtggatcagaatgaggtaaggaaaacatttcaattatgaggactggatttcatcccattcttgaagatcttcttgtaagcctcattctgtttgttcagacagaaaggctttttcacatttttatcaaacctgaatgtctagaaacaggaatgtaggctttcacagttcaggaggatttaaaaagagaactagataacaaagatcatgaataggaaccatatcggaaagcgagaaataggagttgacaccaaaacggacctttccctggcatttgatctgtacccacatgaacttggcccactctgtgccctctccttgggcgcaatcatctttgcgtgctgttgtggtccagatgtattcctcccggcttacagccaccccttcacaagtcccctgaccacaactcttttccatttctactctccttgtcaccactcctattttgattcttatcattaaaactttcatgcactatcctaatagaaaaagccatctcaaacacttctcttatatagtatgtctggtgtgacaacccggaatacgactaacatgtcatcacaaagccacataggagatgtggtttctccacccctcccactgtgagagggaaggaaaagctgccaggggtccctttcccctgctgactgactctggagaaatactcagcagaacagaggaaggctaggtcaaattccaagacaataattccagcagtaggagaatatctaaatcgactgtgagatatcatacttatgcgttattaaaatcactgagatggatctatatgtatgaaaatggataaatctccaagacatattgagtgtaggaaaaaaagtaatttcagaataatagtacctaatctgaaaatccaaaatccacaatgctccaaaatttgaaatgtattgagcacccacatgatgatcaaaggaaattctcactggagcattgtggattttggatttttaaattagagatactcaaccagtatgtataaggcaaatattcccaaaatctgaaacacttctggtttcaagcattttgggtaagagatatgcaacctgtgtctactacaatgtgtcatgtggacacagggctctggtacagagcaggcacttacatatttactgaatcttgaataaatgaatttatgaaaaaatatccagatacagtcacataaaataatgttacatgtttcaatggatatatatataaagaggaaactatacattatatatgttagatatatatttatatagtaaatacatgttaaaaatatataatcattatatcttatgtattatatgtaaaatattgtgtcatactgtatatattataaaatatctaatatattatttatattatataaatacaaataaaatatagttatacttttaatgtattttaaaagtaatgtatatattatttaaatataaataaataaaggaaatgatctcatacccacagttattactgggaaagtgggagaagcctgggagactggggtgagttgtcaaagaaaatttagtgttacttgtaaagttttaatttttttaaaaggaaaacatgtgcaagtattacttgtgaaatttaaaacttctatggcatcattcttgctaagctttatggatgtgttgccacatgcaacaaagaaaaatcttagaaaattcttatagtggctgtacatggcaaatcatgggttggccttaatgatacaatgcctagattaccagaaagccagctaactatggttggttcccctcacccctttcctgctctttcttgacctctaaaatcgcaggagttaactctcagttaaatgacagttgtacctgacttggaggggccctgggagcaaaggaaggtgagtagcaacatttcagagtagcaaatttcattctccttcctccgacactgtggccctatccttcttccactggttgatgctcctgctctccaggcctctaggaaacgggcatccatactgtactgaaataccctacccaagtgtgtcatttatcacagctaagaaaggaggtgaccaaatgaaacacactaaagtagaatgattgctatgcccagcttaacctttttaaggttatctcctttacccaaatgacactgtaacttaggcaatttcaagctgaggggaaaagaaggatattttgggcagagcacccccagctcccaccataaggttttactattaggcattagggaaagacagaaagaagaaagtgttaaggagacactgaacattggttgtagttgagtcagatgactatcttgcatttgaacctttggtaggttcaaactgttgacagtggataacaaagattgaagggaatccctctccttggacacatgaaccaccacctatggcactgtcatctcctgcctccctccacttagtgaaaaatgggaccttaagcagtgtcaatcttccataaaacaaaactattccacaaaaatggttaattgaacactgaagcaatgagtctggggataatgaggtcctgtgggttctatttgctaacggcaggaattgattatttcacactgcacatctaattaaagtggagaggagtaatgagcagtgaagttataaaatgaatatgataatcaattaggtttttacttctgcttaaaataatttagaatagcccatctactgtatattgaaactaatataatcagtttaacagaccttgatgcattcagagagaacaacagactgccaaatcctgcctatctcctcgtaggacattatcaaaacaatatcttgagccttggtgagaaaaatcacaaaaaaaccacattaggcagaacatcacttttccattatgtcatacataccaaatgctttctggtcctgcttatgtttacagaacaaagtgggtcaaaggaatttactgagatcataaagggcaagataaatgctggagctgagcaccccagtagctgctagacttgatggaattaaaaatggaaaattaacctatgactcaggaaatcaaccttttagatagttctggaacactaagtgtggaaggacattcatttaatatagtacagactaagaacagcactgtgagatttactagatgtactagaaaagcatggtaagatgaaagagctagtatgtgcacatgtgtgccttgtgtgtgtatgtgtgtgctgtgtggactatgtgagctctatggtgtgtgtacatgaaagtatgtacacacacatgcttgcacagctgtgactgaagcaatttagagttactctgtgttattatatctgagttaagtgatgagaactgcaggctaatggttaaaaaatgttcaacagctctttttcatgtcatatcagtggattgtaaaatactgtggtgacatattttactgagagttttactttaatatgaggaaaacgattgagcaacataggacttgaaatatgaagtactatactacagtcttctaaaaagaatacgctgggtgttagtttgtgatcacaaatatatatttctactgaagaaaaaggaaaagatgtcatgtatatattcaaaatccagacagtgcttgtacatcagttagataactgttaataagacctgaaagggtgagataactgttccatggcacttcttggaatgatcactgtctgacactcgttgagcttttgtgggtgaggtcattcgtatgctgcaaaatgtcactccagtcattcaaatggtaaatgcttaacttctagagaaataaaatttctaaaaagagatctgtaaacacatctcaatggcacaactggagaagaaaaccccatcatccgaaaactcagagtagccttgagttgatgctcatcatgcagtgaagatgggaaaactacagggtgaaacattaatatctctttgttgtgtctgttagcttcacaaaagcatttgacaccatgcatggaactgagctctggaagatactaggtgtggctgcattgagaagttcatgaacactcttaggctagcctgattgcatggttggtcaagttggagtggggggtaccgagacagaaaatgtataaataatacttatatttcggcttgtcagcttgaggaaactaagtgcagagtattcctgggcatctgaaaaacttccaatggaataggccacattattgatgaaagtctttgttataaaacttatttccaaaaataaccatatacaaatgactaggctctaggaacatatccacaagacatagtttatcatgtcatggttttagccagtactaagcattgacaataaatatgaagaataaataggtggatacagcagcaccagaaagactgtatatgtagcaacaaaatgttcaagggtaatgctgcatggcaggttttcctacggtgttttacagagcataagcatcctatgacatattgacaggtattctgaggcaaaagtttgagaaattctacatactataacagccctgtctccctcctggttccaaaacctgggattctgcgagtctaggaagggaaatggatggaacaaagagtagaaacctgccatgtctggtgttaatatgacatgaagatcaactgcccccacatcccaccccgctccaaacaaaacaaaacaaaacaaaacaaaaacaagccagccgggcgccgcggctcatgcctgtaaattccagcccttcaggaggccaaggcgggtggatcacctgaggtcagaagttcgagaccagcctggccaacagggtgaaaccccatctctaataaaaatacaaaaataagccgggtgtggtggtggatatctgtagtcccagctactccggaggctgaggcaagagaatcgcttgaacccggggggcagaggttgcagtgacccaagatcgtgccactgcactccagcctgggcaacagagtgaaactccatctcgaacaaacaaataaacaaactaacaaaaaaataaataaataagccctgcagaggtcatgcatgctaatgaatccatatagacttccctattcctcttccggagcagtttcttatatactagctatgaatccctttaccatggcaacatcacaaaagaaaagggccaggagaagggttaaaggtaaaagacaggattccaagttcaatttgaatttcagataatcaatgaataattttttggtacaagtgtgtctcaaatattgcataagacccacttataggaaaaaataaaataattttttatctgaaattcagattgaactgtcctctattttcgtttaataaagctggcagctccaaccaaagcacatagcctgtctatcagtgtcagaacagtgcccaacacaacacacaattctctgaggcccaagatgtttggagaagggacggttgtggaatctccaagaacctctgctcactaaaatgcagtagaataaccaaaagctaagaactcagcagattcaccgaagcacagcttcagccagtgttgcataactagaaattagggaatcagaaagtgaggaaccaaatcagcctgaaatgcagttagagcggatgtggtactatgtctgagcaaagctttctggctgagggaggttaaaagacagtgtaacaggtgacagagggcttttcaagcaatgactgaggttccaatcaaaagacaaacttcacatatgcacagtggaaaacggcttcttgcttccaaggtgggcttttcggtcacactcatttcccctcacacacatatactaattataataaatattgataacataatcacgaacacgaaaaccagctagacctaactgtcataggagcagagtggtaaattctggtttgggttgtcagaacaattgatagatgttttataaagatcatgttttttgctacaaacaaaggcagagttcatctatcgtgtttccaaaatacattccctactgaatgcactgccagaaaccattttcatctttgttggtataaatcccagaaaatcaaatttgaaaaatgaagtgctgattggaattctcaaactccagggtgaaggcagatgctgttactcagtgtaattattgtctctcatcacaggatgaagtctgattacattatggtcagagggaagtaacagttaacattgtcagataggaggtttcagcattctcagctctgtttgacccaaatcaaacagaccagaaaaagaatctccttgatctaattctattgctcttgctttagtgtctgtatgttacctctagagtgggctctgaggaggcctctgagtagtgaagacatatttaggaacttagaatttaggagatacaacaccaattttataaacatccaacttaggaatgacccatatctatgaagccgcaaaactgttgctactgtttcaggaacggcctccaagtcagtgcccccatccctaggagagctgctgcagcttctggagccacactgggttgtcaagagatgagtatgtgaggaccataccaactgtccccctaaaaatgtagggaaaaatctactggagaaagataatttccaacctcttcccaagcctttctgggcagtaccttggttccaacttccacaggatgctgtgatttcaatgagagtcagtcaatcagaagccagctgatctcctccacccccattctaccacatcatccaggaagagttcatttcaaagggaattctcagaagcatatcattaaaaacccaataagagactagatctgctgcacttaccaggcctgtaccctcaaggataatcaatcttaccatgacttttatcctgtcatctttggccacccacaaaatgcaagaccctccaggcaactgtcatcccatatattattctctgcttccttgccccacctctgtctcatcccacccattcctccttccactgctggcctccctgagaacctgcccactctgctctctggaaccctcattccattgcagtttaactctcccacacactccacattttcatggaattttccttcagccttttcccttcactgacatctcactttccccttaaggacattgccttctctggagccctatcaaggggaggatgtttattctcccacaatgtaaatatcagaggggccagagacagtgttggccttctggctcccagataccgtttcagaattaaaaactattcctccgttgagatttgtaacatttggtcccactacccactctttccagtgatgtaacttaagggtgccctgtgtatattggatcaaagagtgaaaaaatcatccagtacccccagccaacctgggctcctggttcacagttttcctacccacctaatttcttctcaatatcttgaatgactgcagcacccacaaaggaactccatttaacaactctagcctcaaaattccttaatctccaatgatctgtgtgaccacttctgtctctacttctttacctcctagttgtccatctgttacagtgagctttctgcctgcccctacactctctgagactgctttggcaaaggtcactgatcactttccacccagatccaacagattccttgaagttctcatcttacttgaccactctgcaatgtccagtactgtgaaccacatccatctccttcaaactcaacctctagctttccttctgagatcttgctctcttgcccagctctcttctgcctttcacagttctcctttgctggatcttctgcctcagcctactctgccaatactggggctccttaataagcattctgcctttggtcctcttttcctcttttcctggctacccttctccttatgaaatgaaactataactgaggcagtttcaagccttggacccccttatctgctctcatggctacaacagtcaattatacattcatttctctaattaagcctttgctttgagcgctaaagctatacattcgtttgcatagacattcccatctcgtgctcattcttaacatatgcataatttaaccaatcaaccctccctccaaacctacttttcttggaaaatggcactgtatccactcagaaacctgagtgtaatcctaggttattcatcttacctccattctaatcagttctctttgctatgtatctcaaatgtttgtctcatcttttcagtccctaccgtggctggcttggtcgaggtccttataattacgtagcttgactgctgttacaacgtcctgtctaccttccctccagtatccaaattactctgcacattgctatcagtgctctttctataacagaaatatggccatgctacttttctgttaaaaagccagaacggctccctactgccaagaaaataaagttctaaattcaaaagcatggcttttaagcatctcatgaactggtctctctttagctttgtttcttgctaaacaccatcctatccacacaaaccctacaatccaacccaaccaaatgcttttgcaacatcacagaccctctgtgtgtcctacacctctgcacatttgcttgagaagttccctaggcctcagtgctctcttctttacttccctcccctattaattctgccatatatatatatatatatatatatatatatatatatatatatatatatatatgattactctttgaagatgttgttcaactactacctcttccagacaggtttttcctaaacctatctgggaatagttggcatccgttttccatgtcccagggcaccctgtacatctgtgcaccataggtgctctttgagattgtgagccagttgacacaggtactgggtctcatttaccttctaaactccaacaccttgtacagtgtctggtacctagcttgaattcaatgaatttttattcaatgaatgaataggagccactgctcctttagttaaggataggtctttatgcttcccagtgctcctgcagtagaatgtcttatgttctccacctcatttagaatagcacagtacttcatgtgtttcacagagtaaatacatgattggcgaaagaataatgttttatttccaaagtttgggcaaggctgtgtgtgtgtgtgtgtctgtgtgtgtgaaagagagagagagagagagagatagaaacagagagagagtgagaaagagagggaccttctgttccctgacagggcttgtgctcttggcatccaaagtagaaatacagcatatattttgtcatgaaaacaatgttaaaaatagtgattagattacataattcctatacttattcaactttatgggccatattactatagagttacattgtgggctttaaagttatgtaattcagctaaattagggactacgctggtatcttggaaatcctggaaaacttactggctgtgctagatactgtgatgcgccatccagataccccttgaagaataaaggtcgtattcctccagctgcggggagcatgttagaggaaagtactcactgtcaagcctatctggggattttctcagctggaaaaaacctgcctgatttaaagccatgctccttacaggggcaggactacatccaacgactgaccattgtgagggtagaaaggccctgtccccagccataacttaggacaactctgaaaggcctgcccagctccagagccccttgttaggtcaactgaggctgttgtcagctggcaaagttgcaatacagctcatcttctccgtcctctaagtcctgctcctgtcctctcacttccacaggtgttggccccaggggcacgccctaataagcatccagctcagactttgctcccccaggaatccagcctactaatatatggggaaatgcaacctgagctcaaaataatccactggcaaagtaatttggggatgcaatgttcaataaaatgaaaattatctgtgttctgactcaggcttagtatttataatcttttatcctggagccaaaagatagggttcccatgcccagaaccatagttaacttttctgttgcctacaagtaaatcagtctgggcaatttgtcttctatgattgtttggttagggttctttaccaggcctgagatgagtgccctctccccagaattttttttattttttagaaaaggtctcacgttgtcacccaggctggagttgcagtggtatgatctcagctgactgcaacctctgcctccagggctcaagtgatcctcccacctcagcctcccaagtggctgggaccacaggcatgcaccatcatgctttggcctccaaaagtgctaggtttacgggcaagagctactgtacttgggccccagaagtgtttgaatggaggtttgaaggtattcctcctatttgaagaattcattttcttgagtaggcaatattcatcctagtttatagacacaactgaatataaatagagccttttaggctgggtgcaatggctcatgcctgtactcccagcactttgggaggctgaggcagatggatcacctgaggccaggagttcgagaccagcctggccaacatggcaaaaccccgtctctactaaaaatacaaaaattagctgggcatggtggtgggtacctataatccagctactcgggaggctgaggcaggagaatcccttgaacccaggaggcggaagttgcagcaggagaatcccttgaacctgggaggcgtaagttgcagtgagccgagatggctccattgcacttcagcctgggcgacagagtgagactccatctcaataactaactaaatagataaataaataaataaataaataaataaataaataaataaagcctttttccccaacctcagggcaaactgagaaaaatgggcatgtgattccccctacaactagatgggaaaatggaaatgttggtcgggattctacttgttttctcttggtgattctagaacaatgctcatttgttttgttgaaaataaacaaacaagcaaataacacaatacaagcaactctttttccatttcagattcattccacttagctatctcttcctttaccctctactcttcactgtccttggcagacctcccttctagtcatttccctgctgtcactggctacttggataccagagtcatgggcttcctctatatgtccatcccagctgtcaccttggacaattttaatatccatagggaataggtatgcattttaccaagcttactttctgtctctttgatgcctctggtttgaatcctctacaaacttagaatctgtgttttttgttctgatcatacccttttctccaaagagtctggaagtgatgactgaatggaatacttttttgcagaaaccctcaactatccagtcccttttcttgtgcgtttattacactgaaagacagctccatcaacctgtttatctctcccaccagattaaaaactcctgaggtgctcataaatggtgacttcaagttgaagaccttaatgggatcacaaagactactagacaaaacaaatactcacaccagaaagcagagatccgtgtacttactcactctcatgtgtgcattatctttctctctctcccccacaaccccttctttatcaggtatcatttattcatttcatccaagccatatagccttcaaataggcaggatacaaaggtgcatttctctgatgtagcacctagaataaaccttgataactgtttggtcagtactgtgctctgcaaaagtgcgattgaccacagagctatagagaagtcaatggtccatttactgattgtttctttaattgcattcatgaggaaatgcaaagatcaaagtgtggtcagttccaaaagagaggatgagatggatcatgggtgatttcaaagcagaggtaggcattcatgcttaaggcctgcaacaaagcaagctggaaagaaccttagaaacaatatgatttttattctatttctctggttgctttatgagtgagttttacctctatcaaattctccttgagcttttcttttaaacctgttagaggattgggtatattgagactttacaaatagtagtttgtaagcagtttgtaaaggcttaatatactctttgagcaagagtaaaacaaactcaaggaactgactcaaggtttgaagcagcagcctagggaagcaccagctccactgttctccttcttgtgtctatagctgcataattagcatctaagtgccagaagcactgagaaagctgggaagagagagaagcagagccttcctttatgccatgaagacctgcggtgggctccctcccctctatctccctatgttcctctcctcttctttgtttccaattactcccagcctggtctattacatttcctaaactatttacttgctctccaggcacctcatctccaatatactccaaagagttcctttaaaaatacctccccagagcacaactatcaccatagccccttctgctttggtggttctcttacaaccaaatggaaaaaaaaaatcccctggcttggcattcaaagatttctataacatgactccacttattcaataaagaaaagtaagaaattaaaacaatatgaaagcatacaaagttaaaagaagttcccatctattcctttactccctctccctaaggcaaccattctagcaatttctcacttatttttctagccttatttcttctgatttcctgcacacctccaaagctctggctaaacaaatatccctgccaactctacacgggtttccttgtgtccctgctcccaagactttgctcatattattctttttttaacttgtatttttagttgtaaatggacaaattatcattgtatatatttatgaggtacaaagtgatgtcatgatttatgaattcaatgtggaataattaaataacactaacatatccatcacttcaaatacttatcatttctttgtggtcagaatatttgaaatttactctgtcagcaattttgaaatgtacattatttattatattcattatgcagtacaatatatctcaaagtaaaagacaacacttctcccatctagttgaggctttgtaccctttgaccatcatctccctatcccctcctcccagcttttggtaaccaccattctactctctgcttctttgagttcgattgttttagattccatgtataagtgagaacatgtggtattgtctctctgtgcctggcttatttcaattagtataatgatccccagttccatctatgttgtcacaaatggcaaaaagtctttccttttaaaggttgaacagtatcgcattgtgtatctgtaccacattttctttatccattcatctgttgatggacatttaggttaactccatcacttggctactgtaaataatggtgaagtgaacatgggaatgcagacatgtctttgacatcttgatttcaaatcttttggatacatattgatttcaaatccagaagtggcattactggatcatatagtaattctatttctagtttttctaggaacctccatatagttttccacaatggctgtattaatttacattcccaccaacagtgtacaagggttcccttttctccacatcctccccaacacttgtcatctcttgtctttttgataatagctattctgacaggtgtgacttggtatcttattgcagtttttaatttgcatttcactaatgattggtgatattgaacattttttcatgtatctgttcatagactggaagaattaatattgttaaaatgtccatgttactaaagtgatctatagattcaatgtattccctatcagaattccaaaatcatttttcattgcaatagaaaaaacaaattctaaatttcatatggaaccacaaaaacccctgaatatccaaagctatcatgagtaaaaagaacaaacagcatggtcctagcatacaaatagactcatcgaccaatggaacagaatagagagctcagaaatgaaccacacatgtagactcaactgatttttgacaaagatgccaagaatacacaaggagaaaaagagactcttcaataagtggtgttgggacaactatttatatgcagaagaacaaaaccggatgcttatctcacaccatattcagaaatcaactcaaaatggactaaagagttaaacttatctgaaactgaaaaattactagaagaaaagatgggggaaaaaactacatgacactgatctgggcaataattttttagatttgacccagaaagtgtaggcaacaaaggcaaaattagacaaatggggttacataaaaataaaaagcttctgcagaacaatgtaaacaacagagagcagaggcaacctatgaattgggagaaaatattgtaagccatacagctgatcagggattcatatctgaaatagataagatatttataagaaaatccaataactctacagaaagaaaaccaataattcaatttaaaaatgggtgacctggccaggcgcagtggctcatgcctgtaatcccagcactttaggaggccaaggtgggcagatcacaaggtcaagagattgagactattctggttaacacagtgaaaccccgtctctactaaaaaatacaaaaaattagccaggcgtggtggtgggcgcctgtagtcccagctacttgggagggtgaggcaggagaatggcatgaacccaggaggcggagcttgcagtgagccaagatcatgccactgcactccagcctgggcgacagagcgagactccgtctcaaaaaaaaaagggtgacctgatagacattcctcttaagaagacatataaatgttcacattattctttaagactgagatgttctttcttccatctttgaatgtccaaattctgcccatcctttgagatttaactttcatgtcacctgctctgtaatgcttttctcaacctacttattaaatcctctccttctcctttgaattcacagagtatttcttccaattcctgcttagagcacttgttatttcagtctctgctctttgggtacaaagccagcctccactgtttaaatgtaagctccccaaaccagagacccattctccgttcaccttggcattgcctacagcatgtaccctggtaccctgggcctttctatatacacagcagggactcaacaaattctcattgaggaggagataagggtctggagcctccaggctacagctttggctttcatttcaccttttaaaatgccaatggcatcatctgtgatgagtgggttctgttggtatctcaaagagttaaaggaggtggtgagtcatcagggctctcagaacactgactggttccaggtgactatttagaataggcagtcagaaaactaaaacagaaagaaatttttaaaaaactccaaccttaaaatgcctcctattttaaagtgaacaatacaactctttccaaactacggagcggaacaatctctctcattatttcaatgaaaccaaaacagacatttaaactccaaaacaacaacaaaaagccccaaagcccctaaccttccttggccatgtcaggctgcttgcgcaatgactctgcagggctctctagggaaccatgaattcggtttcattttctaatctgaagggagttattttcagcataaattggtaaagtggaggtgaatgggaaatgagagagggttgtcaaaggggagacagtttcacagcagtttcagagatggtcagatttacttactttctgcattagaagcagccctagggacagttaatagaaactgttaacactgacataaggcagaaattctttcaaaacaacatacttattaatttttttgtatttggtttagtttatacaagcctcttgtatataaaataatggaataataaaagcctgatcagctcctagaatcttaaatattgtaatgaactatcccattacctgttgctttgccgccttgattcatccacaacaattttcatcctatttgtagttttgccaaaaaaaaacacatcaatccccaatcaatccctcccccaaatggtgagatcattatcattccatttgtgagcctacctctgcttaaagttattggtagaactatatccaataacagtgaaaacaactcaaaaaccctttcagatagaagtctcttcttcaaaactttaacctcatttgtatttggaccttacaaaaaatttccattcttttttcaatgattttctattcaagtaaactttattcattctccaaacaaaactctagtctgtctcaatagcaatatcaagggaggaaaagagttactgaaactcttgactataattataaggaaggagagtgattataagatgctgtggggaagaagaattatgagaagggagatggtgtgggcaagaagacatagaaatagaaaaggcctggcacacaacaaggggctgggcagtgatatctgaggccatttctgcatgggtacaatagtgtgtgcctttggaaaaggccagtaaacagagctcctcctctatcataagccatgaggttctaacatgagtaccgattttatttcagcagagatgccaatcccatgctctctatagccaacaatgtcaattggggaaattgtggggccagggaaggcactcacggttcttgtctccatgaaaagcctcaccagccacccagacaccagggggccaatcctcacccttacccccagcatccaatctgccccagatccctgtccactcgacctcataaatgcttctgatgcccctgcctctctctcatcatccctgtcctttggcctggacttctgctatggcctcctaacttgtcatgcagtcttagtgtcctctgtcaatcccttcttcccatgtcaatcaacctgtcgtcccagcctttcactccccagatcctaaccacacctggcttttgtacttcctaaaatgctccttccaccacaaaggcctggaaagctattcatgccattgattctctctgcttgtaatattccttctagccacatttctaccttcacccccgcttttgggattttcctggtcttaaccggaggttggcttcctggtatgtgctttctcagtaatacagacgtgtacttctgtaatcgattgttcagtggctgtcttccctgtcaatctgtacatactctgaggtcagaggctgtatttgtccatgtatattttattctgtaatatggaataaaacaagaacttataggataaagattaaatgagttaatccaggcagagaactagaatagtacctgatgtatataaggactgtgtaagctgtggccatagtaatactaattagcactatgcctagaacaaaggatgtgctctataaattatttgttgaatgaaagaggaatgaataaatgaatgaataaattaatgaattcagcaatccagatggcccccttttcccaaccagcaaagatgtatagaaaactatcacagggaggaattattgatcttcattgtctactgccatcacaataagtggtaaaaacagcaagtttggtttcctgggattttgagttcattctaccatgttgctgaaaaaatattcaaagcaaggagaaatggaattaagagataaagaattgtaatgtcacaaaatgtatttccatgcttctcaatcttgtcttaactaaaatatatgcttcttaatgagcaccatactgcttaattatttccaggctgaatccttcagaaaaccatgcatgtcaggtagtccattccaacacatgtttatacaaaacatttcatcttaggttgccaaaaagggaagggctttacccatttgttctaggacattccatagatctggttcctcaatgtgtttaagggaaaggcatcagtcacctgagtgcacatcatgctctgctggcctaacagaaacacacgcgaatgaacttgggctcccagcacagtctgtagtagcaggactgacacacctttcaaaagctggaaacaggagggagggcagccaagatggctgaataggaatagctctggtctaaagctcccagcgtgagcgacgcagaagacgggtgatttctgcatttctgtctaaggtactgggttcatctcactagggagtgccagacagtgggtgcaagacagtgggtgtagtgcaccgtgcgtgagccgaagcagggcaaggcattgcctcactcgggaagcgcaaggggtcagggagttccctttccgagtcaaagaaaggggtgacagatggcacccggaaaatcgggtcactcccaccctaatactgcgcttttctgatgggcttaaaaaacggtgcaccaggagattatatcctgcacatggcttggagggtcctgcacccacagagtctcgctgattgctagcacagcagcctgagatcaaactgcaaggaggcagcgaggctgggggaggggcgcccgccattgcccaggcttgcttaggtaaacaaagcagccgggaagcttgaactgggtggagcccaccacagttcaaggaggcctgcctgcctctgtaggctccacctctgggggcagggcacagacaaacaaaaagacaaacaaaaagacaaacaaaaagggcacagacaaacaaaaacaaaccactgcagtaacctctgcagacttaaatgtccctgtctgacagctttgaagagagcagtggttctcccagcacaaagctggagatctgagaactggcagactgcctcctcaagtgggtccctgacccctgactcccgagcagcctaactgggaggcaccccccaataggggcagactgacacctcacacggccgggtactcctctgagacaaaaattccagaggaacgatcagacagcagcacttgcggttcatgaaaatctgctgttctgcagccaccgctactgatacccaggcagatagggtctggagtggacctctagcaaactccaacagacctgcagctgagggtcctgtctgttagaaggaaaactaacaaacagaaaggacatccacaccaaaaacccatctgtacatcagcatcatcaaagaccaaaagtagataaaaccacaaagatggggaaaaaacagagcagaaaaactggaaactctaaaaagcagagcacctctcctcctccaaaggaacgcagttcctcaccagcaatggaacaaagctggacggagaatgactttgacgagttgagagaagaaggcttcagacgatcaaactactctgagctacaggaggaaattcaaaccaaaggcaaagaagttaataactttgaaaaaaatttagaagaatgtataactagaataaccaatacagagaagtgcttaaaggagctgatggagctgaaagccaaggctccagaactacatgaagaatgcagaagcctcaggagctgatgcaatcaactggaagaaagagtatcagtgatggaagatgaaatgaatgaaatgaagcaagaagggaagtttagagaaaaaagaataaaaagaaatgatcaaagcctccaagaaatatgggactatgtgaaaagaccaaacctacgtctgattggtgtacctaaaagtgatggggagaatggaaccaagttggaaaacactctgcaggatattatccaggagaacttccccaatcgagcaaggcaggccaacattcagattcaggaaatacagagaatgccacaaagatactcctcaagaagagcaactccaagacacataattgtcagattcaccaaagttgaaatgaaggaaaaaatgttaagggcagccagggagaaaggttgggttacccacaaagggaagcccatcagactaacagcagatctcttggcagaaattctacaagccagaagagagtgggggccaatattcaacgttcttaaagaaaagaattttcaacccagaatttcatatccagccaaactaagcttcataagtgaaggagaaataaaatactttacagacaagcaaatgctgagagattttgtcaccgccaggcctgccctaaaagagctcctgaaggaagcactaaacatggaaaggaacaactggtaccagccactgcaaaatcatgccaaaatgtaaagaccatagagactaggaagaaaccacatcaactaaggagcaaaataaccagctgacatcataatgacaggatcaaattcacacataacaatactaactttaaatgtaaatggactaaatgctccaattaagagacacagactggcaaatgggataaagagtcaagacccatcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatctattcaacaagaagagctaactatcctaaatatatatgcaaccaatacaggagcacccagatgcataaagcaagtcctgagtgacctataaagagacttagactgccacacaataataatgggagactttaacaccccactgtcaacattagacagatcaacaagacagaaagttaacaaggatacccaggaattgaactcagctctgcaccaagtggacctaatagacatctacagaactctccacccaaaatcaacagaatatacatttttttcagcaccacaccacacctattccaaaattgaccacatagttggaagtaaagctctcctcagcaaatgtaaaagaacagaaattataacaaactgtctctcagaccacagtgcaatcaaactagaactcaggattaacaaactcactcaaaaccgctcaactacatggaaactgaacaatctgctcctgaatgactactgggtacataacgaaatgaaggcagaaataaagatgttctttgaaaccaacaggaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaaacccttcaaaaaattaatgaatccaggagctggtttttttaaaggatcaacaaaattgatagaacgctagcaagactaataaagaaaaaaagagagaataatcaaatagatgcaataaaaaatgataaaggggatatcaccactgatcccacagaaatacaaactaccatcagagaatactacaaacaactctatgcaaataaactagaaaatctagaagaaatggataaattcctcgacacatacactctcccaagactaaaccaggaagaagttgaatctctgaatagaccaataacaggagctgaaattgtggcaataatcaatagcttaccaacgaaaaagagtccaggaccagatggattcacagccgaattctaccagaggtacaaggagtaactggtaccattccttctgaaactattccaatcaatagaaaaagagggaatcctccctaactcattttatgaggccagcatcatcctgataccaaagccgggcagagacacaaccaaaaaagagaattttagaccaatatccctgatgaacattgatgcaaaaatcctcaataaaatactggcaaaacgaatccagcagcacatcaaaaagcttatccaccatgatcgagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaatgcttcatgctaaaaactctcaataaattaggtattgatgggacgtatctcaaaataataagagctatctatgacaaacccatagccaatatcatactgaatgggcaaaaactggaagcattccctttgaaaactggcacaagacagggatgccctctctcaccactcctattcaacatagtgttggaagttctggccagggcactcaggcaggagaaggaaataaagggtactcaattaggaaaagaggaagtcaaattgtccctgtttgcagatgacatgattgtatatctagaaaaccccattgtctcagcccaaaatctccttaaggtgataagcaacttcagcaaagtgttaggatacaaaatcaatgtacaaaaatcacaagcattcctatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcaagcaaccaatgactttcttcacagaattggaaaaaactactttaaagttcatacggaaccaaaaaagagcccgcatcaccaagtcagtcctaagccaaaagaacaaagctggaggcatcacgctacctgacttcaaactatactacagggctacaggaaccaaaacagcatggtactggtaccaaaacagagatatagaccaatggaacagaacagagccctcagaaataatgccgcatacctacaactatttgatctttgacaaacctgagaaaaataagcaatggggaaaggattccctatttaacaaatggtgctgggaaaactggctagctatatgtagaaagttgaaactgaattccttccttacaccttatacaaaaattaattcaagatggattaaagacttaaatgttagacctaaaaccataaaaaccctagaagaaaacctaggcattaccattcaggacacaggcatgggcaaggacttcatgtctaaaacaccaaaagcaatggaacaaaagccaaaattgacaaatgggatctaattaaactaaagagcttctgcacagcaaaagaaactaccatcagagtgaacaggcaacctacaacatgggagaaaattttcgcaacctactcatctgacagagggctaatatccagaatctacaatgaactcaaacaaatttacaagaaaaaaacaaacaaccccatcagaaagtgggcaaaggatatgaacagacacttctcaaaagaagacatttatgcagccaaaagacacatgaaaaaatgcccatcatcactggccatcagagaaatgcaaatcaaaaccacaatgagataccatcttacaacagttagaatggccatcattaaaaagtcaggaaacaacaggtgctggagaggatgtggagaaataggaacacttttacactgttggtgggactgtaaactagttcaaccattgtggaagtcagtgtggccattcctcagggatctagaactagaaataccatttgacccagccatcccattattgggtatatacccaaaggactataaatcttgctgctataaagacacatgcacacatatgtttattgtggcactattcacaatagcaaagacttggaaccaacccaaatgtccaacaatgatagactggattaagaaaatgtggcacatatacactatggaatactatgcagccataaaaaatgatgagttcatgtcctttgtagggacatggatgaaattggaaatcatcattctcagtaaactatcgcaaggacaaaaaaccaaacactgcatgttctcactcataggtgggaattgaacaatgagaacacatcgacacaggaaggggaacatcacactctggggactgttgtggggtggggggaggggggagggatagcattgggagatatacctaatgctaaatgacaagttaatgggtgcagcacaccagcatggcacatgtatacatatgtaactaacctgcatattgtgcacatgtacccgaaaacttaaagtataataataataaaataaaattaaaaaaaaaagctggaaacaggaaaggtgtctctgagttggcccaaccctgccaaatgctattacgtgacaaagttttattaatttattgtcatttaagtctgtggtattattattttattatttttgagacagagtctcactctgtcacccaggcaggagtgtagtggcctgatcttggctcactgcaacctccacctctcgggttcaaatgattctcctgcctcagcctcctgagtagctgggattacaggcgcgcaccaccacgcccagctaatttttgcactttttagtagagatagggtttcaccatattggccaggctggtcttgaactcctgaccttgtgatctgcctgccttggcctcccaaaatgctgggattccaggcgtgagccaccgtgcctggcctggtaatatttttaaatagttttcctgcagatagttcatttggatttataaataaacgctgcctcgtcatcatatcagcaatatctgatcttatttgttccctttctctaaaattaacttttttactgttaccctgaacccatctattctaatgctgaattctgagaaaattcatagttggttcccctcagttcagtcatcagtttgggaaagtggtatttaatttaagataattgatagttataaaaaataattctaacaaagaaattgagccttcatcctgatacatgtaaaactaaagggtgctacatcgaaatccattacagacaatgagaaatactggaaatttagtcaactgacctattttcttgtggagcaaactggatcttttccccaaaatgctgaagtcctgggcctgtgagggagctgaggatagtcgcattctttgaccttcttctgggtttcctaggcggaagggtgggctctgggactgtctgaattcacgtctatccatgccagccaagtggagagcctcctgagctttcttcttttctttttttaacatgttgaccaggatatctgaaacttgacttaaggatttaatgcctgatgctagcttatagtaatcaaaacacaaatgtcctaagtgtcattaatgttcctaacatttgctatttatcatgtggtaaagactgaaggaaggcttcaacttcctgaagccccatatatagcaatggacaatttaggaggcttgctttctatatagcaccactgtatgaaaaattagcaaacgcaaggtctttacaatgttctgagtttaaaccaggtacatcttaacaatcttatgaaagtgcttataaaaagtcaaatgaaggctgaatagtagtagacaataggctatgtatacatcttcccagataaaagatgaatttactcacatagcccatgtatatgtatcagccccctgggcgagcacgcgcctgctcgggaggcagcagcagagcagagcgggaggatggtgaaacccacccggctggcagatcagccgtcttcatcctggcggccggtgcggtgacaaaggttcagccagagcaccccaagctcagcacgtgcttatgtagagttcactcagatgggggctttttaagccactaatgtttggtctcaaatgtaacagaaaagaagcgaattgttagcacagacatatcattttaaaatgcaccttctgtaggccattgagatatgccaggaccattgatgataaaggataaaaccactcccctctaccctacttcagtgttcattctgtgttcacgatgcctagaactctaagagatttttgtccaatctgctaaatggaaagactgtaacccctactgagaatctcagagctctaactgcatatggggtaagatgaattcaatgcctttgcatcgctagagaaggctcattaaaatgggagtctaaatgtggtatgtgtcctaaagggtaaacttttcagaggaaggggatacagagagcactgctacttagaaaggcggacaggtacccagatgatatttattcttggacaagcagcgtggaagtcatttgaccttcatcttcctcctcagctttaactcccacttggtgatttctggaagcataatcaggtttgctctctctgatgtggcttccattccttgccccaaaacaacatgtacttaccaaaaatgttcacagcttcttagtgtctaagcattaacatgacagagaagaacagggctctggccgaacacgctgctcctctttgtatggaactgattaccaatgtcatcatacacttccattggttcacacactgtgatggcaatatccatcgactccatcgactcactcattcagtgatatttgttggagcttgtgctatagatgccaggccctgttctaggcatcggtatagagcaatgacaaggcagagtagtttcttgctctcacgaagcagacgtcctactggggaaagacgtctcacacatgcatgcatgcacatgcacacacacacaacatcagaatgccacatacctaatctgaagaaggtcaagggtgactgggcagctgctatacattgggtgctacaaaaggcctaagagtgacctttaagctgagatctgagccataagaagaaccagccagaggaagaacatcaatgcagaggagaaacaggaagtttccctaaagagaaacaggcccggaagtggctcccaatgctacagtcctgtgatcccacttcctacaatgcacaggacagctcctgagatgaagaattatccagccacaaatgttgatagtgccaaggctgaggaacctcgtgttagaagaacaacaagaaggtaactgtgactgaagcctagcacacgtgggacgaggcatgagaaatgaggtccgtgggggaggggatggtgtaggcagggcaagatcatccaggccctcgtaaaccagagcaaggagtttggtttcattcttcatatcatgggaagccccttgaagactttaatgagaataatgatgcgttctgatgtacatttcataaagatcgcaatacgaatctatcttctgtgctgccttccttcttctcacctttcccctgtcttcttgtcctccctattcccatttatgggaatggcctttgtgctaaacactttgctgggtcatggatccccctgtcatatattttgtgaaggggtgtgtgaactttattcaagctgaggatgtcaccaacaggacatcattttcagtctctttccaagaagatctgatgtcgttcgcagtcatttgggtgcattactgtcttttgtgaaactcaattataatcactttttttatttcctggaagccatatctttcccatttgttgtgtcacagtcttagccttctgggttctacaaagaaagatatgaaaacatcctccaacctgactctgaataactgtgagatttcaggaggttttcttagtcgttggtctttgataagcacagctttgagaggattaaatcttagctgctattcttccttcttctgagattgcttattgtcttcatagtcataactccaattacatcacactccgcagtgctcaaagcacttatgggcttttctcagcaggtcttatggtcctgctcctgaagagtagaaagcaatgtcactgagtaggtacagagctaataaatgaagagctaggatttcaatccaggtatgaattgaagtgcagtattctttccactctgactcccatacaccatcattttgaataagagtgtcagatggagggagccctgtttgaattgctgacagttagtaaagaatctagggtaaccccacatgaatggtgatgcctggattcaccacagtgaaggaggggaggtgatggatatctctctttcactctcttttaaaaataaacatataggaacaaacttggactgttctctctctgtcatatctcatttcatccctcctatatgcacagacattcataagcccagaaggggattaagaagttggtaggagtatttaaaggagaagatcctagactaggatcaaggccaggaaaagaaacagagctcagactggggctggggccaggactgaggtccaggccgagaccatgccaggagatggatggtgtaagaggaaggaaaaggaatgtgagggtgacaacaccatgggcagcactgacggatgaaggcttgtgtgtgtgtgtgtgggtggggggggattctcagctgaacctactgttccctggccagctaaaactcacttgaatctgacacacaggatctgctgatactcaagtaaaattagagaccaaagttaatcaggcaacatgtctacctcccatttggtttgttcttacctctttattactgggtttcctttatgtagactattttcatgcattttgcataaatagctgaagctaaagcatcttttggtaatttaaaaaaagaacaaaaatatctgtttataaagaactgaccgaaaggatttcttgtgcatgtttaaattctgcaaacgtaatgaaaatgtcaaatctttttacaagaagcttgaaagataaaatgagaaacaataccaaagaaatatctgggaggcctgagttccacccaaccccacaggggctccatagaagtaaccacttcgtctgcaactggaggcagcacatgctcccatgggctactaccactttcagcacccaaaatacactgcctcttggagccaataagaattctatcttatttggtactgatcagtttagctaaaaaaaagaattctatcttgaacactcatctatactcacttccaaatttgggaacatttgtaagtgtaactcaaagcagtagatctggcttttaaataaaaagttacatttaaatcaatctctgctcttcataagctaaataccatttgtcatttttcagccatcatttgagtttcacccacgcaccagccacagattctgggccatggtgagtctgtggtcagcctgttgtctggtcagcttgctaaagataaccagctaacttactggctcagggctaacacaaagagaacacaacagaggagccaaaaaatatattttaaaaaattaatgttaaaagatggtgtaaaaaggctcatactttgaaataaactaaaatgttccctgcaagagtaactatgtcaggataaaaacaaacacatttttttcttttatagaaactctttttcactggttgcaatactttgctgaagggacctttgacttctcaatggaaagaagcaatgtgaaatggaagctgggtggggagctcagccatgtggctcaggaaagactgctgtttacccctttcaaaccaggatagaggaagtttcttcatcacttcagaaaggatactgatttcgttatctctctgtttcagaatatctcgtagctttctatattcttcttcttttaatggttcttgacaatcttggtctttgctttcagaggagactgtattgttttcaaggatcttcttgtcattcaatagtttctgtaagataaaataagagcttagtacccatatctctagtccaaatttctttgtttctttgactctttttcctttaacaattccctgcacacatcaggcatgtgtgacctgtctgatgcaggtgcgatgtctttgcgatgcagttgcttttttggcttggcatgttttctcccttctacctgccttctttcccctcctccttcctcaaccctctctccccatcttatctctccttccctaaattgggaaatgcctactcaacattatctcttcttggactcctttccctttctctatacatcattccacttaatttacacttttattctagtacttatcatgtattgtgattattctttacaacatctgtcatctccatgacttgcttattaaactttgtcttatctatacctggcccttagtaactcacaacaaatgtttattatcttaaagaagtatgcaaaaatacaagtgagctaaaagtaaaagtgattatattcccagccccttgtcatgaaaattaaaacctaaggcagagaaaaactgaaatatcatatgggtatatcaaactgctgaaaaaatacagaatgcaattctcttgatatagcttgaaaatagttttttaaaaaatatggaactattctgtgtagaaggtagagattcctgacaaaagaattagaagtccatggcctgagtttatttattggcaagtaagatacaatctctgaagaaactcagtgataatcatactattgattcaaagatcgtaccattttctggacatgcaatgctggatcctaaccttccaagaactggtcaactagaaaagtttttttgcagcttgaacatggctgaaaatggcttctattggggaaacatttaagtttacctttaaatgatgaaaacagtgatgaactttacgcatatccgcgccaacctctaatctactgtctgaatcctggtcttccaaaaaggatgttattagtttttccagcctaaaaatacataatgtatgagaagcaactgtgagctagaagctttaaaaattctaatggcattatctagttggttaacatttgaagtacagaatattgttcccacctctttacagaagtacagatttgagtataaaaattaagggaaaagaaacattgacaaagtgaaatttatagtgaagccattatttgactaatttccagtgaattttcttatgaagctttcaatatagaaatcatttgatttctatggtccatccattctagccactctgaatttctatgcccctgtgcctggctgctgcattgctagaaaaagtaatgagaatgtattttaaattaatttcactaaaaatgcatgtgactccgcttcagctggcacctcagtgataccccactatttttttaatcattccaggtgatcttctattcttcacagtgcctattccaaatctttctacagcccccaagcctgccactactctttcactctctgtcaataaagtcacttctttattggtgaaagccatgcagactcctttgtttcctcctcctttgcctcagagtgtctctgcctcactgctcaggccctcttcctgcttttatagattgtggatattcttcctctttctgaaggccagtttctcccctgggctctctctctgcttcttccagggcttatctagttaattacctcttttcccttaatcatctctttatctcctctctatactgactccttcctctttgcttacaatcatgttgtttttcctatcctaaaacaaaatgaaatagaaaacaaaacacctccctttggagggaccatccaaccactctattctaaagtcctagtttggccgggtacagtggctcacacttgtaatcccagcactttgggaggcccaggtgggcggatcacttgaggtcaggagttcaagaccagcctgaccaacagagtgaaaccccttctcttctaaaaacacaaaaactagccaggcaaattggcatgtgcctgtaatcctatctacttaggaggctgaggcaggagaatcacttgaacccaggaggcagaggttgcagtgggttgagattgtgccactgcactccagcctgggcaaaagaacaagaccctgtctcaaaaaaaaaaaaaaaaaaagtcctagtttattcatagcaccacgtgccaatgtagcattctagtactttgtatcagagggaaattcttggctcttatttatctttgttcttcccgtccccctaacattaggttctcaacacaaatatgttcactagttactggattcactgccatggacatggttcccctctaggttgagatggaactcttaataaggaaggtttaaggatgacaatcagtatctatgatgttatgtatcataatacagcagcagcatatctttctagtactattatgaaaatatttgcatactttcagcatcttttaaaactgtatctacacatttctcttctgctgttactatcagcccacccagataaaatgtaatgatttctatcatagaacagccttggatttcatttgtacctcttgtaatttgtgacatgtgacagctatatatttacaagtgtgagacaatttataccgttacttttaaggagtttctttaggtgaagagatacttatttgcactatttgctgattgacagtgtgtttccttttggattagagcttcaaaccatcagatatacagagggatttattcctgatacattttttaaaaaatcatgtaaattattatgaaaacacatgtttatgaacaaaattccaaacaatgcagatgtgaatatattaaaaagtgaaaactcctcccactcccctgccaccattcccctccacctttttttaaaaaaatttgataccttgggaaatccactgttaacagttaaaatatattattcttattcttaatgaagcagatacctatatttatatattcatttatacattttggtttgttgtttttacaaaaatgagatcatagtctgaataatgctttacatcattatatttctaaagcatttatggcagatgagcttttccatcagtgcatacacagtaaaggtatttcatttctaatggctatataatattccatactatggatgtactactattcctctcttgatggacactgaggtgacatactcatacagttgctactttcctctgtaacccatgatgagaccttgatctacaaacctgacttaatgaggtttaaaaaatagtaatgtttagctacttgtattttccctgaatacatagcagaaattttgaaatttcaaaaatcactgtgggttctagaatatacactcgttttctggagtgaaagcactttgtgatttccagagtccataaaatttctagcagacaatattaagttggaagtaatggttaatcaattctttcttcttgctttttctttagaaaacaacttttgaatagtttaatcacaagtacatattctaggaaacgttctctgaaggaaggctgaagtggactcctagctcagaaggaaacctcgtaagatacaagcctgctgatgagctggaccactcacagattgctcacgtgcactgggctttggtattccatcaaggctcctctcccacacagcaacactgtagaatacaaggaggaccagggacatgatccaaagaaatgggcaagaacttctgcctgagtaaaagaactgatcgctttactctttctgggacttgattagtctagtacataactaagaatgaagatcagccttttgacatgctattttgctttcagcacttgagaacacaaagaaacatgcctggtctttccttcatacatttgatttactgttgggtttatttccttatcaggcaaggacttggtctaataattaaaatgcagaaaaatgcttaattcagatgttttcgttgtactcctctagtagttgagagtgaacaaatgaacccaaattccccacattttcctatctaccaaaatagtgtccaagtttatacctagtccctgctccctctaaggggtctcccagctgccagaactctgctgaacagtggaaaactgtttgcagaaaagtctcgctaaggaggtcaagtgagtacaataaagtctattttttaggacaagcccaagtcaacaagagctttccttattctctacttacactagaagaaaagaaggaagaaaaaagaatcctaggggaaagagaaaagaaatacacaccattcagtaacaagaaatattgtaataatttagtgtgtctgaacacatgacttcgctgatggtaggtgatggtttgatgtctggtgactatacagatctcagccaaattgactgctaatgaaatacctctgacagcctgtgtcctggttcagcaactccatcatattagaaattttgatatatggccacataattagaactgaccatatttcctaacatgtgctttaccttcttgaggccactgcactcccctctctgctccttatattccttgtacaaaaaaaaaaagctctctctgtagccatatgtccctaaaaatttaggtttaatagcatgaataaaaagacaaagcaagcttctcatcattaatgacagccaacattgagcatgcactaaatgctggacactcttctgtgctatttgcatatatcatttccttaatttttacaacaacccatgagaaaagtgctattattatccccatgtcataggtgaggaaactgaagcacagagatattacgtatcttgtccaagctcacacagcaagcacacaggtaaaatccaagttttgaagcacaatacttaccatactataacaaagttactcaaagtatttgaataccatattgggtgatgtatttctaaaagggagaacccacacctgcaagcattcattgaggaggcaaataggtggacgaagaagtgggaaataactgaaaagcagttgcttagatcttagcaaggccacggacccccatgacttgtaacggcaaaaaaagttgggaaggaatcagaatgtgctgtatttgaagattacttaaattaattatggcatagctatgtacatagttaagcagcaatttaagtgacggcaaagtgttgtacttattgacattaaaaacactcatactatatatggatagcttaatgatgaatccctctgcagggattctgcaagtacactgtaacacacataagaagactgaagagacaaaaaggaaggaaaggcatgagggaagggagagagggagggaggggagcagatcagcagtcccgaaatttttggccagctagttgtctttggctcaagaacattcatcatcttttgttgaaaaaagagaccagcgacccaagctaacctcactcttcttcaatatttttatgattatgttatgtttaactgttttaaaaaattcatcatttatacattgagtgtgattaagatgttctcattattctcaaataatctttgtaaaaaaatatgaacatgttcgtgtcagcagtgggttctagaaattggctagaaaccatatctctatggcactggctgtgggaaagttgggagaacagaagagtgggatattagaaacaagagcaaacctaacccagggcatggaaatgctggctgtttccaaataactgggacagcaatgggaggtgtgccccaggagtgggaggggagcctggtgctgtaactggggcagagatagcagaagcatgcagcagcacagtattattctagagaatttactataaacaaggctcgggggatgcaaagcaatgggactgcatcctctaatatcaagctggaaatagtgagggggatgaaaaataccccagttggtggggcagagcttccctgtggtagaaccatggaaattggtattccagagctgatggttcttagctcaactgtctcctcactggtttggggagacgatttgacagctcattccagagagctagaaaggagttctgatttataaaactaacttgtattaattataccaaatacatatcaaaatctgcctcactgctctaaatcattttgccacttaaagatgtctccattgagggtgagttgtctctgacagggttaaacatggggatactgacaaactaaagctacatattacctgagcaaagatcgggaaaagaatgggagatagtgacaaagatataaaaggatgtaaaggattattttctatggctgaataatactccattgtgtacacacaccacattttctttatctattcatctgttgatggacacaggttgatttcatatcttggctgttgtgaatagtgctgcaataaatatgggagtgcggatatctcttccatatactgatttcctttcttttggatatatacccagtagtcggattgctggattgtacagcagttctagttttagtttttggaggaaactccatactgaaatcctgtcatttgcaacaacatatttagaaatggaggatattatgttaagtgaaataagccaagcacagaaagacaaatatcacatgttgtcactcacacgtgggaactaaataaaaaattaactcatggagataaagaatagaataacagttttcagaggctgggaagagtagtggggagagagaggataaagagaggatggttaatgggtacaaaaatatagtcagaaggaataagatccagtattcagtggcacaatggggtgactatagttaacaataatttattgtatatttcgaaataactaaaagagtggaattggaatgttcctaacacaaataaatgataagtgcttgaggcaatggatatcccaattcctctgatttgattattacacattatacgtttgtatcaaaatatcacatgtcctataaatatgtacaactaatatatatccataatattaaaaattaaaaaaactttagaaagtataaaaggaaacttgataattattaacttaaaggaatatgataactaggaagaattgagagaatagttacacaatttaaaaaattgactgtggtagcataagaaatatggcagaatgattggttgaatgatcttcattcatcaaccctctgtgggttaaaactttctcatttgtaaaatgtgtagaataataccatctttacactattagctttacgaaatcagataatgcaaggaacgaagagagaatacgcctggcctattaaggctttgctattcgactggaccaactttataggaatcggctatgagacttttgaaaatatagaattttcggctccatcccagacctcctgagtcagaatctacatttaacaacattcccaggtgatctgcatacacactaatgttaagaagcattgcaacaaggcaactggttattgaatgttgacacaagaatacatacacatcttttcagttcggaacaccaaacaaagatgtaactggaaatgttctgtgaaggaggaactaacatcccttgatagtcaaccatgtcctgagcactctgctagtgactttacacatgttttcttatttaagtggaaaaagagccctttagggactatcatagtctggttctctttatacccgccttgtcccagttattttattattactttcattcaatatccattaaaacatgtcaggcactttcacatatattttgttattcatctgttccataagtctataaattattatcactctttcacagatgggaataggaaagctaagagaagttcagtaacttgcatattgtcactaaggtaggaaattgaaacactgagatttgaaaacaattcttttgactcaagaatccccactctttgcattcatactacaaagactctcagttaattcagaaaagtgctttccacatgccataatctctgacatactatatttgtattttcaatttagaatgttcctgtgaacttttaaccaggaaagatgcaaacaacatagttaatgagaatatcaaataaacataatgagatcatcaaataaatagtaactagtctgccatattaaaaaaaagagtttttaacaggctgaaatggtagggggcaaaggatggggttctttttgggatgtggccctttaaaacatacagtattgagatagcaggtaatgcacaaaaggaaagttcagataacaataaattcataattatgattaactacataactacacaatccaccaaggacatgaaaagctgaaggctgagattgtgccaataggactatgaccaaaggaaactatacaaaaatttttcagggtcattagtttcatgtttgctttttctgagattctgctgaaagaatcaattccaattgacttaaaagtagtcacttcaagagtttttccttttgcagtttcctggtctgtgacaggtattatatacattatatgctcccctagccctaaccagttagtgaaagacatggacccttacatgcaaggaattgagttcaatgtcagcaactctgttggaatgagctctttttttaaataacagtagggggccagaaagttcatggttttggtgatgcagaggaaattcctatagagttttccttctgtagggtaaattcatcttagtaatgcatatttccttcacctcaacaaaagcacagtcatgtagtacctcaaatgcagaaatgcacaacttcttgatacttttagtgatttgaaatagcaaatgcgaaaaatcaaaattaaaatccagactggtttgcctttttaatggtgaagataaggcctatttataggtgcatgtatgcattcatggccaggtacttctgtttacagaatttcaaaaactattttgaaataatttttaaataaactaagacaactttaaagacagtagggcatattttacaaggtcctttaaatgcaatgatgaagggttttgaaaagttatacgattgattttgtttttgtcaatccagattttcatatatccaatttacttaaaggtatatatgtcttatgactaaacattttaaattcagtaggtagagacgggctcaggagtctagaacaaatgtaaataagagatgaaaatagctggcctggctgaggagaagcagaggctgggccacaggcactgctgcccctggggaccttaagtgggatacgagaagtatttgagactctcaccaccaagctcccaccacttctgtaggaggccaaggacagcgtgcttgacctcaagctggcagctgacatcctatctgtgtgccagaaaccgcaggtttacagcattaccaatgtattggaaggcatagggctaatggagaaaaaatatccaagaacagcatcagtggaaaggcatggggcctggctgcaatagggctggagattgcagacaagctgactgagctcaaggcagagatcgaggaaccgcagaagcaagagcaaaaaccggaccagcacaaggtgtgggggaagcagaacatctggaacatcatagctgcttggcctatgtgactcatgaggacatgggtagaggctttgctggagacaccctcctaccatactggccacacagaccctgtctggtagcagcccacaggcacccatcccagaagtccccagtgggcaacagtaagagattcacctgaacagcctgactggccccttcaaggctggtgaacaaggaggcatggagctcaccacctgtggctgtgtctatgccgtcaccctccagagcccacctgctgtctctggccctccatctctgcccaagccttccctgttccatctccaggaaacctcacatgcatgtaggactcagttgaccaccccttacctctgaccctgacagctccggagcccagtggtgagctgagctcactcccactgggccggcagcatgagacactggccccctgcagtcttctttcctgctggatagcagcagctgcagcaatgataccaatgcatcagaacccaaccccgctatctcctttgaacccctcaaggcagaccctacaggcattctggaactccccgaagagctgccactcttggatctcacacaagaacacatgagctcagagctgctggaggcattgatgttctcagaaatattctccctcctcctccatctttctccatctgccaagatcatgagatcatggttacacctacaacctggatgagagtaagggtgtctgtgacctctttgatgtgtctattctcagcctctgactgacagggacatgtcctgtgtggctgagacacagactgtctgacctggaggctgcctggggaccaacccctaccccatcactacacagcttgagagccacaggctctggacttctccccgccccccttcactgcacagttctggccacaaatcccactcctgcaccagcacctggactgtcttagagatcaggggaaagctccagccccctgcaccatgaagccaaagtgtttgcctctccttttctggggctttccccacctcatgtcctcctggagccctccccaagcccagtttggctgacacctagtggcacagaacctaggacccacattccacctcccaaggcagcccggccagcccaatgtcctgctccagccatgcccctccccctatacccatatggcaggggaactggatgctggccagcatcaccccagtgtcttttgctgccccccaccctctggccttacggctcctcctggacctcttgtgtatgctaccctgctgggccctcagccccgtgtacttgtagggggtaggagtaggggtgggggagggtgctaacagaatggaacagaggtctctagctaggactctgggtggctcagtccctgaggattggcctaacctcccacggtcccatagcctcccactcatttccatttattcatttacctttatttagagccatttgcagagagttagaaagatttacagtaatgaggccgggtgcagtggctcatacctgtaatcccagcactttgggaggctgaggcaggtggatcatttgaggtcaggtgtttgagaccagcctggccaacatgctgaaaccccgtctctactaaaaatacaaaaattaaccaggtggtagcggtgcatgcctgtaatcccagttactcgggaagctgaggcaggagaatcacttgagcctgggaggcagagattgcggtcagccaagatcaccccactgcactccagcctgggcgacagagtgagacgctgtctcaaaaaaaaaaaaaaaaaaaaagaagatttatagtaatgaatggattcttacataaagattatttttatactttttgcagcaaaaggaaattgtaatatttgtacatgcccaagtgagtaaagatcatgcctatggctaaaaaacaagagagaagaaaattagataaattaatcaatccatagatactaataactccctctttaaattctacatttactttttgaacttcttttttctgtaggcaaacactgttgattgtgtttaatgttaacacaagtacactcatctacataagtctataataaataagaaactgacttacaggaaagagaatggtggtgaggtgggagtggagaagggagtcagtgagcaggagatctagcagcaggaaaatgtggaagataagccacattcaggaagggggaaatgacagtcaacagaaacaaggttttagaaaatagaagaggcctcctatcatcatgacgaaggctgaatgagctgtgaaagagaagttaaactggcttcgaagctgacaaaagagtgtagtagagagatagctacctagggaaaggactgggcaaagaggcaaatctgagactgttgagaagccaccaaagcagcccctctgaccagaacaggggccagagatcaagtctgaggatcaaggaatgagaggcaagacggccggtgggagaacaaggttaggaaggtgggaaaggtgggaaggagtggagagaaagacaggcctcaagtggataaaactagagcacacctttgagaaagaagtttattgggaaatttgggagaataagggccagttggaagtgggctagccctaccaaagctatttatctccatggttaaagtttccaaactagggagtttcctgacagttcattaatttgatggagtagtggaagctttacccatcctttgctccaaatctctgaacttctttttctatggttctgtcttgtatgaaattaaatttgtagacaacattgaagtttagaaatatacatttttttcagctgtttctttagctgaaatttttaaataacagctttggtttatatatgaaaatgcagaacctacatacatatgcacatatatatgtgcacatatatatgtatatgattatatacatagatataaaattaacggaaaacttgtaaaagttttaaaagacatattaaaaggattttgttatgtaaaaatgcaaagtaaatccttgtgggtgtgtttccatttgataaaaaataatgtattttatcctttcatatggaaaacagtatatagctggaaacgtgttcatgtaatattaaatctaaagcaagtgtatgtaaattgaatcatacattatcattgagttctgtattaattgaagatgggtttacaaggcaaagacagatcttaggatgcaataaaatctgataaagagtattgaaaacttaagtgtttaaaagaaaatgaccatgaaattgttaaaacaatgatgcaggacctacaaaaaggaaaagtgcaaatttagagagcaaatgaagaggacaagaacatactgggagttttagtatgttcctgaatgggaagatgcaggattgtaatctctccttgaatttaacaataaaaaagtaaacctaataaaagtcccattgcagttttgttttccagaaaaaaatacatatacagagacaaccaacaaaattttgtatatattttttttggacggaggggtccacaaatcctcagaagtcaaaaaatgaacttttgtatagaaagcccatagaacctctgttggagatgtacacatatacagatatagaaagacgtcacaattaaatgaaaaacacaagttaaaaaacagcaaataaaggatgagtccatttttattaaaatatatatttatatgtattcattaaaaattttgaaggattacaaccagtaataatacttgttatctttggtgaaatcacaagtgatttctatcccccttttttttttgcccgttatcacttttgtacaatgaatgcgaattgttcacaaaataaaaatcataaaactcttacaactctcacaactctcagagcaaagtttaaaaaactcaaaaggtaaaattctaaaatatattataaattataaaaacatataatttataactattcaagttactttccttaagctataggagagagatataccatacttgctgttaggttcttgaaatgaactccacagtgaaaacccaaagctgttccttctgttgcttccagacgggtttgatttgttgatatgatctaattacttattttatggtcctgcttacagtggttggtgactatttctgcatttgtttatccatcctttgtgcaggctatcaggaaccaggtgttagggattgatgtaatttattatttccataagtgcacattttcacactgtgggttttctttaagtggtagaacccatataaaactgtaatcagaataaacatttgtttcaggaagtcttaaaaatatccagctctacacatacaaaaagattttctgtgaaaagcatactggggaaagcaagagagaaagacaaatattcttggttgtgatgaagggtcccatttcttgttttaaagaatttcctggagctcacaaaacccaaagagcaaggaacattaacactgagaaagcattaaacaactggaagaataaaacagtatgttcatgttttcacactcaaaactttctaatttagaagcaagtacttggacttctgatgaaagagctgtctaggccaaaagaatccaacatatcagccatagtccaacaaatggaattgccatttatgcctcatcctttttaaatttgcttttgcttttcattcatttggcctattagaacccaaaacacttaattaaactttaggagactaaaataatcattaaaatacagaaacagccctgagatggagacaggcctttttaatcatatgagataactatttcttaagaactcaaatgcttccataaactacccaaggataattaatacaagctgtagaccatgcttttagttttggttttaatatcttcaaaatgtagtgtcaggaccaaaaacactttgtaccaaagtggagaaatttcatctatagtgaattatatttcatgaatgattttagagatctgatttcttataaaatgcaagggagccattaatgacctctgggatatttaatccacaaagtttaggttattgctttatagacagccattattagaagctggtaagaaggagcctaggagtcaagggatatgaattcaggactaagttagcagataatctgctaaattttttttttaaaactgcccaattacttgggcctcccctcttcaggtggtgtgaattaatcatttggtaaatactgatcatgatgcaggatgtttctcaattctcaaccactgggacattttagaaaaggactatatttgaattacgtgacttctgcaacatgtccctaaaatgactattttccacaaagaacacagaaaaggtgcttcctcagcccacattatcagtaaatatgataatgcttcctcagcccacattatcagtaaaaatgagctgagatggccaggtagagattgcaaagaggaattaaatttgcttaaatttgccattgcatatagggagagtctaacaagacagggaataaaaaatcaataatatgctatctcatttacatttattcagagcgtttattgactgcctattgtcaaccaggtgttggttatataaagatgaataaaacacatccaagtctatccaccttaacttcccttggattttggcctttgaaaacctttgaggttgtgttaagtggtactttaaaaaaaaaaaaaggtataacagcaaatatcaactaactaactgtttttaaggcaaaactattcatcaaattatgaaaataaaaatataaactctgatcatataaaacaaagctaaaatagggttgcaaatattgcaccagacatatttatacaaaacattatttgttatttacttgaaattcaaatttaatgaggcatcttgtatttttagttgctaaatctggccaccctaagctgaaagccagaaaacctgcaggcattccagcttggagctgaccggtgggtgctcactgctgggatgtgtggacccaggcatgaagaaaggcctcaacaactgctcttagtcattaactcatttaccagtaataaattgaagttaggcccagtgctgctgctcttattctgaaagaataaaacgtagtgcaagcattgcccacagcatctaaatgtttccccactaataatatactacattttcaattgattttaaagctaataattcagagagctataaaactgtttagaacccttagggggccagaatttgtgaagactgattttctcaggcaagaatccaacttgatagaaatctttgtaagtcacatcacttctctggatctgtttacgcatctttaaaataaggaagccacacttacggctttgctcatattgattcctctatctgaaatgttctccctgtccagctttgcttttctaaatcttgtcttgattcacgagtctgcacatccctgttcttcccagtcaaaagtaatttctattccccgcaattaccccggcacttctcttgtgacaggtagaattttgactttatattatagatattcacatacttatctcacttacaagattgaaggtctctgaagccagaatctgtcattaatacatctttgcaaccccacccttccatcccagctcattttgtttgctgccaatgttgtgggctaagtaagtaccttttctgtgttctctgcagaaaatagcctttttaggggcattttgcagaagtcattggctgagcattttctgattcaagacagactctctaaaattttgtgctttgtactaacctgagcagtagcaaacaggagtagaaatagctaaagcaatgaaaatactgttgcatacactcctgagattatgtaattgcagtaggaagtctctgcattatggaaggctgactgggggcacttatggactatgcagataatctgcctttgcaatataagcaaggatcagcatcaaaccagaaagcatggccagtatgagtgcacagcatgcacctgagtcagaaaaggcagaaccagaccatgaaagaaaaagtacctaagcaagagtcacaagaaatcctacactagtagagaattggcagctaaaaatagtcctacacactaaattattacaaatctagattacattgaatatttatgaaagtgagtttaagtcataaagtgtttttcaagaaaagaaaactgagaatgttaaaaggagaatattaaactcaaaccattttttttttttgagatggagtctcactctctcacccaggctggagtgcgttggtatgatctcggctcactgcaacctccgccttctgggttcaagagattctcctgcctaagcatcttgagtagctgggattataagcacaggtcaccacgcccggttaatttttttttttgtattttcagtaaagatggggtttcatcatgttggccaggctggtcttgaactcctgacctcaagtgatccgcctgccttggctcccaaagtgctgagattacaggtgtgagccgccgcacctggccaactcaaatcttttatgcacaaacattgtgaaacctttgctttcctaactcagcaaggaaacatgatgctttggaggctgaaagcccagctcagccaagaaagttttgaaatgtgcctagggaagccatgggcaggacagggttacccagggagtccccagacaggaacctgtgtttacaaggtttggcatgaagtggtctcagggcttcttaccagccatctgagcttctagttgtgtaactgctcaatgaatgccacgtgagaaatgtttctgtgaaataagtgatactgaccgaaacaagaagtctcctatgtatctgctattcttctttggctgatgacaatgaataatgaagcaacaaactttgggaaagtcagacatttgacccaaagggtggctaataagaaaaattaggctctgtcctgtgtttcttagtaacaacctcataagttagtggccccatgattacttgaactgtgaggaatttcattactggcatgaactcatgagttttatcagctgtggttacttctacataaactgtctgatattaaaacaagcactggttaatatacttctaacacaccaaaaatcagtcaaagacagtggtggatatctactttatggacctattctctgtcttagtagaagcaagtctttagaatgaaaagggggatacgttttcctaccagaggagacatgagtccttttcttgcctcctactggatatcccagaaaatatcatttctataagacatacccagaatgagggaacaacagtgaagaaaatacagcattccagataggccttagtttttgataccgaaccacgcacaccaattctagaataccacttgcattttgccacataaactccttagaagaaggatttaagtttaagtcaccactgtaaacctcacacctttatggctcaggggtcacaaaagagcagatcttgagacagaccaaacaggattcaaattctgactatgcatctagttagctgaatgttatttgcctcatgaggttactgggaaaattatattagactacatatataaaaagtctaatataaaatgtctaatccaatgcctactggcaaatgctcaataaatggcatttatttataccataattatgaacatttgctgaatgatttgattataacatgaaaaacactatgaggtagagaatatttcatgtctgtactttaacataattttaaatgtctttattttgcctgatcataaagtaatgcatgttcattgcaaaatgtatttagaaaatagagaagaaaggctgggtgtggtggctcacacctgttgtaatcctagcactttgggagggcaaggtgggcaggtcacttgaggtcaggagttcgagaccagcctggccaatatggtgaaacaccatctctaccaaaaatacaaaaataagccaggtgcaggggtgcgcacctgtagtcccagatactaggaaggctgaggcagaagaatcgcttgaacccaggaagtggtggtttcagtgagatcgcgccactgcactccagcctgggtgatagagtgagggaggccctgctgcaaaaagaaaagaaaatttagaagacaaaagattactccatcctggaacccagagataatactgtaaactttaggcgtttatctttccagacttgtttgtaaacacatatatacacatatatttatcatctatgtacatagcatatacatacatgtgtatttttcatcacaaaagtgagatcagaatattttataaaactaacagtatagtttagacatattcccagatcaatatgtagatacatgtatatatatgtagataatatatgcatattatttatatatgtatgtcttcattgacatggataactgttgcgttatgttccataaatgtaccataacccaattctctattataaatagtttgtgataaatatctttgtatctgtgtccttagggacaaatttctagaagtaaaattgctggacctgaaagcacactcagtgaaagagtttgtattaatgcttttcagggctgcccagcaagtggtaacatgaaaaaaattttacaaaggacttgccccaggcctcaggaacaggcttccctgtctgtcactggcctcattcactctactagctgtgtaagagctcattataccctcaccaactcagggtctcatcgcctttttcatttttaccaaaaaggttggccaaaaattgcacctcattttaatttgcatttctttgataattaaccagttgtttcttgatggttacttgcattctccaaacttacaggaaaagttagactatcagggaacataagaaaaagtggcacgcaggaaaaagaggaaacttgtggctgccaatttcaattcagggtttcagactaaatagacaagtaagtatacagtcctgtactctgcccaacacatgctagttgactgatctggaaagcacactgatgagcaaagcagctgagaagctctaatagcaggaggtgggctcatgaaaaagaaggggaaatctgatttctccaggaaattgtggaaatgatacaacaggcagtagctaccttgaccataataatgacaaatttttgaggatgtggcaaaagtcgtaagtatgctcagttaatgataaacacagagggaaccactggggaaattgggtttgaaggatgggaatgagaataaagagtactttgaggaatagagtagaaaaatatgcagtcttaagttatcactgagtttagcttcttagagttaggtttcaagaactaggactaattatttgctaggcaatcagggcaggctgagatcagtccttgggctgtcttggggaatgtttgtctttttgcctataaggatataaaggcaggcaatacagccaagcttctacaaaagagcctgtgaacaccagaggcaaaggtgaatgctcaagctagggttaatatgaagaggaaatgggggatagtttcatgaggtatcttacattttatcttggtgtgcttttgctgtaagttggatgtatactgcgaacacaaattcatgtgctatttggagtcaatgctccattatgttgtgcccaactagaaggctctgccaaactaccattttttaataggtgtaaaatttaaaagaagtagaatttattccaatgcttagctgaatacgaagataataccatttcacagaccaatgaataacacgaattatccttattccatttggaagcattgtctactttatcagcactaggaaatcctacactggggttccttaacaaaatgaaaactttggatttttcttacaagttctcaaatctttatctgaatgtcagagggacaagtatccatattgtactgagaagagagctgaaaaataaaagcaaagtgtctaattctagatttggtggcagttctgagagagcgtaggcttgctttgacattgcatatggacaattctcgaaacgtcatttattttcattttatttttaaacacttgatctatacagacagttatttggataattttgcagtaagttctttgtgctcctgatctttattgctcattttgtatatgatcatttacttgccttaattttaatttttattattcttaatagcagatgccatgcttcctcatatggtctttctaggcaggcaccaggctttatgattcttctgcttctttgacagctctagcaaagtactgctggtgctcaataatcctcaaggactgataattaaggcctcaggacagatccaaatctccattttccgcaagcccagggaatcaaacaggaggataaatctcaatacctcctcttccaagtctcaggtatgaagctaagacaaactgttctctctgaactctctttagcccacaggtttgtaagcaaatgagataaatgagaatatacacccaaaggttaagttcttcactaatacaaaaatttggcaccacctcctacctcaaaacaaagcaaaacaaaacaggtgaacaaatgaaatccttctcagtatcaacaataacaacaaatctcaattcatcttgcccatttataagactgtgtgatattcacaatttcataaaacatttgagtatttttagtacaactgttatacagatgttgaaatgctaaattcagaaaatggaaaacaggaggtttcgttgacatgtccagttttgaaagaacagagagttcaaaataaacacaactaggcagtacctgaaagaagcattaaggtattaaaataaagtatccctgctgaacttctacaaagagatgcagagaattccacctggcatgaatcctgaagaagagggtgaaagagaaaacaggggcctggattccacatctcgatgttggacataacatttacaagtcccttgcaaaatcatctaggggaaaaagtcttcaccaccctcactcaagcccaaagtggctgcctttcacttctggcatgtttctcatgcactcagatatgagtatgtgcatatacatgttgctttctttttcctgtctgtctgtatcttttagaaagtctacaatgagtacatattacttatccacttatatatattacatcatataaacacacacatttgcaaatttttaaaaaaatcatcactttattttaaataaaatgtaatgtttatgcatcagctctttttatgattcaggctgctactttacttttgaatttccaaatatcttaaaggtttcggcaaacatctcctattcagggagtatgtggaactctgttatgggtaagagtgtggacagtaagatgcaaagcaaatagctccagtttggaagcattttatggacattccattctggcaatttatagtttttgttttgtttagccttttagataagcagtcttatatcaactgtctaagaaaagcaccactttgaaatgactaattaacagtatgcaatattacagtccaaatatacaaaaatcatacaaatgttaatgatgaaaataatttgaagattccagaagcagatgtaatttagatctcaaaaccaactacatatattgcacaataaattggtatatgccaagggagaacatttgtttttaattagctgtgaaatttagtataaaagtagagtaagaaaagcattttttccaaggttcattaattaaatgaaacattgtttttctgtcacttggaggtgtaaaatcagcaagtgacattaattcttttaagaatgacctttaattttctgtagaaattttagtaaatacagccaggtaaaaataaccaaaaaaaatcacttgtaattccagtaacaattttatagttttcttttcgggcactttttcttcctgtgtgcatgcatgagtgtatgttctaaagagggtcattaaaacatgatttgcttctttgttttccagtagagaagcttgaaaagacttctataaatgaagtagattcctcagcaataataaaaattgtatcaaggaatcatagtaacaggtaacactgatggggtgcttgtgggcctggcattgtgttcagtacataacacgaattaccccatcaatcctcgtaagagccttgtgatgtgggtgccattactactctcacacaaaagatgagtaacagatgcatggagatgatataaatgctcatgcatgatgaaaatattgaggactacagaaaaggcatgaccatcttaagatagctagtctccttagactaggagagtcaagatgagaattcaagcctcttaactctcagtctattcatataaaagttccctgcctgatcttagtgactaaacagtttagaaaatagttgtcacaaaattctgagtatttccagtaattcctcagtcattcatcctcatgaactgaaatccacaaggcctagcatccagtggataccaaatcaatgacacagaagtgatttcttttttttttttttgagacggagtctcgctctgtcgcccaggctggagtgcagtggcgctatctcggctcactccaagctccgcctcttgggttcacaccattctcctgcctcagcctcccgagtagctgggactacaggcacccaccaccgcgcctggctaattttttgtatttttagtacagacggggtttcactgtgttagccaggatggtctcgatctcctgacctcgtgatccgcccgccttggcctcccaaagtgctgggattacaggtgtgagccactgagcctggcctgggacacagaagtgatttctatcaacagaggctggtcctggggaccctgagtagagatccatgtgatttgaaatgaatggttcatgaaagaagccagagggggcctgagcgccaggcagagtattcactaattcatgcaacaaatatttactactgagagcccatgtgctaggtactgctttaggttctggggcaggcacagtgctgaacaactcagacaacgtcctggtcctcatgcagcaaagcagggagagattgacaaaggacaatgaaacattaaacaggacactgctgctataaacgaaaataactctgtatacagggggtaacgagtgacgggggaaggtatattctagatcaagtggcccaggaaggtctttctgatctgagacatttgatcaaggaagtgaagaaggcgttttcagggagaaatggtgaggagaccagaatgaaagagatgcttgcagggaacggggtcttagcagttgccacaggctaggccatttagggcctttgcatttgggacctgggtcataggaggggttctgaatagtgaggtgtggttaatatcatttgaacagtttcatccattacaagaaattaggcacaaactttcttgagatttttcattttcttttcttttctttttttttttaatttgagatggagtcttgctcttgtcacccaggctggagcacagtggcgcaacctggactcactgcaacctctgcctcccgggtttcagtaattctcctgcctcagcctcctgagtagctgggattacagacacccaccatcatgcccggctaatttttgtatttttagtagagatggggtttcaccatgttggccaggctggtcttggactcctgacctcaggtgatccacctgcgtcagcctcccaaagtgctgggattataggcatgagccactgagcctggccgagatttttcattttctaataagcagtctatataggacagagttcagtcatgtttcaaacaatcttcaatagatggtttagactcttctgtaggcctttctctctctctctctctctgtctctctccactctctctctctccaggtctacttctcatctttgaggttcatagtttcctgaaatccactcctcctgcctttacagtgaagattcttgcagagtgcaatccggagggcttgtcatgtcacagaacttgtggaggatgagtcatgattttgaaatgtttttaatagtggttttataactaaaaccactttggaggccagtgacaataaactgaatataaaaaggataaagcactattggtccagaattaagtactgacaagagactgtccctaaaagactggtttggtatctaattttcactaggactgtattaactcaaatactgtagaatatttatttattttatttgtttgtttcatttgatttttaaaatagtctgaggatcacgttacaagacatatagtcattgggatggtatatatcaaattatatgagatggttttgaaaaattattctgtcttacgctttttggaataagttatcaaattttaggctcaagagagccactgtacctatagttgaaatttattcaacttcaaacatattgaagaactaaatcaaattaaacttttgtttgattagccaataaaaaaatttgaactgcaacttaaatatggtggaaatggcttctcctagagttacctttaaatgctaactttcaaaggatgaaagcattgatgggtgttttgttgtcacttcctatataaaatctttcctctctgtttcctccccttcacagaacactcctccacctccatctctaccagctgtctatcacagcaggtgggcatcagcaaagagcgtgtgtgtctggacatcttcccctgtctgtggcacaccaccttcctgagggattatttagtttgtctctgagcctcccagctcctaacacagtgcccaacatggtcctgttagtactcagtcagtgtttatccactggaaaaaatgaatacaggtataaatttgttttatttcaaagtgcgatttatttgatggataaacgagcatttaagactcttcctttaggcatatttatttgcatttcaatataaagcttggacatcaatgaagcttttattagtacaaatatgttcttttgaaacaaattctgtgtgggttttataatactatgtgtttggatttaaactatatttagtcttaaattatttaatgttataattactttttaaaagaaatgccccaaaccgattggacttggagtatgagaaaaaggacagaaccacaagaaacttctaactttctggcttgggcaacagtacagcttggagagacattgactgatggaggatacagtggtagagaccaggtctggggaaaaatggagaggaattcagtttggggcatgttgagttcagggccacctgttaggtaggagctccttttctcttcattgttaaatatccagtgactggaatatttaattccatgtaaaaatacactggggaggagatgtggtgattgatgtggctaagtgaaaggatgaattcagttggcaatccacctatagtaagcttgcacgtaggaagattatgatcctatggatactaattgatagagtttggctgtgtccccactcaaatctcatcttgaattgtagttcccataatcccaatgtgtcatgggagggacctgataggagataactgaatcatgggggtgtttacccccatgctgttctcttgataatgagtaagttctcacgagatctgatggttttataagaggcttttccacttttgctggacactcactccatcctgccaccccatgaagaaggtgcctgcttctcctttgctttctgccatgattgtaagtttcctgaggacttccaagccatgctaaactgtgagtcaattaaacttcttttctttataaattacccagtctcagcagttctttctagcagtatgaatacagactaatacactaattattacatacctcaggttagatcagagaatttcctaactgactcttggtcttgacctcagtattatatcaactcactaccagtcaccctaaaatttaaatcatcacttttaaccttcctctgaagttccagaattcaatctgtgtatttcttcgtcatacacaaaaactgagcctttcttatctttcctttcccaatttttccacctcttgataacctgttttacagtcataagttatcactattttcccttttttaccccttttatatgtgaaaccatcacttctattgattcttcattaacaagatctctcagacttttctcttctctgttcttatcgtcaccattcaagtctcttccctcatcctcactcccaaactgattataatgtttttctgatttctcactccagccaattctgtccaattctatgagaggagtaatcttaaaaaagacgtcatcacataaattctttcatggtcaccctgctaaagctgcaactcctgttttatttttccttttcagcttctgcaatctgaaatgctctatattttagttatcttgtgtactgtctctccacaagaatgtaagctccatgagggcaagaacattattttgtttattcccatatttcccgcacctaaaacagtgcctagcacaaggagagagcaaaataaacattcattaaatgaatgaatgaatttaatactctcagaccacaattcatttcctagataccattaaggaagataccagctcctctgcatatggtattcataacccaccatgaggtcaccattcatctgtctagtcctattcttcaattcctccatgagaacttcaggctcctgccaggccagtttcaattcagattctcatcagttagtgtttgctatatgcaaactcctatgttggtctcctgctattctctacactccttaccccacccctcccaccctctcacattccctttcagaatctttgttagaagggtgccttcttcctcttgacatcctttagaaatttttcagcttactccatgggtgaaatcttcagtgacttccctcatttctgaattcctacataattattttgctttttattatcatagtgagtaaataatgtattaaccatatgtaataaactgctattacatttttaaacatggaactgaaaagagtgcatagatcacatttggtttaactctctcaccttacacataagaaaccttaagtctgcagagtcattaaaaaactaatatgggtagaataaaaactagaattaaagttaaaattatcagcatccatttattctctccattaatatattcctttgttctgtgttttatatatacatatacatgtgtatgtatttgtgtgtatatatgtgtctgtaagttttccttaataaaactgtaactccttggaattattttttgtaattttttgtatcctatacctctaaccccccaccaaagcacctattaaaatgattagcgtctagtaggtgctcaataaattcagcttgaaggattaactgcaagaagacctctttttctgttagaaaaggatccagatgtttagaggtatccagacactttggggcaagagttaatgaggtccaattcaatttcatctcggaagtgaaacgttgctaacagaaaatatttgactcgcttagatttgggtcaggatacaatgcttccaagcctagccaaagatctacaggcttttttttttttttttttttttaccaaagaaacaattgtatatgtgtttagagactcaatcacaatcaaatcttcaccgaagaagttctgtatacattaacttggctatacagcctttatccagctgtctcttttcaaatatacccagccaccccaccccccaaaaaagatgtaaactaaaaatatcataataactggaggctgacatctgaaatcctcttaaattaaagcatccaagtccatgcaacaaatatttacattaagcatagaaatgctgggaaatggctcaaaaaatctgatagggctagtcattaacagacatcttcaaactgcacaattcatactagataaaataccgtatctactaaatatctgctttctgatattcttcagagaatgtctgatggtaatatccttatgccatgccaatcaacataaacctgcaggaatctgcaggacagagaagtagaagaggatgagagcaattctgccactgtgtcctgacaagctctgggacacatactctctcagtaccatcatccccctcctgcctgtctcctggagagtttgggcgcaataagaggactgaagctgattcacattcctgaataaatatccaggggccctagaacacagagcagtacagactaatggtgttaaatagcagtagcactttaggggtaaattttaatttatcactttcattttaagatgataaaagactcttaagtccgttgaaatgtaggttgtactaatgttcaatctaggtaattatgggaaacataatgataacaatttaacataaacaataaaaacagaacacattgtctgaataatctgcactgtcagttgtgaacgagtgccaaatttactacttttgtgaaactgtatgatttgctttggcagggtgattttcgtttgcaacatttgttctccctaactgctagtcagaaatcactaataagacacaatgatacatagcacacttctcttgacagcagacaagtcatttcattgggaaatgctgaagtttatttagtagcacgtgaactagttttacatgattcctgagcccaaaagtaattattgatatctctgcattctcgttgtattttgtttatatcttctcataatgtttatatatcacatcattacttgtgctcatgtctgtcaccaccactaaattatgagtttcttgagagcaggatctaggttttgctcatatttgtgccccactcagggcctaacatagagttttgtgaatgttagataaataatgagtgttaaatgaatgaacaaataaactaattgcacaaaaaactactggcaaccctccatactgtctataggatctgttgaggttgacatttgtatatttctcatctatagatcaacagaaatcaatccaggatctataagtccttcagtatttcaatctattgtcacaattttagttttcattctatcgcccaaactcttgtgaaagaaaaatttaattgttatttgactgctatgccttctaaacagaaaaattcatttatggaatacatggcaagttagtaaaagatataatataaatattatacaatagtaagaatcataaagaagatataacaaaatttgctcattcttattgcatatactttactgcatttttcttttgttaaattacagtctgtggtcattccttgagaaaggatctagggtgctatcctttcggtctgaaagtttgcatgtcggcagaatgccttttttcatcttcacatttgaatacaaatttggctagatacagaaaaatacatttaaagtactttttgtttgtttccttagcactagatgttcttgttttcagaattattgatgagaagtttgctctaaatcagattattgatttagagtaattttttttcctctctggtaactttcatgattcttttctgtattttgtggctctaaaaattttctacaatatgactatatggcttagcacttggtagcttttcattctgaagttgcatgtcttatttttttagttctaggaaattctgagatattatttcttaactattggctcctctgcatcatctctattttctcctcaccaacacctattcatcagatattggtaaatatagagctattctctatgacacttttcttttaacctttctctttatccttttatctcatattctggaagaaatccttagccctgatcttcctagctcaccaatctgcccctcggttttttcattctgttattgagccatctgttaagttcttaatgacaacaactatattttttcatttccaagatttccccttgattttgcttcataaaagtcaactactgttcttgttttatagatgtaataccatattctatttctctaaagatattaatcactttgggtaatgtttagttctaaggccctatgggttgtacaatcttcttgttcttatcattctcagacttttggcctcatatttctaattccagccacacctgaaccatgggctcatctttcctggactctcaggtatctcagcttgagcagcttgtctgggatgaggggctgaagcagctgccagtgcttgagcgtcttcttatttttctttttttttttttgagatggagtctcactctgttgcccaggccggagtgcagtggcgcgatctcggctcattgcaagctctgcctcccgggttgacgccattctcctgtctcagcctcccgagtagctgggactacaggcgcccgccaccacacccggctaatttttttgtatttttagtagagatgggtttcaccatgttggccaggatggtctcgatctcctgactttgtgatccgcccgccttggccttccaaagtgctgggattacaggcgtgagccaccacgcccggctgcttcctcttatttttcgtgagaataggggatgggtaaataaagctaaagacagcaactggtcttcagaacttctctgggctctctgtcagctacctggggcccttccctgtctctccattcttaacactgcagaggaggagggctcaggagttcacaggacaaactgccccactacaacagctctaccaaatgctcattggctgttcctagccctctcctgctccagggctccacacttccagacgtggagcaattattatgctgcacccatgccttagtctatcctttactcttgtccatctcaagtcccacctctcggtccctcaggaattccttgaagtctctagaccatcaagaagtcggcttcctgtttttaggtatgacgagagatccatgtgtttatcccagtgctataattctctagatttgatacaatagagggaacctgcagcacactcagtctgacatactgaaaccaccatattcaaaatcttacccttaaactaagcctcctgaaaaacatacaggatacacaggaattcgcagaaacactggtactgatttttttttctttttttgagatggagtttcactccatgctggagtgcaatggtgcgatctcggatcactgtaacctctgcctcccgggttcaagcgattctcctgcctcagcctcccgagtagctgggattacaggcatgcaccaccacacccggctaattttgtatttttagtagagacgaggtttctccatgttggtcaggatggcctcgaactcctgacctcaggtgatccacccgcctcagcctcccaaagtgctgggattacagatgtgaacattggtagtgattgaatatgttgcttttagactcagtttcccccttcccatctttgactctgcatcacaagaaactacattcctagacttttttagcaactggcttctggataacttcagccaacaggaagcactggtggaagactgaaagggggacgtgagagaagccaaggatgttcctctggacagtgtctcgactagcacctgtggctcttcagtggctgcagcggctgtcacacagcactcagtatggtctagcttctgcctgtcagctcctgctcttaggttctggtatcatcaccttctcctgttgtccctgcaatcctaggggcatagaagctcctgctgttactgatctctggggtgttgcttcatttcctgtttagtttctcagcaaaactgtctcctggcagtcaatttcctatattaaattccttttgttaaaaggcctagactggttctgttttcttggctggatcctgacttgtagatcaaaattctgaagagacattttcaaagacaataattggtaattcccttctttgaggggaaaggaacaccatagtgaagatagtttgaggttagtgttctcaatatctatgatatcccaagttgtttgaagaaatgacataaaactttttttaaagtgaatttttgtcaatatgcttccccttaattgcaaatatgccacaaagcagtcttgcaagaaaagccttaggggcctatcatgttattaaatacagtgttctggaattaggaaacactaccccgtaggagtgaaagctttgactataacagaaaccttgctgaggcttctcaagctttagacctacctcaggggcagctatgaaatagtttaaagacaaccacttttattctctctctaatttaccattttctccattgagggagggttaggtgaaattatagtatatctttagaaatcctatgtagctctatttctcatttggaaatagagaatgccatggccttcaaagcctggcccattcttactacccaacacatgcttaataagcagcacagaaacaagaaagcccactgtgatcagagagagaatgagagccacattgcaccactgatatgccatatggctgcaaatctaaaggctctgaaagatgccgcagttgtataaagccctgaatacctgctttcattcccagttagagtgttcgagctataatatatgggccatccatttattaaaagagagagcttactttggcatgggataaattggtgcttgtggcaagatgctgtttaatacaaaggatgtctcttgaattcctttcagatctgagacccacagctcaagagtgtttggtgtgtgtgttttaaaattgcatgactattatacaattccttttcttcagctggcatgagaaggatattcccatcctctctttgctctgttctttacttcctcaaagctgaggcggcaaaaacactgccagccttatccagcttttcatggaaagccgccactcttaactggcgcctaaatgcaatttcagactgtcccaggagaccttcatgctttgaggtgaattcataacattagggccaacaaagaagttaacacaaactttcactgttaaagaaaaagaaaaaaaagtctgcagacttactgaaggagctctgcttctgtgagtgcctctgtcctctgctccccagtgaccatggccagttcatccttcagttcctggatttccttttgtaggcgtttaatcacctacaaatggcaaagaggcagagaaaatgtcaacttctcattaaggtgaacttggtgacagagaacatacagctcttaaaattatggacaattttatggacacaaaaatgggtaatggtataaaaagccagctttgttaaatcttaacgttttgtcaaaatagttctagattttttttttttttttttttggagacagagtctcgttctgtcacccaggctggagtgcagtggcatgatcttggctcactgcaacctccgcctcccgggttcaagcgattctcctgcctcagccgagtagctgggactacaggcgcatgctaccatgcccggctaatcttttgtattttttttagtagagacagggttttaccatgttagccaggatggtctcaatctcctgacctcgtgatccacccaccctggcctcccaaagtttgagtttacaggcatgagccacctcgcccagcctctataattttttttaaaacaaataaaacattactgatgtaactggaaccccctattggtatcccccctccgtccttcctggggtgatcactgtactgcatttaaggggtctgatttctctgtgtgttttcatacatttactccatatgtatgcatgtactcataaataatgtagtgtatcattttgcatgccctaaactttatgtaaatgttacattactgcatgtaattgcaacttgtttttgtccttcacattatgtttttaagcttatttacattgcttcatgtggctctagttcattaattttcatggatatatagtatttcagtaaaggaatatatcagaatctatttgtctcctgttgatgaacatttaggatttttacttttgctattacgaacagtgttgctatgaacattatgaatctctttgagcacgtatgtaagagtttctctgtagtgtgcactttagaagtaggatttcctggctggagagtatgtgcatcttgcctttattatatattgttaaattgctcttcagagtagtacaaatttacattcctatcaactacagatgtaagttcctgtttccacatttttgtcactatgtaatattgacaggtactttcattttgccaatctgttaggtgtaaaatgatatctcattttagttctaatttgcattttcatgattatttgtgcagtaggtcattttgcatatgtatattggcagtttgggttcttccttgctcaaattatttattcccattcttgtccatgtttccatttacttgtttttcctttccttattgatttggtagcttctttctatattctggatgtgaatccttcgttagttttatgcaatgcacctgttttctctcaatctctgtcatgtttttcactttgcagtgttctttttgttaaatgaaagttcagaatttcaatataatctaattagcaccttcttcctttatgtgttgtacttttgtgtcatttgaaagaaaatctatcttatcccaaatcataggaatatattcttatatgatcttttaaaagtgttaaaggtttgattttcacatttaggtggattttactttgtataaggtatgaaatagggatcaaattttaatttattttaaatggctaaccatacaagatttgctattataattatataatatgtttatatatataaatgtgtctatttctgggctattggttaaacacatttgtttattttactatatatggcaataccacactaatttaactactaaatcttaagaaagttggcatctagataagataagcccgtttcatcctgttcttttccaaaatagacttggctattcttggccatttgctcttccatgtacattttagacccaacttgtcaaattctaccaaaggctctcctcaaattttaactggaattattacatttagttaaaaggttaatttcgtcagacatcaaattaatgatattaaattatcccatccataaacatggtatagctttccactgattcctttcaataaggatctataattttctttttaaataccttacgtgtctttaattatattttatatcaggaatttaaaagtttttgttgacactgtaaatagaatttttataaaattatatattctaactgttggcttctggcatataggaaggcaactcatttttatgtatggattacataccaaataattttctgaaactttgggggttctatttatcattaaatactcttggatgttctatgtaagcaacataattatctgtaagtaatgacagatgtttttcttcttttctaattcttatatatcttatttcttgttattgtctcattttcctagctaggacttccaagttcaattcttaagacattcctgtcttatttcttctaaaatttcacctttaaaatgatgttttcaaagtatggttgaatgtttaatgtgctcaaacactttttctgcaactagggatgaaataatataatttctttctttaaactctgaatgtgatgaatcatattaattcatgtgattagtattttagtataaaccatctcaggcatataaaatagtataaaagaataccttgtacccactacttagcttaagtgaacatccatgtaccctgtacttaagaaatagaacattacagacctgtctgaagacctcacccctgcatagtcttccctgaatgaattccccattaccattatcctaaattttgttttaacttttctcatttttttcttacaatatacattgatgcattctctagtgatagattactttgaattcccaaaataaacccaactagttcatgatagtacatgtcatattaataatcttcctatcataatgcaaaattcctaaaagaaaaaaattagcaggcttgatccagctttcatcctttctggaatatttggtagtactcaaaacttgaaagaaaaacaccataggatctggtctgtccttccttcctttcttcctcttagtagctttactttctttttttttttttttttttttttgacacagagttttgctcttgttgcccaggctggagtgcaatggtgccatctcagctcactgcaacctccgcattccaggttcaagcgattttcctgcctcagcctcctgagtagctggaattactagtgcctgccaccatgctcggctaatttctgtatttttagtagagacaaggtgtcaccatgttggccatgcacctgacctcaggtgatccacccactcggcctcccaaagtgctgggattacaggcatgagccactgcgcccggcccgctttactcattttctaacttcttttgcttggggattgtcagactaaaggggttatgtaaatttgaatttcaaacctacatgaggtagagctagggtttcaaatttttcaaagtagttttcagaaaaactactttttgttttacctatagtccatttgaaagcggacaagctgccctgacatctccatatggtagtggatagatttttttttttatagttgtcccttttactggttttatgttggggaaaagagaggatgtcttaggttcagcatccatcttgcaacatcccagggctttaatctctattcctttgctacaacctcctttacatctccactccaggacaactgcagcctcagcttagtttttgggccctggagaattcccttacttcctttcaaccttacatatgtatttcaaagatgcttaggtatataggtgagtttcagattatttgggccatatcaacaggaccagaaatcccaaagaacatgatattgagtattttgaacatgtcactgttcctagaattttactgaaatgtatcggatcatgtgggttttgtttgcttcttttttaaaaatattcttaggatcatcaatctatacagaatgaaaatcctgagatagtaactacattggcacccttctctattaaactaatattgatgccatattttctatttttactaaggcttttaagtcaaatctaataccaaattattctcctgtcttattgaataaaaatctcaaaactaagccaagtttttttggttttgagattactacagttatgcctcccatccaattactgaaggaaccctggcattagagacatccttaggagatttgagctcatgcccagtcaccacaggctctggccttgttcatagttcttttaccaccttgtctctctgaggtaccaatactttttttgttttgttttgtttggtttggtttggctttttttgagatggagttttgctcttattgcccaggctggagtgcaatggtgcaatctcggttcactgtaacctctacctcctgggttcaagcaattctcctgcctcagcctccggagtagctgggattacaggcatgtacctccacgcccggctaattttttttgtatttttagtagagatggggtttctccatgttgatccagctggtttcaaactcctgacctcaggtgatccatccgcctcagcctcccaaagtgctgggattacaggcgtgagccaccgtgcctggcctgaggtaccaatacttttaaagaaagcagggcaaatccttatcggctggctccatatttgccattaaattttaaaagtaagacataggaaatgccacccaagttttgtcttgagtggtttgtaggacaaattctcaactgtcatttgtgcctcagacaagctctatacataaaatgactgacagtaatgtcagtttttagaggcaattataaaagagaccaggaaacaacacttgtcaattaccagattaatctgcaccaggaagacctcaacatttgttcaattatcagctattagcttttgattcctgatttctcttttcttcaaatctctcacagacctatatcaaacacataataatgtttacctttcttcaaattcttcacattccttcaaagaaaaatctctagccaaatgcaaaaaacaaacaaacaaacaaacaaacaaaaacaaaaccctccaatgtctaatatgtttattttccttaaattctgaactagtttttgtcttggggctaataactttgttaactctctttctcattcagcactgtaatgctatagggcttctggaagggtagggacagcaacaaaatccaccctagcagttcagttccacctgaatcttgactttgcatgctgtctcctctctccagcaggaacactgtgtgatgctgatacctgaccagggcctttgctgaaacagatcctgcctcactcattggtttctgcagaagagaactccatcagaggagcttggtgctttctgaggcaagaagaacataacagacagccccattattcctttgtcctccttccccctctgtccttccatggggagaaagaggagaaaggacaaacaatcaagaggaagtaattaatatgggtaacaattaatttgttggtttttttttgatttgagaaatttataagtgaaacactgttggtaggatttcacttcttttttttttttttttttttttttttttttttttttacagtgcagattactaagcccctaccagcttattttctagagaaataagaaaaactgagtgatttgaaaaatgatgcaatcttaattatggaatttgatacaattgagatagtttaacattttcaatgttggcataaatggattcagtgttgcatttcatttacagaaaactaacaaaatagagaacagaaaatatctgcatttatgatgagctaaattattaccatgtaaatttttttgcttaaaaacagttctttgataaagcaggatttactgttataaaactagaagtttgacagatcaagccaataatgaattttaaaaaactctagaacaaataacagaacaagtatgtaaaatatggttctactgaatggctattaggacttttctttctttctgagcttttatataagatggactattattggcccggcgcggtggctcacacctataatcctagcactttgggaggccaaggtgggtggactgcctgagctcaggagtttgagaccagcctaggcaactcagtgaaaccccgtctctactaaaatacaaaagaaattagctggttgtggcggcgtgtgtctgtggtcccagctacttgggaggctgaggcaggagaattgcttgagaggcggaggttgcagtgagccaagattgcaccactgcactccacactccagcctgagcaagactctgtctctaaaaaaaaaaaaaaaaaaaaaaaaaaaaaaaaaaaaaaaaaaagactattattgtctctagatagttaaactgatgtattttgaaaggctaagttctgcatatagatgtaatcatgtgtggttctgttgtatgagtccttaggattccctgcatgtctttgaagtgaaacaatggggagctgcaagtaggaagagcaagtggcttttgagttagattgcctgcgtgtgaagcctgactctgctacttattagcacttatgactctgagcaagttatcaaacatctttttacctcagttttgtcatctttaaggtggagatagagatagcatctactcataggttatttagaggattaaatgagttaatatgtttccactacttagaacattcccagtacagagcaagtgcacctacaagttttagctaatctttgatatactttaatatattttttaaaatatcgttaaaagttgcttactaatctggggttaatttcttcattaagaacagcttcattctttatgagtgccactcgctgtgcaaatctgcaggttgatatagactcctaagaaagcaaagtaacttcttaaaatattatggcatagagagatatttctttctagataaaacttatcttttattcacagaaaaaagatacacacctaaaaagtgatgtgtataaaactcacagtgaggaactatgcccctaaattaggaagctttgctctagaacaacagtccccaacctttttggccacaagggcctggttttgtggaagacaatttttccatggacagagggtgcaggtggtgtggtttcaggatgaaactgttccaactcagatcatcaggcattagattctcataaggagcgggcaacctagatccctcgcatgtgcagttcacaattgggttcacgctcttatgagaatctaatggcaccactgatttgacaggcagtaatgctggctccaccaccactcacctcctgctgtgcagctcagcccctaataggccacagacctggtactggtccatggctcgggggtcagggacccctgctctagaacattattttttaaccaaattttattttggcttaataaaattaccaatgacaaaaagtgagagatcacaaggtcctaagtggcagctggtatagtatgtgttttcagttgttgatcacttagaccagaaccacatatataaatcataatcatagcaagagccataatccacacacatgaaagatcacaaaataaagattcataataggtcaaaaagagaggtttgtcaaggcatcttacaatcaaagtcttggccttgtttcctcttctgaggagtgtctggattccaaacattaaacatcagctgactctaaagcaacccagaagagccattcagcagctggctcctgccaaagcatcctggttgcttcactcagcaacatttctagggacacatctcagagatatctccaaggtatccggatcttagtcatcagggcaaaatcaagcaagagaagcggatgggtcagctctcccatttctttgggtgacattgccaacccatcagtaggccttccaaaatctgtgtatgaggcttcttcaaactatcctgtgctatgtgaagtcaattctcaaatggggttattataacaatgacccacaaatagcccacagctataacaaatagcccacagctgtgaactctgtagggtactgccctctgaaggcatacccagctgaaaatgtagaaacccacccaagagcctcaactccgtctcacgtgctagcagtaaaaacctagattaagatctccagaaagaagagcccacatacatcaagattccttttctccaaggagagtgttgcaatcatagttgtcatgcagttccctcccaaactgtctcttaggacactggtcatcatggagtttctataaggaatgtgcgaacggtgcttttctgaaagggcaatgataacctgtggtaaagtagaaagataatgggattaatttagcaagaaaatgcactcctgacaaacaacagagcttcaatagcaataaaaatgcaaaaggaaataataactaaatgcacggtgaagcccaaaacttaagtacagaataaatatcttgacaacaatattcagtacaagatggtgaagactgaataaagtaaatgtagtgtaactgtagcattgtgagccccataatttttggacaaatgaaataacctgtatagaactggatacactattattctgtttttaacgattggaaaatttgtatgaaaacacaagagtaaaacatgcctgattacttcaattactttaatactaccaaaattgggctgtacaccagtaagcaagaactaagggaaacagtataggatagtggttgaggtcccagattctcatgcaagattgtctaggtgcaagtcctggctttcctagggcacatcactcaacatgcctcagtctcctcatctgtaaaataggaataaaaatagtatctacctcacaggtagttgagatgattaaaagagttaaaatgtgcaaattattttgaatagtacctagcccataacaagtgctgtatataggtttgctcccattgtaagcaatgggtagttgaccttggttcaattcaggcttgctcaccttactcttcatgagttccttaggtacttaataggaaggtactagatagatggatggcagatggagcaaaggctgctggggttgtcccgaaaggaggcacctggggctcagggttatcccgggcagacaaatccagtgctagaatgttcattacaaagcagcaggaatcagccacccacaggatgtgtctttaagggcatcacaaagccctagctcctgagaatacctccgccaatgcctgtcattgttctagtcctccctccttccaggtgtgtgatttccatcaccagaacctcctctactcttttggtttacaaaacgaaaagggagcattgctttctgaaggctgttttaagcaacatatgtaactataccactagtctcattctaaattcatgaccacaggtgttggtaaattcagtcatcctgtgatctctctctctcaaaaatcacttttcagctctcagaaatgagaccttcacacttttctcctttttcttcaaacctttgttcaccctctcctctcctcaatttcacttcgagctgatggccacacttctactagatatgatagatatagattcggaaccctgaccaggactatctcatgtctccatcattaaatcccctgtacattctgcccttcaccttcttattgtcctgctcctgtctaaggccagccctccatccttggcctcatctgctccctcctacttttctcctacaattacctcctctctcttctgaattaatttccctttcatctggacaattcccattctgcatgcccactacagtcctaaactaagatggctcttgccaaggtcatcagcaaccttcattgtaccaagagcactgattgccatcttactagacttctgagctgagtaagcatgcaacactggtactcactgcctcccttgggaaacactttgttcacgtggtaactgggacactacactttcctggttttcatctttcctcaaaaactagttaatgaatgtttcttttttcttattcccaaattacaaactttgtagtgccccggggctcagttcttgatcctgttttctgtcttatctacactttctccctatgtaatctcatccaatcacctggctttaattattatttaattcatttatttatttatttgagacagagtcttgctctgttaatgctgaagtgtggtggcacaatctcagctcactgtagcctttgcctcctgggttcaagtgagccttgtgtctcagcctccggagtagctgggattacaggcgtgcaccaccacacccagctaattttttgtatttttagtagagttggggttttgctatgttggccaggctggtctcaaactcctggctccagtgatccacccgcctcggcctcccaaagtgctaggattacaggtgtgagccactgtgcccagccattgcctggcttttaaatgcatttatatcctgatgtcttcccaatttataccatcaatctcaacctcttccctgtgctactatcatcttggcaactctacatctccatctggatttctattcttgattttctttcctctctgcccccaagcctgattctttcccagatctcacccattattattaaggccccaacatcaacccggttgctcaagccaaaaccttaggcaatcatccttgatttgtcttcatccccaatatccaatccatcagcaatttctattaggtttacctataaaacttgccaagaattggaccacttcttaccaccaccactccagttcaaacctctgggatcccttgcttgggaaaccacacacgccttggattagtctccctgcttctacttttgcccttccacgatctgttctccacacagcagccagagaaatcttcacacaatctaagttatgccaagttgctccctaatacacttagcataatatcccagctcctgtgtggtccatccctgttcgacttatctgacatcatgtcctgtcatgttccctgggcctgtactggccttctgactgttgattcagcctgtcgagcttatccccacatcagagcctctgaaattgctgttccttctgcctagcatgctcttgccccagatttccatacagcatacagctttctgcttccattattcacatctttgctcaaattttgttttctcacaagggccttccctggacaccctatcaaaaataataaacctatctccagcctgttaatctttttttatttttcttatactacttatcactatttaaaattatatttaggtacttatttgttatctgcttcccctctaggctttctgctctgcaaggccagagacgttgtctctcttcttcatagctcgacccccactgcggagaacagtgctcagcacttgctaacatggcagaaacaaagctgtctccctcagttctcgtggcagccctcattctagtttgacttcctatgaaattacttttcctagttgtcttgaaggtcatgttttgcttaagatgtagctccaccaagcagacagccctatgtggggtttggaggtgagcagtgagaggtggtagccataaggaggaacatcagatctgcggggggcatggtggcagaggcatctggttcttctgaggcagttgcagggaagtttctggaatccagtgccatgtggctatacagtagtactttgcagagcagtttagtggtgtggttaggtgtgtctcctggttgctctgtgtagcagccaaacccagttttctgacttttcttgagattctttatgtttaataaaccatgcttcttaaaatagctagagcagattttccagtttacaattaagaaatttgacaaatataaaatgtgctcaacaaatttttgttaagtaaatcaatgaatgcatgagaagattacttagtatgtcctaggaaggcagtatgaaggtcatcagcatggaatgaggtttgagagaaccaagtttcagtgtaattggaaaggaggtggggaatatggcagacccaagtcagagtggcaagagatgccaagcagaactctagcctctaagaacaaagaggacagattaagtatctgaaacaggcaaggtgtgcccaaatacccaaacaggggctgggctgacagttgtgcagacagtgtggcattattgcttataaataatttctctaagtactttgaagttcttatataaaacaaattcactttttttcctgctctaggaaacaatattgatgtcttttcattcaatggctttattgacaacttagagaacctaaaggagaatatgcttattaaacttcttgatgatatatatatatgtgtgtgtatgtgtgtgtgtatatatatatatatatatatattttttttttttttttgagatggaggtttcactcttgttgcccaggctggagtgtaatagcacaacctgggctcactggaacctctgcctcctggattcaagcgattcgccagcctcagcctcccgagtagctgggattataggcatgcagcaccatgcccaactaattttgtatttttagtagagatggagtttcaccatgttggccaggctgatctcaaacccctgacctcaagtgatccacccacctttgcctcctaaagtgctgggattacaggcatcagccaccatgcccaacccctgttgatattaaattaaatcatgtgttagtaaacttgcttttggttgcaagaaacagaaaatgtaacccaaactggttttaattataagggaaatttattggttcatgtgattgaaacaggaaaggctttagattagaaggaaacaaaagattaatgctactatcaaggacttagtttttgcctatatctcagctatatcttccatgtggtagaagtcagtctcttcttgcggccccacaatggttgccaaaagccctgatgttatatacttccttattcataacttaggtgagaaagaattctttttccctaatcattaaacaaaattcctgaggttcagtaggcatgagcgtgggtcctgggcccatccttgaactaatcactgtagccaggagaaagacagtctccaattcacttagataagtcaggatctacctggggcgctgggacgggctcctggccgagcttctcattgttatggacattgcagaggcaattcctatgtcctctctagaaagggctctctaaagaattagagatcaaactggaattatggattagaaaatatagtctcaaaaatggagaaaatgaaggcagtcatcttagggaaatctcttaaataaagtgagcttcttaaataaagtgagcctcagttccctcactcgtaaaagtggtattggaatgtctatctcacaaaaatgttttaaagattaatagagattatttctggaatagttcttagtaagcaaaaaagcactcagtgatatggaaggaaatgttctttatgaaacgtttgaagactgatcttcatcatataaacacagtcctgggccgtttctttagaagaggaccgtgagaaggtaccttatcagctctcaaggagcttgaggaatactataagcccagcccacctggagcagatgtaaaactttggaatgacccagaaatggcaggtattcaggaaagaggcagaggtagattattctttgtgaggctggtgtgagttcttaaattgggcaggagccaaatgatctgaaaggcacaggaaaatgcggtggtcataaaacctgactttttggccaggagcggtggctcacacctgtaatcccagcactttgggaggctgaggcgggcggatcacgaggtcaggagatggagaccatcctggctaacatggtgaaaccccatctttaccaaaaatacaaaaaattagccaggtgtggtggctggcgcctgtagtcccagctactcgggaggctgaggcaggagaatggcaagaacccgggagatggaggttgcagtgagctgagatcatgccactgcaccccagcctgggcgacagagtgagactccgtctcaaaaaaacaaacaaacaaacaaacaaacctgactttttttattgtttccttccatcttagattgcatgtacaaatacaatggtaaatattcctgaagttattctctaactgacaaggagtagaacctcacattatgcttaataatatctccaagtacctagaaactgtgcttgcaatcaataattctatttactatttaatgagttaaagactttaaacaaaaaagagctcagaagtgtttggaaaattatcctatgaaaattgacaaaatttggagtgttacaattggcactgacaccattactttttctcctaaacacaacacattcagttggaaactaaatggaaactaaaactctgagaaagtcccatttatgttgaataaatggctgaaggcaactctgattctgatttccatagcagtacagagcaagcacttcatttccagtggtttctcacttgatgtttgggctgatagaggctgtgggtcacaccgggagcactcagtgagatttaggacaagtatgtatgtctcccttttcctcccatgaactcaatttctaaggccaagatgtaccctgttattgtggcttaaaatgtttttgaggaaactttttggaaaaagtactgcatatacaaggagaactccaaaaccaaccatactctggcaaaaagaaagttatttacttgtgaacacaataaagtccattcaactcagagaggttgcaccctttgagcaggtgtgaggtctcacagttatggccaaaagagtaattataatgctgcatggaatttgtggaaccaatgtaggctaattaaggtaaagcaagttaccaaatggtttcccattccatctctgtcttatatattgaaaccgagagaggggatagggatataattgattaccaacactcacatggatttctattataggttttaaattactatattgctaagtatttatttgtatgctttgctgttctgctggctaacatgatagtcctgcctacttctcagtcattcatttatcctcattgtctaacgtaactcacagcacccagtaaacattcaatcacaatttgttgaatgaatgaatgaatgaagctaattaaactaaattgtgttacacttccagtctcattagtgccataataaagtactacataaagagaaattgattaacaaaagtccttgaattttgttattcattaaacatcttcccactctctttattattcttattcctatgtaccgtttggttttctcttctttctgtgtgaaattcaaaaatttctcttctaccgacctacttgctctctagcagctactcctagatttactcagcctaacatctccatgttcacagatgagtttttccatatttatgttctttcctctcccactaatctcttctctattatcttatgttgaaccttctattttcctgtgaagacacttgtgtatcagtgtaaatggctaacagctggagtgatgcagtgggtgaaaatgaaacatcggttacagagaccaaggggcaatgacatgtgaatgtcattgagactctgagcaaattcatccccctgggctggaactaagagctgacaggcttgcaattcccactgcctgacatgctctgccccatccttgattggctcgcctctattcattcctctgcgtggtatcaggccctaagaaaaccatcttcaactctcacctcctcagtctgagtcagataccctgctacaagctcctctcactccttttactttctcttcactgctctcacctggcttacagccacatacttaaagattacatctttaattcatgtctccctgcactagaccatgaggtttttggggaaaggactgtttctattttgttcacactaggctccagtgcctagcacagccctcagcacatggtaggtcattataaatatttgtttgataaataacttaatgatatagaaaatccaatgccacatagcccccaagactactcacacgaggctgtcattaagaattttgaagagaagaaatgtgaggagaggaatagttttagtgacacatagcagtttgcaaaggcttatagaattaaaaaaaaaaaaagaattaagggcagaacatttctcttgagtgattacaattggtgggaagtctgattcaactgatgaacctaattttgcatgaacagatggatataatggaaattaaaacagacagtgctaccatccaaaacaagcagacacatttctttgaaataaagcactttgaatacagtccattatgttttcatatcaatgttctataagtgttctattaagtaaaaagctctgttaagcataagtagtgtgtaatatttgagcaggaaagagcttaggaatgctgactcttgttaaaaacactagaatgatctgaataccaggcaggccttaatctcttggtgctgcctgactgggattcatctggttggagtgtggccatgtgcaccttgttcagatagggtcccttaggtttctctccatctgcgtttttagccaatgtgatgattacatagcatttaacatcgaggcaacatcagtctcagaaggattcattaagcagttaaaaaaaggttttatttttttcccctctaatcttttagctgcaacatttgttaacaagtccttctgcctcacaagactctgtacttctccactccaatttttgatcatgtttcttattttttattttattatttttttttagaatttggaagtagttgccatctttaacattcatctcacagcccttatactcaaaaagctaaatggaacttgagaaatcatctaattcaatccactcattttagagatgaatttttttttctgaaagatttatttagctaaattcagatgaatgttctctcccctggcattaaattcagaaattaaaaatagagcacatactggggtagattgtaatcagcctggggtagaagtaggaagggaaagctacaaggctaacagaaccatcatggggtcaaaattaccaactaaatgaagtctccccaaacagaaaacatgtcggttatctcaaagtcatgttcccatcgttaatctactagcctgaaaacaggcaaaaggaagccatttgtaacctctatttacaccaactactaaattttacaataaagcagtaagacaaaaagtgaaaaaaggtataggctgtgaagccaagtaaatctaggttctaatcttcaccctcccctagctgggtaatcttgtgggaaggcctttggaagacttgaattttaaaatctgtaagagggggatagtaactaacacctacaatgtagggctgttgtgacgtttcaataaaatggtatacacaaaatgctagtagatctaccaatgtttctggcagcattattcacaatagccaaaaggtagaaacaatgcaaatacccatcaagagatgaatgtataaacagcatgtgacgcagacatacaattggatattgttcaatttgaaaaaggaagaaattctgatacatgctacaatatggatgaatcttgaaaacattatgctaagtgaaataaaccagacacaaaaggacagatgttgcataattccacttacacgaggcacctgaaataggcaaattcatagagacagaaagtagagtagagatgaccagggactagagtataggggaatggggatattctgtctgatattataaaagactttcagaaatggatagtgccaatggttatacaactttatgaatgtacttaatgccattgagttgtacacttaaaaatgattaaaatggcaaattttatgttatatatatttcatcataataaaaaaaattctaatagaatgcctgatacatagtatgtggtcaacacatggtagctatagttattaatacatcccactctgcccattttacctgttctaagtaatgtagtgacaagttgatatacttggcctctgttagaagatggccccctactccagtctttgcaactcgctctgaaccagccaggtcaaccagatggagtttggcatgtcgtacagttgcagatcctggttccttgcttgacaaatgaatggtgaaaatgcagtgggaacgggttgaagcttggttcataggagtctataaaaaaattgcaaaacaaaaattatttgaacaatgaaaatttttaaagaatatcaaaagatttaaaataatatttctagtgataagacatttcccatgaagccaactgtcaactggagcaaaaccacttgtaactgagacctttaaagtaagttctttttaatgtattacctcttggattactgatgacaaatgtggatgggttgattcagaaagtgagaaaagagttctaatgaggtatagatcaagtcctcttgccaatataactttatttcattacctgtctataatccatgcattaaccttggcttaatgcttgaaaatgcttaatgttaatctcatgggaaaagaggtgagaatgtgtgtatcagaaaaattcatgatcacaattgtaaacaaaagccacagacaaagaaacctaccatcactgttactactcaacactaaagtggaggccctagacaatacaataaacaagaaaaagaaatagaaggcataatagtaggaaaagaagaaattaaaaatgtcactatgtacaaaaaaatatggtggtctacatagaaaatgcaagagcatctccaaacaaatggcttaagaactaaaaagtttagcatggttgctggatatgagatgaatatataaaatcaatgaggttctaataactcagagcaatgattaatcagaaaatataatattattcacaatggcaagaaagacaatgaaataataagggatgaattttctaaaggatatgtaatttataggaaaaatggtaagataatattaaaggacaaagagaactggagtaaatggtgtgcaggatattaatgcaccatttcatagatgggaaaactcaaaattaatctatatgtaaatgtctatatattaacctatatattcaatgcaattgaaataaaaatgctacaggttttgtttacagaaaaagacaaattgatcctaaatggcatacaggaaagaaatcttcaaataaaatgaaaagtaatgctgtttgcacttccttactaaagttgctccatcaaaaaataaaaagaaacaaatgaaaagtaattctgtgaaagaataacaataaaaggggactttcctgccatttatcaaggtataccacaaagctacagtaattagaacagtgtggtgctggtgctggtgcaggagcagacagctaggtcagtgagacatgctgtgctcactgaggagctctgtatgggacagatgtgacatcataccacagcaaagaaaggatgcactgatttagtaaaaggtgctggaataaccaactatccatcttgaaaaaaataaacttagattgcttccttacacaatgcacacaaagaaattccagaatagattaaagctttaagtgtgaaataacacaactttagcaccaataccataaaacatggaagcatattgtaatcaacccaaggaggtaatggatactttaagatataaaacacaaaaataaattgatttaaaatatttgaccaagataatccaaaatgtaaaaacttcagtgtgataaaatccatcataaaattaaagcactagaagatatttgcaatacatatggctgacaaaacattaataataaataaaggactcggccgggtgtggtggctcacgtctgtaatcccaacactttgggaggctgaggtagatagatcacttgaggtcaggagtttgagaccagcctgaccaaaatggtgaaaccccgtgtgtactaaaaatacaaaacaaaacaaaacaaaacaaaaaacaaaccaggattggtggggcatgcctgtaatcccagctacttgggaggctgaggcaggagaataccttgaaccccggaggcagaggttgcagtgagccaagataatgccactgcattccagcgtgggtggcagagtgagactccatctcaaaaataaataaataaatacataaataaaataaagaactcttgcaaatcagtgagaaaaagtaagcaaagaatatgactaggtaactcataaggaagaaatctggaaatggttaatgaatatttgataaaatgctcaaatttatacataatcagaaccacataacttagaaccataaggtttaaaaaataaagtctaacaaaataagtgttgttggagatataaggaaatgggaaattttgtgtactgcttgtggaaatataaattaagaataaattttgagagcaatctgataatatgtggcgaagttccaaatacatataacacacagccatcaataaactactagatatatttcctagagagaaatcttgggcaggtatacatatatatgtgtgtgtgtgtgtgtgtgtgtgtgtgtatctatatatctatatatctatatatgcgcaatatgcgataaggacatatatatgtggacattcactgcaacattattagggttagcaagaaattggtgcaagacgcacaacctaagtagacatctgtggcagaaaagattagtaaactgagataattcaaattacagagatgttaaaataaagcaacttgggatagattgacataaatggatttctaaaatagaatgctgggaaaaaatagcaagttaaataatgatatgaacattatgatagaatttacataattaaaaaagcaatattatctattgttcatgaagctataacttaggtcattaagtataaaaacatggaccagaagcatacggcaaattaatgatagcagttgtgtttgtgagggatggaaatgaaaggccaagaaagggacttcagctttatctgcaatattctatttcatttagttaaaaattattagaagcaaatcctggattggaaaacatggatgttggttacattattctctgtacttttttgtgttttacattttttggaacaagaaagaaattaatctgattcaagatacaagtgacaagttagtagtatcatcctctcaacaaaaaaactaaaaatattccaaatgagtattcatatgagtaaatatgttcagatctccacctttgcaaaatgagatttaaacaaagaatttcaatatggatgcacatgtgtgcagacagagtaacacatttgaatggcaattcaaccagaaattctttctgtaaatataaattcttgatatacaccagagttgatttacaccaactagcaaaataaaaagatgtcaaaatgctggcatagttttggtgatgatgatgtagctagtgagtcaaacaggctgaaaatttgacccattacttgttgccacaataactatgcccaaacctggccagtgtgtgattttgcctgctaaagtggatcagcaaataactgtgcatgtaaaaccgcaaactcaaatttagaacctaagttgaggtgttttggaagtgactgtaagttatttgcagaacttaaacatgggtttcatttcactgtgatagtcgcacaacaataaatcctacaatactgtaacaaaagtcaaactgacaatcaatataaacaaataacatggagacttctcaacagctgtctttagcttcgaaactgatattctgaaaccaccataaaatgtgagccataaacgaatactggtagagtgtacccatttcaaaggaatatgagattcacataaactaaaattgtatattctggagtctgtaattaaaatgcagtaatatgctgtaggagtccgtgcctacagttttgtaacttctcataaatattttctgcatgaagtagcagttggtgtcctcttagataaaaatttcttaaacctcagaaaacattctttatgtggagctttttaagtgttattggatgtgctgtgtctgctctgtgtttatttaaggatgtctttatgtctcataggcatggccctatgtttgtccttttaaaggtaaaattgtattaaaatgtttctgaaactgcctaagaacagatggcaccatttaggcagattcattcaaagttaagcacacattttaaacaaatgtgcttttggcactagcgactgtgcctttggaaaaattttagtgatgattaatcacctgcatgcagagagctttcacgtttcctattagcctatgtatatcactgtgttaggcagtacagagacaagaaggaaaataagacctggatgttgccctcaaggaacttacaatctagtcaggatctaaagccacaatgtgtgaaatgagaatgagcatgaaatgagaaaagcaaaatgtgcagtaaagaaagtgatctgttcttagcaatgaacatgctgatcctctaggtaatatctgaaaatgctagccattccctcattctaggagctcgccaccctctgcccaccacctggtttccagtgccaaatactctccagtcactttctccttctctatcgctttttcctttactctgctctcttctttgcagtccctaaaaataggtgtgtcctaagctatggtgaccatatttcctccccttggaaactcatcttctacagctcaaatcctcattgcataggctctgtagtgtaataaaaatcacacaccaaaaatctcagaatttggtgtcagataacctggtttcaagtcctggttctgtcacttactagtgttaaaagcttactagtgttataagcaaatttacatgaagtaattttgattttcatgtttctagaatgccatattaagacctgcttcattgcagggagttatattaaataccaactgaattactgagtgctgaagtgatctgggaagtgtaaaaggtcatattaacgtcgctgttgatattcactttattcagatgcctcctgtatccttatctcttacctcaattgttctgtatagcagattggaatgtccagcagtttgactgatcattgtcattaaaatgtcttaccagcatcttgtacataatgttcccaaaacaactgtatctccttccctccctctgtgtcccatggatggatatccaacccatcctactcctgctggatttctttccacttatctgtatctcccccagtagccaaatatcctttatctctcacttgggttactgtagtctctcccttctagtctcagtatttactcttgtcccttccaattgttctccatctctcagacaaagtagtattgttaaaaggcatatttgattaatgccaatcctatctacatcactgaattaaactagcatgctccctaagactaaatatctctcttcctctcaactgggccttatgcaactgtttatcaaaatcctttttaaatatggtactctggcacttgaattgaatatattattatttcaaaagtagcctaaccacagcagaggacattggatgtattacttcctggaacctggacaatctaaatctaatattgccagtaaatagcacatcacatgaagtgttactataccggatttgctccagcccttacatgctatggaatttctttgggacacacacacacacacacacacacacacacacacattagtttatttcatgactgcatttgattagtttttatgtcaacattacaatctattggatcttggtctttttgtcaattttgtgctatctacaaatgaaaatatcttgtatattctcatccaaacaatgtgtaagacatgaagcagtggggcagaccaacaacattcccagaagaccacctctgctctccacccggttaggtaactgttacaggtattctacaattgacttcaatccaagtacttttattaccttcaatttctctttatatccccaaggatattttgagagataaaaaaagaattgatttgatctataaaattttaaatgctatcagaaaagtgaatgaaattagtttaaggtaaaatcaatgctgactttttcttaatagcttactgaccattatttaataatcctttatcagtttcttttttagggcttgtatcaaaaatattagcttgttatcttccatatatgttttctttttcggaaaatggagaatagactttcttttatggggtgaaaattgaaaaacctaggctcactggactccttacagagtcatcatatctgcagtctatggttaaagaaagttatttttcctctttcttatctccagtgtagcaaaactttacttctcactgaagttccattcatctgaaagattacttcctacaaagcctctccatttccctcttcctccctcctagacttcaagctccttgaggacagggactgtgtcttatgcgtcattgcctagcataacacagtagtgttaaaaatgtttgttaatttgttgactcttgctcatttcttgtgttctggaatctctacagcatgctccataatttctaaaaatcttcaaataattctgtgactacatctgcaagctttttaagtccatggaatatagttcatttgagtctaaaaattagaactatttgaaacagctagattaactcaaatctccctatcagtcttgggcttcagttatttgctgtgcgtgattccagagctcttaatcactactctctacatcttcaattgccttttctcctgtctagaatgtcctctagcttatcactcaagtatacccttttcctactccccaaataagcctactcaaaattcatttatcttcatgaattccctggaactatccccaattggcattagccattgtgttcagaaaagacatttaacatttgcgcatatagacagtcattaatatccaaaccctggaacaatccaaaaaattgttgttccaaatggagtttcaaatgttcataaaaaaatccatttggaacattgtttaaatagtgttattgtaatgaactgtttgttctagtgcgtagtgaagtagtggtgtgatccactgggctacaagtgagtgtttggcgtcctgctcattttgtggcagtgtaaacagaatggtgcagattgtaaaaagtgactcaaaaatgaccctgtcagacaatggtggcttcaaaatgttcatatagaaggggcttggagcagcaatgtgactgtggaggcaggggttgatgctgctttgttaggacactttacataacatcaaatgcctggattgaggccaggagagaggtgctaaggccccttctactgccctttattcctctccctggcactgattcagctaccactctcagaagctatttcatatggtaaaaaacctcaaatctcattgaataataatccttttctatacagcaggagatacctgtctgctgaaagagaaatttgaaaataaatggtgatgcattttttttttgtggggggtgtgtgtgtgtgcgtgtgtgtccagccatttttagtaatgataattctgatttgggggcaaaaaagaatttttttcttttttctcttcctattcaataagtgaaatataatttcttgaggtttacataatatgctcttgtggatgtttgtaaaattaatttttttctgcttttagttaaactaatgttttcaatcacttcaaaaatgattatagacagttaatgcagccttcaatgattcaaataacctctgtatatcatattaaaaattttctagggtaccacttacttatttcttgccataacttataccttttattccattcctgtgtaccaaaatctttttttcaatcactttgttatcttggagtaaaatatctcgacaggaatttccactaatctagaatagatcaaataaaggaaatctcttttcgattgaacaggacattataaagcatatgcctgagactccttaaaacaaaccaactaagaacaacaatagcaaccacaggatctagaattcagctttccacttcagttctccttgtctgataacactttctacactgatactctaattgatctgttcctctgctcacttgctctatctgagttgaagactgaaaatgctaacttccatgtggttttctaaatgttttctgggttggcatcttggcctttcaggttaaacctcacccttaatgaagaattaccgaatctgttacctattggttaagtgattctttatatagttcttcccatattaaatgaattgaattaggaagcttgctatgcccttgatgtactctaactcagcctggaaaagtgagacctgaccaaacctagtggtttagcacgtgaccctacaaacacctaccttgaacttttctggagttgtttcagaacacactgcctagcaacaaaatattcctgagtggatattcctctactggaattaatgatcctaaacttctcatttttctttctgacttttctgtttataagatacctggcttttaggaaagtagtcaaaatgattttccccagttgcaggattctaggtctttttcttatccagcatgttgtcaaagtagttttgtaaaagagaaatagactagacacaccaattttatttaaaatttaaaaacaaactttggagcaatctggaacatataataagaatgttctaataattatgattcacctttatgataagaataggtctagtatgttttattgtgtatccctcctaacaagtctggaatcaatttgatggatttttgacttttacatcctcaaagatctattggccgactcaaaaattttgggaaaacaaagtcagaattagtggttctgttgaagtttcctctgtggatgtcaggatttggattacttccctaagggtcatttctccaggatttggcaaattaaagtcaaacacatttatatcaaaatctaagtcggctaaattgtggtacatatgggaaactgagaaggaattttgcctgtatctttaattggaactacattcaattatcattcttacacatcattcttgagctagatagcatcatatcctccacaagcattaaggtttgctctctgaacaatgaaaattatataacccaaaatgtctgcccaaccccctgctgtatttttcacttgattgcaaaaagaattataagctaaatttagccatcaaaacagtaacttatcataattgtctactctgtccatttttcatcttttaaattgagtttgaatttttttcttttttctcttcctattaaaattcagccttcgcttaaaaatttccaagtctgactattcacataagtggaataataatattatggggctaaaagaactaacaatcctaagaattttagcagtttattcaaactgtcttttttatacatactacataccttgggattatagacaagctgaaattaccttttactatcctgtgtataaacaattaagacacaggtaatgataacacaccaaggagaatttagatatccatttgtatcattttgttctaatgaaaaaaaatatatactgtgaaactttattgggatagcactcaatgcaatcttcgagtttggacatcaagatcagtaacagacataaattttaggacaatgtcactcagagtacagatgccgaagaaagaactctagaagcacagatgtccagtggtaggcataacaacctattttattttcacttatagttgacttgtattttctgactagatgcccttaagtctctttctttagctttgtaatttagtaacttcaatagaggatgtcttggaattgagctcttccaattttttctttgagctcttccaattttttcagttacgtccttttcatctgcagattcaagtaattccaagtttcagaaaacttttctctagtttttctgttgcctttgttccctccccttcttcaggatttctaactatgcataattggatgctcctttgtctctctttctagatacaccttctctcattaatttttatatacttagttatttttcagtcacgtttcttcctcttctttttccctcctcctccttctcctatatcttctcttcctcttcttcttcttcctttctattcacttctaatggcactttaatctctttaatggctttttctctttcatttattttctgaagtttttcaagtttgcttttctttgtcttgtaatctttttctttgggctcttctataatattaagctattttttaaaaaacaaagattgtctttaaataacatacttaagattatgaagaacaagccctgtgctctctgatttaatcagccttcagatgtatgttccttagccctgacacctactccatatatataaataggttgtgggatgttttctttctgataattttatctttgaacatgactatccctttcctaaagagtagcctagaggataggtgaggaaatattcatattgggtttacatcctgaatacttttacattacatctgttatgtctttagcctcaagagcataaactttcctcaatatttcacatgaataggtctgggatggctcacagttaagtcccttaaataacaaactccctgaaccccactcaccaaaggccatcttctttggcatgagcctacatcactgatcataaaaatggcttgtatttaaggtttcttctttggatccaccttctatagttagaatgaatatctatataacattcccagagtcttcctccatacttgcctgtgtttcagatctcatcactctaaccaaaagatcattggatttgcatttgagaattgtgaccctttctttaaagggaaactctatcctgcctgaggttggaggacatatgagttggctctcagcaccctctctcaccataagtcaaattcatagtatttggcaggttttctcatagtttgaggttatggctatttccttgtttcactgaagatggcttttttctcctctctttcattttttgttgctgttgttggtgaatgtcaataatactgaatagagtaaaagtgactttcatatgctatgtttaattcgagatgagaactttaaagatcagaagaaactctgggactaaattttatagccaaaagactattcttttaataatgtatatggagtatataaatcttaaaattctaataatagctgttccataccactcatttattttaatcgatgttttagaacaaatctcatggttcatgtaataccattaaatcaggttagatcagaatgcaaactgtgttataacacagaagtgctatttaaagaacactgtatatttctcatgtatttcatatataaaatataagaacaagaaagaaatgcttgtcatatagtaagtgctcaaaattaaagtttcttttcttctatacctagtaggtatgtataatagataagaaaagaggttagaattgtcaatatatcttttactaaggcttctagctacttatcagggcctaataagaagaaaatgctattcttatttatttatttatttatttatttgaggtggagtcgcactatgttacccaggctggcctcaaactcctgggctcaagcaatcctcctgcctcagccttctgagcagctaggattaaaggtgagagccactgcgccctgctaaacatgctattcttactgtaataagatcaaggccaaaatatagtttgcctgttgtatattttgctctaaccaggttcacaaattttataacaaacttgctaattatatataactaacatatctttcaaacaaaaatttgtgaggatgtgttagtcagtatccctttaatgattttggaactaattgaaaccaaaatcctcttgttttccacacacatcccacaaggagattggggcttaaagttgtgttaacaaacacaatcacacaataaagctactccttccttcctgccctatccttatgttattagacaacacgtccaagaacagctgttcctataactcacataaacctattaaccccaactcacaccctgtctcccaattatttgcacttccacaaggtcatacaacttactccaaaagtttgctaatgtgcaaagcctgagagcttacaaagcacatcagcataactcagataaatctagtacacatgctccacggtttatgacatggggttatgttcccacaaacccatcataaatggaaaataccataagttgaaaatgcatttaatacacctaacctactgaacatcataccttagcctagcctaccttcaacgtgcgcagaacacttatattagcctacagttgggcaaaatcatcttgcacaaaccttattttataatgaagtgttgaatatctcatataatttattgaagactgtactgaaagtgaaaaacagaatcattgtatgacaacttgaagtacagtttctactgcatgcatatcactttcgcaccatttaaagctgaaaaattgtaagttggggagtgtctgtatgtcttttatttcaagcaaagaattaggtataaagacctctaatccctcttggggaaattatttataaatcccataaactttgttgataggctaattatttggaaagtaacctctttcaaaagatttgaagtatcacacacacacacaaaatgttgaagtcatctgtgatgttctcagtactcactaataggcacagtgtaccataaaatcactttcaattctgggcctgacattggaggtcttattgcctgaaatcaccaggtcttcctctctcatgaattccacaaaacagttaatcagtaactgatgacctactagttgccaggtgctgagagaatagagatgaacaagacgaaagtcttgtctttaaatagttgccagctaagaactccagggcctgtccaaatgttatttaattcaattgtttctatatccctagaaggtgggtattattatgcccattttacaggttagaaagtacagtttagaccagttaagtgacttgtccaaggacacacacttggcaaagggtggagccaggggtagaaaagaaggtctccaaagctcatgctcttcagcactacttggcggggatggcaggagatggtgaagaaaccacagagtagaaccaacactgactggaggaagtcacctgaccattcacgtgggaaaggaagccaggcggaaagaaagcaagctgcccacccaggggaccccggactttcccaaagtcggcaccgagtgttcctttctcaccaaaggtcccctgcaagcagtttcacagcaaatgttttataccagatacagcatattattgctccagaatccatccaggtcaataactacaccaggtaatacctatataagaaattatatgctagaccactcggacacagtattcacttcctacagctgccagtacacagtacaacaaactgctgaataggatgaagttccagccctcatggggtcaacggatcaatcagacctaacctaacacttcaagagagaaacaaacagaagacatgaacaaaaacagaaatgcaaatggccaacgaagatataaaagtatttggtaatcaaaatgcaaattaaaacaagatttctttttttgtctaccaaattggcagaattttcaaatgttgtggtgttgacaagggtgcagaatatagacctgcttggttttttttgcctctgggagtgggtttcaaccagctttcttaagggtaaagcccagactgctcccaaatttagcctgagcacatttaaaatgctacaatgcacattcctgggctccacatggaagagattctgaatccatcaaccagaaatgtaatccaagaaactgcatcatttaattatcacagggtattctaacacaggttttcctaggaccatacttgggcacagagtgccctagaccatgggtaggactatgccttcaaggtaggggcaaatggtcctatctatggcactatgcatggcctgatcattgaatgcaggctgctttcttcagttagatttgatgacttgatagaaatatttcagctataagacaaaaaaagtatcaagttatacttgcgactggtggacttggatgctgggtcacacacagttcagcttttataatatttattctctttggcccagcagttcaacttaaaaaaaaatttatcctagggacataatcaagttttattcaaaacattggtaggattgctgaaattacttaagagttctgaataaataagaagaggctgaagctactcttaataacttttccttaaaatgctggctatgggtaaagaacatgaaaggaaagagcactccactttgtgtcccacatattcagactttgttttgcaaatgttttctggttaccaaggcaacttctggattcctctgtgtaaatgggaaattgggaacttcgttttttaaaaaaatgattcgtttgttctttttatcctggtaagatcgttctgtgctgacaaattgcattctgacaggttgtaatccaaaacatgcttttttagaagactgtgaataataaggaatttctagtggttgacagttacttgtcatttatatttttatgtatttgctttcattgctttcaaggtataaactaaggtgctaaatattgggtatacttttaaaataatttagaaatatatatataacatgtctacaacaatggaaagacttacactaagcaggctgtcattgtaacatggtaattattattaccaaagaaaagacaaaagcaagcacagaagcaaccaaaacctattagacttggttttttaaataaaacaggctttacataggaaaaataaacaaattaaacaaaaattaatgcacaaccagcattattaggattagccttcttcaggtttcagctatttataatattaaacactcatcagtaagtaataggaaaagacctggaattctggctgggcgcggtggctcacacctgtaattccagcatttgggaggctgaggtggtcaggccacttgaggccaggagttccagaccagcctggctaacatggcgaaaccctgtctctaccaaaaatgcaaaagaattagccaggtgtggtggcgcatgactgcagtcccagctacttggcaggctgaggcacaagaatggcttgaacccgggagatggaggtttcagtgagccatcacacacaccatggcactccagcttaggcaacagagtgagactgtctcaaaaaataaaaaattaaaaagaaaaattttaaaaaagacttggaattttgtaaggtggtaagacaggtaagtttcacaaaggaatttccttaaaactttgcaaaaccccagcctgaaaccatgtagttaaagttcatgcataactttgaaagagcaaatggccaagcttttaagctactggagatcatggtggaacaggttaagggcctttccataacccactgaaggtgagggaaagtaattggcaaggatgaggcctgtacttctctagggatggatcgcctccgaaagaaagtcagttagcactgaggcggcaacaggctcctctacttgttttccttatagaagtttatgaatctatcttttctctttttcataagcattggtggacaggacccatttctattctgtatctcctcgtttgctgtttattaaactatatatggaggaacaggatttagtggagcatgctaaatcctttgtcatcatacgcccaaattcttactcaacctttattccttaatcttcgattattatgacaaataagagcatcacaaagatcaaatgggcaaaatgttggagtactgagcacaaatacaaatttgtaaagcaaaacaaaatattctgagatttaaaactacgtgaatgttgtttcaaataaaagtaaaaatttaagcgaccttaaatccatatatatggcacataaactcaacctatataagttagctagtctattgaaaagtattgatgcaaaactggtaaacaactgtgacaaaaacaaaaactaagggcccaaaataataacagatatcaatacgatgctttcagtatctgaatttggtttgcattggtctatcttgcgtctaaggcagggcattctagagggcagacatggggctgaataaaaggtcccttgacggagatttttctcggactacttatgctttcagcttactatgcctacctaatacttgttatcagagacaaggtaaaatacagaactctggaagggtggtttaaaaagaaaatgccagtgaaaacagtaagctgttcatttggggaactgttcccacaccaccaccaccaccaccaccatcccattcccttcaccacagtgtagctggatgagagcttcataaccctccatctgcaatcagaaaccagttacaatttgggcccctgaccaagctgggtcaatcctagctcctatatagaattctcagataaaataggaactcagttaaatttgaatgtcagattaacaatgaataattttaaatataagcatgttccaaatattgcactgagatatacacactatagtggtgttaccagatatgccaacaatagctgcaaatgcatagaatactccctatgttcaatgcattgttctaagtactttatacatattaacccactaactaaatgaaaacatatggatatgtaaacacatgccaacatatggatgatttcaggttaggaaaaatggactgagtatttttaaattttagaaaatatgcaaaacttcctacaattaagacatgtaatacattgtcattaatgtacaaaccaatttgtatacaacttagaatataaaaataaaaacttaaaggtagatacactaaagtagaaaaagcagtggattgagaatccaggggtctagatttctgttcctgctcattagctagctgggtgaccttgggaaagtctcctcacttatctagatctgggtttctttatctgcatgtgaggtttggacgagattatttttaaggtcattgttggccctaaacttctattatatcttttttttttctgccttggcttcagatactgtatcttataatgttgaagaaacagcttgcagagagaagtttattacctctgcaatcattcggttggtgtctcctaaaaaaagcaaattcagagcttcttcctctgtggttgcctgatggagagtcaagtttttcaggtgaatgttctgatcaggatcctccagtattgtcactttcctaagcaaatgggaagcaagaaaacaaggtactgctgagaatgaaaagaacttgaagtcttccctacaggcttttaaaaagctgtatagtatgacgtcttgaacttataaaagcaaataacacacaagataccagacagcactggattagaatcaaacactgacattcccttcacagtactatcaaatagctttgagactgaaaaatatattacaagctcctgatttaaagccacctgtcattgtaataatcagatcgctaaatcatcttagaatgcatattctttctgaattaaaaatacagataataattttctatctgcatatcaggaaactaggccatattttttctgtgtcatgattcagtttcttacataggcagtgaactcattcctttgttcaatttcatatcactttcaatttacatgacatttcaaactggttcacttaccaacttaaacgtgatgaaaattgaggcatctgtcatccttctaggagttattcccctattgagttttctcatcaaggtgaataaaaaattttcaagtcttataataaagatttagcttgccattattattttaatgcctctcaaatccatttcttgatcctttttcatttacaacatacctttccttccattacatccttttagtcagagccttagatctggaattacattcctctattacaactaccttaatgggcatcctgatgccaacaccgtttcctcccaggtgaatcctaaccctgtttccagagttggcttgtcaatactctccctaaagtcctttcaggactttctgcagtggaacaaaatttggctaaactcctcatactctgcttcacaggcctacagatttgagtcataaagttactaaagagagttcctttctacctcttaaattttgccttcttgattttcttaagaattgttaaggaaaggaaatcttattattcacaagtattgccaaagagtatctcaggtatcttcactcgtttaaaacatttggaattgttgacactaagtaaatgttggcatcatccagcactacttttcctttaaaagaaaaactagcagatggacatgtgtaattttcttttttataaaaacttattaagaatatcttaaaaatgaagattttgcaagtatcataatttttttcatctttcccttttgtaagaaagttatctggactttcatatgtaatttgtgagcacttaaaatcctaatggcaggaagaaaatgtagctctaccagcacatctgtgaccaatatgtcactaataatgtcctcctttgccaagttttagactcttttttgtttccttcaacaataccagcaaaaatggaaaaagatcttttctcttaatgaaaacaagtgtaatttatttatttttcaacaagactcttaagtgagcttattaaaaatgcttggaaaagagaaaggcatttgaattgaattgaattgaaatggatgagttgtattctatttttaaaaactccctttattccttaaactttatttccaccctgatttttctgaagtgctcaagaaggtttggctaaattaaatccctagagacacggaagtaatgattcttcctaaaccgacagattctggggcttataggtgagagaagttaagtaatattggaagataaagtaacaaaataaataatgagatggtatattaaaagtgagaaaagggctaggtgcagtggctcaagcttgtaatcccagcactttggacactgaggtgggaggatggcttgagcccaggcattcaaggctgcagtgagctatgattgtaccactgtcctccagtctgggagacggagcgaggccttttctaaaaaaaaaaaaataactacataaaataaaaagagagagagagaaaagaagagagttctgcctttgtcagcatgaagtcaaaaacgaattatctaactctaaggcaaagtcacctatgatacactttgaaagaccaagacagatacaatactattcttgtgcaagtttggaaaagggagagatggggtagcagcaaacaattcaaaggtggtgcatacactcattgggcactaaatgtacgtcaggcacttgccttatttcatttaatccaggtgttcccaaaaggaactatctgtggatacacacacccacccccacccaccccactctccccagacccccatacacagcactgctgcttaggtcccatcctaagagattctgatttgattggtccagggtatggtctgggtattagaatttgtaaaagtcccaggtgattctagtgtgcagccaagggtgagagccactgacttcatttttaatatcccttctagtagacacatggagaggaggtttctgattttttatctttactttccatcctgttccacttcatgcccaaagggtaaaattactaattttcttggttgtaaaacacctgaagacactgatgagtcatatctactaataggcaaggtcactgaaaattttaaaaagactgtctttccagggcaagtttcttttctacctccctgaccatgcagttggtgagtatactaagccacacaacattaaccacacaataactaacgctcaactggggattatgggtctccctaaacatccatagggtttatataattactgaatcaaaaaatgtaagtaatagtaaggacacctaatacctatatctctcaccattacttcactgaaacaggaaatgcagagaacaagcaagtatggaattctaagcatgctcatttattagaaaaccttatatgggtcactgatttgcgattatatttatatagaataattacatgcataaggtaaaaagtgttaaatgtcatcagtgatatttggctaagctacttttttcttctaaatcacccagagcctttgatctccaatgtagctacttcagaactattacacttctacatttacttccaggtgcttgtccagctttgtcacaaaatacactttgtacatgcccttggcgtttcttcatagaactctcggctatcttttgtaacacatccctgtgcgttaatatcatgtgttcctcacttttttctgatttcttgaccatggaggttttgaaaagtaaatacaaaggcaggttagagttttctttcatgggcttccccctgcttagggctcatttgtgggcacgctataaaagggtccacttctggcatccttctggaatctttgaaacacaatcttccctcaccaatcagggtctcttcttgccagttttcagattcttttctgatttctgcccaatcccttgggcatgatgctttggactttcccatactgccccgcctgcctcccactgaaaatcctttttgcactaagtcttgcagccagtgcgtcagccccacctatgttcatgcctttgctcatagaagcccagcctgagccatgccctgggcactacgtctattgcctgggagaggtagttgcagaatgagagtgttttaaattctactgccagtgaaatggtttttcaaagttgaaggaaataaggaccattacaaaaagtttctcatcaagttccttcctttcctggccctttctttccctctgtccctcacaaatcaatagctatttcctgaatccttaatctaccacttggttctgactgtaattttcatgggcttgaaagagggctttattagagtttcttaaataaacattctaattccaagatggaaacccccaaactatttatttgattttttttaacaggcctgtgaacagctttccctacaaaatgtttctaaaatatttagatttcaagaaaagtcactgatagccttaacttggatacctaagtggaaaagttctgctaagtgtactcagcctgcttaatgatggggaagaagcaagctttgtgttttctctgtaaacagagaatcttttccatttggctaagtagttggaatttgtagactctttttaactgactgaagcacatataaagagcaataggcaggctcttgttctcaataatggaagctatcaatgaaagaatcctccaccccacaccctacctccacatttcagtaccatcaacttgctgaaaaggaacttcccagccattactgcaaggaacatggtttctaacgttcatgttatatataagtgttgccatggtgatttctattttttatctatttgcaaatgtcccctatgatggtataggtcatgcactatgcaatggcgccatgtctgagggggtgctattcacatcatgggtttgtatagttatcacgacaaatgtctgtcataaggcaatgaagagcctcctaacaaaatcagcatactgcaacaattttccaatagatggcagaggtgccttttaataagtgacataaaggtgacttgaggtcatacagactagaggccattccgtctagacaccctgacctagagcaatgtcaagagcaggtgggcctcatgacaatgggtgggggtgcaccaggctcttctaaataactagatatgtttcacatgttgtaaacatagtcccaacacaagtcacttaaataaagagaacattcacttgtttgtcagttctcaatatcctttttgtttctccccaacacattttctcagaagctctttatggtgaaggtttagggaaaagcagagatgtaaagttttaggaaaagtatgtaaggtgacccctcctttctgcatttaaacaatttcaaaggtagattttcttagattgattacaactttctaaaaggtttctttggttataaaatataaatacttgaaatatgtttcttgggaaagattcatgaacctgcaatatatttttgtgttagtgttgacctagacaaaatgggctaaaagcaatggacgttttgtccattactgagatatttcaaaagctctttctagtagcttgaaaaccgtatcttttctttgtagttttatctaacatcatatcttttcactgacaatgaagaatatagctgatcacatgacattcgtaaactaaaaataaaatcctaagcccctcatccaactgaatggaccccctattggccacggggaccccagaaaacctgacaaactgaattcccagccatgataggaaagaaggttggacacgcttcgttatgcgccctcccttttggagtttcggcacaactgactagcattaatgttaaaacagagatcataagactcacagaacaaactttttgtggcaataagacaccaaattataaacaagacccaaggccatgccagactagtgttaagtcacaccctacaaatcacaaaatctaattaaaaggtttttaaaaattaatccaatataatgtggcttgttttccaacctgactgtgatgtagcatcacagcacagataacagacgtccccagtctcaacttaagcattcctttgtactgacttcaagtcattagacaaagcttaactctttcaaccaattgccaaccaaagaatccctaaaacccaactctgacttctaagtccctcctttgagacggtctaccttttcaaactgaaccaatgtatgcctttcatctgttgatttatgattttataattcctgtctttctgaaatgcacaaaaccaatctgtaaccagattgctcaaaataaacctctttttattttattcttattggctcaaaataaatctctttaaaatattttacagagtttcctttttctgttaacacgttttagaaactaagttagttaatataatctgcaacctacaacaccaagttctaacttttataaaagtgaaaacactaacaaataaaatactttatcagaagaagtccaaactcagcactgcaaaatattctgagtaattcttgtgataaatttttcttttgctatccacatgaatttcttttatttcaaactggcaaatatctcctctaaatattatcatttttatttctaatttacctttattgctaaataataatgttaatagacttggactcttgtaagtctgaattcccaaagatcttaaccaacctcctaaggttatcctgctaccataagcctgccatttcagaagtgctggcaatctgtaaatgatttattccctgtctgaagaggaacagaattgaaataaccaatggataaagtcatttaatgtaatgtaaccaacagggttcaaggatgcatagtgacaatgaggaaccagctgcacactctccagaagtgtctgctgcttactgtgctcgtatgcttcaatatgccatgaaaatgaacgtcaccaaagggactcaggacataactggaagctgttggccactgctatggacatgtgaagcccaaacaagaatgatctatgatcagcaaagatagaaccatactaggtgcaattaatgtgtaggagaaccaacgctttctcaggggtgattgcactcatttatttattagtcactataatttaatcatttcactaagattgagcataaatacgaaacattatgttatttccattgtcttttttcaaaataatacccaaatataataaagttttagattgctaataacttgataagaatatctttctgtattatgttaatctaaccaaactattccatgccctaacaatatcacttcacaaccatcaatggcgcccaaatctactgtattgaaacatggtttatcatacacttatctattgcccgccagacatcatcatttgcatgcttttccaaaagtgaatattttagataatcaaaaaactgtgcttgttacgctagtattccttgctaatttctaaaaacattcagccatatcatgttccttctgatgctccaggcttacaaataacccaccacttaatgaaatgtcttgtttggcctaattccatatagtaattatacagccgtgcactaaaatttgttttctttagagctaccaactttttttcaaaggaagttttctcccatttttactaatacttgctttcttattcagattttatagtgatagtaccacaaattatgtactcaagttttccacatttgggaaacctataagaatagatacatctagaggcaatggatttgtaattctggaaaaccatagcatttcctctgccaggtaaatagctttatacacctcttagtttatgatactacattttaaaagttctgaatttatttacttttattttcattttaacattcagtttattatttttccaactataagcataatacatgcttcttgtgaaaaagtatgaaagtagaaagaaccaagaaagcagagcctcatcacaaggacaatgtggtatgttaatatattgccttaattttcttacacacactttgcagatttgtcataaaattataaatgtatgcatgttactctcttttgatcaccccttaacaacattttatttatttatttatttatttatttatttattttgaggcagagtcttccactgttgcccaggctgaagtgcagtggcacgatcttggctcactgcaacctccacctcctgggttcaagcgattctcctgcctcagtctcccaagtagctgagattacaggtgctcaccattgcacccagctaatttttatatttttagtagagacagggttttgccatgttagccaggctggtcttgaactcctgaccttaggtgatttgcccaccctggccgctcaaagtgctgggattacaggtgtgagccaccgcacccagcctacaacatttttttaatagttacacaatattttagggttaggatgtattaatgaaatattttaaccattcctttatgagaatttgttgtttccaatttaaagctgttttaaataacaccgtaagatagacacacacacacacacacacacacacacacacacacgtacacatatatctttaactgtatcaatatatatctgttcctgaagcttttgaaataattcatattttctccttagggatgatttctgggggtgacgttacaagatcaaaagttatgaacagctttaaggctctcatcatacctgggaagcctatagcaccctctgtggaatggacaaacctgggctgagatcctggcctcccgccatgtgctagcagtaagtctttggcatcttaggaactctcgttgcatctctgtctcctctataaactgaggacaatatcacctctacaatggactgttgagaaaaaaatcatgtatttaagttccttgttcatcgctgtgccccaggcctaaaaggacacctgtttatgtttgatgcacaataatacattggatgaatgaacaaatgtgcttagtagtgtatgttgcacattaaaatccaataaatagcaacttccttgaaggtaggcagtaaaatgctttccaaaaatgttatactgatttacattcctactgtatgagagggactgtttcactattattttaataacactgaacattagtttttaaatttttgctaatattttaggttaaaatgttctgtttaatttacattctttgaatggttaatgaaattgaacctatttcagccaggcgtggtggctcatgcctgtaatccaagctctttgggaagccgaggtgggtggatcacctgaggtcaggagttcaagaccagcctggccaacatggtgaaaccccatctctattaaaaattccaaaaattagacgggtggggcggcgggcacctgtaatcccagctactcaggaggctgaggcaggagaatggcttgaacccagaaggcggaggttgcagtgagccaagatcacaccactgcactccagcctgggcaacaaaagcgaaaatccagctcaaaaaaaaaaaaagaaacaaagaaattgaacctatttccaactgttttttaaccgttatattgttttgtcttttgtctacttatttggggtacttaaatgtatgagctctttatatataaaatattttgtttcttatatttattaggcaaattttatatgtgcttgctttttaactttgatgtattagaaattttgtttgttttaacacataaaagtttaaattcttataatgtatcaatcttttcttttatttctgtactttttaagcttaaagtccttccaaatcaacagagtatataaaaattgacttttcttgtactcttttgggatatgagtagatggaatgaaataagggctctaaatggatttttcctctccatcaatgattgtgtggctcatgatgcagtttgcctgtatgggatctgtcctccccttctccctaactattaggctttgattttgttcagggaattatttaaagacactagactttcccagattctcttgcaactaaggctgcccatatcacaaaattctggtcagtgacaaataagtgaaagtcattggatggagcttcctggacatgagcagcctcaggcagcaggtgcctgtttccttccagaaatgtgcacgagatgctggaggtgaggcagccattttgcatgatgactaaagctgcccactaagaatggctgtgcagaatgatggaaggaagccctgaaggcatcctggagcttccacagcagccctccctgcctatttttagaatctttaaggtgcggtggtgtgggagaggtgaggcttggggtgtggcaaggaacagactatttggttaagccattggaagttaggctgctattacctgcagttgttaatttactaacacaaatgtccaatactgttgactgaagaattcttccctctacctacattaaatgattacattgtatagaatatgattctggtttaatctgtttgcttttcttcatctgtttaatttagaagtagtataacatgatttcattattagaacttttacttaatttgaatagatagtgtcattaattttctctcacttctctactttttgaaacttttgttcttcttggttgtctatcctttcagataaactttggaatcatatatatgttttttaaagcctctgtgattttgtttggaatttcattgaacctactcattaatatgagaacacccctttaaggtattcctattgcacactcagaaacagattaataactatctattttcaagtcttcttttactttcacagaaaaatgtactatcttgttcataaagttctcgaacatttcctgagcattttaccttcttttgctattgtaaaagagatctatttagccattatttttctaaatggattattcctagggcttgcttcttagatcgagttaggtaaatactaatagataatagctggccagttggtctgaataccatcagtcttatctctgtttcataataactaactttcgttttgtagaacatcttcaactaccttagaattcaatgtaaaaacacaaagccaattacaattaactgtggaatcacacataggctaactgctacggaagttccagagcagggagattaatatactgcttgtgaccttcatcacctggcccagataactcctccagccatctgacgtaatctcttcacttccctcacctagacttcattctaaaggctcttcccatgtgtcccctctctcaggccagctcagctctgctcccacctcagcagcactgtcagctcttggctcagtcagaacttgccatacgtcagtaaaattaggaaaccattgagggttatgggagcagagacgggggtgttaaaaggggcctgagtaggtagtgacaggaaacaactggctgaagtgggctccttttatgagatgactgcagctctaaatcatgtgtatgctcttttcacatgtacatacattattagtgggatagtcgagtgtggtgcagaagcctcttcaggtgtttcatgtgtataccccattttccaactaaatggtaagttaattgaagagacgaatacagattaaattctttataatgcactcaaaagagctaattgagattcttgcaatatggtaaattgttggtatacatggtattaacactctcaaaaggttgtaataatttttttctctatcagttgagctataatagacgtgtttctaaaccctgtacatttttctaaagaacagaataaagtgatcaagcaagcttagaatcattcaaagctgtttgaaataatcctaaggttttgcttcatatactgaaaattgagaatggattctgaaaatgatgtactatcagaataaatcaattcataatgcaatcgtggagactaacaggacaatatgtcaaagcaagacaaatccatactaatacacagtttagaatgtgtatttcacctcttaatggctgaagaaagtgtatgcatttgttcatacacaaagcacaaggaaaatggaatagattgaggtgacagtgtttttcctgtcattaattcatgtcactaaaagctctaaatatcacagatatatttctatattccagatatacgagtgaaaacactgaaactctttcttcccatccttccacgcatcacttattaggcaatggttggtgaaagctaacatttctattatatggattaaatgtttgtgtcccctccaaattcatatgttgaagccctaacttccaatgtgatgatatttagagatggagcttttgggaggtaattcggtttaaatgaggacatgagggtggggtcccaatcccatgatggtattagtatccttataagaagagctctctctctctttctctcctcaccaggcaagaaggcaacagtctgcaagccaggaagagagccctcaccagacaccaaatctgccagtaccttgatcttggacttcccagcctccagaactgtgagaagtaagtgtctgttgtttaagctacccattctatggtattttgttatggcaacccaagctgactaagacaacctcctaattgtctaagacatttctgatactgagaacaatctccttcaattggctactgagagtagaggaagccagctttctcccttgttattactctagtaggttgggctaggcttcgtgtggaattatgtcattttcgggctatgggggctttctattccttcatcatgattactgacagtgtttcagttctcaatgtacacagtccctggccaagacatagagtaggacttaacatcactggtcactggttactcatttcatcctacaggaaagcacccccaactcctcaagaggctgccattccagctgtgtcagtaattaactcagtttaagaaaagactggagttagctttaactttgagatctatgcttataggcctaggagtcccctcaaatccccataggagacagaaaaaaataacacaaatgaaacatgtaatgcaaaaggtagtagtaaggactgaaggatgcatgcctcatctaaaagcactaagtaaaaaattcttaaacacaaaatgtgtaggccaaacaaaacaggtttagggctgacacaaggagggtccaaagtgtatgggggagaactggcttccaaaaggacagagttcctgagactagaggaaagtaggtaagtgagaaaaagggtgagaggcaggaagctgaggaaattcatgtttgacagtttccatattctttctgagatagggatacaactggttccaaagagatttagggcagggagtagtttaccaaagagatgaacgtctggtataatcattgtgaggatgggaacaaaaagcagcgggcacatgaatgtgttgctcagcaggctgagggcccagctgaggttggagaccataatgtggtggagcctactccagtcttctctgaatccccagattgaaatcagtttcccctcttctgcccccacagaatccagggcatcttgtcacttactatgcacaactgaaatgatcagtttatgagtctgttctattagaaccacagccctttgaggccaagaacatttactttcagacctttgcagagagtctgacatgcaccagatggggctgaaatggacaagctttggctcacccagactgacacaagtggctccagaggcctaaagaaacctagaaaccacagtctgcttcaggtggaatactgggatatgacacagatctcttaggaaagaacaccagcacccccagctctgatgtttaatggaacacggttaatatcctggttctagctcttagcagacatgaaatcctggggtaacagcacacaatctctgtgaacctcagttttgtcaaccataaaacatggattataatacctacttccttaaatgagataatgtatgcacagtccttagcataaaaactggcataaaataagtgctcaataaatactggttcactatcctctttggagagattttcctggtatttcaaaaaacaactttccctacgtggatgagggaagggattcaggcaaacctccggcattagaatcacctgggatgtttattcaaacatgtgaattttctgggggtggaagccaggaattagcatttttaacaatcatcccaggtgattcttacacttagttaaatttcaagccactggattatgaagccttccaatttagttcctttgtttttttactcccactgccacctaagtagtcctagtaacttcccacaatgctctgactcttgtccacctcattccagtcctacacactactaactgatttttcttcctaaaaggcaattccaattatgctatgtcctggaatcaaaatctccaagggctacaccttgcctgccaaatcctcacatttgtaccttgccagtcttaatgctcctgcctactcccttactgggttccagtcaaacaggtctactaactgtcacagaacaagccctatgcttcaacttctctttgtttccacacaaaagccacactccgctgccccaagtcctaccccttccctcaaggatgatttcatctgctatcttccctatgaatctttgcctgatctcttgcattgatgtgatttctttctcctgtgagctcttgtcattttttttggctctcttacaatgtttttcacattccaccttatgttattttatactagctttatcctctctgctacgagttccagggaaacagggactacgttagcaaacatggtgcctagcacaatggctggaacaaagttgggtctcaacaaatgtttgctgagtatatgaatgaattcacatgactggactgtaagtcatgagagcagagactgtgcattaatttttttgtaactcctgcatcacttagcagtgttttctatccagtaggtgttagaaatgtggtgacttaaatttaacatttggtgactttttcccctttgatgacaaattattcaaaaaatacaacacagccaagatttcaatactgaatgctggcatttactggttcctttttatagtaataaccatgacaatcgttagaatcttaaatggaatatgcttccctatttaggaatactaaaattatactaaagtaaggtgactattttctctacagctgagaccaacagttatcctgttttacttcatgagacaaacttagattctaactatagtccttttatagcatgtgacataagaagctttcaaaaatagaatttctattttcatttgaaatactaaaaaatttctaaatacagaataggtttaatacacatatgtgtgtatatgcatatgtatgtctatatacaaatatatagccaattactttttaaattaaaccttttgagattattgtagattcacatacagctataagaaataattcagggaaatctcatatacccattgcccagtttttcccaattgtaacatcttgcaaaactatagtattaaaatatcacaaccaggacattggcaatccaatccaccaatcttattcagatttttccagttttgcttgtactcatttacgtgtgtgtgtgtgtgtgtgtgtatacattttagttctatgcaattatcccagttttgcttgtattcacttgcatgtgcttgtgtgtacatttaatatttaattatatgcaatttccccaattttgcttatgttcccttgtgtgtgtctgtgtgtgcatttagttttatgcaattttatcatatgggtagctttgtgtatccagagccacagtgaagacacagaacactgcatcatcacaaggatcctttgtgttgaccttgtccaaccattcccctgccttccctaactctgtatccactaatctgttcaccaattggaatcatacagcatgtaaacctttcgggattggctttttttactcaacatatttccctggagattcatccaagttgttaattatctcaatagttcattactttttgttgtcaccttattaactaaagcctatagtttacatcagggttcattctttgtattgtaaattctgtgggttttgacaaatgtatgatatcatgtgcccaccattacagtatcatatagaacagtttcaccacccagaaaccccctgtgcttcacctatttattcttctacccgtccccctcaatctctgacaatcactgatcatttcactgtctctatagttttgccttttccagaatgccatatagtttgaatcatacagtatgtagactttcatgctaacttttgcacttagcaatatgcatttacattttctccatgtctttttgtggcttaatagctaatttttttcattgccaaataatattcccttgtatggatgtactacagtttatctgttaacctattgatgaacatcttggttcctaccaatttttagcaattatgaataagactgctatatgtatttgtgggaaggtttttgtgtagacataagttttcaactcatttcggtaaaaacctaggagcgcagttgctggatcatatggtaaaagtatgtttaattttctaagaaactgccaatttgtcttccaaagtggtgggatcattctgcattcccatcagcaatgaataagagttcctgttgctccacatccttgccagcatttggtgttagtattttagattttagccagtctaatttgtatgtagtggtatatcactgttttaatttgcaattccctaatgacaggtgatgttgagattcttttcatacgctatttgccatatgtgtatcttcttcagcgaagtggctattcagatcttttgcccattttaaaaatttgggcatttattttcttattgttgagtttttaaaattctttgcatatttcagatataaaaattctttgtatatttatatctttatcagatatgtatttgataattaatttcttccagcctgtgacttgccttttcattttcttaacagtgtctttcacagaacagaagttttaattttaataaagttcaacttataaatttttatttcactggtcatgcttttggtgttgcatctaaaaactcattggcaaacccaaggccatctggattttctcctgtgttatcttctagaagacttatagttttgcatggtacattctggtctatgactcatttcaagttaattttgtgaaaggtgtaaggtccctgtccagattcacttttttcatgtgtgcatatccagttgctccagtactatttataaaaaagactaccccctttccactgaattgccttcgcttctttgtcaaaaatcagttgactatatttttaagggtctatttctgggctccctattctgttccattgatatatgtgtcagttctcttgccattaccatactgccttaattaccatctttatagtatgtcttgaagttgggtgatgtcagtcttttgactttgttcttcttctgtattgtgttggctattatggctattttgcctttcctgtaaaatttatagtcattttattgatatctacaaaataatttactaggaatttgctttagattaaattgatctatactttatctacaaatcaagtgagaaagaactgacatcttaacaatattgagtcttcttatccatgaacatggaatatctttttatttagacattctttgatttatttgatcagctttgcagttttcctcatatagatcttgtacatatcttgtcagatttatacacaagtatttcattttttgatgctaatgtaggcagtattgtgttttacattttaaattccaattatttattgttggtatataggaaaacaattgacttttgtacattaaccttgtattctgcaaccttgccataatcacttatgaattccaggaatttgtcaattatttgagatgttctacatagataattgaatcatctgtcaacaaagacagttgtatttctttcttcccaataactttaatttctttttccggtattattgcaattggctaggacttccagtacaatgttgaattagagtggtgagagggacatactttccttgttcctgatcttgggagaaagcatctagcttctcatcattatatataatgttacctacaggcattttatagatattctttatcaggttgagaacatttcctacatttctagtttcctgagagtatttatcatgagaagctgttggattttgtcaaatttttttctgcatctattgttatgataatatgatttttattctttagactgttcatgccatggactacattaattgatttttgaatgttgaactagtcttgcataccttaaataaatctcacttggctgtagtatataattctttttatacatttttgaatataatctgctaatattttattgaggatttttgcatgtgtagtcacaagagatattagtccgtagttttcctttcttgtaatgcatttgtctgcttttggtatttggataatgctgggatcactggatgagttaaaacatgtttcctctgctttttttttttcagaagagattgcaaattctttgggatattttagtagacaatatgtatgtcttttcttgtttttcttttactgaagtgactagtatttccatactatattgaagaaaaatggtgagaatggacattgttgcattgtttctgatcttaggaggaaaacattcagtctttcacctttacacatttgttagctgtaggattttgtagatgctctttaacaaactgaggtgattctccttatttctaacttgtttagatttctatcaataatgggtgttaaatactatttctgagcttcgtataatttttcttctttagcctgcggattacattgattgcttttcaaatgttgaactagctgtgcaatctagaattaatctcacttggtcatgatatagtattgattttatacatttgtggattcaattgtcaatattttgttgaggatttttgagcctatgttcatgagagatatcagtctgtagtttttttttttgtttttttgttttttttgtacaatctttgcccagttttggtattcgggcaatactagactcagagaataacctgggaattgttctctctcctatttcctgaaagagattatgtaaaattggtgttaattcttctttaaatatttggtagaattttccagtgaaaccatctaggcctaaagatttcactttgtgaaacttataaaattatgaattcaacttctataatagttattgaagtattcaattatgtatttcatcttggttaagtttggtttaatcacctttgattgttaatttagatgtcagtatttctcacatttactaaacaaatgactatagcaacatttgaaaaaagcaaatgactttagtttagtgccctgacataatatatacaaaatccacagacagttttataggcaaaagttctgcaagagcaggcaagtggtacatcttataatgtaaaagaaaaaaaaaatagaaaaggcagagtgtatgtgagaagagcgtctcgcaggtgatatttggggatgctgtgtcactcaacggtaaggaagctgttactgatggctattattgtgcagcaccaacatgaccctgagttgattttatatagttaagccttgtataagaatgcaaaagagataaaatgggtatattgccattgtccctcaaatggatgactatgagtggggatcaaggtcaacagacattttgcctactatgtttagaaggcattcaaagtgtttgagacatttcagctcacaacaatgaaatcagtcaaccagagagctagaatttcagagttatagtatgccccagttcaagagtttgtaattaatagcacatatgcttaatcaaatccaagtacagcaaaaaaaaaaaaattcattataaataattattttatcatcttagtaaaaggcaaacttgtctaaggccctcagaaaactagcagattcaataccagtcaaacctcattatctccacacctctgcctcccgggttcaagcgattctcctgcctcagcctcccgagtagctaggactacagaagccaccacacccggctaattttttgtatttttaatagaggtggggtttcaccatgttagccaggatggtctcgatctcctgaccttgtgatctgcctgccttggcctcccaaagtgctgggattacaggcatgagccaccgcgcctggccaagcttcaaaatttttatagtgggacctagagaattaaggagtcattgacttaaaaaggagatttccattagaaagtttgattgagtgatgataataaattttacatagataagtttgctgtctaaggatatcatactagatgtttatatttacaataaattcctcagaggtaggaaatatgccttacttggtttagtagtgtctctactgcctaagccagaataagtccttaataacttttaaaaattatttgtggaattgaaactgtgaagcagacgttttgaaatgagagtgtagagggagaagaacagagcatgagctcttttcatctgaatctaatcgacatggtttggtgcagcctaacaatgggaagagctaggaatgagaaaagtccattgaacccttaagagaggtaacataatatatagaaaaaaaagtacttgatgagaagtcagggaatttgggttccagtcccagtcctacagtcttaggtaagttatttcatttttctggatttctctgtttataaaatgtgggcattggattaagtaatatttaacaatctttcaacctccaatgtcaagagttaaaaagactggtgaccttcacaggagaggacttatttgttgagttttctatccttcacaaaagaagaaaaagtgatttcagtattttcaaatgggcttcttttagaaaagagcaagcttgagagcaagcgcaatgccttagtccaccctgtgtcctccacatttctcagcatggctagcattcagcagtcattctcaatgctggtcagattgtctccagagatgttgctagctttcatcttcaacgacttcccctcctttagtagctttgtcctcttgttggagagttcactgactcaagttagaagtgacctcagttatataacagttgttttcaagaaacttccacacacatacacaaaagtggtctaaaactgttcttattctcacattttggactgtaattacatgacaacagatcccattaaaataaaaatgtcattaagaaagaagagtcccatatccaagtcaatagcctatttcttcgaatatattcactactataaaatttcagagcaattcaagaattggatagtccttttggtgtggagataatgcaaattaaaataaacaactgatttgtaatctttttgggagagaatgaatatgtgtttctaaattagagtatttaataagaatataaagatacattttcttggctataggctacttttgatatatgatgtctgaacaaaagtatatgaacagttgccaattaatatatgtctaatataggcagatattcaaacaagcattgagcaatgttatataaatgctggcagggtaacttgctccattattagataaattttgaagacgctatttaaatttcagtcatgaaacaatcagtgccaatctgatcaaatgattgccaaagttagcattaaccatagtagagaagcatttgaggaaaacgtaaaaatgttattttctctgtctcagattctcttattgctgcttgaactctaatttgaataccttcttctcagaaagaggccacaattagaagagcaacagggtttcatgtggcaggaagaaagtagtactgtcatatcccatcaatcctctaagcacccaatcttagagaaaattcattgcactctcttctgccaactccaaaagagattttcccaagaaatgagtttcaggcaattttagttcccatcactactgtccatttgtcataactgaaaaaaaaatccattatattacaaaaagatacggttatccagtatttgctaattatgattgagaccagaaacatacaaagtttcaaagaaaacaattgaagagaacatctgaaagtaatttccctccattctttgttgttctgctactcacggcaaatcttccaaactggaggcttcatgtcttggatccaaaagatcataaccacattcattgtagatttccaaataggaaatgtgtgttgtatatattttgctgctgtcctgattggaaaagggaaaggtattatttatcggttataacaatgattctgcttagatgaagatgaacacatttagcactcagtttcctcatagtttctctctttttctctcactttatatggtttacattttcagttcatgacactttcaagttgccagttaccatatgcatgaagctttttttaatggccaacacccatgattacaagcaacttcagtctgttattttttattggttccacattatacataaaaagtcaatatacacttacaatgagccaacttggttgcagaactgtataacacaccattttttttactttccagaccaaaaaaggttactaaaaaaaataaacatattctgtgaatagtctattcataaaaaagaacacagatcattactttggtttaaaaattttaggagcaaaatagtttccatctttaatcatcattctttttctacttttctaatattcaatattttctgatgacataaatagataacaatgaaagtgacatccagaggacagaaaatagttgattagtcaggtatgagtggacattaatagttcactgccaatacctcacctgtggagttaattttcctggcccaagagggcaaatcagagatgtttagctattagatagagagaaatgagagaaatgtttgtggtgggtcactgctgaaatgcaatgacataggcatcaatgtaatgaggctaaaagtaaaggtgcctggtcctagtctcaattctgccaatagacaaaaatgacccattccctctgaggtggaataaaataaggaattttttcaactcttgagaaagttcagttttcaatacaaaatatcaaacaatagcaccttctttttcttcctccaaaaatacaaatgcttccatttccgcaaatattatcatgcttctcataagaggagagtatatttgggtcttgtggcaagcaggttgccagggtgtcagagtgtatactaacagagaatttgcttaggatgactttcctgattgattctcacccatttccaaggcaatccatttaataggttttgttcaaagggagagaggaccaagtcacagagataggagagagaatagtggcccataaataaaaagctggactcctactctaactagagttgagcctctaccatgtcaggccttcattttcaaactcattaaagtgaggaagttggctaataaatccctatctgttcttcagtgtaaaatgaatgattctttggttctaaaatggctccaattatccaaataaagatactgtcatttcagaaaaacaaaatgataaatgaacaattaaagcaactctcagccttccatgactataataaaaacactcaagctacagctgaaattctatattccggtgttctgtgaaggtgacatggaccgaattaccaagcaattttttttcagcgtaatgctgaaaattcttctgatgtggatgactctaatgcttatcccaacaaatggcctattgattacattagtatcctagtttagtaaaggtactatttcaatataattctttgggttataacttggcttagcacaggtgtcagagactataaacactaaaaagacttggtgtggctgttagtctaatccaatgtttctaaaatattccatggaatactcctggaaaacagagttccatggtcaacatatacatagactctgtccctctctgcagcatgtcaaaggccctaggggatattttggcaacattctgagatcctgtttaaaccaacatatttttaaaatttatccaaaatatctgaaataacccagagattatgatttgagagtttagtatacatttctgagttcttcttagcatcagataacaactgagtttgaatattgaaactccatttataacagaataatcccacacccttatcctcagctgtttcaccataaaaatggggataatagccctgatcttgcattctgttataacagagaaataagattctatatttaaaatcttacaaaagtgtgtggcccataacagatatcaactaatcattgttgctgctgttgctattattattgctgtagttattgtttttattattatttctagaagccttcaaatggagaattcagtatatgaatataaaaggaaaggaaaataaaagcaaaatggacagccaacttgtatgtttatctgcagtggagaaaatctcttcttccagaagttagaataaatcataaaacgtcaggaaaacagcaggtccactgccctgaggtgatagggataatgtctttggctctttcagcttctgcattttctggactttcattggaaaatacacttaaaattcactgagctatgtggcaagctacctttccttattactcctttttagtgtttaggattgccagactgtaatgtaacacacatgtttcctgcagacagccttttctcctgccccaaaacaagtttgaaactcacaataccaaaaataatgagagtgatttctaaaataaatggcatcaattttcttctcttaaaatcagtgaaaatgtactcctggcatactcatagacatttcaggacccagtaggcactgggctcttactgtatcttgaaatgaagactttgcataggtcaaatgtttcctttaagaattctagagagctccatgtacctctctaaggcaatcagctggggacctctgagtactaagctgcattttccagctatacaatatgaacaaacttcatgatgcacttcaagttgcttgaccagtttcaccgcagctgtttgattataatgaatgtgttatgccccatcatgaaaatatgttcatttacaaagagttactctggctttaaattgctccaatgggctcgctgcaagtccaggaagttatttaggatcattcagaatgaaatggagtttacggtaatgtcaatgacaaacagatctaaaacaatgaacctgacaaatggtaagtactaaggagacatttagacatttggatctatactttagtaaccatagataaaaattttaaagggacaaaaaatattttcctttgggagaggatgagtttattctatttaacttaatcatggatttggcttcatttgttttgagagtttcaagggttctctgaaattggtcagggatcacttggccacattaatatccatatgtggatattactggctgtgatcataactatcatgtattgagcatatactgtgtgcaagaatctggacaatatctttaaatacagtatgttcagcccctcacagcaatccataagactgaggcattaagtaaccgccccaaggccacatgctgtaagcagtacactttctcagaaccaggttgacctgtacctccagtgatctttctaagacaaaaggattccacattaggccacagcaatgaaaactattaggaattatattcccaggttgtgaaatgtgggaacaaaacaggcaatgtcagaaataagtgagtaaatgaaaaaagggctttggatccaacatatatgctatactcaatcctttctcatccaaattttctggcatgcaaagctggcatgtttgagctagagaaagatgagctgaactaatggataattgctactttatggatggcaattagaattatgcagatctcagcaatttcttctcatctttgcaactcaaaatgcaaacaatatacagtcaagaaattttggagtgactgttatattgacctagttaagacatgtattatacagaagtaatacaaccaaggaattgctggaactagtagggacactggagattctctaatacaattcaatctctgctttcacagaagggaaaaccgaaactcagagaaggtatgtgactcattacggggaatttgtttgaacataaccaacaaaataaagccagtccgaggtatagaagcaatatacataatggcacaaagcacagagttagacatcaggtggacttgggatagaactctagatcagctacttacaggatgtgggcccagaggaaaatatttaacctgaggctcagtattcccaactgtgaaatgggaagttgcattatatgttatatcaaatactggtaaaactgataaagctactggcattttgaggcactcaataaatgatacatataatctagatagataacccttttttacaatggtaataattacaacggtatttgtactttggtaaattcctctgggcttctatcaagtgtaaaatagtaacaattatactatcctgtttagtgtttcagtagctaaaagaaagatctgctttgataagaagacattcctcagtttcttgaggaatataagatattagttggtaaaaggtgttgtctgctctttcaaccttcgtgcgtatatcagaaggaaatgtccttgagcctttgctgaaatagcagccctttaatgagaagtaccttcttaattttcacttgtacagcaaaatcccaacctctccttaaaggtaaaggccaaagttatgacacaataagactttatcatttagacacaataaaatacatgtcataataaatttcctgctttcagtatatttttgctgaatatatcaaatacaaaatgatatgaacgaaaagtttcataccttttgtaactgttcaaaaatgtatgacagtgtccttgggataatgcctctgtcactgtaacgctctgcaccccctgtgatagtgaatgtcttcccgctgcctgtttgcccatatgcaaagatggtaccattgtaacctgccaggacactgcaataaagaaatgacacactttcaatatcaacatggctaactgcatatgaattaaatggcttgtattctaataacaatcttattaaacactattaaaaaaactttatagaaatatctattaaaaatttatatatgtgaatatctagctagaatttacatttttatctaggaacagcagcacatcaatcctgttctctaagaaaggatgtgcaacacaaatggagttcagtcatcttaaatatattcttcatcttttagtacacactggacttgaatcaaagaatatattgaaaaaaagttctggggaaacaatacctgtaatttggcaaactgtcaacctgacacctggtacctcacatggtgtaaacactcacaatagtagttacttcctagaacaggaggaacacactctgcttgccaccatataccttgcaatgtaattccctacttaatactaagcaccaactgaaaatcctctaggaattcccctcttctcttttcttggaatgactttttggtagaagatgctagtccatatatattcttcagccctgcagagcggcccttgatttgatggtggtcttaagaacccaaaggctggatcttctcagcctttgaagagcaccacctgtaatataagcttttataaatatgcatgaaatgatgtagactttcaaaactgtgtctttaatctatgctacatggaacagtaaacttttgtagctttatgttcgttttttgatacaagtggctccttgatctctgagatgttttcattaaactagctacgatgacatcagctattggtccccatgttgtgggtggattttttgatagatggctcctctgagttcacccctcactgttcatattagaattcctccctattagttctgtcaacatcctatctacagttctatgtttcatatgctttcatgcctgtgtgttgagtgatctgtcattataagggtctcctaaaacacacaggtttgactggagattattctgaagtggtcacttatgaccaccttatgcaactattaaacttatgaccaccttatgcaactattaaactaacaataatatcttcagcaacacgtcaatgcatctgttgctgtgtaggtagaaagtgttgttggtgcttacaaatttaatggacttagtacagggaatgcgcaagaaagtattgtaactgtgtgattcaatgttctacttttgaggagtgtaatcacttttcttcgtgtgtctttacatggagacaatatactgttgaaattctcaatttctaagatgttggaactatgacaaaattagatatataattacagaatctttttcctcaacagaatttgttaccaatgaaacattgatgtcccattagcaatatcatttggatatatgatatttcttggccataaatgctgtaggtaaatgaagtctaaaatttcaaatatctaatcttaaacattttattgattcttgatagaaagaatagatgtaaaatattctaggcattatctgtcttgaaaaacaccatggaatactctgcagccataaaaattgatgagttcatgtcctttgtagggacatggatgaagctggaaaccatcattctcagcaaactatcgcaagggcaaaaaactaaacaccacatgtcctcactcataggtgggaattgaacatgagaacacatggacacaggaaggggaacatcacacaccggggactgttgtgaggtggggggacgggggagggatagcattaggagatatacctaatgttaaataacgagttaatgggtgcagcacaccaacatggcacatgtatacaaatgtaactaacctgcacgttgtgcacatgtaccctaaaacttaaagtataatatatataaaaaaaagccactgccaaggaaacaaaaaaaaaaggaaaaaactacagagcacaaattaatattttcattttgatatagatatagactacgaaaagtgagtaggtagtacactacgttggcatctgctaagtgttatgtctacttttttatgctaaaatcttctttctcactgccagttgtcctagtatgtctgtctttaatatgtgctccccctacccccatctactgtgggatggaaaaccagatgacatagcttcatagaacactgtaaaataaaaagggtaaggcttgacctatatatactcccatggctatttatttattacgttgctacaattaaacgttaaataaggaaatgtaatcaggcaaaatttgtctccagtcccttctgtagagcctccattccaactcagtcttgtaaccactcttcaatggacactaggccttttcatgtgcttctggtctcatctgtcctaaggaaaaatactagttaaaaataaagaaagagaaatagtggtgtaatgaactttgaaaatccattactccacaagaacaataataccagtggcaaaaattgtcaaaatcaactttttcagaactctggaaattatccaaaggctcacaccaatccaagaagtgtttatgtaagacaaacagctaaactcagtaggaaccatgagctttgtggtattttaacttcaacattcccagcacctctccctagctccatggtagccttcaaaaacaacagccttgaaacattggagctgtgaaatccagcagcctagcaaccactgtagggggcagtatggatttggggctcctcaaaatgccccatcctcaaagagctgccactctctgactcgtctgggagctctctggaaaagctccactcatggtacttgtctttgttagacctgattcagagttcactcagtgtgagcagccctgtcctcggggtgtttgttgaaaaaaaatcagtggcaagtgtttaacatcacagctggcaaagctgcaatgccagtgaagtaaacaagaacgtaaccaaaaacttagaaaaacctgagaaatgtgtataaggggtttcaaaaaactctaatgtattcctgggaatcgggaaggccacacacatgtgcaggactatatgtatgcccagaaaagacctgagaagggcattataactcacctctggctggcctttagactgcacaaacagaaagtgagaagaaagacagtgttacaaacttcctcagcattgaaggtatgccccaacaaacatgtagggacccttgtatgtaggctgggagatggaggagttcaaggaatttaaggaaatttatttcattatcttgcctaaatttactggctagtttgttgacgataaatttgctcagtttttgtttatcttggaatgtcttaatttcttcttcatttttgagaataatattgccagacatagaagtctctatttgcacatgacataatcttgtatatagaaaatactaaggaatttactataaaattatgggaagtaagaaacaagttcagcaggattgtagggtacaagtcttaacactgtgtagatggcaatattccctaaactgatctacatttgtgcgatttctatcaaaattcaagctggcttatttgcaaaaattgacaatattcttataaaatttatacagaaagtcaagggacacagaatagctaaaacaatcttgaaaagaaagaacaaaggtagatgactcacacatccctatttcaaaacctactacaaagctagaataattaagacagagggatactggcataaggccatacatatggatcaataaaataaaattaagaatccagaaatagacccttatatttatgatcagttgattttcaacaagggtgccaacactattcaatggaggaaagaatggtctttttaacaaatgatccttggacaactggatatccacatgaaaaagaataaagctggacctctacctcaggccatgtacaaaaattaactcaaaacgaatcacagacctaatgtaagagataaaacttaaaagaaaatcttgcaagaaaacttaggagtaaatcttcatgagctaaattaggcaatgttttttagatatgacatcaaaagcacaaagagccaaaggaaaaaaataagctgcacttcatcaaaattaaaaattttgtgtttcaaaagacacaatcaagtaagtgaaaagacaacacaatggagataatgtatgcaaatcatatctatctggcaagggacttgtcatcatatccataatccataacatacaaagaaatcttacaactcaataataagaagacaaacaatctaattaaaaagcgggcaacagattcgaatagacatttctctaaaaagaaatgcaaatggccaataacatataaaaagatgctcaacataattggtcattagggaaatgcaagtcaaaatcacaataagatgcaatttcacacccactagtatggctaaaacaaaaaaaaaaagagacaatgagaagtgctggtgacaatgtggacaaattggaaccttcatacattgttgctggaaatgtaaaatggtacattttgaggtcttaacagttcctcaaaatgtaaacctagtattgccatatgacccggctaggtgtatacacagcagtattaaaaacatgtgtccacacaaaaatttgtagtgaatgttcacaacagcattattcattatttagccaaaaagtggaaacaacacaaagtgaccgtcagctgatgagtggataaacaagatgtactgtatccattccatgggatattatttggcaaggagaaggcagtacagatacatgctacaataaggataaaacttgaaaacacattaaattttaaaaagccagtcaaaaaagatgatatattgtgattctatttctagaaaatgttcaggataagaaaattccatagagatagaaagtaggttagtgttagacaggggctagaaggaagggaaaatggagagtgactgctaatggctatggtacagagcttctttttggcggtaatgaaaaggtttcaaaattaaataatggtgattgatggtggcacatttgtactaaaaacaactaaattgcatgctttaaagagtaaatgttttagtatttgaattacatctcaacaaagctgttgtaacaataaaatagtaaagaagagtctatactcacttgctaataaccagatgtgtatactatcttttcagtagtattttttaaagacagagagaagggtaattaataaaaggaatgaaaagctaatgatacatttcagcaatgaagagtgagataaacatttttgttcagaagtatttctgaacttcctaaaatcaacaatgcaggctgctgcttaattcatctcagctagagacagtcctaatatgtaaataaatcaaccctttataaacccagagtttgatgatcagaggaaatttccattgtagaaattctctccttccttttgcaaaatgcacttttcctagaagtttaaattaggaagctaaggtagtttgtcatttcttatcttttaatatttgcatgaattaaacaaaaataaagcctcaacccttttggagattataaactgaagtgtcactccagacacaacacatttacatgctagaaaaaaatacaagtcattttaaagtttagtttttccatttgtattactctttgtttaactaggctccaagtagaagattgtctggaggatctgcacaaagtgagacttcattttgtttacctccggatgcaaaggctttaagaacctcaagatacagccttgcattccagggatgaagccaacttgatcatggtggataagctttttgatgtgctgctggattcggtttgccagtattttattgaggatttttgcatcgatgttcatcagggatattggtctaaaattctctttttttgttgtgtctctgccaggctttggtatcaggatgatgctggcctcataaaatgagttagggaggattccctctttttctattgattggaatagtttcagaaggaatggtaccagctcctggattaagaaaatgtggcacatatataccatggaatactatgcggccataaaaaatgatgagttcatgtcctttgtagggacacggatgaagctggaaaccatcattctcagcaaactatcgcaaggacaaaaaaccaaacaccacatgtcctcactcataggtgggaattgaacaatgagaacacttggacacagggtggggaacatcacacaccggggcctgttgttgggtgggggcaggggggagggatagcattaggagatatacctaatgtaaatgatgagttaatgggtgcagcacaccaacatggcacatgtatacatatgtaacaaacctgcatgttgtgcacatgtaccctagaacttaacgtataagaaaaatatatatatatataaaataaataaataaagatgagaaaatggagcctcagagaggtaaaaaaaaagaatctcaagatacaatgtctaaatgaaagtaatcaacaacaaatcattattgtagtaataatttagttcactaaaccaaaaaacaagacatgaattatagtccctcaaagagacagcatagttgaaaaaaaaagaaacaaaatatagtaataggatcatggattttataattgatgtcagcagaggtcttctaactacattttgtccacccaaagaattccctccaaggtatttctgaaaaacagttacacaaagtatgcttagacaggaccaggttggacttagagaactgggcagggctgatttcatttttgagaggggaggggcaggtgaagcagcaccttaaaagtttagtcttagtttaatagttaagtttaacagtttagctttagaaaaattaaaaatcaaaggcaaatacattttatatgtatttaaaaacagttgctagaagcaaaacgtactagttcactcagaaaacacaaaccaaacaattggtactaaggacaaattttttaagctaatagaaatacgctatatacatgtttaatctgacaaaacatctttgcataaatcaacacaactaatttggaacaaatgaaaattaagctcccctattttaaatacacagttccgccttatccatacttgcctttcacacagttctgagatcccgagtaagtgaaactcagttattttgaaatccccagagcagttaacttctgtctactgtaaccctctttctagaataaagtctctcaatccctcataagcagtcccaaggggcaactggatcttttatagagaaatacggtaaatgactcctaactgtttcactttcagaatatctcacagtgcataaattcagtagcttaaattttagagatttcaaccaaaaacaatagcaattcataattagcacaattaacacaattcagttttgccatatataaaaataatcttctcattggttaagccaaatgaacatggaacttgtaaaatttccagcaagattttgatcacggggcatttcctgtgctgcaaagaagggagaaaaaaatgtgaggaggccgacacttctggggaatttaagagaatagtagactttgagaggtctgtttttctgcctagcaagctttcttagtccctcttatggtaataggctcccagtctccttctacaagctcaagaggggcaggcaggtgtatggaccccatgactcaggcctggccagtcataccacttgatcccatcttggttcctccaaccactgtcccacctgtaacagctattatatcattacaagaagctggtgacatgactcaagccgagcaaaaaagagtgcctttgtgtctcctgtatagattttgagaagaaaataagttttatttttactggggtccctactagaggccgtatcccctgcccttcagcacaaggaagcagggccaagtaaagttcagatgggtgaaggattatggctatgtcaggaacctaggtcaaacagtgaaggccctgattttttttttttttttttgagacagagtctccctctgtcacccaggctggagtgcaatggtgcgatctcagctcactgcaacctccgcctcccgggttcagttcaagtgattctcctgcctcagttccctgggtagctgggattacaggcacccgccattatgcccagctaattttggtatttttgtagagacggggtttcaccatgttggccaggctggtcttgaactcctgaactcaggtgatccacccacctcaacctctcaaagtgctgggattacaggcatgagccaccaagcccagctaatgttttttaactttcttttttttttttttgagacagagtcttactctgtccaccaggctggagtgcagtggcatgatcttggctcactgcaaactctgcctcccgggttcaagcgattctcctgcctcagcctcccgagtagctgggactacaggcaactgccaccatgcctggctaatttttgtatttttagtagagacggggggcgggcgggggggggtgcctcaccatgttggccaggctggtctcgaactcctgacctcaggtgatccacccaccttggcctcccaaagtgttgggattataggcatgagccaccatgtccagccaagggccttgatttttatatcactcccttcagttcttctttgagctaaaccagttatgtgagacaagaaatcctctctgctttgagttggaattcagttacatgcaaccaagagaatcataattattgcaaagtttccagagtgatctgaaagacacctcttagtccttgatttacagcaaggatctcaagctggcagtaaaacttgcctacaggaatgcttaaacttaactaaatttgaatgcctttttgcgagacatgttcttcagtttgctgtggtccccaacattccctaacatcttaggatcaactgcttcctaaaggtatgttacttgcctagacttgaaagcagggctgcatcactgcataatcacagtgcagtccatgcgaatgccggtgccccctcacctttgtgcagtgcctagccatttgtgtaggccactgtgaagcatgtcccctggaggtgtacaatatagaagtcctgcgtaaaggcatgtgagtttagttcccctagtttagatactgtcctttctaaaagcatgttttggcccagggcagtggcttatgcctgtaatcctagcacaggaggcagatggattgcttcagcccaggagtttgagaccagcctggtcaacatagcaagaccctgtctctgccaaaaaaaaaaaaaaaaattagttgggtgtgtggtgtgctcctggagtcctagctactcgagaggctaaggtgggaggatcacttgatcccaggacttcaaggttactgtgagctatgattgggtgacaagaagaccctgtctctaaataaataagtaaataaataaaataagtcataaaagtaaaaataaaataaaagcatgttctggcaacatcattctaagatctcttacagcttcagttctatgatatattgatctggttataaatcctgatagagaaataaagtaggttacatggctagccttcgtcaacctaaaccaaatcatcaatcattttggaaaggaatatccaaggccaagaatatctagattagaaatagttaccccacacaaccaaaattgttttgtgtgagaaaaatgaaactgcaaacatggattaactggtaatttatacatctgcgggcatactggttattaaactagagtcacaaagaaagagacccacaggcaaaatatagctagcagagcatttgtttggtcaacactgtcttttttaaaaaattcagtctgagtggtcttagtccccaatttaagcacagataccaccactccatctggccctcactagtttacttcagattaattgtttgccttccatggaatgttgagttttgcaactgctataaagtgactcagataaatggtaagagtaacactctgattaaagaaagaaagaaagaaagaaagaaagaaagaaagaaagaaagaaagaaagaaaagaaactaaactaaatatcagcatcttccaggttttgaaatgtcgtaagcaatcctctcacaccattaaccacccaagaaaccaaatggctatcccacccatcattgttcacatttcgtgtgtgataggaaaacaagaatgttgggtgctttcttctaaaacagtcactttggcacaatcaggactcccactcttggatatctcacaaaacaggatcagcagctgcctgtcttgaatgatttgcaaattctcctccttggatacaggggctaagtaaggggatctcttgagatccttcccagttctatgattctcagggctttgttcacagtcttgtcccaactacttcaaaccaaactttgcaagaagcaaacacatcatggggcacctaatccaaacagcccctcttaaaggatcttcgaggtcttaagcacactaaacagcttcacatccataagttcatggaccaaatccaggccagagtgctctctaaatgaggctgtttattatttcccaagtttctgaagaaaccgttttgtgttagtattaataataagcagcttaagtctggtaaaagaacagaaatgcatgaaactttaatgaagaaaatgaccccttctgaacataatccagttctaaatgtttcagtttgaagtccagcatacagtattgaaaagtgagggctgcatttttatcttatttacattataaaaagtatatatttacattatattatacattattttatcttatttacattatcttatttacataatttataattacattataaaaaatgcatttactgtagcatttctgaccaatatttttcctatgatccttcagaataaacacttagattaattaaatatataatcattttcagataaccatctaaggaggcaactaaaatgaaaccacaaaattttatacaacaatgtgggagaaattcattgtctatagaaatttattaggacagaatcgtgcataaaatctgaactggttactttgggtttcttttatagggatacaaaagaaaatagaaaatactttttcctaaaatcctgagttctctgtcagtaaattgatcaatcacatttcttaagcattcatgatattatatgagaagcctggtactgtgtgctttgtgaatttacaggaaaaaaaaaattcttctcaagaaatttgcagtgcaaggtaaagcaagataaccaccaagataagcatctttaaatatctgagcatgtgcacatattcacctgtataaccttctaatttacacatcaatctataatttttaaaaacccaaagggctaatttataaatgtgtttggagagatagaaagcatttaaagaaagtcttctacaaaaatttataattagagaggccaagtgagaaaactgtgttttcctagagactccatccttttccttgccaagtgtaaagtaaatcgagcttctgggtcctccagccatctgaataggtggaaacagagatccgagaatctaggtgaagaagtaggggagacaggcatagaaatgaaaagacaaagggcctatcttcaggggaggatctgtctgagaagtttggagagagactggaaagcggaaagttgagcactgcaggatggcgggggagggtagcaggtggctgccgtcagtgtggtgggtgctgagagaagcagcagtggaggaaaatgcgtttccctaactcctataattcctgagagcccacatacaatctgacctttgagtacttccaaaagtgacactgtacactgactggaccacatggagctctagtttagatttaagttatgagcctttttctccatacttctagtctcaagattacttgccaaataagaccttatttgacttcaattttgtgtaaaatggaagacattttgcacatttttgggaaaattcaaacacactttgatttcaatggataataatcaaggaggaaaattgccctttggcatagaaaggtaaataaaaatacatctcatgaagctgctaataatcatcatggctttatttgcatcatggatacacaacgatctaatgagatttaggagccagagtttgaagcagaaaggtgtggcttgattgagatcactcataaagggatcaggaaaaaggaacagaaaagactgttcagctaagtaatgtcaaactaccctgcaggccatagacaattatggcctatggaactatgtatggcctgtgaactagaggggcatggcagcagagatgatgaaatcagtcttggctgggcaaaaatcacacgaggagtcttctaggggcacactatgagaagagatatagggaaaatagaagggaatagtgttcacaaaattccgtgagacacatatcctactattagcttatggatagtagagatacagcatcatcttactaactgcaatgaacaatacagtctcaataaactaaaaaatctttagtcttgccaggtacagtggctcatgcctgtaatcccagcactttgggaggccaagcaggtggattacctaaggtcgggagttcaagaccagcctgaccaacacggtgaaaccccgtctctactaaaaatacaaattagccgggcgtggtggcgtatgcctgtaatcccagctactcaggaggctgaggcaggaaaatcgcttgaacctgggaggtggaggttgcagtgagctgagatcgcaccattgtactccagcctgggcaacaggagtgaaactccatctcaaaaaaaaaaaacaaaacaaaacaaacaaagaaaaacaaacaaaaaaactttagtcttaaagcaatcaccatttatatattcaaatttttctgtagcacttcaaactcagtctgatcaaaactgaacttatgttttttttcttttagacatattcttcctctttcattctctaggcaatctattctgagacttctattatctcccattttagagatgagaaaatttagccttagagaagttaactatatcaaggtcacacttagtaagtgataagagtaataccaaagtctatttgattctaaatataatattctttctactacctaagttataaaacaaacctaccatctttttataaagctaataataatcagatatgtttggtagaataatatccagttaaacagttgtctcaaagttgctctccacagaagttagtaggaaaaaataacttaaaagtcttagagattaagtatactggcttcatgtttttaaaatgcgagggctaatcagaataaacagattaagatcaatataacggtttaagttatctacaattaaattacatattccactacttttcatttgttctcatcttaaaaccacacctttgttgctgacacagcctgtagcaagcatcttacaggtaggaatgcagtgcagatttgcaatactttcctctggagtaccttgattttcattaattacatagcacaatcttgcaaagtactgttttataacaccactatctaggatgggtaaaaacaggaaagaaaattaactacaacaaaaaatctgtatcaccattcagagagaagcaaaggatgtgactttatcatcaacatgtttacaataggattaaaagaatagaaaacagaaaagaattactaatctttttaaggttttcctcctaaaggcagatatgaaaggagaaagtaccagagacttggggcacagcctctaggaaagtcagaagattcagaggagaggaaagaataatgcagatactttcctcaatttcctttgatgcctgacatctaaaaactcttttcaattccccatctggaacccaaggaccaaaaagggattgcaacttgtaatgagtgactaaatatattttacacaaaaggtaaggtcaagctgctggaagcctcttaaaatctaaaggagagggagagggcagaagtgctccccaccacttctccctaacttcagttagctgactgttaaagaggaacaacagagggctttgtgaggctgaaaaaaatcccaactctgtaggatgccggtggggggtagtttcatagacttctctgggcataaagctgggaatgtggtcctctgaaggcacaggaaacagaataactcttgagtatagagcagaatataccagaactaagaaggcaggccactgaaagcagtttcccgtgtccttttaaatagtagaaattagttcattggtatggcccattattaggaccttgttgttttcaccacagcactataggacgtgggggcctatgtaatggcattaacaagctactctttacaaagatgacaagaggaaagagtccgatagtaacgagaggctaataacatttaatgtgattgagatgaacaggtggggaagacagtcagtcatatttactggtatctacagcaaggaggacaagacaccagggtggtgggggacaaactgtttctttgaagataaaatggaggtcatcataaagcaaattccccagctcctctctccactctcagcctccacccccacaaacagaagtttatctctcttagtctcatctattcctcctcctctctggtcatagagattggccgtcctcctatctaaagctaaactcttccagctgaattctagattgtacccattctttcctgtctgtcagggacctttctccatcaattaactcctctcctgtattttctacttctcccttcatattaattgctcctccttagaaaataaacaggctcaagtttctcccattactgaaaatacctttacttatttttgattatacaagtaattcataaatgcatgaattaacaaatgcttgttaaaaatatttacatttaaagtctcctttgaatataattctcctcctcatcctccaactttcaccatagttatcgctgttagttatcccttttgtatgcatacttccagacattttacatatagcacagcttcatgtctttttacctttttaaataattggcttaatattctacgtattcctgcgcaatttgttcactcaacaatgtctctcacatcagtagatccacctaattttttatactctaagtctgtatagtatttcacagtataaatgtatcgtttatttaaccaattctctgctgatgaacaactggatcctttccaattacttgccattacaaacagtgctggaaggaacaacagtctttaccatttctctatagtaggtatacattcagttttgatagatactgacaatgatgtcctctaaagtggccttgccaatgtatattcagacctgtaacagaagagttcctatttcctcacttgcttttgatattatcaaatttttattttgccaatttgatgaaagagatatttcttattttaaattttcttttatctgattgtaatgtgatcaaacattttcatattcatattttatattcacgttaagcatacttttatacgttttttgaccaattatatttcctctttagggaactgcctgttaatgtcctttgactacttttgtagtagattttgagtctctttcttattctttgggaggagttatttccatttaatcatattaatcctctgcttatgttgcatattttctcccagatagtagcttaccttttaatactgcttatagtggcctttgttgtccaaaaattttattttaattaagtcaaatttttttcttcattttttttgcatttcatgtcttcacagggccttcagttctccaacatgataaatgtgttttctgcatttccctctatttattgttttcttaattatttaacttacattttttagtaacatgagttagaatctaactttgtttttgctcagttaataactaatttctccagtaccatttattaaatgatccattattccctgatacattttaaatgccacttatatcattaactaagttctcatatatacatgggtctatttctgagctaaccattttatctcaacaatttatttgtttattgtcaataaacaaactgacaatacaacactattttacttatcatagatttataatacagtctgatatctgccaagcaagtctaccatctttgttcttttccaaaattatcttgactattcttgtacatgttcctttccttgtgaattttaaaatcagttttgtcaagtctcagttgctcctaatttatttgaccacagaagacatttttcaaagatcaatgttcaaaagaacacacttcagtgatacactgacttaggctgtatctggcccaaggatttactttgtttgatcaatatagtgttgacccattcatgttttttaaaatgtttgacactcatctgaaagccaaaagtaaagaataaatgtgcaacagggtgtgtgtatgtgtgtgatagggtgtctctgtcttcccaaatggcaacaactggctgaggccaagtggtgactactcccttcatttacatgggctctaagtccaagttctccagtttctgaaatgggcccatttcgattatgtgtgctacctacctatactctagactgcctttgcctctgagaacactgcattattgtaataccattctaaatagtttcatgtccctcaaattcatcctctgtctacactgccaccagaatgacttttctatacacatataactgggcctccactatgatttaaattatttggcaacttccaattccttttaggataagatccaattttttctgtatgccacatgaggctttccataacctggaatatttctcacatgtcatttcccatgatttccacattatcctttctctagctgtttaacctgtctacagtacccaaaagatttcccacacattcattcatatttcaatttaagttgttcttcctgtgtagaaggccaagtcatctacatcacaaacctcagcctccattcttctgccccaaccaaatttcttttgtcctcacattcatttgcatggagaactcctatatttccacatttcagactcaattccattgctacctgctttttaaagctctttctgaccacttgccccataactctcaccttcctaagagagaatggaggctcttcttctatgtccctcttccactcatcatacctttcactaattttcttgtctatttgactcataagattgtgttctttggccgggcatggtggctcacgcctataatcccaacactttgggaggctgaggtgggtggatcacctgaggtcaggagtttgagaccagcctgaccaacatggagaaaccccgtctctactaaaaatacaaaaaaatttgccaggcctggtggtgcgtgcctgtaatcccagctactcgggaggctgaggtaggagaatcgcttgaaccctggaggcggaggttgcagtgagcagagatagcaccagtgcactccagcctgggcaacaagagcgaaactccatctcaaaaaaaaaagaaaaaagaaaaaaaaaaaggttttattcttcttgcagagaaattctttatttctcttaagcctaggtcagggtaactagaattttgtagggattgaaaaaatctgtggaatgaaggaagagaagtgtagagagatgaatgaagggagggagagcttaataaatcagtcattgcctgcactcttggggagcttagagtcatatagagttctgctcattatttaaaataatagtatagccagcgtgaccaaacaactaaatctccaaagagagaatggacttaactttctcccacattttaacaagcagtgtcaacacaattacataattgtttctctgacaaacataaaagttgtgcaagtaaagtaaatatcacagacaaattatctctctctaaatttaaaagtaaggtttttaaagttattttgccttgcagttgatataatttttattttcatttccaaaatactaaaggaatttggtggaaataagtgatcgaatatgcaaatatttactgtgcacataggtatttagtagtctgcaatgttaagatagcctgcactcacataagacttaaggattctccttggcagatatgaacattctttcatattgaagaccactcagctataccacctttgtcaaaccccaaaagtgatctcaacaagatgcctaaaccctacaatcacttttacagaacattcttagattctgactggttccattttggcatttttagcatctgtctagcagacttgtgcatatacataaaacacacaaaattccattagtacaacattaaagtttcaaatttaaacatacaggaaactgagaagttatggctctcataataactgtaacttacccattttatgtatgcattatgtgttaagtttagacacaaaaaggttaagcattgagctggcatactcatatatacacagtccaaattctcatcttgcttagaatatctacctttattttaaaagaactatacactaatataatctgttttctatatacataatggagacagaaggagagttggaactgagcctatttcattaaatattcaggtggtttaaagttattcacactgcattaaaaattgctatgcattttcggacacttttagttcggaaaataaaaacaaaagtatagaaagcacctatttccaaaataaaggaagtacgagatttttaaagtatcttgaaaattctataatggttaaaagaccaaaaaaattatacctaatactcttacaacatgtttccaattctatttattattttattttccctccagattctcattatatataaatttttgaaggaattctgtcagcttggaaataagaactcacctcttgtgaggagcataatttgcctcacatataagaaaaaaagcttactttgttctaccactacttaacatgttaagttcagagtcatacattaaataatttccctgtgagctgaggccaagcacatatatttccacccagggggaaaagtttagagtcaatgaaaacacaactcaataatgaaggtcttcacacagggggcagttagccaacatggtgtgtggctcctacttgaatgcacaaaaaagacctactaaatcacttaagtactggggctttcttttgagttataaagaatcacacaaactttgggctagaaggaccagtctgggttgtccttctgctttcaggtaggcccacccaaactatcctggacagaggagaaattgaactatatttacagcctgccaagagaatccacaattgctcctaataactcattctagtattaaatagctctgtcaagaaatcttcccaatatctccaataaatcctttgtgctgaaatttaaaccggaaaactggccccaatgtgacttgaacatgtggtctcctaacctggaggttatattgtaccataaagatgcatacaataggaccaattctttatgtattttatagcaatttcccaacagttactgaagagtatctgggccaagaaagtgctacatatagaaaatatatgtcctattttgttacggtatttggaaaattatctcattaatctgattttctttctttaattgtggtcaccattctaaggccagcaaagcagcagattacaaaaaaagtgtatttctgtatattgccacagaactggtcagtaagcactcaaattggctttctcaccttattaatgaatgatcaagtgatacggtttgggtgtgttcccacccaaatctcatcttgaattgtagttcccataatccccacgtgttgtgggatggacctgtgggaggtaaatgaatcatgggggcggttaccccatgctgttcttatgacagtgaatgagttctcataagatctgatggttttataaggggcttttccccctttgcttggcacttctctctcctgccaccatgtgaagaaggacatgtttgcttcgccttctgccatgattgtaagttttctgaggccttcccagcaaaagcagaactgtgagtcaattaaacctctttcctttataaattacccagttttgtgtatttcttcacagcagtgtgagaatggactaatacatcaagtcatggttgatcagcacaacaaatctgaatcagtaaaatttcactttgaatgatttacttagcctcaaagaaatggcttaaatttggccatgctgagaactggccaacctagccatattaaatttatccataagtttatatatgtagtataatatgtttcattaaaatctccaatctggcctggcatggtgtctcatgcctgtaatcccagcacttggggaggccgaggcagtaggattgcttgagctcaggagtttgaaaccagcctgggcaacagagtgagaccctgtctctaaaataatttttaaaaatttccaataaaaaatgtgttgaagttgtattatttattccctcaagcatctatttcttcatgcattcatagcaaaagacatttatggtgcccctttttccacagcaatgttctaggtacaatataatggatgcatgtaaaattcatgtgctgtcacagttcatacggagtatacaagctagtgtatacttgggtgggaagtcctaagcacagaatctttctcaaccgcttgaggtatcatcaaatcatctcagcatagtgggtgagtaactacctatgggggtataagctgtctagttgtgttgtcaatgtcccttcggaggttttgaagttatagcttgctaagttcagatacataaaatgctcacacaatcttgtcaatgaagctttccttcaacagcagaaatcctctaccttttttttctgggtcatccaaaacagtctttcaaaagctaaatttttttttgagctaaggagccccaatattcaatttattcgattcagtgagatgaatgttgtcagtctaagcacagtcagcactgtgcccctcataaaaaactttacagcaacttcaaaatactaacatgagtgtgaaataacaaaatagattaatgtgatccagaagcgtccattttctttctaaataaatcaaaagttaaaatataattattctggtcaacaaagccattatggattattccataattatatcaagttttctaaggcaagtaatagtttccttttcactgcctgtgagtccccatgaaatcaccttgcagtgcttcacacaaaaatctggtgcttacatgtttgtttattgcactgctgctttttccctgagagctgcaaaatccaaattggtcttacttccataagaccataattattgcactatggaatcaatcactctgaaaagctgatactgtttcaaaatgaacctactcacagtgactataactcacaaccaggctgaaaagacacatcaaattctgctattttaaaagcaatttttactctacaattatgcattgataaaatatttgataataataattttttaaatggttaggctcaattcttcaccaagattcacttctatttttctgattttattgccacactaatcctttgatttgcatttctcataattatttttatttaactgattatagaaatagtatatgttctttgtcaaaaacacatcatgtcatacagcacaaagttaagtactccataatgttccacaaagataacccaggttaacatatgctatgtacacttttagatttttttctgtgtctattgcctatgtgtaaagaattcattctttttttctctctctctcccttaactcattctcttcctggggaccaactttcctctaccccaagaatgtaagcatcccattctacctatggtagtaaaactgagaggaaataaaaatcaaacatcagaaaaggagttaaaagggcatgcagtagcggggaaagaagtagggccatagcagaaaagagaggtacaagaaggaacagagccttgggagctaataaggagtaccctgggagaacaaaataaaggccctttccgtgaaaagccgttgaagagttacacagaacaaaagggtcactaccagatggataccttctaacctccctcaatccttctccacttagcaaccaggagccatctttgaaaaatacaaatcaggtcagtctctgaccaataattcatcatactgatattctgatttttcaacctggtatactcagccatccatggatggtaaaactgcttactttaattgtactggagaccttggcaccccaggaaagtttaaataattaagaatagagataaagtaaatcaaacccatactcttaataacattatagaatatatttaagtgtacttttcatatcattgggccattctagttgttttatttaaagagtttgaaatacttaaaaatattatgactttaatttaaaacatataatcaattccagatttgggatattaagtggtgtaagtacatttgattcaattttggaaatagcattaaaatgttaagagaggctgatttactatgggtatatgtttgcttactattttttaagttgctatgtgcttaaaatgatttgttaggtttgtaagtctgccccacaaggcatttgaggtgtttgagacagtcacatacattacatgtgtaaatgaggtttaaaatgtttaagggaatttaattagctaaattagaattgtaattaattgtttaggaaaatttcaactgttaaatttgaattaatcaaatgttaatagggtaacaaatgaaagagactattcttatataataactaaatgtaaaaatagtctcataagatttgtaggttgaagtaggtgtttgaacacacagcttttatagagacaatatcaattcgaaacccaatgtaagaagtccttttaaagatttatctggaggctaaggcagaaggattgcttgagtacaggagtttgagaacaacctgggcaatatactgagcccctatctcaaaaaaaattatcttgaataataaaatactcaaactgaaaacaagatccacaaaagcaaggtgtttctctgcctggcgtaccccaatgtcttcagagccaaaaattgtctgcacacacacatagtcaaaaatacgcgtccacatggagttgtttattcaacttcagcttagtatctttttttcttttcttcttttctctctctcttttttttttttatagggtcttgcccaggctggagtgcagtggcaccatcatggctcactgcagcctcaacctcacagactcaattgatcctcccacttcagcctcctagtagctgggactacaggtgcacaccgccatgcctggctagtttttgtatttttggtagagatggggttttgccatgttgcccaagctagtctcaaactcttggactcaagtgatccactggcctcgtcctcccaaagtgtgcctggtggaacttgctatctttctgaagatcaaattagagcaaccagtcacaggaacactaatggaaaaaaatctgttttggactatttgtagatacaaggaaatttaaattttgaaacaagatttccaagggacactgtggaaaataagaactataagtataggactataaggatttgttccttggttggtgattgcagatggatgacaggaagaggagaagtagggagttaagccataaactgcagagttagaaataaaagtagtcagtcccagagatccctcaagaagcacatgggaccatgtgctactgaaaccaaaggcagaagcatggccagttgcaggtgggaactgggaaaggtcagaataagtataatacaggcacttttagatttggctataagaagctttatgaaaatatgttgatgaggggaatttataaaatatgaatatagcacaaatcaaactggagagaacggagccaatgcagcagagtgcacagtcacttctaagacatgagctgagcagggaggaaaggaattacaaggagcagtaagttaaaaaaaatagataaatctaaagaagtaattgccttttgttaaagaaaaaaacagttgtgatatttggcttcccttaaaggtacagactgaagacagcattttataatgacatcaaaagagagaatgaaggtgtggcagagatcacatcacatgagacagtgtagttttaagaaagaaatgtaaagcaatttaatcaccactactagatacctaagcagataaataagccaataaacatgttgaaagatttgttcctagtacttatatgtattaagcaagcttcctgtcctcatgaggcttacattttagtagaactaattaggactggaactaatatcaagtttaaaacaaaataaatgctgtatataatatgatttcacgtggtgataactgttataaataataagaaaccagggaaaggagagaatcaaaggattgtctaggattgtcaagacataaacaagcaggtcagagagttcaagcttggtgtttcagggtggggtagtagcgatcccaaagaagaaatagaaggtaaggtagcctgagaatcaccatttctggaaacatcaatcagtcttagacaatgaccttacaattacctctaatttcccccacatgatggcagccttgattctgagactgaaaactattaaactcatttttcacccctaaacatctcactgacagatggctgcatgcggaaggagctgggattatgtgtcctctcaagatatttctaaataaattcgtgtcctccggacccaaaatatacagtgtttttcatgacagttgacttcacataaaaatttgtgaaatatatttggtagtgaattagatatgtaaagaaggaacatgaactgggtgggagcaagatttaattgcttgaagtacaggagatctggaagacaaaaaatagctaagacatatatatttttctcttctctagcttgaattaaagttgtgagagtaagaagttagagacgcttttttgcatcctttccaaaatttgaataaatcatttgttccctatgtgatttaatttgggagtcaatcataatccccaaagatacaatccttaataccgtaatgccaaatgttgaaatcctggaagatcaaaatctgggaagaataattttaaatattctctaaaagatatttatttacatttttaaaagggaatttatttgagaaacacaaaaacatgacaaaacatttcataggtcattttacacaacagactaggcaataataacatatttttacaagtgtaaaccctcatgtataacaatgacagttgcagagtatgaagttatgagcatatgagctgtattcataaacaaataggtcgaaaagggaaatgtataaacatatactactatggttggcaattgcatgcacccagctttataactgtggtcatctgaaacaccaaaatgaacaacctaagacgaaattgatggaaaaccatgatgggtcacccccatatattcagttatccaaagagccaaaatctcgagaaattttatctttcacaaatgcagacgtacaaaatggacatctcttcatttagagaggaagttacaatgtttttgcatacatgcacaatgcttacacacaaagtcaatatgcacaatgcttacacacaaagtcaatgtggtgacaatgcacttttgtgaagtcaaatttgcaaaaactgcatacaacaaatgagaattctctaaaagtctcaacacaatttataactctagtattggaaatgatgtgaagatgaaatacatagcataattaattggaaaaaaataatgccgacaattttaaatagttaaaaaaactataaaaagtaaataaaacccaaatccaaaaagaaaattcaacatgaaaaagtgtattacaggaatagactataagcaactgcacagatctgtccagaagagctggccaactttcacgatcattaattatattttgaagtcttacatcgcagtgaagagctgttttttttttcttttaggacataactctccttgcagaatatgttcacattaattttctatgtgacgctgatcttcctgaaatccttctattatttggcatgcacaaacatgaagagtgtctattaaattttcccattttctgtgctgtgcttctttgttgttttgggtacatggaaatccattctgcatacactcatatacagaccacaaatttgacagaaacaatactggtgatcaaacagcaacaccatgtcttcttatcctaccatgaacataattattttcaaatcagttacttcactggcttcttcaggcaaatgtggttttaattcattaaaatctggaatgtcatcagctggaaggaatgtcatacaggcaaatcatgcatttttaaattcaagtattcgtggccaatccactcatctgaatttttcaccaaatgcactgggcaaaaacaaactttgttggtaacaccttaaaaatcatttttagaagccttgatcacacctaattccaaatctgtcattatggtttggcaattcagttgaaatctattttcttctgcaaagtccaccacatctttgaataagcatttataaagtactttgttttttccagtcattagtacataaacaagcatatcagttctagaattttatgatctaacaggagctatgaattgtatatatgaatatacaactatgaattgtatacagttgatttaaaaaatagtggggacagctttgaaagtgccaaccattagccaaagtgaaaaaagtgctagtttttatgttagattttgtggtaaatatatacgtaagaactctatcttcttctacagtcaaatctctagtcaaggataattcaccacctagtgtgttctgtaacactggagaaagctcaatattagcaagtgtctttggtccagaaagttgctgagcttctcgaattctttttactctctgacaaaggatgttttttgaaggcaagcatggtgttatgtgtgaaggggcagaagtcgtacatgattgaacaatttggcaggggagatttcttgcatttttcgcctgtgttttcactttttctatgatctttgaaacacttgcagcactcgtatttgaagggggattgtggcctacaaattttgtaaatatattctgtctatctgagagtctaattgtgtggccattgcaattaagcaattttctgcttttgcagcaccaataataattagcttttaaacttttatctttcatttcattaagttcctcatacacttaatttatcacagcctttttgcacgggaacagtttcacagatctctttcactgtgttgtaagaaatagagtaaaaaggaatgatactcagcttcccgataccaaatctctattagtcagggtttctccagagagaaccaataggatatttacatagacaaatgagagaggatttattaggggaaaggctcacacaattatggtgactgagaagtcccacaacaggccatctgaaagccagcgaccctgggatgcccatagctggctcaggctaaaagcctcaggatggggtgggaggggtggggatgaagtcagtcctggaatccaagggccaatgagcctggagttctgacgtttaaggcaacagaagaaaagtctgtcctagctctcagagaccagtttgccttctgtatttgttttctctggccagcaccaataggatggcacccgctaacactgtgggcaaatcacacccacctaatccactcggactcatacactaatctcccttggaaacaccctcacagacacacccaaaagaatgctttaccagctttctagatattccttaatctagtcaaactgacacctaaaattaagtcttcaagtccactctatgtcaacttggcacccatacatatctccttaaaacatacttaatttccaaataaagacaataacaaggtaatagtactgctgagcatgatgcaattatcctgtgagtgtaattactgagattttagatgttagcgattttagactttgggaattttgatctttcaggatttcaacattcaggataatggtgttcaggattgtgtctgatatggtttggatgtctgtcccctccaaatcttacattgaaatgtaatccccagtaatggagatagagcctggtgggaggtgtttggatcatgggggtgatccctcatgagtggcttagtgccatccccttgatgatgagtgagttctcgctttgagttcatgagagatctggttgtttaaaagtgggtggtaccttgcccctctttctcttactccagcttttttcacagaagacaccagctcccccttcaccttccgccatgattgtaagcttcctgaggctctcaccaaaagcagatgccgtcaccatactccctgtacagcctgcagaactgtgagccaaattgatcttgtctttattaattgcttagcctcaggcgttcctttttagcaatgcaagaacagactaacacatgtctttcagaattatgatctaaataaacctatttattttaggttctgaagttttaaaaggttaagtgttcaactgtaccttaaataattaagagtgattccttccggctttctttttaggagaaaaaaataatcatatgataagttcaaacactgactcaattcaacaaaaagtacacaattaggacaaactaaactatttagaacttttgtcctagaatccaaagagcccttagaagtgtctccctactgaacatctcctcacagaataaagaaacccactgcacctcagaatctccagtataaagtcattcaggctttgcttgaatacttcgtgtgatgagaagctcattacttcacaaaacagccatttcacttttgatcgagtttaattgctacacatgccttctgtatccagaaccccaggccatctcatgaaaacttttcctgattgcttctgttctgcctcgccagatcctccaatgtaaattaattattaattatcccccaaataagaaacgcaaatacaattcagaccctcctccattataattttaagtaatattttatattactttcaaagtagtaatgcaattatgtgaatacatatttaggcccattttcagtaatgaaaaatgaaatctaaaaatgaaatttatgtggaaaaaaattttaaattataataatagaaacatttattcggatgactagatattgagcaactttgactagtccataaaatccttattttagctagtggtgagaaagtaacttgaataaatttatttttcaaaataattttttattacttaatacctgtacagccatttgattcatgaaacaaaggataaaatatgttatcctaaagtgttcgcttagatatcttgcagagttgcaaaaacagactccacagaaaaataaatacataggaaaatctaacaaaacaaaccaagttaaatatttcaaaggtcactttttaattactttacaaagggtccattatgtaaacaaagctctactccacaagtcatgctacctcccccaacaccaccaccactctgattctaagaggaaatggctaaaatcattcaaagagttctttactctctgaatactaatgttaaataattttctgtgttatgcaaagcacacacatatggatttatccaagacatagaggctctccacagaagttaaaagctgacctgcataattcatctaagtttcacgtctttgaggtggtgaatcatttcctttgctttaaaatattttccacatctcacataggtccattctcagtttattttcttttgaaaatgttaccattcattcatagcccgctactttaaaagctttaattgtaataataaactctcaggttttttctgtcgtctgacttctgtcacaaaggtacttaggctttgtacctcaaacaagatgttaagaagtactgttccccggaatagaatagacatatttagaccttatgcggggcagcacgaggtgggcggcacctttggtgatgcagtgtggagtctgcagtaactggtgtaattgaggcagggcagaggtggccaggtgctggctgagctggctcctgaatatctgggcttggactccagcatacgcagacttaaggaaacattgccagtgatggcaaaccacatgttgcttgcttctctttctttaaaattgcttttctgagaagcccagacaagactgagtgtaaagcagatggcctgctctcctcaaagtcactgggaaagggtcttttaatggaaaaagctaccaggcatcaattcagataagtgagaaggtccttacacccgtgacaacgccctgagcagtccatgaagctctgcctcactctttccatgacagcatgtggctactctgggcgcgggagaaggaacagaaaccccagcctcaaagagcgtttggggaacatccaaggagagtaactagatctctatagtaacaatttgttaatatgatgacacttcatcataatgctgttttagactacagatattaaggcaaggtgttttcacaaagttcagttaatccttgaatgatgcagtcaaagatctgcatataacttttgactctacagaaacttaattagtaatagcctactgttgactagaagccttaccaataacataaatggccaatttccacaaattttgtaccatattcttacaataaagctacagaaaatattattaagaaaattataaggaagaaaagatatttattatttattaagtggaagtgggtcatcatacataaaggtcttcatcctcatcttcacattgagtagggtgaggagaaagaggaggtagaagaggtggcattggttttgcagactcggggtgggtgacagaggtgggagaaaatggaagtaaataggatcctccgcacagttcaaattcatgttgttcaagggtcaactgtactttggtttattgactttagggtctggctcactcaaaaagtgctctaggtgttgcctttagtgagtcctcctcccttagaaatagtatatcaatatgcaaatctgtattaccttctgcctctggctgtttgaataagggtaggctttgagcaccctccccaaaccaaccatatgagggcattgtagatgtcacctataattcacacctgtagttcattagtagttaacacttagttaaacagctttaggaaataaactgcattatgtcaccacttatctaaaaaatcactaatttggtttttaattccatatgtattttgcacctgtcacatacaaagcactttgataattactgtgggaatatatcaatggatcagacaggattcctgacttcaagaagcttatagttcagttggcgaaatgatgcacaatacacaagacaaactactaaagacacagaccaaatgctgagaaagccaaaaaggaagagtgatttacttccgttggggtgactggaagtttcactaaggaaatgtgctttaagcaggatgtgaaaggatttgtagtatttgtagactcaatatttgcaatgaatgtcccatttttagctgcctcaaccctccctggaggcagacattggattttgctgttttcatcaaaggactgcaatgcctggagagatctctagacttctctagactctagtgataataatatccaacagcagcttcctagttatctccgtgagggtattggtgtgagggtctagcccgcttctatcctaggcattggtgcctgaagctgaggctggcaggggaaaggagccctgccctatgttcctgatggccagctgaggcctacattcctatgtcattcctgttcagctcattctccaggcactccccactattgtgcttctcacgccatcccagacatctcaagctgacttccctcaatgacaaaactctgtatctgatgtccccacatctttgttttgtttttctaaagctctaccttgctttgtccctaataacaatatagcagggcttttcaaattatgtcatttcattcaacattgttttgttataatattgataagaaaaaagactgattcctggccagggccactgtctgtgtggagcttgcacgttctccccatgtctttgtgggttgtcttcgggtactctggtttcctcccatacttcaaagatgtgcatgttagattcactggtgtgtttaaatggtcacagtctcagtgagtgtcagtgtgtgaatgcaccctgtgatggaatggtgccttatccagggttggttcccacctggtaccctaagctgttgccaaccctgaactggaaataagcaggaaaataattaccttacatgtttaatattaaaagtgttttgatctttatttagatgtttggtgatagttctgtgaccagaaatacggtgtaggaagttgacttttttattttagagagagggtctcactatgttgcctgggctggtctcaaattcctgtgctcaagtgatccttctgtctcagccttccaaagtgctgggattacaggcatgagccaccacgcccagctagaaacttaactcttgtttatatcaattagcttatggtaacattggttttgttatacgttttgcttaaagccatagtttccaagaacatatcaatgactttgaggacttaatgaatactactactaataatataacaattatttgttgaaaatttaccatgtgacagataatatacataatctcagttaatatttacaacaaccctatgaacttttcagaattcttttcagaaccaactctacttgatttaagcagtatattagtcagcttgggttgccataacaaaataccaaagactgggttgcttaaataacagaaatttatttttcacattctgaaggctggaaagtccacaatcaaggcttgacagggtttggtttctggtgaggtccctggcttgcagacagctgccttcttgctgcatcctcacatgaaagagagaggtttctctttctctcttcctcttcctataaagtcttggtcttatctgattagggtcccactcttatgacctcatttaaccttaattacttccaaagatcctacctccagatatagtcacactgggggttaggacttcaacatatgaatggaggagtagagagatgacaaaattcagtccatagcaagtagaaaagaaattggttgaaagaaactagagtagctcataaaatctccaggaagtttaaagtgccagctcagaaaataggcaggagcaaaaggaagtgaggtagccagaatcatagccaaaccatgaccagaaccattctgatgaggaccctgttgctatcactggctgtcagccgctgctgcctcaaaagccaaatgctggtgtccgccaccaccagcagccttggtattcattttccctgcttctgtaagtgccagttcaacaaaccaggcatctgattaagcaagcttaggttacaggtaagcaacctagctgcaagggatgctgggaaagacaagacctgggctattttttagcttctataatggaagcaggccctacatcctaccaagtctcatataatacagaatattctaatcatggggaaaggttcagatgctagatagatgcccctccaaaggacaaccaacacaattataatctcccattacaagtggtaagttaacacttagcatacatatgtaaataattaaaacaatttcatgaaatctcttattatgtgccatgtactccaatattgtgtatatgttctattttacatcactaaaaagttatgatcatgaacaagtaaattgagtttataacctacaggaacatgaatcataatttgaaaaacaaaagactaagattaatgtcagaagaaatgggaaatatttaggaggttatcccattatcagctgagaaaagataagggcatggactgtgacactaaatatgggaataaagctttggaaacagatgtaaaatgcttcaaagaggaaatattgacagattttcctgatgaatgaatgttgtttggggttatagtgagaaaagagtaaaggtaagatccaaaatttctagcccagataaaaacttagtgcttaactaaattaagctctttcactgaaaactgtttgtctaacaaatcttgaaaggccaataataaaaaatgagatgaagtcttagaacaagtagaaagacttggacaggaaagtcaatataaggaaccaggccaaaaaagatcaaattgatatgagactatctggtactattcttttggggaaatataaggtttagaaaagaaagggagaattttgagaaaaataaaattaaccaagggggaaaatagaataggaataaaaagagaagaaaagaaaatctgaaagtaatatttgtttaacattttagcaccctttactgacatatattttaggattttaaaatacttaaatgaatttattaacaataaattatacagagaagatatatggaaaaatcagccttgtgaaactttccccacagatgaattgtataaattcaactggtatgtctatgacttagcaagaaaggaaagaggacaggggccataagctatagatcagtcgtgtagaagttgatcctgagcaaaatgcagaaagagatgatcatatgactggcttttttgcttacctgaattcttcctctaccagactatgagcatcacgaaggaaggagctgtggctttttcttctttatatctcagatgcataccgtatacacaaaggcccagagtgcgcacttaagaaatatgggctgaaccaaattgaactgagctgagcaagttgactaagaacaagccttgtgggtaaaatgtggaaatgtgaactgaaatatacaaacagagttggagacatctgcaacagtttcaaagagttctgatcaatacccactgacaggaaaatctttagtggcctattcctgggctatgtacatgaatggctcctgtttaatatttttaccaaacaattatggaatacccagataatatgcacatcaaatttacaaatgactcagggctgggaggtaaaactaacatactagataactgagtcaggattaaagacaaaaaagctagaatgagagaaccaaacctaacaataacaattttaaaaagtaacagggatcaataaaaagtcttgcagcacaataataacaaacaaattaattgcattagtacaggagagggaaatgtaaaatgactcagactttcaattctcccactatagctgtccagaaagcctaaaatctctccttctaaaatctacttagagattctggataaaatataatacatactccttttaatgcataaatttgcaaaaatgtaaggaaaatatctaaggacccaaaacaaagaagtaaatgaaaatcgaaataaaagcttatgagctaatcctggggcacacataggagtgtgggatggagaaagaaggctgacatcagaaaccagggtcttaggccaatagggagtgggtaatttgaattgaagatggctttataaacctgaagctatcactaataggaatgtcaaagaaacttgcctttctacctgaactatgggtgggaaaagtcttccttcagtatttgtaaacattgactctatccatgtacataattgaggtgtaaatttgtactacccaaatgtcatgcaaatctcaatcacagaaagtaatataaaaagtggtttgaagatgactagccctgaagtagcaggcagaagcaaaaataaatctactctatagtgatgtgcccataaactagcagaacaggactccagtagacaatgtcccaccaaacatgagctcacaatctaaaacaacaaaacccacaagaacacaattccaccataaaagagtcagcaggtataacaaagagtgagtgtagacatacaagagctatcacataagactatataatagacatgtttaaaattattaaatacccaaaataagttataaaaaataataacataacaagacactatgaaacacaaaaacagataggaaaaaaaaatgaccaagtagaacttctaaaaatgaagatatcaccattgaaactttaaaaactcaatataagggttaaatggaagattagacataggtgagaaaaggcttaatgaactagaagaaatatttgaagaaactactcaaaatgcaagaaagagcaataaaaagaaagaaaatatatttttcaaagtctaagggataacactgaatgaaaagaaaaatgtatgtttaatatgagttacagaaataggcactacagagaatggaggaaaggaaatatggaaaaaaaaaaaagactagctgagaattttccagaattggtgacagacatgaatcctcagatttaggaagcacaattagttccaactgggatagataaataaaaataaatccacattgagatgcatcattgagaaaccataaaacacctgcacaaagtaaaactcttttaaaaaatgcaagaaaagacattgcctgaaaaagaccaattagactaaagcagacttctcaaaagcaaaagctaaagagtgatggaatcgttatcttcaacatactgagagaacatgctgtcaaccaagaattccacacccagctaatatgtaaatcaaatgaaataaataatgaaagagttaatcattaatagaccctctctgaataagccatcaaaggatgtacttcaggaagaaggaaactgaaaccagaaagaagtgaaaacaggcaacacttagcaaagaaactaggataacacggggaataagctaaacatgcacagattttttaaataaaataacagtaattactaatgagtcatataaaaacaagatagaattaaaacatttaacaatagagaaaatgggaggtatgtgattaaagtgaatcatatatatcagataagtagcgacattaattttagactttataaagtcaagtatgtttaaaaatttttaacaatagccactaaaagaaaagaaagtacaaaattttcaaataattagcagagaaaacaaataaggaaaagtttgtcagcaaaacaggcagtaggaaaggtgggagaaaaaagaaaaaggcacagaaaaaaaggttaaattgaaaagtaaatatgatagaaatgattgcaaatgttggcaaaccactaaatcgactaaaacttgaataaaagtaaaaatcatccatgtcatttataaagagactcaactaaagcataaggatataagaagcttgaaaataaaaacaaaaaatatatatttttatatatcccacttagtgtaaagattcacacattttattgtgatcatatcaatatgcttgattactgaatgctggcccagatcctttgctggtgttatataatattctgtactgtgggctttagaaaagatatagtagacctataattttgtaaaatagactttaagatataaagaattgttagagataaaatcagtcattacataggataaaagagaggattttcaggaaggtgaaacaattctaaactcataacacaacctccaaatatataaggcataaattgacagaattacaagtagaaatatatgcatctgaaggtttttaacacatctcccttggttcttgataaatcaaacagaaaaaaaattcacatggatatagcaaacctggaccacaaagtcaacaggtttgatccaaatggataaacgtggaatattgcaggaagttttttagttattaaaaagacttcagacaattttatttatttatttatttatttatttatttatttttattttactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataattcagacaattttaaattgactcttggaatcatgtgtcaggtggagagtttggtcaaatgacctctaagatctcaactgactctgggattgtttagtctagtttcaataaatatttcacttacagatttaaaatacaggccaggcttttctttctttcaaaactgggtaaagctctaggatgagttatagcttgaggtataaacctcaacattcccactgtgttccactttgagtttggtgtggggtggggatcaccaatctaaacccaaagaaaacttcatgggtgtagcccaaagggaaccaaatcaaacgaaccaacaattttgcacaaattcccatgagccaaaaccactgaatttcactcagcaacaaagacctatattagaccccctcatcaacttgagccaaattttcctaaacctcagacatatcaggacactgttgagtttgaaagatgaacaaaaggcttgattttaaaagaattaacttgaaactattcaagcttctataacattttggagtctttacaatagaacattttggagtctttaccatggaataaaataactgaagaaataaatcataaaaggccccagtaccctcttccagagagcagtatttcctcctagacattcaccgcagaggaaaataaaaaaatcacatactgatgttcaacaaacaaatgacagcagaattttaaaaggaagaataagttacaaagcacacgttgaaataatatgttgggctaaatttacaactaacatctttgtaaaaacagacttggcccaaacatcaatttgtatacacaattagagttctgttattaaaaacagatgaagacaaaaggaagccatcatttaattggtactaactgtacctacttgtgtggaaaacagtgctgtgtgtactgatacatgaattcacatggccaaatttatgatatctcagtctctttttaaagagtccagttaatctgcttacatcatatcatttttaagggatgcattagggcggtattatcctcactgatgcttaccttaccaccaggggtgagatacctagaaatggaacggtgggggacagggcaaggaagacggaagaaaagttaacagaggagtcatctgtccagtagaattttagatcctttggcttcttctgaaattccctttggcttttgaacatgtcattctctctccatggaatgctatccagaatgtccatgtttctgaattggagatcagccttataatcaatgcatagataatacatggcagggtttcttttcttttctttttttttttttttttttgaggcggagtctcactctgctgcccaggctggagtgcagtggtgcaatctcggctcactgtaacctccacctcctgggttcaagcaattctcttgcctcagcctcccgagtagctgggactacaggtgcatgccaccatgcccggctaattttttgtatttttttagtagagaaggggtttcaccgtgttagccaggatggtctcaatctcctgacctcgtgatccgcccacctcagcctcccaaagtgctgggattacaggcgtgagccaccatgcctggctggcagggtttcttttcttacatggaagctgttataacctaacagtatatcttaaaagttctggcatctcaaataaaacaagtatagttagtttttttgtttgtttattttgaggcagggtctcatgctgttgcccaggctggagtgcagtggcgtgatctcagctcactgcaacctccacttcccgggttgagcaattctcatgcctcagcctcccaagtagctgggattacagcggcacaccaccacacctggctaatttttgtaattttagtagacacaaagtttcgccatgttggccaggctggttttgaactcctgacctcaagtgacccgcccacctcagcctcccaaagtgctgggactacaggcatgagccaccatgcccgggtgtataattagtttttaattcagaaaactatcagcttcttaagagcagacatggcactttaatatttgtcagtaattcctgctgtacccatcatagctctggctttcagtgactatgcactgactggtttagataggccttcaaacaacttagagttcaatacagtaaacaggagaacaccaacagaaaattcactaatgcatatatgaaactgtagaagggaaatgggtcagctacctttctcacagatagatagtagagggagacatgatgggcttatcaatgaagaccttaatctaagaactaaaagagagagaatgcagtttaacaggcagtgaaacaaataccccatgctactctgacaacttgacaaagactagaaataggtggtcattaagccagcagctttgctaaaaaggccagtagaagatgtagtaagtggttataaaagtaaggcaataagctaaggtagctacagaagtggtgctaccattccataaacatgtatttaaaaccctttttgtcccattttattaggtaaaatagggaatagaagaaggactgcaggtggggaatgcaaaagtgaataaaacacagtgcttgtctttagtatggtcagtgtacaggacacaggcagataaatacaattacaatatgataaaggccatgtatcaagtactttgggtacaaggaagagggaataaatgtgtctgtctgagaaagccaataaaagttcttaataaatgacttcaaaaagtaattcaatgctgagaagttgaatctgggcaaataaatacataaaataaaataaaataaaataaaaaataactcaagacatttttatactataacattaaggcaaaattttgatgatccgatttgaacacaatgaccattacaatgaaggaaagatcttcataatataaccaagctgtttccatatttcagaagaatacccaattaaaagcaaaaacaaaaagaccttcacttctctatttacaacaaactgccaacaccaaatagttcactataggaactgtattctgttttgttttgtttcattttctggcccttgttcatgtatattttcatgtataaaaacagcacctgaggatgtagctttttatgctacaaaaagtaggagagaatactatttaccttaatgttttaaaaaaaaactctagaatcttttcttgtcaacaaatcataattgccttttaatttttttctcttcctcaactacccctacttctttcaatactcaaatccttcagccagaaacaaacaaaaaacccaaagccaacattccatgtaaaatatcagggaggctagagaagaggcaggaggttcactagatagatctcacttctcatttcagagtcagaactcttcccttcccaattccacggagaaatggacaataagcagtttcatccttagtttctgtggactggaaatgcaatttctggccctgtgacaaattccgctataacaaagccaatagcatgccccgtggaattcactgtaatgggattttaactgtattggcattatgtacaaatccaaagaaaagcacatcttagggaatgatgaatgtaggaagaactacaggggtatgtagagtttggaaaattcaccatttttttctttcagagaaaaaaaatgctcatcgggggaaatactgaattctgtcaacttactcattccacagatatttatgaatacttactacatatcatgtgtcaggcactggtctcactgctaggaatgcagtaataagaagacagaaaagaaccatgttctcatggaacttatgtatgaatcggggagacagataataaataaacaagaaaaagatcagaaagcataagtactgttatgcatcgctaaacaatagtgatacattctgtgaaatccttcatttggagatttagtccttgtgtgaacatcatagcatgtacttacacaaatctagatggtttagcctacgacacacccaggctatattggcatagactgttgctcctaaggtacaaacatgtgcaggatgttactgtactgaatacagtaggcaactgtaacacagtactaagcatttgtgtctctaaacatatgtaaatatacaaaaggtacagtaaaaatacagtattataatctcatgggataacttttgtatatgtggtctgtcaatgatctaaacgtccttatgcagtgcataatcgaactatgaagagaatgcaaataaaataatgcactacaatgtgactagataatttctttttattttttttgagatggagtcttgctctgttgcccaggctggagtgcagtggcgcaattttggcttactgcaacctccacctcctgggttcaagcgattctcctgcctcagcctcctgagtagctgagattataggtgtgtgccaccatacccagataatttttgtatttttagtagagatggggtttcaccatgttggtcaggctggtctcaaactcctgaccttgtgattcacccacctcagcctcccaaaatgctggggttacaggcatgagccaccgcgccagcgtgactagatatttctaatgcgattgggaggtcagcaaagcctttctgaggagctaacagtaaaactgagatctaagcgataaggaggaaggacacttagagataaggtaacaggccaaagggcaagaacaatcttgtcttattttaggaaacaaaagaaagctgctgagcctgggcaaaggaaaggaaaaggtaggtctgagaggctggtagaggccagatggcagggttttacaaacaaggtatagtctgagttttatgcaaagtttgagagagcctttatagcactttaaacagggggatgattggatatgatctgcatttttaaaagctcattttggctagtgaatggtgactggactataagtggccaagagagtgaagggttagaggattgctgcaaaactgattagggtggcagtaatgaaaatggagacaaattgattgattcgggagatactttagagttcagttgacaggacctgctgaaaggagatgaggaaaagagcaaatcagaatgactggagccatttactaagaaaaggataattgagggaggacagatttggataaagaggatcaagagttccttaaaatataccaacttttagatgttcataaatacccaagtggagatgtcaagaatgtgactagatacagatgtctggagttctggggagagatcagagctagagatacagatttgagaatcaatgacataaagattatattcaaagtcatggaactgaatgagatcataaagagatcaagaagagaagacttagtccaaggttggggccatcagtgttaagggctcatgaaggagaggaggaataggcaaagaagacagaagaacagccgagtgggtaagggaataggatagtgtgtatctgtttgggtcatcctctggaaatctgacaccaagatggaattagatgtacaagagagatataaaagaggaggaagtaggattaggtaatgagaggttcagacctggtgtggatctgacatctgtgaaaggaggcagggatagtaaggattagatacgaagagctcagttctaagaaagacttgacctagtcaaaggagagtttggattcaacattgccaattagaagattctcatgtaatgaaagaatgttccaattctagtatccccatcatgctcagttattgactgggaacactccaaggaagcctggattgtgtttccactgtgttcaatctaggggtatggtagctgaaggctgctagtcagctcttgccctgcagcagatactcatgaagggagacacaggacacttccatagctaccacagtatgatgttatgaaaattaagagtaggccgggtgcaggggctcacgcctgtaatcctagcactttgggaggccaaggcaggtggtttgcttgaagtcaggagttcgagaccagcctgaccaacatggagaaaccccatctctactaaaaatacaaaaattacctgtaatcctaacactctgggaggccaaggtgggtgatcacctgaggttgggagttcgaggccagcctgaccaacatggagaaaccctgtctctactaaaaatacaaaattagctgggcatggtgacacaagcctgtaaccccagccactcgggaggctgaggcaaaagaatcactttgaacccgggaggcggagtttgcagtgagccgagatcacgccattgcactccaacctgggcaacaagagcaaacctctgtctcaaaaaaaaaaaaaaaatacaaaaattagctgggagtggtggcaagtgcctgtaatcccagctactctggaggctgaggcaggagaatcacttgaacctgggggacggaggttgcagtgagctgagattggaccacttcactccagcctgggtgtaagagtgaaactctgtctcgaaaaaaaaaaaaagaaagaaaattaagagtaaacaagtattttaaagaggaggaggaagaaatttagccctgtcaaatgctgcttaaagatcaaataggacaagaatgggcacatgaccatgctttcaggcaacatgagtatcactaatgactctaacaagcaaaagcagtctcagcagggcagagaagacagacagaagcccagttggagagggtccagaaataaatgggaagtgaagtataggcaagaggacagacaactcttttcaggtagtttttgtggaaaaggggagcacagaaatgggaaatagctagaagggatgagagtaaatgaaggtcattgttttattttaagagagcagatactacaatgaactgatgagaatgatctcatagagttggaaaaatcagcgatgctgtggaaagaagaaaactgcaagtgcaatatacttgagatggcaagacaacaaggcctcaggaaacaaatggaggactggcctttggcagagacagtagagctctgactacagtaacaggagggaggccaaggaattaggtgcagatgcaggctggcagatatgacgtgggagaatgaggctgtacttgattggttgggtctatttactcagcgaagtatgaggaagctgaaagtgagagcaagggaagggaatgtaggaagtttgagaagaaccaaattgggaaacagtcatctctgacagtgagaaggtgaacataccagagaagcgtattaggactgtaagtctgcactaagtgcccatttgaaatatgcaggcatgagtctatagtgagttcaatcatttcagttaatattttactccagcaatattcagcagcccagccatagagatagagtaggtggatgatcgagtttaaccagaggggaaattttgctgagtatatgacagaaaaagaaatggaaggcttaaatggtgtttcttgaccacaggtccaaccccacatggggcacagtagttgccagcagacagaactgatggttgaatggtcatagcccctccaaatttccaacgctctagaaaaacttctactcctattttcccctctgtttgggcaatctctttatttacttttcctttgtagcaaattaaactcacagatactgacgtttttaatgaatacaatgcaaaaatctgctgcataaatctacttttgttttaattgatttttaatgactttttttgaaattttattctttcatgatgagggttggattttaaaccatctctgtacgtaaatatatcttcttatttggatggcagatgaaagagccttttgatgaaaataaacaaaagagctcaaaatgacatcttcttcttaagtctttgccaggacaattgaataaatcatattttgtaaggtgtttagcttaatagatctgtctggatttcaaatgtatgtaaaatgcttttttaaacaaaaggcactaccacattgatctttttttggcaatttgccttgaaaaatagatgcaaccagaattaccccttttattttaacaaacctttgaaaatgcacttaaaatttactttctgtaggcaaaaacatttgatagaaaagatgctaattatgccaatcacatggcaaatggaaactttttaataagcagctttctcttatagtcttaaagctacagtttatttcagaataagtcttaaatacaacccaaggtgagtagtttgagaaaatataaatgattgcttgtgttcacagattagattttctggccaaattccctagtttggcagttttagcccatggtaatatcaaatgagattccaggcaagcagagtgaactgcaaagaaaccctggctttctctcataacctaaccccccacattagaaaaaaatgactgtgaacaaatctgtcaaaaccaggaccttcactatagaataaccacccaagacccaaagcataaacaaccactcattctattgtactctttttaacaataagaacacctgaatcattaatgcatgtttttttcttctttgagctcctagaaaccaattgcatttttaaagctagtgtatacctgagactagtataattacaggctaccattctatgacattttaatgatccaaagatcccaaaataaagaacagggctggttttttatttttagtattttagcatgaagaaatgaagctacactttaggaggctgctgtgttggaagaaatttcagctgccaaataagtcatctagaagcagtattctgtagcaacccaggatacctagagtccagaatcaacacactgcagctgcattcaatagcagcgccacaacacaagcccaagaggatggaaaatgtgaccggttacaccacagatgaatatggaagacaatgaacaatgaatactgagtggtgaaagtagggggcagggcagaagaagacacatcccccaacacaaagcagacaacaaaatgacgactacatcagttctgggaaccaacggacaggaccaaaattatgtagaaactaggtcattctgaaaaatgaatactaacgcccaacatcgggctcttaagaaaagaaagaagctaaatttgagcctttgagagttcatattttaaagagaatacttagttgttggcaaagaattgttctctaaaaggtctgaaagtaataagtaaaatttgaacttcttattccttaacatcaaagagtatcattctttcattctttcctgggtaaaagggaaaaaataatcagcatcttttgaagtatgcagatgaaagggctaggtggggaggaatgataatttgggtgatcaaccttatctgtcatcagcatgattaattttaatacattttgttagtataaatattcctaaagcaacaatgtaataactgtgttatacatattatcatacttaggttaaaatcactaggctgcagccagactttctgggctcaaatcctggctttatcacatattagccatgcaacctttgcaggtcattgagtgtagctgtgctgcacttttcttttccacagaatgaggatacttttctagttgagaggattatttaattactccatgtaaagcactatatcaacaaggaccccaataggaaatagatggcatactccattcatagagggtcttgtgacaaagatgtgtgtgtgtatatacaggggaaccacaaagcatagtgctgaaacctgcggctagcagtagatttgttaacccccgtaggcctgaaaggttactggaatccaaaaggagtgagaaagttctacagaataggtggtcttgagaaggaactcatcttcagtctggagaaactgccaatccagggtgaccttgcaggggagaatgcaagggggaaacatattttgagttcactgtcctcccctctgatctcctgctggggtttcccattggctgaccccactgggaggccagagggcaggaggcaggttactgagcccacacaggtcagcctaccaggacagacagcagatggagaagggaagacaggagatctcttcatggcagggcaaatgaagagatcccactcaagcacttcactgtactgggaaacacctgatgactacacatcttacttttgccaaatatatatcgctgtaatgaatgtaattacatcatattaatcagtaccagttgtgaggataaatgcaccgagatagaagttcacatgaatagaaccctattttcatttgatagatatcggccaggaactcattgtttattcaatatattgtggcccaggagaaaagaatgagaaaagaagtaccacaggaacgagtagtagcctttctcagatttcccaagaagctgccacagcatttgtaatcaagccaaacccataaaaagaagtgtggtaaggtacacctctgagacatattccccagagccttgggcttgtgcaataaaaacaaatggagagtcatgaggaggaagtggagaactgtatacaatctggctttttatttattgtgaataaagatgatctaagtctgaaggatattcactgtagaaaattcttagaaatagcaacctgcaatccactttcttagctcaacacttagaaatataatgtaaatccagcctgggtagcatagtgagactccatctctatgaaaaataaaaagttagcccagtgtgtgccaccacatctggataattttttatttgtagtcccagttatttgggaggctaaagtgggaggatcactgaagcccaggagttcgaggctgcagtgaactatgattgcatcactgcactctagcctggtgacagtgtgagacgctgtctgcaaaaaaaagagaaaagacaaggaaagaaaagaaaagagaaaagaaatataacaaatatgaaaatatattagttgatttgagatttgatttaaaaatgcaaaatgcagctgggtgcggtgactcatgcctgaaatcccagcactttgggaggtgagattgcttgaacccaggagtttcaggcaagcctgggcaacatagtgaaaccctgtctctacaacaaatatgaaaattagctgagtgtggtggtgcgtgcctgtggtcccagctacttagaaggctgatgtgggaggatcgcctgagcgtggggaggctgaggctgcaatgagccctggtcacaccactgcactccagcctgggtgacagggtaagaaactttctcaaaaaatagtaataataataataataataaataaaaatgcaaaatgcaagcattaaacatcaggtcagtcatgaattctgctgtcatataatttattttttgtttttcttttttttcagagggccagggtctcactctgtcacccaggcccgtgcagtggcacaaacatggctcactgcatcactgcagccttgacctcctggactcaagggatcctccccactcagcctcccaagtaactggacccacaggcatacacctccatgctaagctaatttttaaaatttttgtagagaccatgtcttgctatgttgcccaggctggtcttaaactcctgggctcaggcaatctttccacctcagcctccaaaagtgccggaattaaaaacttcaggtgtcaaccatcgcacccagtcagtacaggttaacaataatgtacatttcagtatatatttggttatgaagccaaacataatgaaaggtgccattttaaattttatttaaaaatcacatttttaattatctaattaattcaaatacaagaaagtgtgtgtcatttgctaaatagggaaaagtcaaaacatttcttgctatttatataatgtgaatattattacattttattaggataaactatataatgtaacatttactaatacagtgatataaactaaaataatgcttccttttatctgtatgccaaatgattacataatttaaaacttcccgaagggagttttcaataatatattatagtgaaagagtgagagtatcggaaagggtggtaggcactgatgcaaagtaacgatgtcaatggcactagggaaataggaagaggacaattctggaaagttcctgcatatgagtccttgaataaggaacttatacttcattctgcagacaatagtaagtcactgaaggagggaaagagtagaattggtacaatatttctgaatgattaaccaggcagtgcaagatggcctggacagggagtgtctagagcaggaggctgggtgggcaagtgggtgggcagaaacctgaatgagggcagtgtagggaacagacaagcagggacagacaggagggagaaggggaaggggaagtaaagatgaggagggaaggagggaaagatccccctgcggaagaagaatgaacaggaattgttattgtccaggacaagagtaaaggaggactcaaggtaacctaggagtgtcaagcataataaacactgctgtgccaccaacaggagacagctcaagaagagtggccaatgggggactgcaggtaagctgagaaaccagcaaggggagaacagagcaggatccagatggaaatggctgcaggcagaggaaaatgcagccacagaagagtgtcctctgcgtagttcagtgcactgatggagatgtgaacttcagcaaaggaaatttacagacaaggttgcaggcataagggttttacatagggttgtccaataaaatacagttaaatttgaatttcagagaaacaatgaataattttatgggtatgacccatgcaacatttgggacatatttatactaaaaacgtgttcaccatttatctgaaattcacatttaactgggagtcctatatttttcattttctaaatctggcaaccctggttggaactgaattaggagataaacttctgaaaaaagcaaacttagctggaaacaaagctccatgtagtaaggatagtaaagagaaatatttctgagagaagagtaaaggaagaaaggctaagaaaaaagatacacgcatttgaggtagcagaaacggaaaagctcccttatgataacctttctcaaaacaagtcagtgtcgaaaatgctcagtgtggagttaaattaagagcctaagggcaagtgaatatataaaaacttctgctcacttttgtaagttatatttcttggaggaaggctaaagaccttgaagttcctttcaaccctaggtttctgtgactcaagcttttcatgtataaatgtttcaatatttttggctacataattttttatattattagaatttctatgtatgaaaacagaactgtgttatttaatgtagccatataaatgacaatcttataaagattgcttggtggtgattccattaataaaaagcaaaatgactatttaagtttttatgagaaaaacatgtttacataagtaaaaggcatcattaagagaaaagctattgttagaagaaaatattagcatcaaatggaacaatgaaaatctgtcagtttaaaacatatcactttggcggaaaaatactacataactgcactggtgcctcatcctgaagaccttgggaactgcagacttgctgggttgatccagttcctgtaggactgagatagaaaatgagatatgaattctcacttcttacagtcaccgtgtaacaccgtggccaatttaacagaatacaggatacatttctattaaaaaacaaaaacaaaccaaaaggaacaaatcaagactaacgtgttaattaacaatacaagggaaaacatttggaagatactactccagataaaaacatagatttcttcacctgaacgtgggaggcggaggttgcagtgagctgagatctcgccactgcactgcagcctggcaacagagcgagactccgtttcaaaacaaaaacaaaaacatagattcttcagcattcaggaaataactctttactgtgtacagaaaaaacgtaaatcatcatcctcagaacatctcaacctggtcaataaagaacttgcaaacaaacctgtctcccctgccctgattcttctcatttttatcttccaatattttggtagagcaagaaaccaacaaaagctcaaacttaaaactaaagaaaatcagcttgtctgtactcacttttaaacaatcacctaactttccccaaagtaaatattgctattcttttcataacatgatggtcacatggagacactgtgcagtctggttttgtttgaggtcactataatagatattcagaatcacgcacaggaagaattacattgtggaagctttgcactcacttgttgctggtacttctaatcttaggttgacaacatcaggtaagttgccaagtacttcctcaataagctaaaactgtgatagaatgatggttatatcattgagatacttctgaacctccattcattacttattttgtcaagtaatttctaaggagaaacatttttaccatacctatactttgataaatttactgatggttaattaataaacaaccctattgtactcttactcgtccttaaaggatttgcaatacatgagatgaaacagaagagttatcctccatatttttttttcattagagaagagtatactgtacttaatataaaaaagcctcacttttaaaagtcatatagcaatgcacctgctagttaggatagaaatgaagtagcctctcagcatcaaaaatataactatcataaacaactctcacctatcaattccctcagggaagaatggattcacttaggtggtaatgaaagggcatgactcagtagtggtcacacatggaactggcgtacagctgcgctgcccagatcaatgtacgcatatgcccctgggaggttggtactatgagaatatcctccaggagccactttgttttagctcgtctgactgaggccttaaacaaggaaaggaagagagctgttaagggcaccacagtagcacaaatccagagatattaagactttcctaactcaagtcacaaggtcttccagctcaataactaatgcttgatgcatatcttaggagataaagtgtgagggagagatgcctggctgcctcccagtagttattctctccttctctagtaacaaaaccccagattttaattgggtacactgtcacccaactaaaagaattacatttccctgagtcacttacagcttggtattgccatgtgactaagttatggctaatgagctctatgtggtgtgtgtaactgtcaataattatctttaaaaaggtcctcagggactactatgaacatctctatgcacataaactagaaaatctagagaaaatagataaatcctagaaacacacaatctcccaagactgaaacaggaagaaacagaaatcttgaaaagaccaataatgagttccaaaatggaatcagtaataaaaaaaaaatctaccaaccaaaagagtcctgagccagaaggatttatagcagaattctaccagatgtacaaagaagagctggtaccatttctactaaaactattccaaaaaattgaggaggaatgactccttcctaactcattctacaaaaccagcatcatcctgataccaaaatctggcaaagacacaacaaaaaagaaaactataagccaatatccctgaagaacatagatgcaaaaatcctcaagaaaataccagcaaaccaaatccagcagtacatctaaaagttaattcaccatgatcagttggatcttattcctgggatgcaaagatgattcaacatacacaaatcaataaatgtgattcaccaagtagaattaaaaacaaaaaccatatgatcatctcaatagatatggaaaaagcatccaataaaatccaacatcccttcatggtaaaaaaaaaaaccctcaacaaatgaggcatcaaaagaatacctcaaaataataaaagccatctatgacaaacccacagccaacatcatactgaatgggcaaaaggtggaagcattccccttaagaactgcaacaaggcaaggatgtccactctcaccactcctgctcaacataggactggaagtcccacccagaacagtcaggcaaaagaaagaaataaaaggcgtccaaacagaaaaagaagaagtcaaattatttcttcactgatgatatgtttctatacctagaaaaccttaaggattctgccgaaagtctcctagacctgataaatgacttcagcaaagtctcagaatacataaatcaatatacaaaaatcactatcatttctgtacaccaataacattcaagctgagaaccaaatcaagaatgcaatcccatttataatagccacacacaccaaaaaaatacctagcactagatttagccaaggaggtaagatctctacaagaagaatgacaagacactgctgaaagaaatcataggtgatacaaacaaatggaaaagtattctatgttcatggattgtaagaatcaatattaccaaaatgtccatactgcccaaagcaatcaaataattcaacacttttcctatcaaattaccaacatcatttttcacagatttagaaaaaaactatcctaaaattcatatggaaccaaaaaaaagctcaaagagtcaaaacaatcctaagcaaaaagaataaagccagaggtatcacattacccaacttcaaattatactacaaggctacagtaatcaaaaaagcatagtactattacaaaaacagacacacaggccaatggaatacaatagacactcctgaaataaagctgcacatctacaaccaactgatttttggcaaagttaacaaaaataaacaatggggaaaggataccctattgaataaatggtgctgggaaaactggctaaccatatgaaaaagaatcaaactggacccctacctctcaccatatacaaaaattaactcagtagactaaaaacttaaatgaaaggcctcaaatgataaaatttctgaaagaaaacctaggaaatacccttctagacactggcttaggcaaggaatttataacttaagttctcaagagcaaatgcaacaaaaacaaaaattgacgattgaactaaagagcttctgcaaagcaaaagaaactatcaacagggcaaacagacaacctacagagtggaagaaaatatttgtaaactatgcatctgataaaggactaatatccagaatctataaggaacttaaagaaatcaataagaaaaacacaaacaaccacattgaaaagtggacaaagaacaaacacttctcaaaagaagatatacaaatgggcaaccaagataaaaaatgctcaacattactaatcatcagagtgatgcaaaccaaaactacaataggataccatctcacaccagtcagaattgctattattaaaaagtcagaaaataacagatgtcaaggttgcagagaaaagggaatctttctacactgttcatgggaatgcaaattacttcagcccctgtggaaagcaatttggagatttctcaaagaactaaaaatagaatgacctttagacccagaaaacccaatactgggtatatactcaaaagaaaacaaatcattctaccaaaaagacacccacactcgtattctcatcacaacactattcacaatggcaaagacatggaatcaacacaggtgcccatcaacggtggactggataaagaaaatgtggtatatatacaccatggaataccacacagccataaaaaagaatgaaatcatgtcctttgcagcagcattatcctaagtgagttaacacagaaacagaaaatcaaatgccacatgttctcacgtgtaagtgggagctaggcattgggtatacaaagacacaaagatgggaacaataagcactggggattccaaaaagggggagtggaggggaggaaggaggaagaggaacaagagttgaaaatctacctgttgggtactatgttcactgcttgggcaatggaattattagaagcccaaacctcagaaccacgtaatatacccatgttatacacccgcacatgtacccctgaatctaaaatttaaaaataatagtactaaacattctctttaaaaatgaggggctccaaacttcttctcccactttttccttcctgttgcctagaaggtgcataattgagctggagttcaagcggccatcctgtgtcacaagctgatgtgataaagatggtgcaacggcaagggagaaggagcttgagtccctagtgaccagaaagctgccaatacagccttggactgcctacctgcaggtttcttgtatgtgaaatagtaagtggttatgactttaagtcactattgtcttaagtttttcttcactgatgaatctacacctcacagatttcaactagaatgtgtgtgtgtgtgtacagtatataatatataaatatatatattataaaacagctaacataaactaggctcctactaggtgtcaggctgtaaatactttgagatattgtgtatgtctgtgtatctcaaagtttgtgtgtgtgtgtacagtgtaaatactggacacacacacacacacatctcaaagtattcacagcctgaaacatagtaggaacctcatacatgttagctcttttttaaatctagtataactacaatcaactcaaaatgtataggtatctgtaaacctcccatggttagacagatggcagaattagaaaaaaaaaattgttagatgccacaggtacagccaaaatgtgaacaagccctactcttttttattttctatagtcatctctaaaagtcctcaagcctgaaatatctcctaggtatcttctaattgatttgggtttgtttacttttcctattaacccaaagcggaggtttatctgccaagtttgttttcttatctctcttctctggcatcaccaacttctgtcctttggtgaaacctctccctatttccaaatggtgcagataggactgacaatcaggttgaggaagccaaggtaatcagagtgctccatgcctctagtgacagtgattggtctggggatggggatgtgactccagaatcctcatatggaaattctactgaagctagtagaaaggacaatgtcctgtcttaagggtcgtggttcataagcctatcaggttggtgctgtcggccacatggaggaaactgagactgaagtcaacatatttttagacttcccagttatgtaagccaataaattcccttttgcagggggtttccatctcttgtcattgaaaaagatctcaagactaatattagactaaccatttttctttatcctttcttttttttttttttcttttgagacagagtcttgctctctttgccaggctgcagtgcagtggcatgatctccactcactgtgacctccgcctcccaggttcaagtgattctcctgcctcagcctcccaagtagctggcatcacaggcacacaccaccacacttggctaatcttttttttgtatttttggtagagatggggtttctttgtgttggccaggttggtctcaaactcctgacctcaggtgatccacctgcctcggcctcccaaagtgctgggattacaggcatgagccaccgtgcccggcctagactgatcatttttctatgtgacctaacaagttcactggcatattaaggataaaacagattgggaaactacagcatcaacaacttttcagtgtctatcttaatatctccttagcaccttacattgtttactcatataatattactcatataattattaatatcacatggaaattgggaaatctttgcagcatgacttcatctaatatagatatgagactattgccatgattttcatccttctaattatttttcaagaagctaattcagtttttacatatcaacatttagaaaatgactttggcttgctacttaaatgttacattattcttgtggcttccttggaaatccagattttcatgtactgatagaaatacttcctctaccagatacataaacacagcatagcagctttcagcacaatttctctcattaaagaagcaattccattttttaaaaagaatcatacaaaagaagtttgttattttatttaaaaaggatactgcctagttgtaacattaaacctgatttttgtctcagtaagaagaaaatgtggtgttcttatgataaagtaaacacaacttaaattataagaaaaagaaatattgattgccaaagattctagtgcttgagagtgaatacaagttagtaaacatacatttaaatctcgacagagccatagatgaagaatattttatttatgaataagaataattcctgacacaattggctaggcaccgaaactcagagtgaaaacacagacactcccaagtgaaaatatactgtacttctattatcatttagattgaggcaaaatagggtttcctaagaaataaatattcttaacaagcaaataaagaattcagccattgggattttcttattttacaactgttttagcttttataacaaagtttttagcactctgaaagctttttatggctctaaatatgctacaattacatgaacaacactatttaattagcacacattcagtgcatggctctataatgggaattttcattaattaaaatcaatggaaatacaaaagcagtagctgtaaacaatttgaggaatcaagaatctaatttgcctattgcacaacaaggaaaaacaccttgcagttatgtgaataattttggcttgcgtagcagctgcatgtctaactggtagtttcaggcttcattccacacatatttactgggtatttactatgggctggcactattatatgtgattgggaatcattagtgaagaaaacaaaaagatccctgtacttgtgaagcttgcattctagcagaggagataggtaatgtacaataacacagcacataagtaaattatatattagaagatgataagtgctatgaaaaaaaaaatgtggcatcaggtaggggagtgaggaatgccatggtggttggggcagagatgggctgcagtttttagtagcctggtcagaatgggcctcactaagaaggtatcatttgaacaaagactttaaagaggtgacagtgtgagctatctgggtatgtggggaaagagcattccagacacagaaaacagccagggcaagagcctttaaggctagaggtttccggaatgttaaaagctgaagcagagtaagcaaaagggagaatattagaaaaacaaaacaaaactataaggtaaggtcccctttgtttacaagggggaagtggatcatggaagctggcctttttggcagggctggctaaactattgtggagcccagtgcacaatgaaaatgcagggccccttgttgaaaaagtagaggaaaagtgctgttaaaggtaccaaaatataaaactttttcccttaaaaacattttagtatttgtaatatagggataacataattagaggaataataataaatgagtaagggataaatttccaaattgcaaaaatataatatgttgatgctataattttatacaatataaaacaataatactttattaatatatcttgactgatcacacaaatttcctcgcttacttttctacatattcatttatttgatcattgaagtttatatttttagcaacttcattttcaatggatataattgaaagcaatgtcaattatttttgatacattccagctcacaaatcattttttctgattttcatttttattttttagctttttaatttttgtgggtccatagtaggtgtaaatatttaaggcgatacatatggctatacagccatgcaatgcataatgatcacatcatgaagaatgggcatacatcccctcaagcatttatcctttgtattacaaataatccaattacactcatttaattattttaaaatgtacacttaagttattattgactatagtcaccctgttgtgctattcaatagtaggtcttattcattctttctataaggtttgctaacttttaatttggagaaagatctttcagttgatctcagttatcactagagctaagagtattttataaactgtgacaacattaaggtaaatttctgtaaattacttcgaaatgtaagttttagtatgttcaagctgatgatccttgcaaactaatttttctaaaaagatttaaccctacatgcaagtcagtttcatggaagtttgaattttgttttaaatgtaaatatatacaatgcattttaatgtttcctatgatatttcctgtcacttgtggaggttgaacaagaaactgaaagaagcttcatggtaagttcataattcaaaacacctgcttatgcattccctcactgtatctactattacaagaaaaaaattaacttcaaaattgtcttccttattaataattggttcatctgaagtttcacatgaaaatggtatccataattttaattttttttttttttgagttggaatcttgttctgtcacccaggctggagtgcagtggcacgatctcggctcactgcaacctctgcctcccagttcaagccattctcatacctcaacctcccgagtagctgggactacaggcacatgccaccacacccagctaacttttgtattttttagtagagacagggccaagctggtcttgaactcctgacctcaggtgatctgcctgcctcagcctcccaaagtgctgggattagaggtgtgagccaccgcacctagcctttaaatttaatttttatttctaagcctgtagatatttgccttacaaagttgcagcagttttcaaaactggtaattctaaattctgaagaattctaacaacttcttgatatgttttattgcgatgttaacatgcacactttaattttgtaataatttactgattaagtttgctgcctgagctccaaaagtttctgttcagacactcaggacaaagagattggctctggtacctatgggatagccacctcctaggcaagtcctggtccagcccccacgggaagccctgctctggcatggccacactgccacttctgctcatgctgtcacagctgctaccaccaatctgggtccaggttccaggatatcctcctgctggggtccccatggtatcctggactgctctgaggtgtatacagcgggccaaatgctattgcgtggatgctgctctgtgcccgagcctgcctgcgcacaaactgctgctggagcataacaacttgcgtgtgctgctgctccacagatctcccctgttcaggtttatgctttgttgtctcacaggacttcacttacaaaacatacgttcaaagataaaattgttaagaatttcaagacagcaaccgctgagcattaaaacaaatggactgcacgaggcccaggcctaggaagccagagttccttctaggccatcacaaggagctggctttttctctgagtgaaatatggagccactgaagggttctgagcagagaagtaacatcatatccttcacctgcagtcactagtgaagaatattggttttgcatttcacactagagactaggctcaataaaatcctctgattcaagcattaaacttcatttacacaactattattttgcttttggacattcaatatgaactcaaaaggaatttctcaatctttactcaggtcaacaaatttggtatacacaaaatagatcaagtctacttataaaatgtggccctgatttaattagatgcttctgatataatgaataaaaaccaacaagaaggaaggtaattgtaagaatatgagggcatgtggaaatgggaatttcctccagacttccagatctcttaggacccttctccttgtttacctttgtctagtatagcctctgctgattcctaactgtcatctccttgtccatagtgatccttccagactctcattctctctacctgaatgcctttcagcttctgttcctggtaatagcctgatttgtccagattttcccagttcacaccgccaagagtgatagtctgatggccccagctcatttctatttgggcaatgcttctagcccctagattgacctcctataccataagcaggcagcctttgttttgctgcccttgactcagattccttcggccatggctgcagacgacagtgtcacaggatcacaacatagttccactggaaactgggtagaacatttttccttatcaaaagctgtgaggactgtaagtatggcaatgacataattggatgcttgcccaatatgtctctcacacaacttaatatctttcatttcagtgtattgctgtgcctgaaattggactaattttggtaaacaaaaatctttttctccaggctggtcttgaattcctgggctcaaacgatcctcccacctcagcctcccgaagtggtggaattgtaggcatgagccaccaaggcagtcaggatctttctgttaataacacaaattcctttaagaaagttagacttatttgcagtgcttgatatacagctgacactcagtaaatattagcagaatgaatgtcaaatgaagtttcatatatctaatttaattattttcctctgagaacggctacactgaatgaagaaattttataaacaaaaggaagaaatgtcatttgcatgcaaaaatttgacagagcatgggagttggatgcagtaggtaaagtacttgggcatctggagcacaggagaaaaaactcaggaggtgagcagtaaaagggaaagttgcctttcatttcccaactccaccccacccccatttccaccccccggccaccaagacaaaatccaccaaccccccacccccactcccggccaccaagacaaaacaaacatctcaattttgcctatttgtcatggccacaaggaaagagttaacactgttgactgctactgaaaggtaaaatgggatgaagactgaacaaagcccactgattcagtgacatgaacatcattagtgaatttagcaaggatgatttcaatgaaattgaatgaaacacataaatgctgggtgtgataaagcaatttaagaaacaaaagactatgaaaggaagatctattctagtttcagctccacaacctaattactgggtaaccccgcagaaaccaattaaatgctcagggtcccgtttttcatctaaaatgggaataataatatctatcaacccatagggtcattataaaaattaggtgagataatatacgtgaaactgctcttatattggcaaagctttatataaaataatatatattcttagtgttatcaattaataagtaaatttgttcctattatttagcaagaattacactaaaaattctgaccagaaacacatggcctagtataaaagtaaggctcaaattcactgacaatgatagaaactctgctaaaagtgctctgctccaagtaaaggaacttttaaatgaagatatttagatctgcaagtgataaagcacgagataaatttactgctgtatattctccaaccattctaacaacatattttcagtatgattttgcttttgccagtcaattataaagtcaaataactatagtaaaaatcttgccagttgtaatcaatcactacacatttgtataggaaggattttccagaacaccttgcttcctacttgtgttctttctatatctctcttttggaggctatcaaggtgagaaataataactagaaatatctttggtttatttgtaagtgtatcctcaagtcctgaattgaagatctgatataaaattgcaaactttttggtgcctcgggagaaaccaaatctaaaaagagttaagggggaaaaaaatcatacagaaaaacattcataacttggtaaaattctgaattgggatgaaaatccttttctataaaaatgtcagtggggagccaaaaatggatgatagctaatactcattgagcatgcactatgtacttactgagcaatcacatatactggggcatgtgattttcacgtacagctcattggattgtcatggcaaatgaggtagatattacagtatcattttccccacttaaagataaaaagctggttcaggccaggcgcgttggctcatgcctgtaatcccagcactttgggaggccaaagcaggtggatcacctgaggtcaggagttcaagactagcttggccaacatggtaaaaccctgtctctactaaaaatacaaaattagcagggtggggtggcacatgcctgtaatcccagctacttgggagactgaggcaggagaactgcttgaagctgggtggcagaggttgcagtgagccaagatcgtgccaccgcactccagcctgggtgacagagagaaactccgtctttaaaaaaaaaaaagcaaagctagaacagagaaagatgaaataacttgcccaaggacatagagctaataagtattaaagttgggatctgaactgcacttatatggctccaaagtccctgctcttagtcaatgtgttatatggtctcccccaattatatctttagagaaaatgttcagctttctgaaaataatctgttaagcacctaacttagtctaaatagtttcagatttctcttaacttgtaacgttcctgtgaatgttaactatagtgctttaaatcaagagtgggtcccttctgagcatggggccctgtgttatgacataggtctcatgtatatgaagccggttctggctttaggataaggtgctttaatttattttagaaataagtgggaggtaaattataaacaaacaaataccaatttcggaattgtaaagtcgtttagagcacatcttggatctctgaggaagatactaacaacaaataccactggtatcatctgtccctatctgcatcaccccacagcctagctgtaggcctaggtgagtgaatctcaaaccttagtgtgcatcagaatcacctggagggcttgttaaactacagatagttctgattcaataggtctgggtgaggcctgagaatgtgcatttctaacaagtgcccaggtaacattgatgctgctgggttacggaccacactttgagaaccactggcctagacaaaagagcaggtgtctatatagcgtgattttagtcattgaaaagatctctgtccaaaaagtacttcaggaaggaaacagaaataaaactcactttataagaaataaagcccatcactgtgcatttaagcaataaagggaaggctgacaggtgctaaaggatcatcctctatctgccaattctcttcctcaacaaatactcagagtatctaatagacacctgacactattctaggagccaggaacactacagtgaacaaaggtaaagaggagaccttgcctccatgaagtttaattcacacacaggtgaggctcaaagtgccatgatgtgaacaccccagaagcagccttcaaccaataatgggcaggagtggtcaagtaccctggcttctttgccccttgggtgggacaactctgagacatgttcctaacagttccccagtgggtaccagtagaaataagtcccagttgcttacagtggtaacctgctccttaaaggaccctaccttcctttccttcgctttctcacttccctactgcactcctggtgcttcctgaactcacctcccaaacaaattactttccctggaatcctagcctcaggatctgcttctggtggcaccagcttaagagatgtctcttcatgctgcagaatcagtgcatctccgatccactggttcgtctcttttattatcttaggaaacccccaactaactttttaatccaagtaacgctttttattttaccgctgacccagtaattttcaccccttgcatatacaatattctgtcaaggaatcctacttcttacaatcaaatagcttcatgcaactcttatgcttttttttctgtaggtattttatcaaaaattatgaataacttgtagttattattgcaaaaatgatagtatgcaatttcttgatcaattattcttaagaagagaaaccgagatttaggctcactttttacctacagtaataaaatctgtgtttgaaatgtgcatctttaatacattctatactggttacatcaactgctgttgttttattcacattcaacagctgtaggtagaatgggaatattatccccttccttgttaagtccttgatggagcttgtcaaggtcatcatcttgtataattacatggctttaagctgatatgttagtgtccctgtttttaatcataagaccatgttctcagttgaaaatgtaattttaaaattgtcacacttaaaagtttagatttaagtataattgtaaagtcacaaaagccagaaatgtgatgtcatcaggaaattcagcatagcagcaagtaaagccaagtgcaggtacatgtttataaacaacgcatctggcaaagtgcaactgtggccagaagttgaacagatttagggaacaggcaatgagtttttgtacaattcagtggtgaataacgtttcctgtaaacttggaaaaaaaacaaaatgtcactggtgtttttgtgaatttcagatgggattagctttattgaatcccctgggggagaagttccagtgcaataactgagattgcctaatttacagaatagaagaatatcacagaacaaatgtcactaaaatttttataactgaggattttcttactgctttattttgaaataatgataaatttacaggaagtcataaagagagtatagaatagttctctggaccccatttgccccagtggttacatattgcataactgtagtacattttcaaaaccaggaaattgacattggtagaatgtatgtgtatagttctatgccgttttctcacatgtgtagaattaagcaatcaccactgccatcaaaatacagaactattctatcactatagaaatctactggtgttaacattttaccagtttgaatgaagtgtagaaaccttacttcccttagggcccccttctctttaaaacacataggggtggagtcacgggtttttccatggtatctggacggagtaaggcaactagtatctacaagttttctgtcttgctaggctgccagtcccctggccctcttgctagagacagtagactcttcttgaggattttgtctgagcccactggtgtttctgggtgtctggtttctccagcatccaatctgggcagggtggttaagtgtccccgctctgtgcagatatatgaggggaaaaatccaaggggattcaccattctgtcacttctcaggtcctgaggtctctagctaggctatcttctcttcaactttcagagtcatgtttctttgtatatgacgtccagagtctttagctgtacttagtaaggggaatagagagaagtgtgtctactctatcttggtctggaaccagaggtcactaagcatgttttttgagtggcaaagaaattaaagatttctaattttttcatcccttacattgaatagggcactgacgcttgtaaagcacattgtttcttttcatctttaaaacaaccttgtaaacttggtgttattagcatcccctttctcagaagggataactgattcagaagtgatatgtctgattcagagtcacatagggagttagtcacagggctagggccagaattggattatttgacttgatgccaaatattttgagccagaaaaggtaaaaccatgagtacacagaagtgaataactaagatttttttaatcctcttttgtgagcctttttctccctattctgtcctccttgtcttgaaagagcaggatctcttctctggttggattagcagaactgggtgtgctaggcaacccacggcattatcagcaaagcctgtttcctaaagagcaacaggcaaaagtcctgctgggcaatgaccttggcacaactgagagtgtggtactgccccctgccatgagaaaatcccctgcatcaagccttggcctcccacccagcaagagctcatgtgcaaaagttgtcaagcacatccttctccaaacctgagagggtagcgtccctttacagtaagaagagagtgaaggaaaagagaaatcttcttactataaattgaaaggctgctcctgataatgttcatcactggtgaaatcaaaggttaaccagtggtggctcataatgactaatagctttccaaaagccaacctcattggccttattgtagtgtaggtgccttagctgttcagcaccagctactgggactgtgtcatagcatagccagtcctcctgccagtgcacattctattcattttggtcaaaccatcatgctcttacaaaacattgaatttccaaatttttgcaaaattactcactgcacataaagtaaatttcctacaccccaagcttttaggtaaaacatagattggctctattagaaaactggaattctgcaaacttgcagatgtgtgctaagacctcacaaatgtctagacttcatagttttcctccctaagtctttgaatgaaatgggcactcaaggataatgtactatttttgcttgaagcttcaggtattctctgatagcctaccacatattccagagattgatgcacttcagtttgagaagcacaacactagataaaaaaaaaaaaacaaataaaacaagacgctcttttgtatactgcaataccatagacatttgtagacttcttaaatcttacctttataaaaaaattcatccagaaattaatgagcaaaattcagatgacaaaaggcagttttgacaatgttactaatcaacccaaatagatttcaaagacacctgagattagaagaggcatcatgatgaagcacttcctagtggaaatgtactaaataataaataaccacaaagattattttactttatttccaataatacaaagttcaagctttactatttctccccatacatgcagtcctatacagctttggtccctgccatttttggcaccagggactggttttgtggaagacaatttttccaccaaataattgtgtgttgtcggagggatggttttgggatgaaactgttccgccccagatcatcaggcattagttagattctcataaggagtgtgtaacctagattgctcgcatgcacagttcacaatagggtttgtgctcctatgaggatctaatgccgcagctgatctgacaggaggtggagctcaggcagtaatgctccctccaccagcactcacctcctactgtgtggcccagttcctaacaggccacagactggtaccggtgcatggcctggggctttggggacccctgctacatagtcatgcacataatatcactggtttggacgaagtagaaaagatgtctaaattggtgagattcctgaattacagaattttggacagaaatgtgattagttttatttagccttaattgcatacagtaaccagaattaagttaccatgtgttaacccagtagaataactttaaagggctagtttaaagtggtcagattttatgttgggaatgtgttcttgaaggctaatcttcactaggaatagcggacatttctgtttaatatctgaagtggtatagtgtctattcaaaggcctgccaaattatgtaattcttaaaaatttgattttcaatgtatggggatacattactttaaatattgtgcataaatgacactttattttatcagtattttatgttttaccatttcaaagtcatacaatttgcataaaatataaacatcctgtatacagcatatttaaagtcaatgaaaaaagtgattccctccccaggctcttaaataagtcaatttgcttaacaacactctcctacagagatgaatgagaagaaaatgtgaatctgcccccaactgtctattcactggtgcagtacatgtttctgcagaggagaagcttggattagggacagtaagatactcctagcaccctggaggaaagagggcctcacgcctagcaaataaacacaccatgccctcagcacatgccatcccttccccatagacacatgggtaggccacagtgaacagaaacagcatgctcaaacagacaaacgcattctcaaatgacagggataagcccacctctaagaatcaccagtatctgagggaaatctgcaccaggaaagcgaggcaccaaactcatcagaagaacatgcacataaagaaaaagaagacagaaaaaaaaaaaaacccagtgtttcaaaagatcattatcttcagagggaaagggaggataccacattcacaagcaagaatagactttttcatttcctagaaatgaaaaataatagcaaaaattaaaaaatttagagggataaagaagaattcaccactgaaaagcaaattaccatgctggaagtctgtgctgacaaattcttgcagaactcagaaccacagggcaaagagaggagaactatgaatgggaagttgtaatatttgaaggataggactgcaaggtccagaaataaagaatagatatgttagaggtaagaaaattatttaggaggccgaggtgggaggatcgcctgagcccaggagtttgagaccagtctgagaccccatctctataaaaaattcaaaaaattagccgagtgtggtagcatgcatgtgtaatttcaactactcgggaggccttgaggcaggaggatcgtttaagtccagcagatcaaggctgcagtgagctgtgatcatgccactgcactccagcctgggcaaaagagtgagactatgtctcaaaaactaaaaattaaaaaattaaataataaataaataaataaaaatgagatcactttaaaaaaaaaagaaagaattttttttaattaccaaagaaatggtccatgtgatgacccttgaatctgagttttcagattgaaatagctgactgagagataagaatacatgaaaaaaaaatccttacctagactcattaatatcaaatttcataaaaacaaaaaaagaaaaaaatcctaaaaacacctggaaagtaaaaaaaaaaaaaaaaaaaagtatgtctaaaaagaaataagaatcagattggcatggacatcttttcaacaaccctgtatgcaaagagacaatgaagcagtatcttcacagtttggagaggaaagaactattaacacagagtgctatacccagtcaaatggctgggtatagcagcctcaacctgctgggcttaagtgatcctcccacccgaacctcctgagtagttggaactataggcatgcaccaccatgcccagctgatttttaaaattatttacagagacaaaaatctcactatgttgcccaggctggtcttgaactcctgggctcatttaactgtgaagggaaaggaaagacttcagaaagttccccagtcctgaattttttctaagaggttattagaggatgattaccaaaaggaatctaagaattagacatgaatacaagaaacagtgatagacaaagaaataggtataactttgagataattaaaataaacgttaataaaaattaataataataattcagacagaaatatcagttgatctccacagtggaagttgtagaggtataggagaggcaaagtaaaagtatcctaacattcttgactagagaaaagacagagagagcaagacagagacagagacaaagtttttgatattgagaaaaatacaaatgtttaaatatctgaatttaaactagagctgttgaagtacaatgtacaacttgagaaagaaaatggaagcagcaacaacagtcaaaccaacaaaaagcaagaaaggaaaaaaaattagggagtataataaagaggagaaagaaaataacataggaggaatagctccaaattatggcgatcataaaaaagataaactggttaaagtaactaattaaagatcaagaactgtgggtttagctaaaaaggcaaaagcagctatattttatttatcaggcccattcttaaaaacaaaatgtcacaaggcagttgactaggagaaggagaaagacaagacaaaggctgacagaaaaaaatagcaaaactaatttcaggaaaaaaaaaagaatacaaggagaaaagtaataaaaaggataaagaggaatatttcttattgataaaagataaaacccaccgggaccaacttgagctgcttggataaaagtgctcttgcctgtcgtttttgaaaccttgttatcatggagtttatcacatcagtgaataaaacgaagcccctgccttcatggagctttgttttagtggaggcaaatagacacaaaaactaatatagaattaaactatataatatgtcagggccaggtgcggtggctcacacctctaatcctagcactttgggaggccgaggtgggtggatcacgaggtcaggagttcaagaccagcctggccaagatggtgaaaccccatctcacaagacagaaaaccaaacaccgcatgttctcactcataggtgggaattgaacaatgaaaacacttggacacagggtggggaacatcacaccccagagcctgtcatgtggttggggacagggggaggaatagcattaggagaaatacctaatgtaaatgacgagttaatgggtgcagcaaaccaacatggcacgtgtatacctatgtaacaaacctgcacgttgcgcacatgtaccctagaacttaaagtaaaataataatttaaaaaatgtcagatggtgatatgtgctaaaataaataaagtcaaatagggaagggtaacggaggtgcaattttaaataaggtactgcaggaaggccttactgagaaagccgctatgagcaaagatttcaagttgctgagggagaaaccatgcagatttctgagggaagagaattccgggcagagggaacagcaagaggaaatggtcaccgcacacaattaaagctgcataaattaactgagaaggaatggagaaccaggagagtgtgacaagtgaacaaagtatttggaggaggatggagtgatcaactgtgtcaaaatggcagacatatcacatagcatgaggactgggaaatgatcattattaaatttagcaaatagaagtcatagttgactttgacaaaaacaatttcagtgaggcagtggaggcgaaagcttgacaagaacagggtttaggagaggaactgaagtagtgaatatagtaggccatttctgtaaagtaaagctgaagcaaagggcagtggctggaggagaaagtggggtcaagatgagagagtctgtagtggaaggaaaacccaggcatccatgaaaaagaaacttaaggttcccttcctgaatgatgttaggaagtttaaaaataaaacacacgaaactagctatctgaaaaatgacacaacccaaatgattactaaaaagaagggaatttcagaaatgtttgacatctaatcaaggagacttgaatttcatctaaagaggtgttattggattgttggattttgattataactctgaaatagtttaagcctacttgattgtaagttacctaatgaaggagactgtattaaaaagacaagggcatggtttgcataggattcataaaacaggagtttgagagacaaaatgtggcactgtgttcccagcaatgtccactaaaaaaggtgtactgatgagcagacttgaaaactgggatcatttagcaggtataattttcattatttaactgtaaagatgaatgtgtcttgggattatcattaggtcattagcatcatccagatgatttcagatcagaaagcaagcttatgagcagtagttttccatatggattccttataagaggactctgtgcttgagtgtctagtccctaggagactgtgaattcctattaataaattggcattctgatttatttggtaccctcatgtgagtttggttctagtagtcagcagcctagaattagctagatatattaaagcaaagggccaagctttgaaatgacactgaggtagagcagggccagcatcattaggcagcctcccaggtgccacccataccttatcctttgtccatctaaccatatgtttgaagtaccgtactgaggaaagaacactgaacttaacagtcagaaaatcatctaggactctgccaccactacccatgcaaccctgagtagtgtcacttaatttctgtgaccctcagtttatatatctttacaaataggagtaacaatagctagtctattttgctgcgttattttgttttgttttgttttgagactcagaatctaaatctaaaacaaatggttataggaacagaaggtattaatgccatcatcattacatgtcctgcagcctaagtatataattgatacacttaagcacactaccacagttatctgagaattgaaggcaacatgaaaaaccacgagcccactgaacaaaatatgggaaatcctacctcccagcaactggtttggcaatgttttcaaaaacggtctcttggtttgcatcctgatcaaaaattctttgaaatctgcaatgtgaaaaatagtaattatttaaaagctgcacctccaaacactatcagattaataaatcttgtttttctgaaagctctattaattaccccatatttacatcactgggcttacctaacttagcacaatgtttgccctgtagtctcaaccacactgtgctgttgtactcctgtatacaaatggtgggtaaacagtattgctttgacaagatctgcacaataaatccctctgaaaaactgcagcagctttgaaccaaataacaaattgtgtgctttttagctctcaagagggacagtgtctacaattggcaagaaattcaaaaccagatagctgcatgaaatggaaatccaagaacaggatgtaaacagccaaggaacttctaatatctgacctgtgagaaaagaatgcaactgtgaattgtatgattattgaacttagttttagtattttgaactaaagtttatttttccactaatttggtgctatatcctagcatcaaccatttaattctcaggatggttttgtttcattttgttgaccatgagtcaaaagtcaaaaagtaaattatgatagacctgtcccacagagagaaggtttaatcagattggcaatggcttaggggaagagagtggaggtgtggtgtcaatttcactcttcttgcaatgcttctctgacttagcttagtactggattgcaagcacagtggaacactcggggtagaagacacagaatctattttttttttttttttgagacagagtctcactctgtcacccaggctggagtgcagtggcgctatctcgcctcactgcaacctctgcctcctgggttcaagcgattctcctgcctcagcctcccgagtagctgggattacaggtgcaccatcactcctggctaattttcatattttcagtagcgacagagtttagtagagacagctgacctacctccattttagagaagcaaacaatgaactatacaaagagataatctaaggcactctggctagtatgtcatttagcagggaagattgtattttagacagtaatatttactgtttagtgtgcccagattgcttctcaaaactctatagatgtatcacagcttcagatatgaacaccaacataacacagaggtcaacataacacatagctgctgaactgcttttcagagcactgtgtagtatgaggtctgagcacatattctcagcttttgaggagaatgatgataacgctggttcacttcttttatcagatgggtgatgactgggtgaatcaattagccattttctaccccacttctttaaaaaaagagtaattatatctactaccatgtaaataaaagagatagcagaagttttaaagaaggcagtgaatcacacacagaatatcttctgaaaggtaccttgtgtaaaattaatgatagcattttcatttctaattgatctattcattccacaaacacatactgagggcctaccatgtaccagtcacttctaacaagatttaaattaaaaatatctataaaggatattgaattccttgggggaaaatgacatcctccactatttaaaatagcaggtggtagaaacacaagcaatccagatctccctttttattgacttttccccacacattttagaagaacgattttagcaccaaagtttacaataaaccattaactatatattaagcatcaaatgtcatcatcccaaaatattgcattttatacaatatagttgcatagtaatctgaaaaggcattttgatcagctgtcttctgaaaaccactgaagagcacaataggatcacaattagaagggattttaacaggttcagtctaatgattaacagaggaagaagtcgagatccacagagataaagtaattactcagagtcttagagctcatcaataatatgccttgagacataacttaggtttcctgattcttaggaggtcttttcatttgttaggaacttgagtaggctttttctaaactccatttcaaactcagcatatgctgacttcttcccaccctaaagaatggtgcacttcctgtgctcttcctcatctcagaaagcaacagctctatccctctaaatgttcagtccaaaaccattaggatctgcttgactcctctgtttctactatactttatgtctaatccatcagcaaactctgtcaggtgagaccttcacaatatatccagaattcaattatttctcaacatttccactgttaccaccttggtccacgctaccataatttcttgcctggtatctcttgcaatagcctaactagtcttttcccccttccagcctgttttccacatgtcaacaagagtgatcctgctaaaacataagtgagataatttcattcctctgctcaaagccctccattgccttctcacggctcaagtcctcacaatgacttataaggctctaagtgatctggccattctgctgcctcatgcttactctactcctcatgcttactctactcctcatgcttactctactcatgcttactcccctctacctcttgcttactctactccagccacatagatcactttttctcaaacatgccgggcgttctccccattagggatttcactcttgctattcccttggcctgaaagtctcatcccttagatacttgaatggctggcttcctcacctccatcaagtctttgctcaaatgttcctttgctgtacaccttccctgacctattaaatgttgcaaccattcctctccttcacccccctcatccagcactcctcattccccttctttgtcacacttttctccatggcacgtagcaccttctgacgtacattttgcttactgatcttctcctctatctcctcccactaaaatgtaagctccctaagagcaggagctttgttgtgttccctgctgtattcctagcaattaaaacagctcacagtgggtagccaataagtatttattggttgaataaatgttcttgggggaaaacagcctttaaaatgcttaaatatttatctctgaacatatgtgtaagttgaatattttattaatttttaattttgaatattaaaaccattattttcaattcagagatttaaaaataagccaatggtgcttttacaacaattgcactttgtttgtatctatataaagaatactttggggccaggtgcagtggttcacacctgtaatcctagcactttgggaggccgaggcgggcagatcactcgaggtcaggagttctagaccagcctggccaatgtggtgaaaccctgtctctactaaaaatggaaacaaaattagccaggtgtggtgttgcatgcctgtaatcccagctactcaggaggctgaggaaggagaattgcttgaacccaggaagcggaggttgcagtgagccgagatcgcgccattgcactccagcctgggcgacagagtgagactccatctcaaaaaaaaaaaaaaaaaaaaaaaagaatactttggatagggtccatagataaagacatagtaaattgttcttatcaatcaaatggaatcatgttgaataaaatatttcagcaaactgttgttttatgtaatagattttggcctaggccagctggtaacaagtcacaattatgaaggtatgtagcatgcttacatcagtgggagaacgtcctcttcagaaaaagcaaagcaggggccaggcgcggtggctcacacctgtaatcccagcactttgggaggccaaggagggtcagatcgcttgagcccaggagttcaagaccagcctgggcaacatggtaaaacccagtctctaccaaaaaaaaaaaaattagctggatgtggtggtgcatacctgaagtctcacaggctgaggtgggagaatcacctgagccctgaaggtcagaactgcagtgaactgagattgtagcactgtactccagcctgggtgacagagtgagaacctgtcttagaaaaaaaaaaaaaaaagaaagaaagaaaaagaaaagcacaggttttagggctattccttaaaggatataatgaaagacaatggggagacataaagacaaggtgaggaccgccccactaggcaacaataggttagcaagccttgcttgtacttactgtaaaagacacaataagaaaatgaggtggaagtggagggagagatgtatattatatatgaaagacaaaaggtagagttatgaagaccaaggagaaattctttatgagacaacaaaaaaagcaaataagaatttaaaaagaaaaaggccagatacggtggctcatgcctgtaatcccagcactttgagaggccgaggcaggtggatcacttgagatcagaagttcgagaccagcctggcccacatggtgaaaccctgtctctactaaaaatacaaaaattagctgggcatggtagcaggtgcctgtaatcccagttacttgggaggctgaggcaggagaatcgcttgaacccgggaggcggaagttgtagtgagccaagactgcgccattgcactccagcctgggcgacagagcaaaactctgtctcaaaaaaaagaaaagaatttaaaaagaaaaagagagagagagagaggaataaaaaaaaatctgggatagttttatccaaagggcaaaggcaggaatagtctcaaaacagggcctttgtaaaacagtctagagatacattgaagagaagaattaggattctttcagcaggatccagaaatccgtcaccaaaatttgggccagagatcaaagacggatttaatttgggctcaaacttccccagaaatcaaaagtggagattaaaagaaatagattaatctgaaaatggagactaaagagaatgtgaaatagctatactccctaaattcaagacctagctacaaaaagagtattcagaccaaagacactgatgaccatgcaagggtagctgtttggtatttttcaactgagccattatagttcagcattacccaagagaaatataatggcatccctaaatgtgagggcatatgtaatttaaaattttctactagccacgtttttaaaaaagcaaaaagattagttgggcatggtggtgcaggcctgtagttccagctattcaggaggctaaggtgggaggatcactggagcccagcagttcaaggccacagtgaactatgactccaccactgcactccagcctgggtgacagagcaggaccccatcttaaaaatttaaaataaaataaataaaactttaagaaacaaaaagaaacagctgaaattaattttaataatatacttttaaccaaagttagaagtttcatgtaccaaaatgttacaatttcagcaaataatcaatatgaaaaatgtcttgagatattttacattctttttccttcatgctaagtcttcaaaaatccttcatatgttttatactttacagcacatctcaattcagtttgaacatacttcaagtgttcaagaaccacatgtggcttgtggctattatattggacagcacagatatagagtatacatatgtgtatatgaggtccaaatatcatatatattataaagaaggcttacctatgtagcacacaaatgatactgtaagttcttaccgtcagtgaagtttaatcatgcattggaactttctgtaagtgctaaacaagagtgggttgagtaggaaaatactagataaacagagctagtaaagaaaggctggaatcttggaatacaatctcagatatagaaatacacattatttttgaccttgggcacagcagtgaaaaggcaacttgagttcagtctactaggtgagatgaagagctgcgttgcattttccacaagaaatggtgctaatgatttcacaatgaatattaatgcagtacaagagttagttcaataatgaaacagaaatgaaaaaaggagaaagaaaaacttacttaaatttgtagctttctcgcttattattcacaaacccatctgccaaatcacgtggtaagatgatttccaagctaggtattaatttttcatcttcatctatggaataaatctgcaaatgtgaagacaacaaatggatataaaatggtgaaattatggcttgaactatcaccatgttattatgacttgtaatgatatgaaaattatactcttaagattaaaaagtcataatatcatataatttgaataatttttctctttgaactgtgtggattcagacaaatatatggaactgaaccagaagtaaaacctaaattaatgctgtatcaaagtcagatcatctttgaatgatctaacattcaaatataagtatttgactatctctgttattattgtcattgagaaactaatagcctgaaagcaacattttatctaagtattgctttagtattgtgtatcaggagttaacattttactacaatcaataagcatttctgagcatttacaaaataccagagataaagggactaggtttggagccatctcagatagctcaccaagaatgctctaattcaagttatgttcaaagaagcctaaggttccatgagacattttcaggcatttgataagagagatgtggcttcaaaagacacatgtaattcatgtatttgatgtcattttcaaggttctccttccaactcagccactaattagcaagtgacctgggagaaatccttaagcctttctaagctgatatggaaatagagggtcttaaccaacacccttaggactgtaacattctctgattctcttcctggtttcctactccatcatttttattggccaggaaaattaaaagtcaagcctataaagaggtcatgtggaataaataaaagcataagatttgtcccaagacttgggtccaacactgagctcaatttaccagctgtgtgaccagccaccactttcagaattgaggttccttgtacataaaatgaggaaaacagaattacctcccttacaagattgctgtggggatcaaatgatgtaatggaaatcaccataaaattgtaatgcaccataaaaaaaaaaagtcattagatttaaaggttttttttttttttttaaaggcttcttgtcttttaccatgaaataaaattccttctaacaggcaatacttcctgtttaagacccatttagatgcttggttatgaggaaaaagtcatattcctaagcaagtaaaagcctacctaaatctccagaaagtttgaatattttcctaagtatatttttattgaaacttctcatttaaaatgtgaagaattcatgcagaaaagtcattacataaaataaagtatttgtagaaagcaatggcatcaggttcaaggctttctggctaggttttctcaagagacatttaaaaattatatcctgttgggcactacattaaaaaaaaaagttttatagccagacaggtgagtgaagggggtgtataagacatgaaacatacaagagtgaggagttacatccatttttaaaaagtctatatttctctgctcagcagacagaaaagaatattaactgccattaatgaccctccactactctgattaagacactctttgaggccttaagaaaagtcccttagaaccagatcacttgtttagtgtaatattggctttctatccttattcataaaaatattatttgagatagtgaagttttttttttaagaagacagaacaagtgcaaggatgattatgaaaatgttttgaaatgtataaagcactgtacaaatggaaagcattaccactgttaaaactatcaaagattcattttatatatcctttttattaatctgttattacaatttactttatgatgccttaaagaataaaagtaatgcagtaatgaagctataaaatgaagagaaagaaaaaaattcctttgagtcactctcaatttaatactacaaaaagcatttctagtcagagaaagaactctacaatcttttgcggacaagaagatatggcattaaactgtggagtttttaagggcgaacagggatatactaattcaatatttattcattcccattctctttgtgtgtatgtgtgtgtgacacctaaaaatatgacacctaaaactacttcctggaggatcaaacaatccactctacagactcaccaaagacatacaaaatgaggtacattaaaatatccaaacactgcattttaagagaaaagaaagttcagtattaaatccaagactctccatccacttccctgagccccacccctacccatcctgtctcttgaccttatcccagcctctgctctgactgctgagcccatgtagataagctcaacagtttaagctaagaatctggggggaaatgttacatacaatacactttttacatatgatgcactctaaaaagaaatgcatgtaagtgattattagaggagagaaaatgggaagatacccatggttctttctacaccactttattcctgttttaaatacataaattatacgaggcaaatgcttaatcatgagatgctatgatattccacatagacatatacccagtatatatatggaacaggaatacaacattattaatatgcccactccatatactcacaaatatgatccaaattgcccttgcctaaattgtcactttgagaggcaaaaaaggtttccgaaaaggggatagctttgaaatcaaaaatccttaattaaaattacagctctgctgttcacaatagcaaagacatagaaccaatctaaatgcccatcagtgatagactggttaaagaaaatgtggtacatatatatacaccatggaatactatgcagccataaaaaaggatgagttcatgtcgtttgcagggacatggatgaagctggaaaccatcattctcagcaaactaaaacaagaacagaaagccaaacaccacatgttctcactcataagtgggagctgaacaatgagaacgcatgcacacagggaggggaacatcacaccctggggcctgtcgtggggtgggaggctacgggagggatagcattaggagaaatacctaatgtagatgacagattggtgggtgcagcaaaccaccacggcacgtgtatacctacgtgagaaacctgtacgttctgcacatgcaccccaggacttaaagtataataacgaataaaataaatgttctaaaattgaaaaaaaaaattacagctatgccactccccagctgggtgccttggtcacattatttaacctgagactcagtttcctaatctgtaaaatgcggaaaatgacaccaaccttgcagggttcttgtgagaatgagagataatgcagataaagcacctgtcaggtggccatttctcaagatacataagaatgactatgctcccttctaggcagaagagaggatgttttgaaatatttaagaagcataaaaagtgctgggcgcggtggctcacgcctgtaatcccagcactttgggaggccgaggcgggcggatcacaagatcaggaggagatcgagaccatcctagctaacagggtgaaacccggtctcttctaaaaccacaaaaaattaaccgggcgtggtggcgggcacctgtagtcccagctacttgagaggttgaggcaggagaatggcgtgaatccaagaggcagagcttgcagtgagccgagatcgcgccactgcacttcagtctgggtggcagagcgagactccgtctcaaaaaaaaaaaaaaaaaaaaaaggtgcatacaaagtatcattgctcagagtcagggcaatgtcttaaccttctttatacctttctgaatttagcacactagaggaagcacctggtaaatatttagttaattgtttctgaatgaagtacacatgcgtattctttgggtcaggatgcttaagcatctacctatatctattaatacaaggagtatatgtaaaggttcacgtttatgttggagaataacaacagtcaactaattactgaggccccactgggtgcaaagtactacatatgtgtatgctttgtgcatttgtgtctatctatatttgtattatttcagaggtacataaacacgcatctcttgcttgcacgttttgcccgagtgccaaaatgtacctttgagtgtatctgcatgtgcggtgctgcgtgagtttcccagaaaggtgcaataagtgcttatgtgtagttgaagcgcacactatacaggcatactgaacatgcactagtctgcccccgcgtgaacacgtgtgcctgggtgcaaaaaaaatggctctctgccgggtctgcgctgtgccaggtaggagtggcctggctgtcggtcgcgtagctgacagcagtgcgcgggggtcttcgcggctgcagggctcctcggtcagtgtgtgcgggattccgggcggcctcggcgcccaccagcaagcccctcacctccgcccagccccttcgcgtgccgccgcccgaccccagcccaagaggccccgccgcgccggcgccccggaggctccagcccgtaccccttgttggtgcttccggacagggggcttcaccctcgcgaatatctggatagtctgcttcaccatctcctccctggctctgcaatgacccttgacctctctcaggcccgggctgccaaaactaactcccaccacctccggcgacccacagtcttagcaacagtagctagggacactacccagtgagcaccttggcagccaggatcccgcctcctccctctaattggtcgcgaccggaaggaggccactacggggcggggctagggaggggagggcgggggtggagaggagagcgctgcgcatgcgcatgagcgagtgtctgggctctgggtttagcgccggacccggcctggaccgtgtggttaaaggggaacaaccaccatgccttgccccgccccgctcattcacccattttattctccatgcccttgcctttaaaaaaaaatacagcactgggccgggcgtggtggctcatgcttgtaatcccagcagtttttgggaagccgaggtggtaggatcgcttagagcccaggaatttgagaccagcctgggcagcatagtgagactccgtctctacaaaaaatacaaaagttagccaagcgtggtggcgcgcctgtatcccagctactcgggaggttgaggcaggaggatcgcttgagcccgggaggtcgaagctgtagtgagccaagattgcagaactgctccagcccacttggagatcacagtctgaagaaggagacagattttttttttccttcacaaggtctctcaagtgacaaggagacagattttcaacaggaaatcaaaaccaaggaatacaaactatgccatgatggaattagaagtggggctagctctgttttggaaaaggataaaactggatgaaggggactgtttcccacacaatggtcacggcaagaaaggatgagctcttcaaacactgttagcacatgaaaagatagtcaacattattatccacgtgggaaatataagttaaaaccacaatgaggcatcactattcatctatcagaatggcttaaaaaaaaaaaaaaaaaaaaaaagtggcaacaccagatgctagcaaagatgtggagaaactgaatcagttgcactttactggtaggaatgtataatgtaaaacatacactgtataaaggtacagccactctggaaaatagtttgacagtttcttacaaaactaaaggtgcaactactctaagacacagcaattgcactcttgggcatttatctcagatgaatgaaaacgtgtgttcacacaaaaacctgcgcatgtgtgtttatagttttagcacctttatttgtaatagccccaaactggaaaaaaaacccagatgttcttcagctgatagtttaaaataactggaataccattcagcaattaagaaggaaggaagtgttgatacacgtaacaaattggttgaattttcggggaattatgtttcatgaaagaagccagactcgaaagctaactaccgtatggttctattactattgccagggaggtgtgcagggtatggttataaaagaaatccttgtgatgggctgttctgtatcttgactgtgatggtgatcacagaaatctacacatgtgatagcattgcatagaacaaattacacacatgttcaaataagcacatgtaaaactggcaaaagtcacataaaattgaataagattgatggattgtatcaatgtcaattccctgatttttatattgtactatagttatgcaaaacattaccactggggaaaactgggagatgggtatacgagttctctctgtattattttttacaaaacaaaaagtttattaaagacacccttttttctttctttcttttttgagacaaggtcttgctctgtaccccaggctggagtgcagtggcatgaacacggctcactgcagcctcaacctcctgggctcaagcgattctcctgcctcagccccacaagtagctgggcttatagacatgtgccatcacactcagctaatttttgtattttttgcagagacaggatttcatcatcttgcccaggctggtcttgaactcctgaggtcaagcaatccacccacctcagcctcccaaagtgcagggattacagccatgaaccactgcacccagctgaaagacacttaagaaaacaaaaagactaactacagattgggagaaaacttttgcaaaacacgtatcttgataaaggacttgcatccagaatatatacaaactgttaaaacctaataatagaaaaacaaacaattcatttgtttaaggtgaagggagggtgcaaagatttgaacaaacgcttcaccaaagaggatctatggatggcaaataagcacatgaaaaatatgctcaatatcattaatcattaatgaaatgaaattaaaaccacaatgagataccactacacatctcttagaatggcgaaaaataagaaaataaaactgacaaaactaagtgccgacatggatgcagagcatctagaactctcaaacatcactgatgagaaaacaagatggaccagccactttgtaaaatagttttgtaatttcttataaagttatacacatacttaccatatgacacaacaatcccactcttagttattaacccaaatgaaatgaaaactatgttcacatagaaacctaaacatgaatgtgtatagtggctttattcacaattgccaaaaactggaaacaaagtaaatgttcttcagctggtaaatagataaacaaactgatatatctatgccgtaaaaaggaatgaattacagatgcctacaacaacatggttaagtctcacatttattatgatgagtgaaagataccagactcactgcgtactttataattccatatataattgaattatatataatatatatctaattatatatatcatatataatatgttatatatgttatatattatatgtcatatataattatatttatatctgtatatatatatgacattcgagaaaaaaaaaaactgtaaggatagaaaacagatcagtggtttccaggtgctgagggtaggaaaaggggttgactgcagatgaacatgggagagttttttggggggtgatggaactgttgcatatttagattgtggttgtggtaacataagtatatgcatttgttaaaactcatagaactatctatacacttaaaagagtgaattatactgtatataaactgtaccacaataagaaaagaaaaaaaaaagaagaagattgagtatgaacaggtgctgcaatatcaggaattgagaagaagagagaaccaggtatttattatatagactttggggctttttcacctagcaaggaagagatgactcaagattgggtgcaggtattcacctggacaagcaaaatagatgggagtgggaaaaaggaggaaataaggagttggggacatgttaaatttcaattgcttgtgggacttcagaagtaactggataaggtttaggagtaagttatggtggaaatataggcttgggagtcatcacaaagttttttccagaaagtaaccaagtcactcacgagcatcaaggttgaaatcctaacactgatggttggaggtggaagaggggctgcaaaagaagttgaaggaagcagccagagaggtctgagagagaaaagggaatgttatgccatggaagccaagggaagagaacattttgagaggaaagtattcaacggtgttgaatagtaaagacaatgcactgaaaaacacccatttcattcagcaactagaaagtcattagtaatatagatttcagtggagtagcagtgtcagaagtcaggttgccagaggctgaagaataagtgggaagttaggaagtggaggcagtcaagataggctacttttcacagaagcctagttgtgaaggattgtgaagaagcaacacacaggtgagagctagaggaacccagcgtaccagtggtctttgtccatatccaaaggggtatatctaataaacaaggggaggttgacggtatggggaagagagaagagaatgggtgttttcctcagatgagcaattgcacttaccaagagggtgtaatggaaggtgacaaggccagggagccaagggtattcacaaaggagcattttaatcatgaagtctaggctgcttaaagatacctgtggtctttgaagaagtgttgcaaaaggaagaagggaaatctgtgggtccaggatgtgggatctttaacaattcctgtcttgagctctgggtcatacaattaaatgtttcgatggagagaaaatgtgggttccaatcctgcatctgtcattcccaaatcctgtgttcatctttacttgtgtgaccttgggcaagtaatttatgcttttaagtctcagttgcctcatccaataaatgaagatagataataacaatagctacctcatggggttatcatggacatgtaatgtgggcattaacgtggtttccggtgaatagagaatgctcatatctaaagggttctgacctgtggattgaattcctttgattgtaaacaccttctaaagagcagaaacaatggcatacatatgcatgtaagacatattggagattgcaaactcaaatgtctcctggggccagaccaatgatgtaaattcatcaagcagacaggcatatgacaatagggagcgtcatggtgaactggagactagtgccccaactaaaaccattcacattcaaaatggttacagcacagtactgcctaaataaagcacatttgcaggaccatacttcaacccctttttctgtttctggtataactgacctcagtaactcccaggcccactgcctctgacaggtttacctaaatctcaaacagatggctgtaatgtgtacaaaataggttttgagattaaatctccaagtcacagtgtctttcccacccctggatttatattcagtgttattatttgtattttatctgcttgtttaaatgtgagaattaagatgcttttcaactatttaaaagatgcttgaactttgtagttgccaaaataacagataattgtaccaggcaaattagccagggtttataagcctcaaatctgaaagaaattaagctgtgcctgaaatgaattagtctatcggtaagttagttggatttgtttgcttgtatgtttcgttttgttttgttttgtttaaaaaaaaaatgaaactacgctctcgcactagttttcaaatacctctttagctgttgctgctacaactataaaatgcattattttattttacaagtctgaagagggaccagtaaaaatgttatgggctgtaattttgatatagaatatgtacataaaattacctaattgcagtcaatttcctcctcccctagtttatccatggctttggggaatttatgtttttgcttgttcaaaaatctttcatggtcacagcatgactgtcccctcccacccccgccattataaggtgaacaagactttccagacaggtgctggagacttcactaacaagagagaaaacatttgactggggtcttcttttaataactacctccaagaagcaaggccagtcatcagaaatttgccacttattaataaatagcaatattaatggaacaaaagtcaaccaaggctgggtgcagtggctcacacctgtaatcccagcactttgtgaggccaaggcgggtggatcatttgaggtcaggagtttgagaccagcttggccctgtctctactaaaaaatacaaaagttagccgggcgtggtggcacacacctgtaatgccagctactggggaggctgaggcaggagaatcacttgaacctgggaagcagaggttgcagtgagccgagattgcaccactgtactccagtctgggcgatgaagtaagacttcgtctcgaaaaaaaaagaatcaacttatgtaaactgtccctttatatttggtgatactgggtaggactttgggcactgtatgattcctgggtgtccctgattgaggatttcatgggaagtagtcaaaagaagaggaagaaaaaacatattttctgcggaggagactttcatcagaaatcccctccctatcagtctgtgggtggtcagtaccagaaggatcctctaataccaggcagtctaagaaggtaatttatttcattgtttctgaaccaagtggagaatactcagagcaatttctggtactcattaaatgccaaataataacaacatgctgttaaattgcagagcaagggtaccacaaaatctgtaatatataattttagcaaaaaatgttcttctgagaatatgttcagctaatttaaagcatagtttcattagcataaccatctttccacatatagcggagtggaattcataaaacgtcaccagcacttgggtcgataggattttgccatcacactcggttctctctcctgctggttcttacctctttggctaagaagcagaggcccctttctcccaatttatctgatctcttcctgcagcaccccctggagctccccctgaagaacaacatcaaagccatttagggctggaagctggtggccagccatatggaattacagcccaggctcttgccggattatagactataacatatgaaccaaatgacagtgccatggcatcgagggaaagctggtaaagcctccagttttgaatggaaaatatgactgtgtatttatacacaggctcctcataaacaacctgaatgtttcaccaacatcccgaggaaacaagggatgggctgagttaaaaatagctctagaacgcctctcttctaactaaattacccatgctgtcctatctcctgagggtgtttacttaaatgtgcttctttgcatatttcagaattagaaaaaatgcttatcaacaaataactgaaaacgtaaaagaaaatggctcacatagcagagagccttatctgacacattattattgtcacaacatccaaccacaccttattcatcctgaatctgggtatttggcagtcgaatctatccaggtctctacttcctaatctctcatttacttttcaacctcctgcagtctagtttctgtctctcctcctccatgggacctatttaaactttgcacctccagagtgacaccttttgtctgtacattttggaatattgtcatgatagagccagttgcctaggcatgacctcaaagttgccctttgctgcttcctctctctagcatatctacatccaaatagtttccaagtcctggttatgctgcctcctgaataattttttcctccctcccctcaactttgtcctcactacttactacttgctttagtttggctcttagtctctttgccagaactagcaaagttctcctaactgcttttcctgcctctaatcccgccctcccctttattccgtctgttacaaccgctgcaagattatacaatgcaaaccagttcacatcagtgcttgtttgaagacctccaatccctgttacaaatagaatcaaggccaaaagtccttcataacctggtccccagctgtctttacatcactttcatagcccttaccatgtcttccacctcctcttccctgcccctgtacgccagccacagatttcctgcagttcccaagcacgccgtgttttttcatttctccatgcttttgtcaggaccatttcttctgttttcagtgctgcctcccactttgtcaggaaaattcgacctatacttcaagatccagctcaaatgtcacccggtctggaaagccatcccttccatctcccctagcgaagttagtgaccctcttctgtgaagctacatctttatacgttcctttgtattagtgcttctttcgctgccaatgttgtcaatatgtatctgtctcctcatcattcttaggattatttaagggcagcgactaaaccctgtttatctttgtatttccagtgactaacaaggtttaggtactggggagatttctacatgtgtattgaatgaatgagtggatgcagaactcattgcaaggaattgattcaataaaacctttacaaattaaaaatttttattagagcttcatattttcatagtgaaaattactttctcttcctgtttcacccaagaaaacaaagacaatctacaaattgagtagacatttagcaagagaaagaattaaatcatggtttccatttctgaaccttcttttttcaggcaaaaaaaaaaaaaaaaaaaatggttgcaaatttcccagggtgataaacagagtacattaacatttgtatcaatggaagacaacagaaacaggatctgagggagtgataggtatagaagcacagtggcccactgttaaattagtgagtttctttcaggatgtctgggaagcatttaatgactctagggatcaatttgtttttaatttaaaaagaatgcatcgtttacaaatcaccaattaaatacttattcaccttcttttatttcgtattaaaatggactttcagatgtttgacaaaggcagtttgctcttcctcctctgccatgacttttatttccccaaatacaaaaagaatgtttcctaaattacacagcttgtaacacttttctccctcctcttttccaagcctttgctcactgctcaggcagaactgaaacatcactctctttgagaagtctcccctgaccctctcagactagattcagagccctagctacatgtgcccttagcaccttggactttataattactactagtctaggttaaatgaaggcctagatcacttttcacttgctcatcatcgtattccattcttgtatgtagtaagtgtttaataaatacttatttaatgagaaatgacataatggttaaactggtaaaaacatgcctgctgggggaaaaaacaacattgtctcagattgcattctccccaaacagacactgagatgaggatttgggtgtcaggaatttatttgggagatgatcccaagaaaacagggaaaggaagaaaaccagtgataggtgcatttatgggtggattttcccagtgggaaagtagggctcattcccaccaggaccctccacaagactgttacagagcacacctcagcattgctccccaaggggcgaagaagcagggtatttattcaacagctcctgcttttcattgctggagggctgctctcggaggtgggaatattctacctccccagcacttccaacttaccctgtgtgccctgacattcagagaaagccgttgggcagagagaggtgcagaccctggaggcaggatgcttttggcatgtataggtatgtccactaaagttgcaatgatctgcggggtggactgggaagaagtgggcagagtatcaacagtgtcttctatggtcagcactattgatgtttttcttctaaatttctaaattaaaaacatgtatgttagaaaattaccaagcatacttgtgtacttctaagttttatgtggttatctaagtaacaggatctacctctaaatgataatattataacatcctatagtatgtggttatctaagtaacagcatctacctctaaatgataatagtataacatcctatagaatcacagtaaaccacacaagattcatctgctctaggaacacataacatccaatcatagatgcttagatcacgttcgtcagccaatcatccttttagtattatttacctatttgatgatctctaatctgtgtctgtgtgtgtcttataatatatagttttgataatattccacttttttatatactaaacatttgtactatacaatgttttctctgtggatcagttgctaaatcaaggatttaaaggattaaaggacaaaaagctggcattaactctcccgggcaatgtgttggtgttctgtgtttacattataatttttaagtgccctatggtcaaagaaatttggaaaattctgttttaaagtcaagctctactgaaaatgttttaatggttccccactttccattgaattaagaacatcttaccaagccattcaagacactccacaaattagttccaacatgttcccctttccctccaatcaaactgaaccacgcgtctctgtccctacacagcctgcttcaccgccagcacccatcaccttctgtgggcctccttctgccctgacctctcttc

SEQ ID NO: 292 - DNA, 23218 bp, Homo sapiens
atatcatactgaatgggcaaaaactggaagcattccctttgaaaaccagcacaagacaaggatgccctctctcaccactcctattcaacatagtattggaagttctggctagagtaatcaggcaagagaaagaaataaaggatattcaattaggaaaagaggaagtcaaattgcctctgtttgcagatgaaatgattgtatatttagaaaaccccattgtctcagcccaaaatctctttaagctgataagcaacttcagcagagtctcaggatacaaaatcaatgtgcaaaaatcacaagcattcgtatacaccaataacaggcaaacagagagccaaatcatgagtgaactctctttcacaattactacaaagagaataaaatacctaggagtccaactttcaagggatgtgaaaaacctcttcaaggagaactacaaactactgctcaaggaaataaaagaggacacaaacaaatggaagaacattccatgctcatggataagaataatcaatatcatgaaaatggccatactgcccagggtaatttatagattcaatgctatccccatcaagctaccactgactttcttcacagaattggaaaaaactactttaaagttcatatggaaccaaaaaagagcctgcatagccaagacaatcctaagcaataagaacaaagctggaggcatcacgctacctgacttcaaactatactacaaggctacagtaaccaaaagagcatggtactggtaccaaaacagagatatagaccattggaacagaacagaggcctcaggaacgacaccacatatctacaatcatctaatctttgacaaacctgacaaaagcaaggaatggggaaaggatttcctacttaataaatcatgctgggaaaactggctagccatatgtagaaagctgaaactggatcccttccttagaccatatacaaaaattaactcaagatggattgaagacttaaatataagacctaacaccataaaaaccctagaagaaaacctaggcaataccattcaggacataggcatgggcaaagacttcatgactaaaacactaaaagcaatggcaacaaaagctaaaatagacaaatgggatctaattaaattaaagagcttctgcaccacaaaagaaactatcatcagagtgaacaggcaacctacagaatgggagaaaatctttgcaatctacccatcagacaaacaatcccatcaaaaagtgggcaaaggacatgaacagacacttctcaaaggaagacatttatgccaccaacagacatatgaaacaatgctcatcatcactggtcatcagagaaattcaaatcaaaaccgcaatcagataccatctcacgccagttagaatggcaatcattaaaaagtcaggaaacaacagaagctggagaggatggggagaaacaggaatgtttttacactgttggtgccagtgtaaattagttcaatcattgtggaagacagtatggcaatttctcagggatctagaactagaaataccatttgacccagccatcccattactgggtatatacccaaaggattataaatcatgctactataaagacacatgcatatgtatgtttattgcagcactattcacagtaacaaagacttcgaaccaacccaaatgtccagcaatgatagaatggattaaaaaaatgtggcacatatacaccatggaatactatacaaccaaaaaaaaggatgagttcatgtcctttgcaggggcatggatgaagctggaaaccatcattctcagcaaactatcacaaggacagaaaaccaaacacctcatgttctcactcctaggtgggagttgaacagtgagaacacatggacacagggcgggaaacatcacaccctgaagcgtgttgcgggggtgggagcctgggggagggttagcattaggagaaacacttaatgtaaatgacgagttaatgggtgcagcaaaccaacatggcacatgtatacctatgtaacaaacctgcacgttgcacatgtgtaccctagaacttaatgtataattttaaaaaaatctcaaagaattagattccctagcatgaggaatttatcttactggatttttttttttttttttttttgagacggagtctcactctgttgcccaggctggagtgcagtggcgcaatctctgctcactgcaagctccgcctcccgggttcacgccattctcctgcctcagcctcccgagtagctgggactacaggcgcccgccaccacgcccggctatttttttttttttgtatttttagtagagacggggtttcaccgtgttagccaggatggtctcgatctcctaacctcgtgatccgcccgcctcgaccacccaaagtgctgggattacaggcgtgagccaccgcgcccggcctcttactggattttttaatgccactatccggcagtgattaaatagcaagttcaagtgattaaatctgatccaatcactacacttttcctttaaaattgctattaggttttgtaagtaaggaagtggaggcatttttgtaagtgcattaactctcaaaggccacaaaagtacgtttttaaacttatggatcaagttgtgtggatacgatttcagacccccagaggttctttcaacgtgtctagtgtccagcacagcgcacctggtcagagtttcgttgtaacttacagcaccatgttttctttggagtgttgttcaggggtctcttgcatcagaatggcctgaactgcttgttaggaatgcagcttcctgatcttaccgtccagtttctgattcagtaggtctggagtgagccttggaaaactgcattttatttagcataatcccctgggggattgggggctccccaaagtttgagaaccaccgctaagggctattatgtttctgcaggcaaacatatttttctttttttgttttatgtaatacaaagtaggagtttaaaaatttatttttggtaaaactagaacactgtcttcaaattagtaagagccttgtgtaggagaaatattctcttcaaaaatccctccacgaaattgatcttaaaaagactagctgagtcaaatcctaacagatctgtcctgtatctggctgccacctttcaaaattgctgaccttatgcttacatattcgaatgcttcctggaagtcaaaacatattttcaaaagtttctaatggaaaagaactaagcctgtcacttggttttaaaaggtggaaattgaaataagacaaaatggttgagattaatttcacatcacaagaatacaggtaagaaaagaatacaaatttccataacttctatcaactatcttttaggttgaggatattatgaaataatccttcccttcccaaccaacaatgaagatgattgatacagccatcatactgaaggattcctactgtgtcagcaattatattaatttcttatagaaatataaagagtataaccttcaaaaactgggtattgttaaattatacattggattctgttaaatgataacaaataaatataaatataaatagttaaattaaaaatatatagatattacttaataggtataagatactcaaatttatgaatgtacttaagtttctttgttttacagtgagaacacttggacacaagaagggaaacatcacacaccagggcctgttgtgcagtgggggggagggggaagggatagcgttaggagatatacctaatgtaaatgacgagttaatgggtgcagcacaccaacgtggcacatgtatacatatgtaacaaacttgcatgttgtgcacatgtactatagaacttaaagtataattttaaagaaagtttatttgttttaaaatttcatacattatgaatttactatgtcccctattacaatggtctccacaatgaagagaccctcactgtcctattatgttcccccaagtagttttataatttctttcatatgagtcctctatctttcttcagtctacattccactgttactattgttactctcgtatataactctattgctactgattaacttgttttggtggaagtgtttccctgttgtattagatagggttctccagagagataaaaccaatagaatggatggatggatggatggatggatggatggatggatggatggatggacagatgaatggacatacagacagacagttcagaaggaatttgttagaggaattggctcactgggttatggaaactgagaaggtccaggacagggcaattgtaagctggagaccctgggattccattggtgttgctcagcccaaatctgaaagcttcagaatcagggaatctgatggcataattctcaatacgaggccaaaagcctaggaacctggggaccactggtgttaagtcctggagtccaaaggccagagagcctggagttctgatgtccaagggcaggagaagaagaatgttccagctccaggagagagagagaaatcacctttcctctgcctttttcattcaatctagcccccaccacacacacacttacagctgtttggctgacgcccacccaagttgagaacagatcttcataactcactccaccaactcgcatgccaacctcctctagaaacaccctcacagacacacccatgataatgctttaccagttttcatgggtattccttaattcaatcaagttgacacctaaaattaaagataacacctgtgctatgataaattggcaacattgattaaatgtccatgaacaccaagtactaagataaaaattgcagtgtccaatgaagcataaatgaaggtcatctaatccaggcaagaaaatggcatgcaaattgttgaaagaatgcctagaaacacacacacacacacacagtcacacacacataggtaagtccaactatccacaagcaatctctctgtatgtgttttgtatcccaagtcagacaagtctaagctcttctggtttgaggaggtagctagtgtgggtcaatgtacctatttctatgaagcccatggtccacgcttgcctgtcacacttcctcacttagcatactgggagccagagccctgatattttgaaatgctgtttattaataacaagtccatgggtctagctagaaattcgtgagattatttgcattaaggaatttggggcctgggagtttacttcatgtctttgtcacttcttgtaagacagcaccatttcttggtaacaatggacactatgagttggacactaaaaaggctctggttacattagtaactttatttcaactgtagcacttactctatgcttttttttcttctacctagtgttttaaaatgtatatctatatcttctctttaaggatatgtaacttagtgaacactcatcttctttctcactactttcagcctaccgtgtttatctaattcctatttcatttcgatcagggctttacacatttttataagttgaaagacttaatcgaattacttctttactcttactttttagactgtatttttaaaaaaaatctcatgtgtttatttgattttggaatactctttttccaaaagagggctggtaggtgtctttgtgttgcaaatattctgattgttaattgcctgagtcaatatcaaggaattgtctataggccatcacatttaaatgccagtttggctagatataaaatttcagtttcaaaattatcttttcttcaagttagattggcggcacctctctgaaacccttggagtcacataaagtttcagaatctgaatgacttaagaaaggctccttaatacacacaccatatgtagagtgttacatagctagaccaattaggtccaggttatgactctcaaatcaaatacaccaatatatctgcagcaagacatataaacattcttgctaaaatggggtttttcaaagattatagacttttgccacctcacattagatatttttctaacaaattttgttaccaaattttcacaaatgcacaagcttttatttccatttggagggtgtttcaaaagtatatatataagatttagcgtgaacagtataaaattacttcaggtatttttatttgattttgatccctccttcttttctttaactgtttatgttaacaaattctaaacttacagaaaagctactgtatcctcaactatattttctaaatggacttatttttttctcctttctcaggtatgccaatgagtcacagatttgatctctttgcataatcccatatttcaaagaagttttgttcatttttaaaattcttttctctttacttctgtctgactgagttaattggaagactctcaagctctgagagtctttcctcaatttggtctattctgttgttaatgcttctgagtgtacgatgaaattcttaaagtaaatttttcaattctagaagttcagtttttttctttcttaaaatggctattttgtctttcagctcctggattattttattgaattcattgtattgggttttgactttctcctaaatcttgatgagcttccttacctccagagtctgaattctatgtcagtcatttccgtctgcttaattatcattactgtggggttggggtattcgtttggagataaggcgacattctatctttctgaattgccagagttcttatgctgattctttctcatgtgtgagggctggtgttcctttaactgtaatgtaagtttagtatagacagttggcttcatttctaggtgctttcttagggccaacactctgcattgataaaagaaaaacttcagccaaattaaatttaaatgagtttaattgagcaatgaatgatcgtgaatcggggagccctcagaatcacagcagtttcagagatactccaggggtgccttgtgatcagaacgaatttatagacaaaaaaggtaaagtgaggtacaagaatcggaagtgaggtacagaaagagtgagattggttacagctcggcgtttgccttattttaacacaatttgaacattccgcagtctacgagtagttgaagtatggctgctgggactagccaacactcagccattgttacaggtgcataccattaagttaggttttcaattttgtctcacaaggttagggttcatccacaaggactcaaatatagaagtatggagtatggagttcttctaaggccatgtttagtttgctttaacagtacagaatctttatttgtggctgaaatttttgccttaggtttcacaggcactgtatactggcaaaatatttttggtgttgtaatttgggtacaatatagtaagagtggtggtcagcagacagacttactcagctgcacagctctcgcattttggcatgttcacagtagtgctctgttggggcggaggggaagagaactaaccccctcaccagatccactcctgaatcttggaggatccccctcaaatcactggcaccatgctctcattttccttactcgggtgttctgggccacagggctccctcaggcaggggacatggctgacaagctgtactctttccagactagccctgcagaaagagcaacattctgctcctccaccagcccagatgtctcatccttctcagtgttctgagagtgtggatttttttttttccagatggagttttcgctcttgttgcccaggctagaatccaatggcgtgatctcagctccccgcaacctgtgcctcccgggttcaagcaattctgcctcagcctcctgagtagctgattacaggcatgcgccaccatgcccagctaattttctatttttagtagagatggggtttctccacattggtcaggctggtcttgaactcctgacctgaggtgatctgcccacctcagcctcccagagtgccgggattacaggtgtgagccaccacacccggtcgaatgtgggtgttttaagagtgtgggctcccccaactgcttgaatgctttccaagctggcaaatctgccaggctaggagcagcagggatgggttgagttgcccaatctgccatccaggtgcttttcaggggaacatggagatgtatagcctagcagaggtcaggtaggggtagagctggaagctggtactgagcctggtctggtagagaggagtgtagcaatttgacttctccccagcaccatgactgcaggctctattgggactatggcagctggtactgggctgctctggggttcaagacctgtgaggctccctgtggagtaaagtgttgcctccatcaaaacttctgggggctctctgaattcatctagaggcctgggagggccaagggaattctcctcttcccaggattgcaaaggtcccttttagaaactgtgtatcctcttggggggtctcactcaccctttctccttgttagagagctcctgctggctccaggccaggcctcagtgggctgttgcttggcttcactctcctctgttctccatgtccctttattcccttgatggatctcaacctggtttcttagataatcttcctgtacagtcagtttactcaccactttgtttcctctccatgagagcagcacacacttgctgcttctagtctgccatcttgactccatcctcctatatttccaattttttagttccaccctaactccttatgaggaagttttctatcagatcctatctcattctataactagaataatttatattattattatatagcaaactattatgtgtggagccaggtcttttgaactccaaaacttaagctcttaacactcatgttctctttcttgtatcaacatgttaaaggaaaatattggagagaaaaagaagtgtcatttttcacaaatagtgtttctcatatgctatattatattcagagttttggacattatatataaatatatccaatgtaaggtattccatatagttggtttcaaattgagtatatcaacataattgtataattttgtataatcttaatttaaacttcattaattttatgaagttcatatattctttatatctacctttcaagaagaaaggcaggaaaatatttgatgcagaaagctttaaaaggcaagatatgctatataattctgggtcttaaatatgcaaaataaaaaaaaaacgaggtaaaacagagaaattattgagggctttccatgccagagtgaggagtaatgcacttttcccaaagaaaatggagaagtattcaatgatttcaagtagggtagaaatatgaattatagagagagctggctcaatgaaaacaactgattagagaaattaacctggaaaggggaagatcaagcaatttttgaaaatatcccagtcagtaaatgctttgattctacattttggaggaagttgatttccagcaaagggacaatgatatggccacagaggacacagagaatatggtccaacaataattgagagagcatcttaatgagagctgattagggaaaagccaaatgagcaagtcagtacctcaacaagactttcttgtgctgtggcagaacgtttcttctaaaatgtaagaagctacagcccattttgtgcataggccacataaatcatagtaggtggaggaagagtcaggtatcaatatgcagatatccagaaaaaggttccagcctcctaaaagatggcaagaataaccagagttcgacaccacacacagcacatactctaaacactggaacagttacctatttccagacacacttccaccacatccaccctaacccaactcaactatcataatatagggaaaaaaatttttagatcatcttgatgcaacaattcataatcaatactccaaatgatgtaactggtgattacagtccatcttcatcacacacacccaagagcaacactttgacatcggccactcactcacataggcatagccagtctttccaattgtctgtataaatgtgtgacactgtacgccacttttctcttgtaggttctacccgtcacctacagataatggtgagtaaatacaagaacaatgttctgctgaaaggattagaagccatcaatgactatcacttcagcataattaattccttactgatcaatgatttaaaacttaattcaacaaggagagacgaatatgacaaaattcagattgccgacttgatggaagaaaagttcccaggtgatgctggttttggcaaactgagaactcttcaaagaaataccaacactgggagaggagaccttgctgaaactcttagaaaagtcaaaaggtaattgggaaaagggaattctcccctccctgccactgtccctaaacccttcccaaccttgaatagaacctcagcttcattatggttaatatatccatttcccaatttatgcctcagcggtcatgatattgttggtactttgcatgtcaacaagttgacagcatagagcattcccattccagtggattcatatgttttgaagggtgtatctggggtatggagtaaaagcaatagataaaagttgtcgatgaaagaccgaggcttctggtatgataaaaaggttagaaggtggtgaatcaagccgggtgcagtggcttacagcactttgggaggctgaggcgggcagatcccttgaggtcaggagtttgagaaagtggtgaatctaaatttaaaaatgatgttttatatgttaaatatatcaattaacctattgtttcacttgctctattaaggctatttacactatcaccattatcctctgtagtaacaaagaggagacaatacttcaatgaaagcctacctgtcagagagacaaactacctttttaaaaaaacacagatttaattttttttcaaaaggcaaagttcagaatcaccatatagtcacctcataaacctatatcatatttcatttcactggtttctgtaatttgaatagattatctctggagcatgtccaagaagttagacttgtgaaaatatgacagttttacaagtaaatgataggagaaccgggattgggaaacatctgactgaggcacatggagttcgcaggacagaaaggatgttctccgtgaacaggggaggagtaatgaaagcactgaggagcatgagactttgcctgtgcctgtgcctgtgcctgtgcctgtgttatgactatcgacctcattgaggccaggctggattaatacagttgagtacactaaagcacacctgaatgcttaagcaggaactgagacaaaacagcatagagattgtttcacctcccatagatcatctgctctgggtttagatgtcctccttttttctttattggttgtgaataaaattaaatccattccagcaaaaggaaaaacctcatcaaagaagaggaagcagagaaaagtaggtccaactacacctttagcaaccacagacaagaagttcacagctgaaggaggagaggagactcctatagctcaggtaagcttgagtaagaggagcaggcttcaattcccacagaagaaactgccatggctcttccactctgtctctccagcaggcagtttttcttcattagtttctcatcaagcttcagatttatcaaattgcataataattaatcttgtttgtaaaaagcaatgagctaaacactttagtaaatatatatcgcacaaatatagtatcttcaccccccaatagagaagagtgttaacttcaggttcagaggggaaaatgctttgttcatatttataaaaacctagttttttaattgcaagtcagtacatccccaaacactagtacttagaggaatgatgtgtataactttctagtgtctctttttttttttttttttaatgaagccatctatgccctgtcttacaataggccaggaaatgtgcaccaatcctttgtttccagaaagacaattgacatataacaaacctactacccagtaatgaaaatgtgctctacttcatttgtcactgaaaacaaataacaggaaaatcaaaccactttcagaaaagaaaaaacccaaccaaagaaaaggctggaaccaaaaggagtaagatatccgaggagcagactcagcctccctgtcctgcaggagccggcatgtccacagccatgggcattccccacctccccagacctcatcatcagctccacccaacacttcctcaactgaggtacactctccctggtccccttttgctttgttttcttcaaccccaaatataaaaattttatctcctacttaaaaataacatggataattagccaaataatccaatgtatatactgagaattagctagagtttaatcttttgcttccataggatactcgataaatttgatattatctctgacatcaggaggttttctgtcctgtgttgtttgggagaaatatagagaggtatggagttcagaatagtacaggtagatacagcagtgtgttcacagtttactgcttcagtctcttttacgcctcttccctctgctcaataacctgttaaagtttctttgatccacaatatgttcttttcttcctcagcgttttcacacaccatagtccctctccctgtaaaactcttaaatggctaaatagaggtactctgtggatcccaatattgatattccgtcctcagggaatcatccctggaaccacgttcagactaggtaaaatatttacggtgttcactttagtagaatctcattttttcctaccaattatgttaactacaactaataaatgtttgtccattcaatttattctgtgttgtaagattacaagctgcttgttgatctggtgaatccctgtaacccagagatttctttgagtgacagaaagtactgaaatgtgaatctgcacagctaatgaaggacaaatgagagttatctaatccagccatgaaaaccatgaaggttatatttttgtgaggcctaaaacagtacaaaaacaaacaaagtggtggaataggatggagagttgaaattgtggaaatccaggcagaaggaagactatacaccacgtcttggaaaataaaggaagtgggttgcaatttataattacgtgttcattcttattaggttgtactacttttaaagtggcttctcatattttgctatatctcacatcattgttcatctgataatatatgaaaactccaatgtgtttcttattccagaaaggggagtaattcttattcatgatatgaaaactctaatgtgtttcttattccagaaaagggagtaattcttattcatgaataaacactgacggagaaagattatggatcatagtgggaaaagccacaataccatctacattctctctctctcattttttctacttaggtaaaacatgattactttagaacttgaggaaatggttaaaacccacaagtcaaacaaaaagtaattaatttttaattaattgaaaccttcccaagcagatattaataaatttttctctgtatttttagatatactctttataagcttgcattttttgcaatatagtatcctacaatgattactattttagtacttgttttattcatttaactatcagatctatcttttcaagtctatgaattaaaatacaaattattatttagtggcaatgtaatgttgaattgcacaaatattggaatttattttcaaaataattctctatttacttccaatatcccaacctcaatgcctgtcctaggaacattcatgcacctgtgccctttgaggctcctattatgtcctttagagtagttgtataatttatttcatatgtgtactgtaactttcttgtcaacttgaaatttgttgttactagtgttttagaaaagtgttccttgtgttatgttatttggcaatattaatataatcaattaaagttaaatcctagtaaagtccaaacacccacagatgttgattgtgttcagtgtgacaggacagatcatttgcctcacttctggtgcacagagacaactagcatatttctatacaatacagggtctaaataattaggttacgtgccaataatttcatctctttgtactctatcccaactggagctcataattttactttggattttgatatatttactttgtataatgaattgtactaccaaggttgaattctagttgtgacgtgcaataagtataataaatggattggctaactttctcctaagtgcaaatactttcagcagctatgcatatgatctaaacatttgtgctgtctcccttctgtcttatttacttatttatttatgaagatagtattgaataaaaattttgaattccatgatacttagaagataaggtaatcgaatcctctcatttacaaagtaataataataataataattaaaaggcacagttttactgatatgtccatgtccaaattcaaggtgacagcatgacacattcaattcctccctaacagtcctcaaaaaaattacaaactgctatgaattcaactaacatttcacatgattgactgctttgtaaccctacatacatatcttctaagttagccccttaaatttacctccagattttcctacacactctataagagatctcgcatataaatggaattatacaattgatgaataatagcttctgtgtgtaagatactacaatacaggaaccatggatgtagtcaggaatgaaaaatggcacaatatcaagtgtgaggaaggagataagttttgattattctgctttcatctaagaacaattgactacaagctaaaattgatttgtagaattcacatttttatcaaggtgggaactggatagaggaacattagtttgccaaagaagtaaatgattttgtttaggcttcaggaacactagattcctatcctgttactcagacagtccagcaggtgggaggaaaatccaaacaatgtccttgcactcatttctacgtagaagagtttttaatgatattaaggaaatagtattcttataagcttcaaaggaatattcaaaaggattataatacttgtgctaagtaataaagtatttaaagaaattaggatgacagggaagtaatttcatatagtgttcaagagaaagggttatgaataagacaaatctgatttgaatcctgaattcaacactcattagttgattgatattggggaaatagtttcactgatcctctaaaataatggaagtctccacttcatcagcatggttaaaatattaagtgagacaatgcgtatttatgcatataagtttacatatatgtaaaatttatataacatatctcactgcctagtacatcatgagaaattaatctatggtaagcactacttttcctatcacggcaaagatattggaaggggatctaagcaatgaaaatgacacacgcaaatgctctaaagtgtgaaactgcactgtgagttctgtacaactaaaattctataaagagtttctatgaagaaactatggaaagatgcagcacagaataaaaattgggggcgggggcaggtggtagagtatagctgtttgtcagaaataaagaaacagaaaattcattgtgaaaaacagataaaacctaaagattttatgcagaagaatgtctgatcacattgacactttagcaaaaaaaaaaaaaaaaggtattatggtaacaattctagaagtatgcattagagaggcattaggttagagcagagatatcaattagaagcaatgatgtgcccaagtcagctctcaccagaacacttattgctaagtatttggggattttatgaactgtttgtaaaatctttggaagtttgaaactagcatagtggaaatatttaggccagcaaaatatgcaaaggctacaaatagatattttctaaaattgggcagctagtttaccaggacaccacgaaaggtttcttcagatttctatttaagaaggagaaagacaaacagggctgtgatgaatggagtaaaatattttttgaagctatatcctcatgattgtgtgactaattaagtgatgatgttgagaaagataaaagatttaaggagcattcaaagatgattcaagaatattatccaggcaactgtataaatggtgctactgttcactaacatcaagaaagcagagaacagcacagtctaggaagtgaaaacatgttgtttggacaagttgactttgagctacctgttggatatctaagaaatatctctctatcaatctgaagatatatagatctgtataaacagatctggaacaaaaaaagtaattttgtactggcgagttatgcatttgtacatttagagatacatgttaaaattatgggtttagatgatattatctaaaataattgtataattctacatttatactaatagaaaactgagcactcactatgtttggggaagtgagacaataatgaagctataataattattcccatatcatagataaagataccgatgctcagaaaatgtaagcaatacacaccaattgaaacaaccagttagtggtggaactgacattccagcccaggctgtgtagatttagaatgcagattcttaagcaaggtgaatgagaagatcaaactgccataggtggagccatagaaaagttggatatatatttgggggtgactacaagtaaaggatgctacaaatgaggatgaaactatgtacacagagaggtcaaagataaagtggaaatatgtataatatgcatcaaaaataagtttaacaaggaagagggtcaacacagctcatgtcagactcaaataaacaaggaagtcttggaataacttcatcttagaccaaaaattgctatactttagtgaaaggcaattgctgattcacagaagaaaacatggctggctctccataacatcatactaaatatctcattctccaaaagcacactaacgacaagcacaaaggttcacaataggagccttgataacactaaccaaagttaaatttaagtacaaatgattaaaatggaaatagtgacataatcaggcacacagacatatatatgcacgtaaatcgttccacatctcagattccctaattcaataatcctttcatttcaattgaaacaaccatagttgtactgtgaaaaaccttacctaatatcctcctgccaacattctgcctaattaaaatcttccctgaatgttttgcactgagtaaataagctattccctgtcacctgtggtactgccttactgcctttgtttaactcctgctctgtttaaatgtacccataatgggcatgagagcatatctctattcagactccagaccacagctgggagcaagcagactcaaaagatggtaatacgtcaaaggagattgctgagagagaagcaatgaccattgagattggagtaaaagaataatgtagccgaggaggaggagccaagatggccgaataggaacagatcgggtctacagctcccagcatgagcgacgcagaagacgggtgatttctgcatttccatctgagataccgggttcatctcactagggagtgccagacagtgggcgcaggtcagtgggtgtgtgctccgtgtgcaagccgaagcagggcaaggcattgcctcacttgggaagcacaaggggtcagggagttccctttccgagtcaaagaaaggggtgacggacgcacctggaaaatcgggtcactcccacccaaatactgtgcttttccgaccggtttaaaaaatggcgcaccatgagattatatcccgcacctggctcggagggtcctacgcccacggagtctcgctgattgtgagcacagcagtctgagatcaaactgcaaggtggcagtgaggctgggggaggggcacccgccattgcccaggcttgcttaggtaaacaaagcagctgggaagctccaactgggtggagcccaccacagctcaaggaggcctgcctgcctctgtaggctccacctctgggggcagggcacagacaaaaagacagcagtaacctctgcagacttaaatgtccctgtctgacagctttgaagagagcagtggttctcccagcacccagctggagatctgagaacaggcagactgcctcctcaagtggttccctgacacctgacccctgagcagcctaactgggaggcacccccagcaggggcacactgacacctcacaaggcagggtattccaacagacctgcagctgagggtcctgtctgttagaaggaaaactaataaacagaaaggacatccacaccaaaaacccatctgtacatcaccatcatcaaagaccaaaagtagataaaaccacaaagatggggaaaaaacagaacagaaaaactggaaactctaaaaagcagagtgcctctcctcctccaaaggatagcagttcctcaccagcaacggaacaaagctggatggagaatgactttgacgagctgagaaaagaaggcttcagacgatcaaattactctgagctacgggaggacattcaaaccaaaggcaaaaaagttgaaaactttgaaaaaaatttagaagaatgtataactagaataaccaatacagagaagtgcttaaaggagctgatggagctgaaaaccaaggctcgagaactacgtgaagaaatgcagaagcctcaggagccgatgcaatcaactggaagaaagggtatcagcaatggaagatgaaatgaatgaaatgaagcgagaggggaagtttagagaaaaaagaataaaaagaaatgagcaaagcctccaagaaatatgggactatgtgaaaagaccaaatctacgtctgattggtgtacctgaaagtgacagggagaatggaaccaagttggaaaacactctgcaggatattatccaggagaatttccccaatctagcaaggcaggccaacgttcagattcaggaaatacagagaacgccacaaagatactccttgagaagagcaactccaagacacataattgtcagattcaccgaagttgaaatgaaggaaaaaatgttaagtgcagccagagagaaaggtcaggttaccctcaaagggaagcccatcagactaacagcggatctctcagcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaaacgctaaacatgaaaaggaacaaccagtaccagccactgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaatgcatctcacgtgcagagacacacataggctcaaaataaaaggatggaggaagatctaacaagcaaatggaaaacaaaaaaaggcacgggttgcaatcctagtctctgataaaacagactttaaaccaacaaagatcaaaagagacaaagaaggccattacataatggtaaagggatcaattcaacaagaagagctaactatcccaaatatatatgcacccaatacaggagcacccagattcataaagcaagtcctgagtgacctacaaagagactcagactcccacacattaataatgggagactttaataccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagagattataacaaactatctctcagaccacagtgcaatcaaactagaactcaggattaagaatctcactcaaaaccgctcaactacatggaaactgaacaacctgctcctgaatgactactgggtacataaggaaatgaaggcagaaataaagatgttctttgaaaccaacgagaacaaagacacaacataccagaatctctgggacgcattcaaagcagtgtgtagagggaaatttatagcactaaaagcccacaagagaaagcaggaaagatccaaaattgacaccctaacatcacagttaaaagaactagaaaagcaagagcaaacacattcaaaagctagcagaaggcaagaaataactaaaatcagagcagaactgaaggaaatagagacacaaaaaacccttcaaaaaattaaggaatccaggagctggttttttgaaaggatcaacaaaattgatagactgctagcaagactaataaagaaaaaaagagacaagaatcaaatagacgcaataaaaaatgataaaggggatgtcaccaccaatcccacagaaatacaaactaccatcagagaatactacaaacacctctacacaaataaactagaaaatctagaagaaatggataaattcctggacacatatactctcccaagactaaaccaggaagaagttgaatctctgaatagaccaaaaacaggatctgaaattgtggcaataatcaatagcttaccaaccaaaaagagtccaggaccagacggattcacagccaaattctaccagaggtacaaggagaaagtgctaccattccttctgaaattattccaatcaatagaaaaagagggaatcctccctaactcattttatgaggccagcatcattctgataccaaagctggacagagacacaaccaaaaaagagaattttagaagaatatccttgatgaacattgatgcacaaatcctcaataaaatactggcaaaccgaatccagcagcacatcaaaaagcttatccaccatgatcaagtgggcttcatccctgggatgcaaggctggttcgatatacgcaaatcaataaatgtaatccagcatataaacagagccaaagacaaaaaccacatgattatctcaatagatgcagaaaaagcctttgacaaaattcaacaactgttcacgctaaacactctcaataaattagatattgatgggacgtatttcaaaataataagagctatctatgacaaacccacagccaatatcatactgaatgggcaaaaactggaagcatcccctttgaaaacgggcacaagacagggatgccctctctcaccactcctattcaacatagtgttggaagttctggccagggcaatcaggcagaagaaggaaataaagggtattcaattaggaaaagaggaagtcaaattgtccctgtttgcagatgacatgattgtatatctagaaaaccccattgtctcagcccaaaatctccttaagctgataagcaactttagcaaagtctcaggatgcaaaatcaatgtaccaaaatcacaagcattcttttacaccaaaaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcattggtaggaagactcaatatcatgaaaatggccaaactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatacttcaaggctacagtaaccaaaacagcatggtactgttaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttctacaaaaatcaattcaagatggattaaagacttaaatgttagacctaaaaccataaaaaccctagaagaaaatctaggcattaccattcaggacataggcatgggcaaggacttcatgtctaaaacaccaaaagcaatggcaacaaaagacaaaattgacaaatgggatctaattaaactaaagatcttctgcacagcaaaagaaactaccatcagagtgaacaggcaacccacaaaatgggagaaaattttcgcaacctactcatctgacaaagggctaatatccagaatctacaaagaactcaaacaaatttacaagaaaaaaacaaacaaccccataaaaaagtgggcaaaggacatgaacagacacttctcaaaagaagacatttatgcagccaaaaaacacatgaaaaaatgctcatcatcactggccatcagaggaatgcaaatcaaaaccacagtgagataccatctcacaccagttagaatggcaatcattaaaaagtcaggaaacaacaggtgctggaaaggatgtcgagaaataggaacacttttacactgttggtgggactgtaaactagttcaccattgtggaagtcaatgtggtgattcctcagggatctagaactagaaataccatttgacccagccatcccactactgggtatatatccaaaggactataaatcatgctgctataaagacacatgcacatgtatgtttattgcagcattattcacaatagcaaagacttggaaccaacccaaatgtccaacaatgatagactggattaagaaaatgtggcacatatacaccatggaatactatgaagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggattg

SEQ ID NO: 293 - DNA, 23248 bp, Homo sapiens
gggagacatgaggcatcaactgatatatgtaagaagtacattggttccatctgtaaaggcgggacaacttgaagcgaaggcaggaatactcaaagaggggacggagctcccaggtcacagatgggtgatacacaaacggtacgttctttagagtttctgatgagcctttccaaaggaggcaactcagatatgcatctatctcagtgagcagaggagtgactttgaatagaataggaggctggtggccaggtgcagtggctcgcgcctgtaatcccagcactttgggaggccgaggtgggcagatcatgaggtcaagagttcgagaccagcctgaccaacatggtggaaccctctctgtactaaaaatacaaaaattagccgggcatggtggcacacacctgttatcccagctactcaggaggctgaggcaggagaatcgcttgaacccgggaggcggaggttgcagtgagccaagatcacgccacctcacaccagcctgggccacagagcaacattctttctaaaaataataataataataataataatagatcaatactgattccttaattgtcacaaatataccatactaatgtaagatgttaataaaaggggaaacttagtatggggtttatggaaaaatcttcaaactgtctcttcaatttttctgtgaatctaaaactgctttaaaagtaaagcctattacctattaaaaaaatttttttagccgggtgtggtggctcatgcctctaatcctagcactttgtgaggctgaggtgggtggatcacatgaggtcgggagttcaagaccagcctgaccaacatggagaaaccctgtctctactaaaaatacaaaattagccgagcatggtggcgcatgcctgtaatcccagctagtcgggaggctgaggcaggagaatcacttgaacccaggaggcaaaggttgtggtgagccaagatcgcgccattgcactccagcctgggcaacaagagcaaaactccatctcaaaaaaaaaaaaaaaaaaaagaaaaatttttttaaagtagactcctgggcctccgcttcagaatctcaggtaatgagccccaggactgcactttaaacaagtgtctccgaaggttcttgcacaccctaaagtttgaacaccattttaagaatctcagctgggtgccgtggctcacgcctgtaatcccagcactttgagaagctgaggcgggtggattgcctgaggtcaggagttcgagatcagcctgaccaacatggtggaaccctgtctctactaaaattacaaaaattaggtgggcgtggtggcgcacgcctgtaataccagctactcggaaggctgaggcaggagaaacacttgaacccgggaggcagaggttgcagtgagctgagatcacgccattgcactccagcctggacaagagccaaactccatctcaaaaaaaaaaaaaaaaaaaaaaaagaatctctgcacactctgcacagagttaagttagaaagaattgttgctggctgggcgcggtggctcatgcctgtaatcccagcacttctggagaccgagccaggcagatcacaaggtcaaaagatcaagaccatcctggccaacatggtgaaaccccgtctctactaaaaatacaaaaattagctgggcgtggtggcacatgcctgtagtcccagctactcaggaggctgagataggagaattacttgaatctgggagtgggaggctgcagtgagacgagattacaccactgcaccactccagcctggcaacagagtgagcctctgtcacaaaaaaaaaaaaaaaaaggaaaagaaaaagaaaagaattgttgcttacagagtggatgtgtgcctatccgtctgctgcaggccttcccatggcattgttttgattgccctatgtatgtatccacaggagccagcactgaagaattgggaggttcttcagcacagtccacactctgggctgcctttctacagccttccattccctgtgttccagcataaggctctggtgtggctcacctccaggggcagttatgtgcccgtcagtttagcacagcctgcattcttccccgttgctcctaacacttagggactgtcatgaccatgtctgtattgttaaagtgttgaacaaacctgttctctgtatctgtgtcaccgtcaaaagtggaaaaatgcaaggtaaatcaagtgagcctgggccgggcacagtggctcatgcctgtaatcccagcacattgggaggctgaggtgggcggatcacttgaggtcaggagttttagaccagcctgactaacatggtgaaaccccgtctctacccaaaatacaaaaattagccaggcatagtagcgcatgcctgtaatcccagctactagggagggtgaggcaggacaattgcttgaacccagggggcagaggttgcagtgagctgagatcgtgccactgcacaccagcctgggtgacagagtgagactctgtctcaaaaaaagtcaagggaggctgtgtttctagaatctgggagacggcacacctttagttgtgtaggtggagactatcactaggtgacgagcatgaaagcgaagttcatgtgttgatcgtttgcaccagcctgcttccctcctcgatggcgcctgtgggcatctgagtgcgccagctcccatttggacctcagggcagtgaggggtgctgcacccccatttggacctcagggcagtgaggggtgctgcagtgatgatcaggccataggtgtatgcggaaggaagaaggtgggagaatgacttcttcccctctgttttatcaccccctgggaacgccatggagagtacctcgactccgtagagaattgggatcctgatggagctaagccagaagctgactttttggatgatcacactgttctggttctttactcctaattgctgctttaggaacaaactgtctcatgagtattctggcagaaacagacagacttgattttcagaaccgtcttttcttttttgccaagattcagagtatgattactaaaatgatgatattaatagtagcaagctcttactgcaggcagtacttctcatagctttcactcatcacacacatggggccatcagcagagggggcagtgatgatgacccttttggctcccccatctaggtgatccccagccttctccatgctggcaaagatgctggtggccgccacaatataatcagtgctggcatgaccccacttgatttgggtgggatctcactcctgcgagatggtgatgggattgtcattgatggcaggcttcccgttctcagccttgatggtgccgtggaacttgccatgagcggaatcatactggaacatggagaccatgtagttgaggtcattgatagtgacaatatccactttgccagagttggcatccctggtgaccaggcccccaatatggccaaatctgttttttctggccttcaccttcaccatgttgtctcagggacacagctggcactgctcaagaagatgcggctgtcttgtcaaacaggagaagcagagacccagaataattatttaaatgatacattttatcttaagaattcaggtggatttttttccttctcaatccaacctgtgggttaattagcagattgtgttagagtctcttttcctttccattagaagtctgcagtcaggggccagaccctgtaagttgtcatcacaaaaagttcatgatcaatgaatgctatacctctattttaggggtagagtctcacataccatttaaactccatgatgtaaagataatatggaaaattggggaggattcaaaaacattagaatgaccaaagggttggaaagttacagaaatatttagtctggagtagaaaaggctgaaaggtgtttgcaaaattcacttcaaatagatgaataaaggaatcaagaggatattgagcagatgttttggttttgtggctgatggagcagatttggttaaggccattgcacagagcagctgcaagggactaaaactgaagatcctctgtaccagggatcagggctgcacccaacagtgggcaggttttagttggaagaatggatggcgcacaaagggagtggtttattaaaggaaacccacccagatggacacgtggacatcagaactatttaaaattagtgtcaggattccaccattcctgggcacattcctccctccttggagtcaagtttcctcgtgcagggtccacctgagtctcactctgtctccctgttgtgtttgcacagggcaaaccctcctaaacctgctggctcagaaaacccaagaggttattatgttgtgtctttttggacactggtgggggtactcattactgaataaattcccttctaaacaaatactccatccctagcaggcagaaggatataaacatttggcagatcagcgcaatgatctcactttaacatcttaaccaaccccagcttctacaaatagatgatatcattgtagcaatatagggcagactctgccagcagactttctgagactctcctggaacataatttgtcttacaacacttttggcaatcccttggccatgctagggggaggggtagaggggaaggagaagggtggggtccaggggtaagaggataaggagattaggcagcctcatttccttctttccactagaaggagcctctgtaaaagctgaggctgcacccacaacctgggaaaggtgcaaccggtcacacacccggtgacaggcgtgtcagcaaaccacagagcgtggcggagggggagggcagccaggctaagtgtccagtgtttgtaaagtctacacttctgcacagtaacatcctaagccttcacattcactcaccaatcactcgcctactcacccagagcaacttccagtcctgcaagctccatccatggtgatggacggtgatgggctatttccccaatgtagaaagcagattcaaaaacagattcaacaaaacatagcaaggcacctgccctctgcaggtggaccatttttaatcttttatatcatatttttactgcaccttttctgtgtttagatacacacatacttaccattgtgttacaattgcctacagcattcagtacaggcccatgttgtacaggtttatggcctggaagcaatgggttatatcatatagcctaggtgtgtggtaggctacaccctccaggtttgtgtaaatacactctgatgtttacatggtaacaaaaatgtcttgcctgggactagaggtaggagaatagggagattaggaaattcaggcttactgccttcttttcacctgtaggagatgctactggtgtcccaactgcattctctttgcccaccctggaagtagtacctagcacttcagtggcaattctcatataagcacccatgtctctctgcctgagggctttctctggatacaggggtgtgcttggcccatgcatagagcaggctgaaagtgcccaggggcttataacccccaggagaatctcctacttgtatctgaaacttttgtctcagagtctgcttttggagagacccaaattgaaacagatggcaataatatgaaatatttttaagaatctgagtgatgaagtttaatgaagttctaattcttttaaagtgtctcaaatgttctgttacattttgttactttgcagtaattgttccactgcactgaaatccttttcacccaaatatgcagctggaaatactataataaataacacagctcccattttaaaggagggcaaagctgggcacggtgactcacgcctgtagtcccagcctttaatcccagcactctggggggcctcagcaggaggatcactaagctcaggagtttgagaccagcgtgggcaaaatagtgagaccctgtctctacaacaaataagataattagctaggtgtgggagcatgcaccctgtagtcccagctacttgggaggctgaggcatgaggattgcttgagcccagcaggtcgggctgcagtgaaccatgatcatgcccctgcattccagcctaggtgacggagcgagaccctgtctaaatatatatatgtatatatcccacagttctggaggctgggaagtccaagatcaaggcaccagcaaagtcggtgtctggtgagggctggctctgtttccagctgtgccttcacatggtgggagcgcagaacaagtgccctcaggcctcttttataagggcactgatcctgttcatgagagctctgtcctcatgacctaatcaccttccagatgacccacctaccagcaccactgtactgtgggttccctttcaacatatgcattctgagggacacaagcattcagaccagagcaacatgtaaaatggaataggctccagacctgaaagaatacaaacaggcttttcacccacataataagcatgtggcaagatagtcaaaggtggttagaatcgagaacaatctggtttttgtgcagcattgtctgccactattggacctcatgtgatatctcccaattcattgtcgacaaccaaaaataccctatgaatttccaaactactccctgctgagtaaacatccaaagtgaaaactactggatcattgaaaagatttaactactcttttcaaagattccagacccactttctttcttttttatctttttcttagagaagggggtctcactctatgcccaggttggagtgcagtggtgtgattatggctcactgcagctttgaattcctgggctcaagcaatcctcctgcctcagccacccaagtagctgagactacaggtgcacacaaccatgcctggccagtttttgaaattttttatctgtagaggtgaggccttcctatggtttcccaggctggtctcaaactcctggcctcaagggatcctcctacctcagcctccaaaattgtgggattacaggtgttagccactgtgcccagccctgttttctagtattagtttatatgtattatatgttgaaagtggatttgaagcagtgcaaagtgcatctgaagcctattttatccaaggattgaccaccaaccctagtgattatctactgatttcccagaaggctgctgccgagaatctctggagattcggagatggatttctcagccacaaagtggaacaggatatcacctctatgctggggggacaggagataccgtttgtacacagctcgatactttggaagtttgtgattgtttgttgttttcggccttctccactacttagtaatttttaggaagaatttcagtctatctcagctattcagaaggagcactgtactaaaggcaggtgaaagcaaggggaaggtggttgttcgggatgcttggccaaccatcttccctcctgcctgaaaaagactctctcctttgaccaaaactccagtcaggcttctctgagtcctctgcttgactaggcccaatcttggacttttctctctgtccttgcagagcccagtgtgagcaagaatcctgctaagtgggtctagtgaaaagcctctactcttggttgaccacccttgttatctgatctccctggcctgccttcagcaggaatcctatcaggtctgtttagacagaaacccccttatccttggggcttcctcttagtaattttccatgcgctgctttccaccctgctccttgattataaatccccacctgtccttggtagagttggtgctgagttcaatttctccccactgcaaagccctgcagtgcccctctacctatcaccatggccccctggaataaagtctgctttaccatctgatatggtttggctgtgtcctcacccaaatctcatcttgaagtgtaatcccgaggtgtctagggagagacctggtgggaggtgactggagcatgggaacaaccatgctgttcccatgatagtgagttctcatgagatctgatggttttacaaggggctcttcccccttcactcggcacttctctctcctgacaccttgtgaaggacgtgtttgcttccctttctgccatggtcgtaagtttcctcaggcctccgcagccatgtggaactgtgagtcaattaaaactctttcctttataaattactcagtcttggccgggtgtggtggctcacacctgtaatcccagcactttggggggccgaggcgggtggatcacctgaggtcaggagttcgagaccagcctggtcaaaatagtgaaaccctgtctctacaaaaaatacaaaattagccagatgtggtggcgggcgcctgtaatcccagttactagggaggctgaggcaggagaatcacttgaacccggaaggcggaggttgcagtgagccgagatagcgccagtgtactccagcctgggcaacaagagtgagactccatctcaaaaaaatgaaaaataggccgggcgcggtggctcacacctgtaatcccagcactttgggaggctgaggcgggtggatcacgaggtcaggagatcgagaccatcctggctaacatggtgaaaccccgtctctactaaaaaatacaaaaaagaattagccgagcgtgatggcaggcgcctgtagtcccagctacttgggaggctgaggcaggagaatggcgtgaacctgggaggcgaagcttgcagtgagccgagattgcgccactgcactccagcctgggcaacagagccagactccgtctcaaaaaaaaaaaaaaaattaattaaaaaataaatcaataaaaaaattacccagtcttgggtatttatagcagtgtgagaagagactattgcaccacactgaacaagtgtcatgaataattttttctttaaccttacccacctggagattttcctgatgctaagacctcagaaatgctgttttattttattgaaggaggacaatggcttcacatcagaatgagcaggatacaacattttgaaagacacattccctgttttttatgggctcaccctttcacagtagaagacagaaacccaataacagagacaatggcataagtattataaagtaggcatgcatcaagtgtgatgacagcacgaaagaggggataactacttctgccattacagtctggaagaggtatcatttcagctgatattgtggcaaagtattttacccagcagagggagtatccactcaatgatgttcttaaagtacctaggtaggagtgctaggcagcaaatgattctcttaatgtgtatgtccacacattgttatgtgtaagtagccttattaatttggttgtaaataaaaggttgagtaataataaaaatgaaatcaccaaattctacaatttgacctcaaaatatgctgtaagttctgatattattcctactttacctgggaaggcagagcggttacctaggaaggtgaactgtggaagtccgctgtggattggggatacctgatctcatgatgagtcaggcttaccctgactccttctgggtctctctggtggagacagcccttcacctctgcaaagcttatccacgtgtctggtgatttccttatagcatacagagcttttaaggtttacaaacgtatacctatttccccaatgtagaaagcagattcaaaaacaggttcaacaaaacatagcaaggcaataggtgattcctagagaccaacagattgagttcttgtaataaaatctagaaaagagaaaaggtggaaatgtcagccagggcaacagaaatgatatgcaccaggagatccaggaattcatagtaaaggtcagatgagtttcacaggtgtagggtttcctctacctctgcactactgacaatccaggcggggtaattctttactgtgggcaggaggaggggggaggttggcccggtattgccagatgtttagcagcacccttggcctcagcccattagatgccagtagcaccctctccccagcacgttgtgacacccaaaaatgtctccagatattgtcccctggaggtcaaaattgtccccctgcgaatcactacactagtgcatctcagactctaaggtgcacacaaattacctggggtgtcttgttaaacgccagttctgctttaataggtctagggtagggcttggcactttctagtgcaaacaaaatcccaggtgaggctgaagctgcctgtccacagaccacacttgctccttagaagacaaatctgcagccaccagttagcatgttcaggtcctcaggatgcagagtagatgtacaatcaaggtatggatcactgcagatacttatgagcagagtctggatgccataccatcttgcatttagctgcaaagaatgtttatagaattgaacgtaagtgaagggtttatgttttttaagctttaaagcactttttaatgtcggttctcaaactttttggaatccctttattcttagaaattattaagaactacagatctttagtttatgtgggtttatacctatgagtatttaccatagtagaaattgaaactgagaaatgtaaaagatatatatgaagttcattaaaaaaaatacccattacatattaacatatctaacactttttaatgcaaaattactatactgtcccaagcaaaaaaatattggaagaatagcacggtttaacattttggcaaatgcatgcacgtatgtatgtatgtatgtatgtatttatttatttattttgagatggggtctctctctgtcccccaggttggagtgcagtggcacaaccttggctcactgcaacctctgcctttgggttcaagcgattctcatgcttcagcttcctgagaagctggaacttcaggtgtgcaccaccacacccagctattttttgtactttttgtagagacagggtttcgccacgttggctaggctggtctcaaactcttgacctcaagtgaaccgtctgcctcagcctcccaaagtgctggaattacaggcctaagccactgtgtctggcgggcaaatgtctttaatgtctggttcaatagaaaacagctgggtcctcatatatgcttctgctttcagtttgttgggatacattgctttggttgaagcatatgaggaaaacctggcttcacctagatacacccccacggttggaaaaggaagcattttaatagcctttcaggtgatacattattttttgatactatacgataacttagcaagtggtagtttcttaaaggttaattgcagtgaggaatctgaaaccatatgaatgaacattttggactgttacactaaagtttactggtgtattttatggttcaaattaatcttttacccacataagatttcataacattatgcatcggtcaactggaaaatccagttatgtagctctgtacagtggaaaatccagttacgtagctctgtacagttgtccaattgtacaatggaaaactccactatatacttgagagagtagaaaataaaactaatgtcttagcattattatgaaaatagttttggactttgcatccccttaatgggtcagggtgtagtccatcaacagcttctgcaaacataaaggaccttttgactgtcgttttcctgaaaaataactcgaacgaacctaaaggtaaatgtaaaatgtacttcaagactgtgaaaatgggctgggcccagaggctcacgcctgtaatcccaacactttgggaggccaaggcgggcggatcacgaggtcaggagttcgagaccagcctgaccaacatggtgaaacctcatctctactaaaaatacaaaaaatagccagggtggtgtcaggtgcctgtagtcccagctacttgggaggctgaggcaggagaatcgcttgaaccggggaggcagaggtatcagtgagccgagatcgcgccactgcactccagctggggagagcgagactccgtctcaaaacaaacgaacaaaacaagactgtgaaaatgaactttacgaataaagcctaaagaagcaaataaaagtcatacttttgccttctataatcagtgttaacattttggcccactggaacctctctttgagggtagggactgtgttgatctacgaatcacagatttagcacactggctggcacttatgagcactgaaaatgcttttttttttttagtactccatagcctatccctttcatttagctgggtagtgtggtcaattttccccataacatgcgttctcacataattgcatgtatttctggggtacagtgtgatggttccatacatatacacattgtgcaaccatctaatcagggtaattagcacatccatcaccaaaacacttgtcatttctttgtggtgagaatattcaaaatcctctcttctagctattttgaagttaacattatcgttgagtatagtcatccaaacgtgcaagagaataccaaaacttattccttctaactataactttgtgtctgttgaccaacctctccccatcttcctccccactaactctcctctgtacaagaataaccactcttttactccctactttcacgagatcaacttaaaaaaaaactttttaaaacgactgcatgatatgttttcaggctcacacatttaaaaaccgtgactttggcaaagagtaacttcattctgctggggaaaaaaatttaaatggcctgagtccggaagctcgccagggcagaagcgcagggtcgctccgccgggctcgccgggccggggaccccccagccacccgccaccacggcggggagggcagggtgctgactccagggaccacgacagtcggccccggtggtggggattccgcgcgggacccacgcgggaacaaagaggcggctggacggcccagctctccgcacccggaaggacctgttccacctctccggctcccgtacccctctatccgcatctgagtgaccagatcccactgcagtcaacagcccgcggggtagccagcttcgagggaccgcccggaaagacacaacgcgcgtggaaggcgccgggcgtccagtctcgggagagattagaagtggcgctcctgcccagcgccggcaatccaggggaatccgcggccatcgcggatccaccaggggtgaggcggcactgagcacaagtgtgaggctctcgggagctacgcctccgcttccccagtgccacccgtttttacctcaggcggttctgaccgccatcgtttcaacctggagaggtgagccctcccctaccgacgcacttcccttccccggcaggaaggagggcgctgacccagcgggcgcacgcccctgactgcgcatgcgccgggtgcgccgttcgtcagcggcgagtggcctcgcggcgccggattcgtcgctccgccaagagtgcgcctgcgcggtcgctggggctcgcacttcagcttcccctcccccggcgccctctggggctccgagcccggcgggaccatgttcaccagcaccggctccagtgggctctgtgagtaccggcctccgccatcctggctgccccctacacgccaccctaggcacctctttgaggaggctggggcagcggggaccctcgggtttgccggaggtggtggggccgaccctccagacccgcgtccgaaccctgctagttcccggtcttgggggtcagcggaaaccgcccccatttcggcctggaggggcgaatggggacaaagccccgccgcccgccccgaccccacctggtatccccaggtgctctgcccaggagtctcttggggccgctgcaagtgggcaggtgccctggtgttctcgtgggccggccccaggccctttgcggagcgtgtgccgcgctgaaggaaggggccgtcccccttaccatgccccattcttttaggcttgggggaccgaactaactccccccgcccccacttgcaaagttcagcctccgctttagaagctgacctctcagtttcacttggatgtgtttcttcttcagtctccaagaagagtttttagacaaacacacactgatgagagtgctttcaagtggagggaagttaggaagtcgtggcgagggagcgcagctgtgctgctggatgttgctgttttcctggcgtgttagcggtggtcagcaggtagggggcggagtatttttacagccagttaaacggcttttctcactgagtgtgtggaattgactttcggtaaggtagactgcgtgttaacagttaggcacgggtacagcaacggagaacagctctaattttgcaattgcttgtcactgttcatactccatgtgaagttaatgctgctggaggacagaaacatctgacatttccaaatattaaagatctgttggccgggcgcggtggctcacgcctgtaatcccagcactttgggaggccgaggtgggcggatcacgaggtcaggagatcgagaccatcctggctaacacggtgaaaccccgtctctctactaaaaacacaaaaaattagctgggcgtggtggcgggtgcctgtattcccagctactcgggaggctgaggcaggagaatggcgtgaacccgggaggcggagcttgcagcgagccgagattgcgccactgcactttggcctgggcgacaaagcgagactccatctcaaaaaaaaaaaaaaaaaaaaaagatctgttgggaatgtcatgaatcttctgagaatgtgtgtctcgtcttatagtctgacagtgagttagtatcagcgccacaggcataattttaaatcttcctcacttctcaacttctcaggttttgaagtggtttcaatatttatgatttcctttgtttcataattaatttgatttatggcatctttcatggattggtcccggagtatgttacaactactaagtaatcttccccaaactaccctttagataaagagcattaggactgtagctgaagctgacagttcaagaaggcaatgtggttttcctgggatcacacagtgagccaggaactactggttatgaaattaatggtggaattcttcaatttcaattgttctttagcattttgatctatccttgctggccaaagtacatataaaaaaataaagggcaagagaaatcttattggttgctgtactgtattagccatgagattatattggccaagtgtattcaaatttgatacagggcaactgtggggaagataatattttgttatctatggcacatggtggtgagtgttgaattctaggaaccaaactgttgcccagggagaggcgtaggtctggagcccctctgcagctgtcttggcctgtttctaaaattaagtgcttctgcagtgtaagagttgttgggatggccgttcctcagaaggctgtgtcttacatgctcattttacaaacattttgggcatctcctctgggcgatgaactgggctaggtgctgggaatgcagcaacgaacaggtcctggtctcagtgcttacagtgctgacggagcttaggcacagttttccaggactggtcattagaaaaggctgtgtgtcagctttaacatttttctctggagaagctacccactgagggagaagtgatttcctttgttttattttatttatttatttatttatttatttatttattgagatggagtctcactgttgcccaggctggagtgcagtggtggatctccgctcactgcaacctccgcctcccgagttcaagcgattctcccgcctcagcctcccaagtagctgggattacaggtgcccaccatcacacctggctatttttgtatttttagtagagacggggttttgccatgttgaccaggctggtcttgagctcctgacctcaagtggtcctcccgcctcggcctccaaaagtgctgggattacaggcgtgagccactgcctatgatttcctttagataagttgagggaccctttagcaaatcaaaattctgatcctgagcaagaatctgaaagaaggacgacacgtgtacctagccctacccccatgggtggtgaataacagtccctttccagggataaatccctgccattttctaccacctgcatgtttcccacgttttgtggttagtagataatagtattttagtgttaaacttgcctttctctctcatccattcaataagtgtctgttgggtacccatatcagccacacactgttgatatacagaggataaagtaataagcaggatcaaggagaccagcatcaaacaggctaacaagtcagtatgattcacatagtgataagtgacatgaagacaatgagagggtaactgcaaagaccgaagttatggtggaggaccactttagcatgcatggtcacggagggtagccgggaaggtgacattgagctgaggctcagatggtgtgaaggagcaagccatatcagagtttgttgaaaactcttcattttgaagaaaggggacagcaatacagtttcagacacaatgcagttgaaaacaccctgccatgcctgtttcaagtgcttgaaactatattgctgtctgcaattatgaccgggtaaaagtgcgtaggattagtgatcatgacttattttaggttccttacttgtagaccaatgctgtcactcagctctacgttgagtaatatgtgtatcattcactgcatttattaataagctcctatttacctcacagtatgtttactgtgtaatgatggactcagtcaacattaattgcatgcctaatattttccaggtatagttcccaccctcaaggagttcactgtctattggggcaaaactttttaaaaaagaacgtttgtcctcggtgctgtgggtttattgcagggggtaggctggttgtggggaggcacagttaaggaagacttcccaatgtagcaatatttgggctgacttttgagagtttggcaggcatcatagtgtggagaaggcctctgggagggacagagcctggacagggcttggcagagaggcaggaagcaatgaattaggggtggttatggctggagtgagcagttcgtaagagatgtgtggtgaagtctttcagaggacagtggaaggtgagacaagaactagggacagaacttgtgaacattttaaactttaaagagggagaagagtaggtgccagggaagaaaactgaggaatggccaaggaagtagggggacacccgggaggagacaatttcaggggagagtggctgatggcattacacgctgcagagattttcaaaacgggcctgaagcgcgacctgtgggaaagaaagaggcccccccagaacctttccagaaaagctcatccagtagttggggagagaagtgagattataattagctgaggaatgagtgaggagtgagtgggacataaatggagacagtgagcttggaaagtgctttcaagatctcggttctgagaatcaagagagtgagttgtggttagaggtggccgcaggtgtaagggggagtttcgtttcctttttttttttttttttttttgcgacggagtcttgctctgtcgccaggctggagtgcagcggtgtgatctcagctcactgcaacctctgcctcctgggttcaagcaattcttctgcctcagcatcctgagtagcagggactataggtgtgtgatgccacacccggctaatttttgtatttttgctagagacagggtttcaccatattggccaggttggtcttgatctcctgacctcgtgatccgcccgcctcggcctcccagagtgctgggattataggcgtgagccactgtgcccggttgggggagtttctttaagtggagaggaggcttagcttgtttaaaaggtgttgggaaaaacccagtgggaagggtgtggttgaagatacagacaggaatgagtgataggactgagttgtgaggaggtgaggatccggggcccagggcaggtatgcttctcattgctgtaggagggaagaggaggggttactcttggtcacggagcggtggttgtcaaacgctgctcctgtcccagctgcaaaaaaatcaatcacggtgttttctgaatgtacaccttcctgggtctcctccccagagggtcagattcagaagagctagcatgagtgtcagaaacctgttattttttgttttaagaaatgtgtatttttaaagtctccacatccccccaccccaggacattttaatggacaaacagattgagatggaggcaggagggcagccacaggcagggcagagagaacggagtctggtgcgctgatgagagaagatagaagatagaaggattcttggatgtgagggcgatctggctgtgacatctgtcaccccattgatcgccagagttgattcggctgatctggctggctaggcgggtgtccccttcctccctcaccgttccatgtgcgtccctcccgaagctgcgtgctcggtcgaagaggacgaccatccccgatagaggaggaccggtctttggtcaagggtatacgagtagctgcgctcccctgctagaacctccaaacaagctctcaagatagaaggattctaaagatgtgtattctggtaggttgtgtcaataaagctgattggatctgcggcgagggaggagttgaagctgactctgctttactgcctgggcagctgggtggataggtaacgttcccagtcactagagagggaatgcagagaagcaggagctcatttcaggagaagatgagttcagctttggacctgtgcagtgttgaggggtttgcagagtccggtcagaggtactcgggacacttggggaaagaaatccagagctggactggattggacatgagtaggtgagagttaggttgtgggtgtgagtgaggactccagaggtggggggacagttggaagctgaggacagaccttcagcccattccagcatgtaagggatggatagagaaagaggaggcagaaagtaggcagagctgggggcttctgtaggaggagttgcgtctcttcccctagtccagcggatggatgtgccttcttccacggaatcacgcgtcccgcagccgcttccctggctttgctcaccaccatggctatgctcaccagcctctgatccctccttgtctccagtgtatcagcccatttgtggcatctctttcttcatatccagtctggaacctgtagttcattactggagccatggtctcatccagactctcggagacctggcacgtctgttctgtggtgctcatcgagcaaaaccctaactttgcattgatttatggggtcaagtctgggcccttggcaccgtttctcagctaagtttctggtattcatttctcagctaagtttctgggattcagtcatctccctatgctacctctattttgtcttcggctcaaggctattctcagtctctccccatctcttcacccaccatctcactcttcacccatccaaaaaatcggggccatcacctgggtgctccttccgcttcctgctccctctctctgacttgtttctgtccacactcagctttgttcctttcctccaatccagaagaatgaagcagccttctcctgaggcccaccctccaccgattctgaactctttcttccctgtcttttctagcaccactcttgctttttctttaccttcattctctctcctgcaggaatgagcctggcacgtggttacagctgatgctttctcctgcgggtgccttagtggcacccctccctgagttgggagtctttacctgctgctgcgttgacctgggggttgcatccttatttggtgagagggcagagtatagaggtgtagcacacaggcctggaagtgagactacctgtacttcagatgctttcttgatgggaaggaagatcagaaaagttagtatgtgtggagctcctagaattttgccatagtaactactcaggtttaagtagtattaactggatccttcttctgagcctattcttaaaaatgcaaaagtataacccatccaacaactctatcatgtaccttcccaactgctgaccaccttctttccagctcttaaaaggtgatcttcccttattttttccctgttctcatctcccttcactttttagccttgtgcaattagtctgctactcttcgatggcggggccctgttctgggctcattgtggcctgcttccgtcccgctataccattgagctactctgagtgaaactcttgtttgatccaaaacatttggtagggagccttgggccagatgcagttagagaagtttgatgagcctaaggtccactggtgtcagcctgtggtgtggacatttgtctcactgtagagctgggtgagccctcaggactggtggggtcatttgaggcctgcactctccaccttcgttccagcttaggatcctgccttcggaacctgaataccctgtcccctgcatactgctaaaatggacaccaacattgactcctgaggctcttttttttgtgttctcatgaaggagcaaaccgtgttcctactgacattctttcttaagtatgcattcagtgtgtgggagatgatgcaaataaatctttatttttgcctctcatcgtctctttttttttttttttttttttgaggtggagtttcgctcttgttgcccaggctggagtgcaatggcgtgatcttggctcactgcagcctctgcctcctgggtttgagcaattctcctgcctcagccccccaagtagctgggattacaggcgtgtaccaccacgcctggctaattttgtatttttagtagagacggggtttctccatgttggtcaggctggtcttgaactcctgacctcaggtgatccgccctcctctgcctcccaaagtcttgggattacaggcatgagccaccatgccccaccttcactgtctctttaaaatacactcagttggggagctgtttgcttttatgaaaagctgtcaggccttgtgacttaccctttatgctttaattaactgattcagcagatacttactgagcactcctgtgggccagccggtctcctaggttctcaggattcaataggaagtaaaaggccacataaggtgatgatcttaggtgatagaagtcttgaaatgtaggctccatttaaaaattaaaagtgtccagttcaatatattaacacttcagtcttcattcaaagattagactttcccccctttttttcccagttaagacttgtagttggcaaccatctctgtccgaaaaagcggtgtgacaggcttctggtgcgttcggctcctctctgtccctcagatttcttgtgtctgacttcactagtttctggattgagtggaataggaggaggaaggagaggtgaggctctcagattgttcttctgtggctccctgagcctcgcacgtagttaaagctgaccctgtgtcctgcaggtgcttcagtgggctcttcagagactcccgacttctatcccttttgcctccttgacctgggggtttgcatctttattttggtcgatttattttggccagtttattttggtgactcctcagcacctaggaacttagatccccctatagtttcctcctgctggagtccttttggcctgcctgggggcactgttgtttgaacctaagaccctctgctggctctcgcgcacagcctggctgggactgcgtgttccttgccctggctgtgcatgtgggtcccagtgctcagcacggcttttccagctctctagatttcccaggttggagatccactgtacccttgctggtcacagatttagcacatgaaataggccatcgagcccctacctcagcttggtatgaaggtgtggctgtactcacagcccctcaaggattcacttcacaaagccccctcctcctgtcctgtcttcacgggagggaaccctcacattccactgtctgtagccctgacctggctgagaggactgtgggaatcaggggactgccttgcaatcactcttggaaagttctgcattctgctatggagcctccctttggtggcagcagcccttctcttttggtaccttagtggaaattcctgtttgatcatcttgttttggttggttttctgtttgtgggccaggaactgtttggctctcttctttaaggcaggctttagtgtttatacttttctgctgtaaccaggcctgggttgcccaaacctgaacagctcgtttactcttggggacacactcttccccaccagtcttaagtttttgggggctgtattattgaaacttccaaggaatatactcttcataaattttagcggctgggcatagtggctcacgcctgtaatcccagcactttgggaggccaaggcgggtggatcatctgaggccaggagttcgagaccagcctggccaacatggtgaaaccctatctctactaaaaatacaaaattaactgggcgtggtggttggcgcctgtaatcccagctactcgggaggctgaggcagggagaatcagttgaacccaggaggcggaggttgcagtgagccgagatcatgccattccactgcactccagcctgggtgcgagactgtctcaaaaaacaaaacaaaaaacaaatttagctaaaaaggaaagctaggcattaactagggagggacaagcttaagagaggatgcttttagaaaatgtttcttttcatcgtaaaagtaacgttaaccacactataggaagtttggaaaatagaaaaaaaacggtcctagcatttcatttaatttattcgtcttttctttttctatacacttatgttcttgttttgaaataactgactttgttataaaatgagtacgtgttcatcagagacaattctgtgatgcaggaaaggagttcagtgcaatgtaggaaagcactaggaagaaataaaatggcatttattgatattttggtgtttctgctgtttttccagtacaaaaatgaatatctaaataataggtaaaaataaatttatctcaatactattttcttgccttttttccacccaagagaatcttttaaaatgtaatcataatgagcatgtatatgctccgcttttttctttttcttttcttttttttttttttttgagatggagtttcgctcttgttgcccatgctggagtgcaatggtgtgatctcggcttgctgcaacctccgcctcctgggttcaagtgattcttctgcctcagcctcctgagtagctgggattataggcatgcaccaccacgtccggctaattttgtgtttttagtagagacggggtttctccattttggtcaggctggtctcaaactcccgacctctggtgatctgcctgccttggcctcctaaagtgctgggattacaggcttgaa

SEQ ID NO: 294 - DNA, 22076 bp, Homo sapiens
attttcttcattgtttggttataattctccaactaaaaactaaaactgcttctcttctaaagccctgtaagatgaacctaaacacattttaagaaacaagcctcatgcctgatgtatggtccacacataaggttcaccaaactgcttgatgccacaaccagagatattcaagctgcaaactgggaggaaaagttgatgttttcatgttgtaaacagttttccctggacattggaacaagactccatatcataaggagactctaactcaactcctcttaatgtctatccttttcacttgacaggataataatgaaattgaaatttcacaatcagtagcttctgctggtaacttaacagaacgtaacctttaaaaatcttttagtaacacccgtaatcccagcactttgggaggccgaggcgggtggatcacctgaggtaaggagttcgagaccagcctggtcaacatggtgaaaccccgtctctactaaaaaataccaaaaattagctgggtgcagtggtggatgcctgtaatcccagctactcaggaggctgagacaggaaaatcgcttgaacccgggaggcggaggttgcagtgagctgagatcacaccactgcactccagcctgggtgacaagagtgaaactccgtctcaaaaaaaaaaaaaaaaaatcctttagtattcattggttaaataagaaaatgcctgtgcatttcttattgtggtacctggataaattcctctgggaaagttgagacccatatacacaaaagaagaaaacaggccacatcattcaagtcttacctaattccctatggtcattgattcattcgtctttaagcctaccaagttcatggatgcaaactgggattgtcacattactattaattttactttttatttcccctttttaaactttgtatctgttacttgtcattttttttccatctaggatacataggaataaagataatttttttgagataggatattgctatgttgtccaggctggccttgaactcctggactcaaacagtcttcccacctcaggctcctgagtagctgggactataggcatgagccaccatgcctggttacttgttaactgatctgcagaagtacaactcctaataacataatgctggcccagcactttcagatgatagcaaaagatcatggaaaagacaaaactgcacttaacaatgcactccaggtagacttatccagggagccactcccttcaaacctcccttgctgctcagatgtggctaaaagggttttgacactggatcctagtcaccaatcattcccctcaaagtggggtgagaccaccaacgatgacaggtccatcccagcacggagaggcatcaaaacgcaaccacaggttgattgatcagtgaggcttttaaagaaagatcttgatcagaagaggaaatgtgaaaattgtcagagtcaaaaaagggtcactagtgttaaagaaaaaaaagtcagaaaagattcactagtttaaagaaaaacaaacaagcaaacaaacaaaaactcctgacaaatagagtcagggaaggccttgaagagagggttctcatgcttgtatattgataacaaaaatgatgacaaaacccaaaaccttgcaccaaggctatcacaaccttacacaaaaggtgctttggcaagaacacctgcccagcaattgcctgtccagccccagactggatcgtccttgttaccgatctctgtactgaggacaattatctcagaataattatgtgattccttccctgtctgaatatgcagcgtttactgtggaacgcatattcccattgcagtgctctatctttaggttgacagaagcattaggttttctcatctgtgcctcatctagtgagctttgaggttcaacaaacatttttgcatcatgatactgtgctctcacagtaggcatcaacttatgggagggtcacccaaaacttcttcagtgagaaatgtggtttacattttgtatcagttttgtagagatatagtttacaaatcatcaaatttaaagcatgcaattcaattgttttaatacatgtcctgggttatggaatcgtcaccgtaatccagtctcagaatattttaatctccccccaaagaaaccccgtacccttagcagtcacccctcgtttcccatgcacctgctaactccctcagccctgagcaagtgctggtctatattttgtccctatagacctgcctcttctggacacttcatataaatataatcgtacagtatgtggtcttttgtgcctggcttatttcacttagcatgatgtttgcaaggttcatccatgttgtaccatgtatccgaacttcattttttatggccaaataatattccatttcatggacataccaattttgtttatccattaatcatttgctgaacgtttaggtcatttccaccttttagctattgcgaaaagtgccgctatgaatatttaggtacaagttttcatatggacatatattttcaattctcctgggcatacacttaggaattctgggtcataagacaacttgatgtttaacattttgaggccaaatgttgtccaaggttgctgcaccattttacattcctgctggcaacttatgagggtcccaatttctccacagaatcacctgttatttttattttaatacactttattttttggagtatttttaggtttagggaaaaaatgcacagagagtacaaagaattcccacatactcttccatcccctcacccccagtttctgcaattgttaacatcttgcattagtgtggtccatttgttacaggatgacccaatataatcacattactatttttatcgtttttattattatagccatctgtcttagtccattttgctttgctataacagaatatcagagactggggaatttataaataaaagaaatgtatttgacccaggattctggaggtggaaaaatccaagatccaggggccacaactgctgagggtccaacagtgtgtgtgagaacaagagcaagaggctgagggtccaacagtgtgtgtgaaaacaagagcaagaggctgagggtccaacagtgtgtgtgaaaacaagagcaagagaaggccaagctccctttcatcaggaactcaagtccgtaatcacgaacccactcctttgataacagcatcagccattcacgaaggcagggctgtcacagcctaatcacctcttataggccacacctctcaacacagttgtactggggatcaggtttccaacacatgaactttgtgggacacactcaagccatagcaccatcctgacaggtatgaggtggtttctcattgtggttttgatttgcagatccctgactgatatggtttggctgtgtccccacccaaatctcaccttgaattgtagctcccataattcccacgtcatgggagggacccggtgggaggtaactgaatcatgggggtgggaattccgtgtgctgttctcaggatagtgaataagtctcacaagatctgatggtttgataaagggcagttcccctgcatacgttctcttgcccgccgccatgtaagtcgtgactttgctcctcctttgccttctgccatgattgtgaggcctccccagccctgtggaactgagtcaattaaacctctttcctttataaattacgcagtctcaggtatgtattcattagcagcatgagaacagactaatacattgacctttaaagacactgaacatcttgtcatgtgttcactggtcatttacatattgtcagcaccatttgttgaaaacacttttcttttgcccaataagatgtcttcacatccttgaaaatcagttgaccataaatatgagggtttacttctggactctaaattctatttagactggaattctattccactgatctacatttctatcctgatgtcagtaccacattgtcttgattactgcagctttgtagggaattctgagtactctaaataatttttcaagattctttctgctatcctgggtccctttcatttttatgaattttaggatcagcttgtcaacttctgcataaaagtcagctgggattttgaaaaggattgtattgactctatagatcgatttgggaaatatttccttcttaacaatattaagtcttctgatccataaacatgagatatctttcaatctatttaaatcttctttattttctttcaacaatgctttgcagttttcagtgttcacatcttgaacttcttaagtctattcctgagtattttattctttttggtgctattataaacggaattgtttgcttattttggctttctcattgctggtatatagaaacacaatttatatcctgcaacattgctaaacatggtttttctaaggtttttaaaatgaattccagccgggcgcggtggctcatgcctgtaatcccagcactttgggaggccaaggtgggcagatcacctgaggtcaggagttgcagaccagcctggccaacatggtgaaaccctgtctctaccaaaaatacaaaaattagccaggtgtggtggcgggtgcctgtaatcccagctactcgggaggctgaggcaggagaattgcttgaacccaggaggtagaggttacagtgagctgagaacgcgccactgcactccagcctgggtaacaagagcaaaactcgtctcaaaaaaaaaagattccataggttgtttgtttgtttgttttgtagagatggggtctcactgtgttgccctggctggccttgaactcctgggctcaagcagtcctctcaccttggcctcccaaagcactgggatcataggtgtgagccattgtgccctgccataggctttttttacataaaagattaagccatcttcaacaatctctagagattgttttatacctttcttttgaattggatgctttttttcttgactaactgccctggctagagccttctgtacacaattacctagaaggggcaagccgctcttgttttattcctgattttaggcgaaggcctcccatcttcaagcattgagtctgatgtcagctacaggttttttgtagaggctgtttatcaagctaaagaaatttccttccattcctcgtatgttgagactgaaattcagcagacagctggcacactgactgaagttcaaagctcggaacctgaacgtgagcctgagtgaggcagctccctgagggggcagaactgttgccttatgtgacagctagtgggtatggaggaatgaaaggagcctccactccttgctgccctgatctggctcctgacattttccttcaaatggcatcaggaccaggggccagctgggctctgtgaaacgcaggaagcagggagctgcgtccacccgccagcctgccctcacctccctagagccttgccttctctgtactgcacacttaggcacggtgagcccagcccaaggcatcattctcacctgcccctgaagtcagaccagtctagcggcctccgtccccttcctgccagtcctcttgtaaggagggcaaaaataaaacaccaaacaaaacatcaactatattctgtatttcctacattattcagataaattgtatttatcgaaaaagctgtcccgtttcgttttgacggccctggagtacggccccttcatcagctgagatcacaaagacgtctagcggaggtaacgggagcagggtctgcagtcagccacctggcttccagatgccagtcctgcccgctcctggctgtgcagctgagcacccaaacctccgcaggcctcgctttcctctcttatctgtaagctggaaaccgtagctacctcagtgagtcatggtgcagatgaaatgagaccaggctctgcaatgcacttggtacagcagctggcaaagtgtcatctgcccccgacaataagcaccatccttgcctctgcagagatgcttagcaaggtaagtgggttctcagtgttaagattcacagtgtaaccaacatctaaagctgttcatgattttggcctgaatgggaagttaggaagaactcacaaagaaatcacaaaggaaagtaaaaaaaggaaaaaagaaagtcatcaaggggagtaaaaactggttaacatttcattttcttttcttttttggcctagagattattaacttttagaaacaggtgtcacaggcaatggtctttaaagagcatctaaatagacctggaatttgcttttttaaatgtacttaattcccattacctctgtgcttctcaagcaattctggttcacattatgaaatgagtacattctcagattatttagttcagaaatcggaatatttattctattatgccacaaattaagcagaactctgcaaagtgatctctaaaaataagtctgaaaaataatcatctaattccagtagaggcctcttacactttttaaatgttaactccaggccgggtgtggtggctcacgcctgttatcccagcactttgggaggccaagatgcgtggatcacttgaacccaggagtttgagaccagcctggccaacatggtgaaatcccatctctactgaaaatacaaaaattagccgggcatggtggtgggtgcccgtagtcccatctattcaggaggctgaggcaggagaactgcttgaacccgagagatgggggttgcagtgagccgagattgcaccaccgcactccaccctgggcaacagagcaagattccatctcaataaaaaataataatacattttaattgtggttaaaaaatacataaaatttaccatattaactgtttttaagtgtacactttagtagcattgtttattcatattggtctgaattttttttatcttgcaaaactaaaactctgtacccatcaaacaactgcccaccctgcccccagccctggtaactaccattttgttttctgtttctataaatttgactttaggcatctcacagaaggggaataagacggtattgcacagccaagatcatgccactgcactccagcttggcaacagagcaagactctgtctcaaaagaaaaaaaaaaaaagacagtatttgccttttcgcagctggcttatttcacttggcatagtttcttcaaggttcacccatgttgtagcatgggtcagaatttcattcctttttttttttggagatggagtcttgctctgtcgccaaggctggagtgcagtggcgcgatctcggctcaccgcaagctccgcctcccagttcacaccattctcctgcctcagcctccggagtagctgggactacaggtgcccaccaccacacccggctaattctttgtatttttagtagagatggggtttcaccatgttagccaggatggtctcgatctcctgacctcgtgatccacccacctcggcctcccaaagtgctgggattacaggcatgagacactgtgcctggccttcattcctttttaaggcttaataatatcccatctcacaggccacctggcttgtccattcatctgttgattgacgctatgttgtttctgcctcttggctactgtgaacagtgcagctgtgaacatggtgtgcaagtggctctttagactttgctttcaattctttgggtaaatacgtacaggtgggattcctggatcacatgctaactctgaggaaaacctccatgctgttttcatcacagccatcctaactccatgctgtttttcatcatagccatcctcatgagtatggagtgatcatctcattgtgactgtggttcgcatttctctaatggtcagtgattttgagcatcttttcatgtgcctactggtcatctgtaaatacgactgtcccttggtatctgtgggggactggttccagaacctcccacggaccaaaatctaaggatgttgggagtatttgcctgtaacctatgcacaccctcctgcatcctttaaatcgtcactagattacttataatagctaatgcaaagtaaatgctatgtaaatagttgttacactatattgtttagagaacaatgagaaggaaagtctgtacatgttcagcatgggcacatttttttaataaaaatattttcaatccctggctggttacatccagggatgcaaaacccatcgatagagtgctgactgtatatcctcttcagagaagtgtctgttgaagtcccttgctcatttttaaatgaggtgacttgttttactgttgagtggtggttgtctatatattccagatattaaccccttatcagatatatgatttgcagatattttctcacattccacaggttaccttttccctgcacagaagggaaaggttgattgtgtccttcgatgcacagaagtttctaagcctgatgtcgtcttagttttacttttgttgcccgtgtctttggtgtcatatccaataaatcactgctaaatccaatgtcataaatttttcccgttttcttctagaaattgtatacctttatttcttgtttagtctttaatccactgagttttcacataaggtgtcagataagggtcttgggggccacatgttggcctgtgcaacagttaaagggccccaagcatagtcacatacgtgcagatgatgttcacacacagatacccaggcccaggagatcttggactccccaaggccatattctattcctacaactgctgtccttccccttaacctccttttgttctggccttgctagcacagacccttgcatgctaatcaaatgacacagttgagtttggaggaaacatacatcagtgaggaaaagtgaccacagaatccttccaggtttcaccaaaaccacccgtgacgtagataaaactagaattctggggactgggattcctccttttcccctgagccactacgtaaaggtgactgcattacagtcccatacctcttatctgtggccccagtatccattttttttaagacagggtctcgctctgttgctcagactggaggacagtggtgcaatcacagctcactgcagccttgacctcctaggctcaatggatcctcccacctcagcctcctgagtagctgggactccagacaggtgcacaccaccacactcagctaattttttgtagaaatgaggtctcactatgttgcccaggttggtcttgaactcccgggctcaagtgatccacctgtctcagcctctcaaagtgctgggattacaggcatgagtcacagtgcctggcccaaattcatagtcctaaacatggaaagttttgtgtacttcatttggcggaaagtctaacctgatttggcacgagacgacccatgatccttttcgtcctgcttgtattttgctgcaggaatatcagtttgatgagggtgttgccccaggccccaagtggaatatgcacacgtcactttcctaaaatcagaacaattcagagttctgaaacacacgaaacacagctgtttctaagattcttgactaagaggttgtggcttatgctatttttcctgactgtggcctcactttcttcccaataaatgtttcaatctgttgatactaatgttttttctcatgatacttgtaagataactgattttaacaaaaggtggcacacctattaaagacatggttaagtttcattggctgtatagcatctctaattggaagactacatggcatctatccaggttggagttgtaatcacctagggatgtctacatctgtctacctagatcagtctgtcagttccatcgaggtctgtatttcaaagtccatacataacacacggttcttcccattttacagaattattttttcaaaccaaagttcacatactgctggtgggaacaggttcaaatagggaatgctgatacatatcaacaacctttgagacaaacctgttcacacagtgagtgtggagcccttggcccccctactttctctctcgcaggccccgacatcaccctgggcttgcgctgttggtagtgttcaaaggaaaactttagaaacattaaattttacagagtttaattgagcaaagaatgattcaggaatcagggaacccctcaaaccagaataggctcagagagactccagtgccactgtgtggccaaagacttacggacagaaaagggagtgaggcacagaaggcagaggtgaggcctgcaaacagcagggtggctacagctcgtgtctggcttattgaaacagagtttgaagtgctgctgcctgtgactgattcaagagtaggttacagtgtccacacatccaattagatgactgttcactacgtatggagaaacctataggctaaacttacagtatgtaaggaggcggcttcaggctacagctgagtagtgtgtccttacagttggaaccaggagttcatgggaattcttcatcatccagtggtctgtaaatgttgcccatgctgagtagtctgtccttacagtgtgaaccaggggttcatgggaattcttcaccatccagtagtctgtaaatgttgcccatgctgagtagtgtgtccttacagtgtgaaccaggggttcatgggaattcttcaccatccagtggtctgtaaatgttgcccatgctttagttttgttacctggttgctctgtttttatgggattgtgagaaactgaaaaactgtgactgctggagccattttcccacaatccccattttttaaaaatcccataaaggctctctcgtgagcaccgcacgttttcccttgtagtcacgagggtaggggctggagaaagcagcagagatagtcaaaaacccacagctacaaaaaatgcactcctaagagcaagtaatggcgagggctaaaaggcactgtgccccttctgggccattctaattaccacatttaaatggttttgagaaaagagaatttttatctgaggaacgcgagttcttttaattatcaggccgagagagacattcaaatgaggcgacaatcgcgccctactaccccttgacctgtgttcacctctttaaactgctactggtggcaacagcgccacaaacagctataaattaacctaatgacgccacaatggacactatacccacactcaatagctgaacaacatatagtcagtcactaatcaatgttatttctgtaaaccagtgagaattcctcacaaacaagttcctattagtccactccctggcccccttttttgcctttaaaatccactgttaactgctaatcggagtacacattcagggcgccttgaatttgtgctcaagtgtggcccaaataaactctctacttagagaaactgtgtctccgctcgttttcaggccgacagtttccaaaatgttagtattcagcctaacatgagaaaagtcaccatataaaagtgaggggggaaaagcaaatacaggataatctcaattgtatataaaatttatatacgtaaggacaaagatacatagtaaaaaaaaaattctggcaggtattaaggctgaaaaaattaaaacagtccagagcggtctggctcaggccagcctgggcctgccgagtagctgggacctcagccaccgcgcctggctaagtattaatgaatctgttttagagatagggtcttgctacgttgcgcaggctggtctccaactcccaggctcaggtgatccgcccgccacagcctcccgaagtgctgagcctcccaaagtgctgagactacaggcctggccgcccgcccgccagcttaattcacgtaaattccagacaaacgtagaaagtggctcctttagtaagccacttgcggctgctgctcatcagggttcgcctggggccactgagaccacgcgccggtgcccgccctcccgctgcggtccgattttctgaaccaaccaggcgcttccgggcgccttgccccagacgggcccaccgcctgcgcgggccgagggcggcgcacctgcccctgcgcttccgcatcgaaggtgaggtcggaggaagagaagaccgcaacccccaagctcccgcggcgtggggtccggggggggacacgaggcggggccaccaggacgccgacagcctcacgtctctgggcccgcggcgcgcaaggcatgccgggacccgtagtcccgcgacgttgcgactcacagtgcgcgatgggagtggaggagagcggctcgcggtgcatgccggaactcgtagtctcgggatgctgggtctcagcgcgtgatggggtaatggcacgcaggcctgcgttgaacgctgggactcgtagtcccgccatgctctgtccgcggtgcacgccgggatacgtagttccgagcgcgccaagaccgtcactgggactgggcgacagcggcccgcgttgcatgccgctgctccacggtgccggcgctccgaggaaaagtaggtagggctcaggaacgcagttcttcacggccggcacgcagggttggtcccaggacggagccggctccggccccgcgcggcgctcgtatttacacgcgcacgtacgcacgtacgcggcgcccttgcgtgacgtcacgcgccctccaggaagtcggcgcgggctaggcgacgggtggaagccggtaccgagaggaactacagcgtcgccgcctgggttgtgtcgccgcggtaggcgctgcgctctgagcgcagcgcaggccccgtaccgaccgcccgcccgccctctgtccgcgatggaggtgccggccgcgggtcgcgttcctgccgagggcgccccgacggcggctgtggccgaggtgcgctgcccggggcccgcgccgctgcgcctgctggagtggagggtggcggcgggcgcggccgtgcgcatcggctcggtgctggccgtgttcgaggccgccgcctccgcgcagtcctccggggcctctcagtcccgtgtagcctccgggggctgcgtgcgccccgcgcggccggaacgcaggctgaggtcggagcgcgcgggcgtggtgcgggagctgtgcgcgcagccgggccaggtggtcgccccagggtgagtgtgctgagccgggcggggccgagggcgggcggctccggggagggatcctggaggacccccgggctgctgcgtccgcggtgggcaggggcgcccctggtgagggagcgataaagcgggacgcaggcactgcgcttctcccctaaaactggatagtcaccacctgtggttttaccaacggggagcattttgagataaaaggaaagggtcctgcgtagcgacacgaagttactgtttggaaaagctatgtttgtttctttctttctgcagtgatagtccccgccccttcctttagctccacctttgtgacttaggaaaactcatgggtggctgtgagcacaagagtcatcaggcaggctccagacctgttattgaaatataaactgttgggtgtgtgcacatctttaaatttttgtaaactttgtgaaacgcagttgtaaaacctggtgcagttctgtttcgtggctaaggaacgggcggaacccaggcctgcagcgaaggcagtagccccgtggttgaccacagtgggcattgtcgcaggctgcttcagggtgacgtgggcgttgtgacagactccacagctctcagtagctgtgctctgaccccagaaggggatatgtttccgtagcaccgaagtgtccagccatgtttgaatctacccttgtgttctgggatgggcgggcaagtggacacgcgtgtgcgcctggctctggtagttttgattgtgagaacagaaactccagggagaggtggacactccagcccgcagtgggccgggcgtgagctccctctgggaaaggtgccgctccttctggggatgccactctcttccctcctcggcagccgcggctcctcgtccctttggcttgccctgaccctgtgtttgttgaggatcttctctgcatctggttccgcaagagtgaggactgggacaggagtcttcccgtcacagccccagaacgtcctggctccgcttcctttggagacagagcctgggtccttgaccctcggcacgggcactcactcctgccccctgcgtgctggtgggtggggctgggaggttcagggccttgcctcccagaaaatgccttcacggcttcctcagtgggcactggccgtacctgggaggattgtggaggcagatcccaatgctggtgtattccctggacagaaaaccccaggatggaagatccctactgaggtttcattctgttcctctgattgtacagaaagggctgctttggcctagacaggtgagtaacttggttatgtggcaagttagtattgaaattccatgttcagtcagtctagtgaataaaaccaacccagtgcatcagtcagtcagccagccaggtcatgagcttgatgacgggttcccagcagtcagtagtgtttacagggaggtgctgtttgagatcttggggtacctcacagggccctttgagacactgatgtgatatcatttctcctcagatggagcgtctgtgtggcaccaggtgtccctctggttccaggaggctcatctctctgcctccagtccatgggcggcaggtaaatccttgccttagagaaagccacagacggtgctgcctggaatttgaggtggcttcttccccgtttctgtgtactcctgtgggtttgtgtacatgggttttatgagcgttctggggagtgtggtggtggtggtgtgacgtcagcatttccggaggtgttcctgcccgtgcagtgggcgtgggtgccatagatccaggaaggagcgactggaagggctttagtctaaagccctgtgtgcatgtgccctggcagttctggtcgtctgtttggaatcaggttcctgcctcgcagttgcattagccagctgaattcgggaggtgcatttgcagcaggagtccatgctgctgacggtcggctccgtgtggtccagatgacactgccctggctctggggggctgccgttgggagccggtatgtgttggcctccccaaaatgcctgctgcacctttgtggaacacagttgaaaattactagattcagtcacttgttgacagattttgtgaacagggtgggttacaagtgcgtttctctggcagcacccctgtgatgggagtagcgccctgcagtgtggacttgtggtggctttgctgacgtctctccatagagagttgcaggtagaaatctccgcagcttttgcttaaagccaacagtgatggatttctccaggacgttgagttccagctcagcagctctttatacacaatttacagctaaccctcgaacaacttgctttggtctgcgagggccacctttatgtagatgtttttcagtaaatcgtctgctgttcgcatccatgggttccacgcccaacactgtttgctgggtgtggagcccagcctgtttatacagagcgctgactttctggatcagtgggttctccaggttgactgcgggacctgagtatctgtggatgtggaatttggtatctgaaggagtcctgcagcccgtcccccgtgagaatgagggactgattaaatatggaagtctttccataatagattgtgccgctttgtgatgaagtagagaatattgggcataattccatcctgatgttggaaggtgataggtgtgagtttagttctcatccctgcgacgcctctgggacgtcggttggtgaagagcatctgccttcctctagagagcctgagtcactttcacttaaaaggtttttcctctgtttttctttttttctctgattgctggtgtggtcatttccagcaacagctccgcggttctcttctgcggtgtcccaccacttggaggctggaaggtgaagacatcagggaagaggaactgccttcaaccgtcattgactctgctcaccagcccaggtgtttgatttttactaagcaagttcccagaattgcacgtgggctgttttataattgacttatcttgaccacctctaaaagttctcttgaagttacagattcctgagatctttatctgggagagcaagcatttggttgaagtttgctttaaatgtttatagactgattatcgtgtattgatccttagagtacccctttcagattatgcaaataacacgcacttgtatagacaagcatgggcagaatccacaactgcttttgtggaggctccaaccctggcttcagctcatctgcgtgtgagggcaggggaggtgcagaatctgctcctgggcttgtgctgaaaggaggtcccttttaacagggacctcccagcaccaatggaaccccgtggctcttggtgagagagagcaggtcctgcccagctgatggatcagaaactcaggtgtcagaaacggggtttcagggcggctgcctgaggaatgcgcaggcgatctgacgttggaattctggcttgggcgaagcccttgatgtggccacacagttttggtccctcaagggcttactggttgcctgcgtgccctggtggctccttggtgaggggcctttggagaaagtcttgggaaatcagatttcccgagggtgttgttgaggacattgctgacgaggtgtgggatttacggggaggacagcctgtctcttgaggcttggtcgctgtgttcaccctgcaggtgttatgaattagcttctggcccaggacggttttgggaccggggggtgcctacccactgttgttcctttatcttgatcctttcacagggcttataaaaatacttatttttcaggaataacgggaagtatctttgaaaacatagcattaaatctgctgaactggagcttgcagagagcagacagcggcagcagcctgagtgtgctaagctcaagcgtcgcttgtgtgccatcaccttagtgaaggtggctcttgaccccactggccgccggctgcttgacagtaacttgtttagctgagactgtgtttgagaaactgagaggtgtggatgttgcttgtacatgtgcagccagcatgctcacagtgccgaggagcagactacgcgctgctccagagcgtagattagaacgtcagtctaaacagttctttatagcatggaattttaacaaagaaagaagaatcccacgtgggtatgtgtgagtgagccttgtgtagcttagtgtcggttactgaggcggagcactgcggagagaggtaatggaacctgtggccctgtgaaacctccctctataaatagcaggtgtgagtgaacctgtgaaaagcaccagcaccagccaggcagggtgggtccgtgccctcgttgcctgcattgttgtcaccaggcaaggtgggtccctgctcttgttaccttcattgttgtcaccaggcaaggtgggtccgtgccctcgttgcctgcgttgttgtcaccaggcaaggtgggtccgtgccctcgttgcctgcattgttgttaccagcaacatttatcctaaccacatcagtggttatttttagacaaagaaccattctgggaacttaaaaacactgcatttgggtgaagttacaatagtcactagattgtcgttttgatctttaataagattgtatgtttttgtcgggcttcatcctatctggcagaagtaagaacctcctcactccattggaaagaaactgaggttccaagaagtttggacctgccctgccccttacagggtgtgaggtcctggtgaggaggacggtgcagggacctcgtggtctctactcccggtttctctgcggtgctccttacggggtgtgaggtcctggtgaggaggacggtgcagggacctcgtggtctctactcccagtttctctgcggtgctccttacggggtgtgaggtcctggtgaggaggacggtgcagatgcctcgtggtgtgctcaggcccttgagagagcctctgtccttggttctctgcgtgctgctctctgtagaccaggtttcagccctggagattcctagtgtggggggagtagctagaacaatagtgtttgtctgcttttataatatttatgtggagtacaattattttaatagaaaatattctgacaggtcaccatctttcagaaactaagtcttttttttcctgcagatttctttgctttggctttttcccagtcactcacagggaggtatttaaatcgccacagaaaggggaaggtacctaaaatgatctgggagcctgcagtgactggtgagaactaacaggcggaggccgtgtgcgagggttgatgacgtctgacagactgtacctgtgcctttagcgtgtccacaggaagggcatctgcattcaccagcgcagggtgtgagagtgccacagagaagcagaaaaacattgctgaataaaatgaagatcattccaacagcaacggtattgctgtctttattgctttgtagattttggaatgagaatctctgagaaatagtaatacagttagaataggctgcaacctaagattagtccccgaatttattgttctgtgatgagggagtagaagcctctgaaattctaaatgtgcttcagtcagtgcacgaacgtcgtcacctaagggtccggtcctggaaataaggacatttcgttttcatcctggtaccaagaatcttgatgaattggtaattcttttagaatagttttattattaacaattctaataattatttagaatacttttattcttccctgttgacgcctgcactatttaaaggatgatactttaaaaaagatatttgtgcctaaaatttggggggctgtcactttgtcagcccattaaacgtgggtaagttgcacttcaaacgttttgctttgtttttcccacttttcacctaacagaaaaccactgggccttgttacttgcttggttttgttcgtctgtgatttacctttgtcatgggtttttaggtatctccgatctaatcttttagataaaggactttgaagcacgtctgcctggaaatggtttgtaggtttcagaaattttgtgtgcattatcagatttgtctccattttcatggtttctttaaagttagttttaaagtgggttatgtgaaatcatctagtatctgggtacagaggaatggatgaattctcagttttatgtgtgttttaaaagtgcacaaatacaaaacggaaaacaagcgatgtaagttgtctcagaaaaaagtgctttttatattttcaggagaaagagaatgtagagagaatggaactgatgagtttgaagagattcaggtgatatttcttaaaggataaatgcacattttaaaggttatgaagagatggtcttggtaggtttttaaatatacatctagcatcatatgtgcaaaattccttacaatgttaagaggaacttgagctaaaacttaactcatttaatatttgtaacatttttgaagtagcgtttaaaagacagtaatttccctacggtgctttaaatggtgaagaatgctggtgtcgtacgattttgatgcattttttgtgctgactatagactggcgggaatgatgcagttagcgagttgatacccagcatcatgttggcttctccagttcactggtgggcctgcaccacagcagttggcttctccagttcactggtgggcctgcaccgcagcagttggcttcgtcagttcactggtgggcctgcaccgcagcagttggcttcgccagttcactggtgggcctgcaccgcagcagttggcttctccagttcactggtgggcctgcaccgcagcagttggcttctccagttcactggtgggcctgcaccgcagcagttggcttctccagttcactggtgggcctgcaccgcagcagttgacttctccagttcactggtgggcctgcaccgcagcagttggcttcgtcagttcactggtgggcctgcaccgcagcagttggcttctccagttcactggtgggcctgcaccgcagcagttggcttcgtcagttcactggtgggcctgcaccgcagcagttggcttctccagttcactggtgggcatgcaccgcagcagttggcttcgtcagttcactggtgggcctgcaccagagcagttggcttctccagttcactggtgggcctgcaccgcagcagttggcttcgccagttcactggtgggcctgcaccgcagcagttggcttcgtcagttcactggtgggcctgcaccggagcagttggcttctccagttcactggtgggcctgcaccgcagcagttggcttcgccagttcactggtgggcctgcaccgcagcagttggcttcgtcagttcactggtgggcctgcaccggagcagttggcttctccagttcactggtgggcctgcaccgcagcagttggcttctccagttcactggtgggcctgcaccgcagcagttggcttctccagttcactggtgggcctgcaccgcagcagttggcttcgccagttcactggtgggcctgcaccgcagcagttgacttctccagttcactggtgggcatgcaccggagcagttggttggttgtcctgagcataccaccagggggttaaagtgttttcaggctggaagcatttgacaccatggctccctggggtctgtggaggttctgaggcaaggactttccttgcaggtctgtttacccagcagagagggcagtagggtctgaatggtgtggtgcacgtggtgccacgtggttttgagacgtgctgggaactggttttgttggatgactcgctctagaccacagtggcagtgttgaagctttccagccacggctctgtggatgtgtgcagtgttgggaatcaggctgggctgcccttgttccttctttacattcctcagacgttgtgctttacagccacagtttcagtaaccgctgccagagccccacctgtgcgtgttctccaggatggctgcgtctgggctctgggcgactgaaccaggtgcagagcgtcagccacagctgacgactgcactgcactggactccagcctggggctcccacccctgtggctgcacaggagacaaaacaacaacacttgttcctttgaagctgtttgttttttgttttgagatgaagtttcactgttgtcacccaggctggagtgcagcggtgcaatctcagttcactgcaacctccacctcctgggttcaagcgattctcctgcctcggcctcctgagtagctgggattacaggtgcccaccaccatgcccagctaattattgtatttttagtagagacagggtttcaccatgttggccaggctggtctcgaactcctgacctcaggtgatccacctgcctcggcctcctgaagtgttgggattacaggcgtgagccaccgcgcccaactaatttttgtatttttagtagaggcagggttttaccatgttggccaggctcatctcgaactcctgacctcaggtgacccacctgccttggcttcccaaagtgctgggattacaggcgtgagccatcactcccagccacacccggctaatttttgtatttttagtagagacgatttcaccacgttggccaggctggtctggaacttctgacctcaggtgatcctgcctcagcctcgctaagtgctgggattacaggcgtgagccaccacacccagccactctggctcttttgggacataatttttgaccttaaagttgcaagaacagtgcacagaattctcacaccagcttcaccccagattccgcaaatgttaatgctttgctgagtttgcttatctttccccatgcacacgcacatttttctggagttggagagttagttgcaggtgtgatgtcacttcacccctaaatacttgagtttcctgaaaacaaagacgtgctcttacatagcactaatagtcctaataaagtcctttgtaacaaaagcaagccctggaccccacgtggcatcgctggttgaaccctcaagagtcagctccttcgtctttctttctttctgtatcattgcctggtttagtaggacatccctcagttagatcgcagctgtgcactctggtgagactgtcccagagcctgcgtttagtgaaggtggtgtctgttgtaaaaagttacaacttttcctgttgtaattcagtatcttgaaagagatactttgttaccacataaatacatttgca

SEQ ID NO: 295 - DNA, 21500 bp, Homo sapiens
aaactcggtcgccccctacagccccctgcccctgggttcttttccacatcccccaccactcctccatttcgcatccaagacttcatgaaaggctttcccagaaaagaaaaaatgaggagtcttgcgacttgaacagccctcccctgcccgtctgcaaatttgaattcctggatttcacaacagtgagctcttcttgtgcctaccacccggcatgagcaagacaagggggtgggtggtgggagagtggggaagtgtgggaaagaaaagtgtagacaaatgggtggaacaaagaagtttaaagtttagatttgggggctagagttctggtcccagttcaactaagtgtacaagcttgataatcgtgggccttcctatcacactggcctcttccagcaaaaccctacccattctcatctctagaggccttgacttcccttatcaccctgcattataatatttgataacatgggccgggagtggtggctcatgcctgcaaccccagcactttgggaagccgaggccggcggatcacctgaggtcgggagttcaagaccagcttggccaacatggagaaaccccgtctctactaaaaatacaaaattagctgggcgtggtggggcatgcctgtaatcccagctactggggaggctgaggcaggagaatcccttgaactcggggggcagaggttgtggtgagccgagatcatgccattgcactccagcctgggcaatgagagcgaaactgcatctcaaaaaaaaaagaaaaaaattgataacatggcactttccctctccagctgtgaactctttgagggttgggaatgtctttacctgtattcttggcacatagtatatggacttatgtttgtgaaatcagtgaattggctgtagtcagggaactcctcctgggggaagtgagacttgcacgaagctgggcaattcttggtccaggggggttgaaagaataggtgggggactcccaggagggtctgggacctgaaagtgaacccagattggcagggaggtgaccttatcatgccacctggagaggctgccccttctgactcaggtgggacttgcatgtggctcccaggcttctgtttggcttcctcaaaatagcttccagaaaagtgaataaaccacaaatggttgatttatttctgactctcagcccgtctctcacgaagacagagcctattgaccaaaaacttcaggatctgcatctgagcagatcccaggaaggggaagtcaaagggcccaggtcagaggcccaagttcagacttcagcagcagactagggtcagactttaccaaagtcagaactcgaggttcatgtaagtccttagatcccgctcccaagccctgtctttctcctccctccttctctcctccctccagctcagtgtggccacccgagggggtctctccctcccagccacagctcgggtatcccaagctgggaaatgtgtcactcggggctggggtgctgatctgtagcctagtccttcctggtccctcttgaggacagtggggatgggattggcacggccctcaccccggggtcccagccccattcctggctcccagccccccctcagcagcagtttgaagcccgggctggagatgggcaccccaagtggaaggttgggaggctgaggaccctgcgacagtgacagcaggtgagcagtggatgtgcggtggttggaatcttggaagtgggtgtcacagttctcgcagtactggagggagggagtaggagacctgcagagaaagaagaaaaagcattaagggcaggggaaggaaaaggggaagagttgaggcctcagagggggctggcagggtagaataggatcttttcagcttttctgctaaggaacaaattgccagctaggcatagtggctcacgcctgtaatcccaacactttgggaggcagaggcgggcagatggctttgagctcaggagtttgagaccagcctgggcaaaatggcaacgcctgctttttttttttttttttttgagatggagtcttgctctgctgcccaggttggagtgcagtgccatgatcctggctcactgcaacttccaccttagcgattctcctgcctcagcctcccaagtagccgggattacaggcacatgccaccatgtcccggcaaagcctgctttctacaaaaaatatgcttgagcccaggaagcggaggttgcagtgagctgaaatcacaccattgcacaccagcctgggcgacagagtgagatgagtgagactttgtctcaaaaaaaaaaaaaaaaaaaaaagggacaaattgccttccttcctacttaacagtgagggatccaggctggtccaaaggtggtggtgagttatctgaattaattgttcactcagttacagatcaaactccttactccacttttcccctccttctcactactgcacttgacttgtcttaaaaacaaatttctttaaaccattgtgggatccagagcagaatagttgaaagaaaaaaatggtaaccagacctagcaaactcttgggcaaggggagggacattagtcataatgactatagctaacattcatgtattgcatactatgcggcatgcactattctagcattttacatatattaacccattgaatcctaacaacaattcttactacccccatttctaagatgagaaaactggaacatgtagacattaggttgtttgcccaagtaagtggaatcaggctttaaatccagggagctcatgtttataaccacttgactatactaccctgtcaacctacacatgaggataaggaaagaactcttcagcactgtgctggggcgtctggtgtggtgtggctgggagaggcagaacacaatgagacatgggtctgagctaaagtttccccttaccggttttccgggctccttgtctctccatggctctccctgaccatgcgggctacctcagggaagccagcttcttcagcgagctgagccgcatccctgccactcagctcacagacccccacccaggcagccccacggcccaggagatagctcacagctgccccctggcccgctcgagcagcacacatcagtggggtccaccagaaggcatcccgggcgttgatattccccccagctcctcctgcctcatgcggttccagcagtctcctaagttctggcaggtccccctcctgggctgccctcagtatccggtgagtcatcttatcctcagcctcaagggatctcccttgtccatgtcttcctgatgctccttctgccactgcttctgctgctggtgccttcattattcttcttttctttctctttctttctctggcaggttcagtctgagatctctgggagtcaggagcgctgctctcatccccaatcagggcctcatagaaagctcgggctgcagccccatccagggtggactctggcttctcgggctgtggctgctgctgcccatccttccagaggtcgctggggtcagtggctggggtgaaggtgatgagcaagggccgggacatggcttttgggagaactgagaaaatgataccaggcaagggaaggatgagacaagtaagccaagctcgtggtgaccctgtagcaaccacagcctcagagacctgctgggatgagaaaaagtagtcaaaaacactttcctgccactaaagtaaccccacaacttaggactctgcagggcctaagggagagagactttgcgtaaaaacatggaaccctacaataccgactttgctccttagtaaagattaataaaactccatgagactgttgtccagaggtcctgcgtccggcccccacccccatcctcaccaacaataaacaccagcctctttctgaaaccactttcccaccccgtaagacataccagtaggaaaaaaaaatcagcctggccctttaagtcttccgcgatcccatttcggagtttcctcttcccaaacaaaaatagatgggtcactccctagaagatctcggggagagtctcctatacgtgttgctgtgtagcttccgtaccgcaaaatggcgccattctaatcagaagagttgacacaatcaaatagccacacggcacgaagacgcatgcgtggcgacaacaacaacaaaaaccacaacccacattacttgagggctcgggcgtgcgcaaagctccgggttcagtttcccgcgctggaactttttcaatagtaaacgagcaaagctccgcgcgcccaggtggcgcgagcactaggatctgtcggttggggtcctacttttacataacgcccccacaatgcccttcgccttcctcaacgtggcccccgctccaagcccattttctggagccaggaatccactctgtgggttaggaaaggccctcaggaggcggagggaaacctgtggaatgccgagaagccgtgtaatgaaataacgtcacgcctgcccctcaccattactctgaccagggttcgaaggtcacacttagagcctaaggggaaatggagaagtgcaaagggacgagcagaatggctggcaccacctcaggttagcgcactgggacgttccagttctcacaccgcccaccccaccccacccaagtccctacgcacggagccaagccgcacctctcccctcatgaggcaggagcccggaggaaacagtatgcccgtcaagggtctctggcgggactgattcgcactaggggcccaacaggcaataaggacccagcggattggccgaggataggccagtcccctgggcagcagcgccgcgccgggactagaggggaacgtgaggagagctgcggaaagagatccagcctggctccctcctttccccgccctaagtcagcctcttcacccagtgagcacaaaactgtattgcccagactcccgggccccgaacgccatacctggcttccgcttccggtggcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccggtgagtctgaagtcgtcgctgctccgagtcccttgtcgctgggagcggcacatggggtctccggactttgatgtgggggcgggggaggaagcgaccaggtccggcacgaaggagggagaggtggcctgaggagcggaggggggatgtgtggattccggtgaaagggacctgacaatcgcccccaacccgtgagaaaaggaggagcccagttcttgcttgagaatgataaacttggaaacccttgggaaaggcgtgggggtcatgcagagacttgtattggtagggagcctgagtcgaggtccctgccggagttgacacagaggagagagggccctggccttcgggagctccagggatgtgggtcgggctggtgggtcaaagtatctgttggcttctttcaagtggtgggaccccaaagaatgtttaacttcaaagaaaaggggctgagatgtaaattagaggagctggagaggagtgcttcagagtttgggttgctttaagaaagggtggttccgaattctcccgtggttggagggccgaatgtgggaggagggaggataccagaggcagggaaggagaacttgagctttactgacactgttctttttctagctgacgtgaagatgagcagctcagaggaggtgtcctggatttcctggttctgtgggctccgtggcaatgaattcttctgtgaagtgagttctcttcaacctccctacttgccagcttcacatatcttcccaccagacgttccttcacatattccacttctgcactgttctcttacatgctatttgaaaacttcctatcagcaaagagtcccccctataaaccccgacgaacctgtgctaaagtggcaaaactggggcccaagtcctgagtctgccaccgtccagcaatataacgttgggctagtcaatttgtgtctttttcttttttttgagactgggtctcactctgtcaccgaggctggagggtagtggtgcgatctcggcttactgccacctctgcctcccaggttcaagcgattctcctgctccagcctcccaagtagctgggattacaagtgcctgccaccatgcctggctaatttttgtatttttagtagagacagggtttcactatgttggccaggctggtctcgaactccagacctcaggtgatctgcctgcctcggcctcccaaagtgctgggattacaggcgtgagccattgcgcccggcctgtatcttttgttactaaagtggcactgctagtacttgtctcaggtggcctttaggaaaactgaaatgctacacattgaaatgttttgttcagaaaccatgctgttcagcttccaccttccttagccagctgagaggacaaaactggttcctagagacgggatacaggagtggagtagggacaaagatcttgaaaagaatgtctaagaaaaagattgctgtatctacttatccttagaaaagaaaagccaaagcttttatgggagagagtgtaggtgaactagggagagacacaagtacttctgctgagttgggagtgagaaacaagcacaacagatgcagttgtgttgatgataaggcatcacttagagcattttgcccaggtcaaagatgaggattttgatatgggttccctcttggcttccatgtcctgacaggtggatgaagactacatccaggacaaatttaatcttactggactcaatgagcaggtccctcactatcgacaagctctagacatgatcttggacctggagcctggtgaggcaccctcagggttgttttgtgtgtgtgcgtgcactatttttctcttcaaatctctattcacttgcctgaattttgaaatttcctttggttctctgatttctttaaccccaaattcatgctttattttgatcctccacctgactcttgtctagttttgtgacgtatatcacttgttctcatgttttctaaatccgcaattcagacctattccaaaatgcgtttcctcatgggtctggtttgttgtctgtttctcctgctttgcaccttccagtctagaatttcatcttctgcattgacattgttgcagttatgtattgaggagggagttgggagggagagcaaggagcagaggctgaaaaggtgtgaagggaaggcagagctgtcttcgtttgatgcaagggtcagaagcccaggtttctgggtcccatgcccagatgttggatggggtaaggcccaaaagtaggtgctaggcaaactgaatagcccgcagcccctggatatgggcagggcacctaggaaagctgaaaaacaagtagttgcatttggccgggctgtgtttcagatgaagaactggaagacaaccccaaccagagtgacctgattgagcaggcagccgagatgctttatggattgatccacgcccgctacatccttaccaaccgtggcatcgcccagatggtgaggcctctctgctcctacctgcctccttctgagcagtaagagacacaggttcctgcagcaagaagtcatgtttaagccctgtttaaggaagctagctgagaagaggggaagaaccccagaacttgggcctgggaattgaattctgattgggggtcatcctgaagggattgttttcagggagggagacagaccttgaatcagagagttgtgatagactgcctcttcctcaaggaacaaacaacaaatggctctgatggtttgtagcctgcctaattggaagaaaggcaacacagaagtttgagagcccatctagtccagagaaggggcctctggacagaggtgggaggagtgggggacagagtggtatgggttgggctgcgaagggagttgcctcttctttacatctacctgccaaccccttccattgtattcacctcagttggaaaagtaccagcaaggagactttggttactgtcctcgtgtgtactgtgagaaccagccaatgcttcccattggtgagtgttgaagaagggaaaggaaagcaccgtgtggcagtcttatgggaaggagttggggctcaacacattggagcctgagtcctgaggggaggttaggtaggaatagggggatacctggcctgctgagtctggctgtctcccaggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggtagggagcagggagagtcattaagggtcaaaggaaaggcccaagatcccccagagaggggaggacagggcatggccctttcttgaggtctgcttctcccagaatcagggcatctccctgctgagtgactgtgggaaagttatttgattatctgtgcttgagttaccttattgtagaatgttcttgagctgagaagttgggaaccacgaggctttagctctgagcaggtccatagaggagctcaggtggggaggtgggaatgcaggtgactggcagggcctggatggggctcatgctgctgcctctctgacctctgccctggcctaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatcgtggtgggaatatgaaataaagtagaagaaaaggccatgagctagtctgctggtgcttgctgttggggaagggaaggtgatggtgtgttggactccaggggccctcatggcccagcccaccctccccagattgaaaaccaggacagatttgtgctcagtggattgggtggtgtttttagtatggagcagaacagaattcctaggactgcgtgtgatgaaatgcaaggtcaaaaggaaaagacaaagcatatttcaaagatgagaaatatttgtttggatatctatgactgtctgtttatactgtaaggggcttaatcagcagctccatcttttagttttagttctaaaggaaaagtagcctaaagtcagtataactaaagggtggaacgaggtgggacaaggtccggaattgctgctcagtgatgtgtgtgtgcctgccgctggtggagctgagactgctcatctcagaaggatggggatgcttgatttcctggccaggttgtcccagcacagtggggattggccctgttgtatgacgaagacagcacatggtggcagagatagatactaacccatggactttccaagggagggaataggtctttggagggtatgcaagacaaaggtagacactggataaagaacccggtagtgcccaggtattaccccatctgggccattactcccacactcaggaaccagacgttgtgggtgaggacatgctgtccctcctgccaagtaataacttccttcccagccaggatcctgccccaagtaggaatatagctctgcatttacagcagctcctgctcagaccttgtcaaaaccaccctgcagcttaggattaaggagcatggtcacaggaaggtggggtttcagggcatcccctcaggaactgcccatctccccagaattccaaaatgaaggtccatatgcttgtaggtgtgctggtcatggtgggcttcacagtaggaaagggtaagtggggcccaggggcagggagggaggaaggggtaactgagtccaggaagggggtggagcgtggccatggataatcgggcttcctactggcccagggtatttgagagtgacccagtgcctccatccctccttctgcctccccagttcctgttcccgacatccggacgtgccacttctgcctcgtagaagacccttctgtaggatgcatttcaggctcagagaagtgtaccatcagcagctcatccctgtgcatggtgatcaccatctattatggtaaataaggtcccaggaaggggctgctggtggggcagccaatggcttggtcttctctcctctcacagatcagggctgctccgggcatggggtacaagaagagaggaggggctgagtgcaatggctcatgcctgtaaccctagcactttgggaggctgaggcaggtggatcacttaagctctagagttcaagaccagcctaggcaacatagtgagaccctgtctctacaaaaaaatagccaggcatggtggtatgcacctgtagtcccagctactcgggaggctgaggtgggagatctcttaaactcaggaggcataggttgcagtgagccaagattgcgccaccatgctccagcctgagtaacagagctagaccctgtctcaaaaaaaaccagaagaatcttggaaggaggggtctaaggttctagggggccagcagagctcacttttctagcctcttgaaggactctgggttagaagtaaattaggtctgggtgaaggatgggaaaagtcagtagcaggggttcttggactatgggaagctattggaaggggttatcagctttcccctctccctcagatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgtttttttgtttgtttgagacaaagtctcgctctgtcacccagggtggagtgcagtggcatgatctctgctcactacaacctccacctcccgggttccagcgattctcctgcctcagcctcccgagtagctgggactacaggcgtgcaccaccacgcctggctaattttttgtatttttagtagagacggggtttcaccatgttggtcaggctggtctcgaactcctgacctcgtaatctgccctcctcgacctcccaaagtgccgggattacaggtgtgagccactgtgcctgtctgagctctggtgctgttcttccccctagaaaagaatctctagtgtggattctgcccagacaggctgacctgagaaaggcacagtggttcctccattccttccccatcatctgagtgttccagtatcccccatccctctcaatccagtcacctgcctattgacatctagctctgtttcccctgtcttgtccatgtctctaagacccagtaccagactgaactagcagcaagaaggacgaggaggccgggcatggtggctcacgccggtaatcccagcactttgggaggccgaggtgggcggatcacttgagattgggagtttgagaccagcctggccaacatggtaaaacccgctctctattaaaaatagaaaaatcagctgggtgtggtggcacacctctgtaatcccagctactcaggaggctgagacaggagaatcacttgaacccgggaggcagaggttgcagtgagccgagatcgcgccactgcactccagcctgggtgacacagtgagactccgtctccaaaaaaaaggatgaggaatagaattctgtgcagatgtcctgacttggcaattttgtgtccctgcctcactgtctccaccaacccccgcctgtcctagtgttgttctgcctcctgtcctctcttgctctcttgtcagtctctggcttcctcggccccatttcacttcactgagtcctgacacccatctccctaggggcctgtgagaggagagggaagggtctgttctgctcagctccatgtcccccattttcctccacaataaactgggactgggctaaaactgtgtcacattgtttgtggggtcaggctcaggtgtgggcaggtaaacacagattaaagagggttaatgcctggcgcagtggctcacgcctgtaatcccagcactttgggaggctgaggcaggcggatcacctgagattgggagtttgagaccagcctgactaatatggagaaaccccatcgctactaaaaatacaaaattagccgggcttggtagcgcatacctgtaattacagctactcgggaggctgaggccggagaatcacttgaacctggaaggtggaggtggcgatgagccgagattgcaccattgcactccagcctgggcaacaagagtgaaactgtgtctcaaaaaaaaaaaaaaaaaaaagggttagtgaggtttgggatccaaataggattgcagagccctctccattgcacttggcgtttgtcgcttcctctcggcctcctgtaaagggcacacatccctccccaccctctgcttagctggagatcaaagcatggggactgtgattcttcccagccttaaacataccctacaaaacctggaaagttagaccctgatgatgccaggtcttttcacctaagaaaagaaactttaggccaggtgcggtggctcatgcttgtaatccctgaactttgggaggccgaggtgggtggatcacctgaggtcgggtttgagaccagcctgaccaacatggtgaaatcttgtctctactaaatatgaaaaattagctgggcatggtggctcatgcttgtaatcccagctacttgggaggctgaggcaggagaattgcttgaaccggggaggtgtaggttgcagtgagctgagatcacgccattgcactccagacagggcaacaagagcgaaactctgtcttaaaaaaaaaaaaaaaagcctgggcgcggtggcttgcctgtaatcccagcactttgggaggccgaagcaggcggatcatgaggtcaggagttcgacaccagcctgaccaacatggtgaaagcccatctctactaaaaaaaaaaaaaaaaaaattagttgggcatggtggcacgtgtctgtgatcccagctactcaggaggctgaggcaggagaatcgcttgaacctgggaggcagagtttgcagtgagccgagatcgtgccactgtactccagcctgggtgacagaccgagactgtctccaaaaaaaaaaaaaaagaaactttctctttaaaccagaaagactcaggaactcagagccacatgccagagttacctgctgctggggccctggactcctgccattccttagttcttttcaaggattctggcatccaggatgccctctcgaggggcccaatttgaggggcaaagtgctgagagcactgatgttgggctgcagtggttggatcttcatgctaatattttaattttgaaatagtgcaaacgtatagaaagcaaggatggatacaacagccttttccatacactggataaacatgctggacataacgctgctctgagtcaggcttggtattgagcagcaggactcccagatgagtatagccaggtgtctgcccttccaagtcttgcagcccagtgcttgggttatgaaacctttttctgaaaagcagtgcagctttgtggctgggaggtccaatcccagcccctctaccacttggatatgtcagtctcttcagccccaccttggtcacctgtcaagtagggatagtgcctcagatgattgagaaaacacatgtaaatgtgcatacacaagtagaagttaaggccttttccccctcaaaaaaatatatttgccctagagtcaaatgcatacacaatgttcagcttttttttctaaggttcttactatgttgcccaagctggccttgaactcctgggctcaagagattcttctgcctcagcctccaagtagctgggactacagatgcacaccaccatgctcacctggctgatttacttattttcaaacctttttggtaaaacattcagaagcttgcacatatcacaagatggatttttgtaaaccacacatctgtgtaaccagccaccaaatcagcgtgaagacctttacctgcagccaagcctgcctctgttcccctctcccaggtgctcttcccagctctggggtagccgctgtcctgactggtagtagcttagatgagttctgtctgtgcttgatggaaatggcatcgtacgcatctgcttttacctatatagtgttttgcacacgtgttaacaaatctgtgtggcctgtactctgacggaaaataccaaaccaatgataattaagtcatgaggcagttggcgtacaaagagaggtacaaacccttaatgtgccccccaacccccaccttgctaagtccacccttctccatgacctctgacgtcagtataagacagagaaaggcccaggtttatagcaggtcaacctggaagacaccctcagaggctgaagaacttggcccagaattgaagagaccaggactccaataaggtctaacatctctttgagagtggccttctcggctcggggtgactcacgcctgtaatcccagccctttgggaggccaacgcaggcagatcacttgaagtcaggagttcgagaccagcctggccaactggtgaaaccccgtctctactaataaaatataaaaattagccaggtgtggtggcatgtgcttgtaatcccagctactcgggaggctgaggcagaagaatcacttgaacctgggaggcagaagttgcaatgagccaagatcacaccactgcactccagcctaggtgacagtgagactgtctcaaaaaaagagtggccttctcacccacctccttctacctgggcctggtcctttcgcagcccccttcccaccaacatagccctctaaacgcccctagcccccacacagctctggtctgacagcactgccgaggatgcccactaactttctggcattcaccataggagggctttcatttcctctttctctttttgtgtctagagcaaatcacataccaaggcaggacaagaggacagctcagcagagctgggggtcccttacctgacccatggtagggcagttaggcaggtgcacctccctcagccttcacctccaccagaagaaagagacataccaaacagtttacacacaaatttatttgggagaaacatccagggactaggggacaagagaggaaacctggtgggcagtagggctgggggtacagagtagcagtaagtgtgctgaagggcgtcaaccaagaggaagagccaaggctggggtccagtggctggagggaggcaaggagggctggtatgagggactagaagtcctggccaagcccagatagaagtcaggaaggtggctggaaactggtggaattttacaccaaagtttgctgcagtcacactaaggagtatagagccctctgttttgagggtcattgcagaaatccaggaagcagtattgagagaatatccagaagccagacaccggagaagttcgggtatttgaacaatcactcatctgctccttacttcggcagtcactcaccatgacgtcagaaccgctgcctggggagggacagtgggcaccagtgatacggaagtccccaggaagagccccaaatcctctcatccccacactcataagtcaaaaaaaaaagaaaaagaaaagattcctgtagttaggcatgggtggacatgcccagtgttcaccagccatggaactccactgaagttcccatgcaaggctggaggaaaagagccatatgaaatgtaatggttggagggggagttgggagttactgagccaagtgaggagaactagcaccataggaccatgtgagaaaaagctgggaaatgttttggagattgggtggcaggaaggaggtgtattgttatttatttttcagaccaaaagagaataagatgatgtctgctgctgttatacataatagagaaaaatctttgtgcctgcatcccaagaagtcatgttcagggatgtttgctgctgccctgcttgagagaaatgaccaaaatgcccatcaatagtgggatggggaaatcagctgtgatatgcgcatgctatggagtagtatacagcaggtcaataaaacaaggaagctgtttacaaactgatatcggaacattcagttcccctaacttaaatgtggaataatgtttacagtgggatgctactatcttgggttggggcgggggaagaggtgaaaaaatagtaaacagcatatttgtgcagggtggaatgtgcataaaagattgcaggagggatcatccagaaagtaaaaaaagtggtcacatgtgcaggggagccaggtgggttagggtagtagcgggagactttggtttgatggtattgtatactctgatatttgacccacatctgtgcatcggctatgttaaaagggtagtaagaggacttgaacacaggcagctgcatgcagtggttgttgagagcaccatctctggagccatcacaaattctggctcagcatctgtgagactcaggcaaggttatgacctttctgcacctgtttcctcatctgtaaaatgcacatagtaataatacctgcctcagcggattgcaagtgtttagaacagtgcctagcacatattatgtgttacgtttttgctaacttaagaaaggtggggggtcggtggaagagcaggcatcgggaaggagtcaattttcagcgagggagatgtccagtggtcaacgggatatgaggagagcggtttgacataacattcagattcagaaggaagtggtatgtggctgctggttgaagccagcaaagcagataaaatcctctgcttttgagtatatgaagtgggaagacagctaaggaccaaaccttggtgaacatgaaccactaagggtcagagagaaaacgctccatgaaggagactgaagaagccgtggaggatgcaggagaagagcaacaccagcagtaactgcagacagatgcggaagcagacagcttgaggacaggcaagggcacctggagatctggagggtccccgtcaaagctgcgcaccttgatagggtagaagctattcagctacagattgaggagagaaggttagtggaagtggagacagagtgtggctctgaagaaaagggaagagaggctgggcacggtggctcacgcctgtaatcccagcactctgggaagctaaggtgggtggatcacctgaggtcaggagttcgagaccagcctggccaacatggtgaatccccatctctactaaaaatacaaaaaattagctgggcgtggtggcgtgcacctttaatcccagctgcttgggagactgaggcacaagaattgcttgaactggagaggtggaggttgcagtgagccaagattgcgccactgcactccagcctgggtgacagagcagcaaaaaaaaaaagacaggattggagcaatgtcttatgggattatgggaacaagacttggggtgcagcttaggaggctgagagagtttccgtttgggagagtgctgggcccatgacaggagaaggccacttactgttctttttgtggagagtgatgcagctgctgccagctggggtgaggcagatgtcagatcccagaaggcaccctaactccttggtctccaagaggcatcggtagcagcgcaggtatttggggaatggaagtggttgagggggttcccaattgacaggaacaaacttacctagaacacagagaagtgctgaccccactcacaccccattctacctcacaccctaccactgcctgattccaggccactcagccccactcctccctcccttcctgtctcagaaaaccatcaaagccccaattctctgcttccttccccaactgcatacacatacatcccccttttcctctggtcctaaggccagaccacatgttaacaaatccccagacccagcagagcacttggtgttaggcagaggaaagtgctaaaccaacactttgaatcctgtgtctctgtggctggtgctttgcagccaagtggggagcccagcaggctggactcagtcttgttctatcctgtggattctggttttctcatccagcacactccctaaccctccctattctatgttgccctcagatccagagaggattccttcagtatctctattcaggtcactgctgtgaagtgagacagccctggggtggtcactagaaatctccttcagaggctgggtgcggtggctcacgcctgtaatcccagcactttgggaggccaaggcgggcaggtacctgaggtcaggagttcgagaccagcctggccaacatggtgaaaccccgtctctactaaatatacaaaaattagctgggcttggtggcttatgcctgtaatcccagttattcgggaggctgaggcatgagaatcgcttgaacccgggaggtggaggttgcagtgagccgagatctcgccactgcactccggcctgggatacagagcgagactccatctcaaaaataataataataataaatttttaaaaatcttcagattgcacatcagtccatgagcaggcattccctaccaaacccatctgtcccatctctcctcctgcatgggtttacctgagcatcctggacaggtgtacccagacacttggtgtctgtgggtttctccatccaggccaggagacccttctgaacccttggagccacttaccaaacaccaagctcatcatgaccagcactattaagaggaccgtgtagagggcttgggggctgctgtggaagcacaggggacccagactctggctccctgcagggcctgccataaaacgcatgactgcctgctggcctccagtttgggcttatattggtggaagagaggttggccaagaggaaggagagaggcaacaccagctcagggtggaaatcagtgccagaccagccagaggggcagaatgttcgcacccacagccactctggggcataacatcctgcttgagggcaggggaccagcaataggggaatgagaaaaggaactgtctttcctattaattggacagatgtttattgaatcactgcatcagatgctggggatacaaccctgcacaaagtctccaccctcacagggcacagtctagtaggggagacaagtccaccagcaatgatgtggggagggcagagtgctgccaggagcacctcgacagttaaaccactgaccagagggatttcggcagaggagtaacttgatcggatttctgtttataaaagattgccatggctgcacattgcatttgggtcaagagtggaggccgccgggaagtaggacgctattcccgagtccggtcacaagatggcggactggtccggcagaagacgagcagggacgaggaagcggggctaatgaacctgagatacagttagaagactggacagatttgctgttggactgaacgaggggtgagggaacaggggtaggcttgcacaaggaagtggtaccattttccaagataggaaacatgtggtctgtctcaaaaaaaaaaaaaaaaaagcaaatagggggtgcccagtcccacttctcataccctggggacacctgtcagacatcctaaaacaaggacacctggatcccaagcgatacgtactcagctcagtgctcccttggggttccaggaacccagcgccttccctcacctcatcctttttcctgccccgcctgtgctcagctgcggctcagtgggcctgaactccggagcccacagaatctggcgctgggcgtccgctctccgcgcctgaccgcacctcagaactccggtaggacgggggggtggccccccgctcaagctctgttccctggggaagaaacctggaaagtgcgaaccgcgcgtcgggacccaagcgtcgggccccagcggacatccggagcccgaagcggctccccaggaaggcggcgccgtagcgccactctccctcccaggcgaattctggagaccgcggccccaggcgtctcacccattttctccgctggggacccgctgggctccccatccacgcctactcggtccccaccccaccagctcagtcttgactcagaaactcagggtttttacttttaggatcgttgggctgtgcgttaggggaggaggtggtcctcagcgtcctggaacgacaccacctgctccaatttcccgtctggaggttctggtcgaggctccgaactcgggttccctgctacctcccagactattcaagaattatccagtcccaggatgataagggggaagatgggaagaaacagacgggagacgcccgcccagaaagactgcgggaagaaagaaattcgagaggaaactgcacgccactgagcgcctcccaaaagccttggaatgaatgaatttaaaaactatattagggccggactgcggtggctcacgcctgtaatcccagcactttgggaggccaaggcgggtggactacctgaggtcaggagttcgcacccagcctggctaacatggtgaaaccccgtttctactacaaataccaaaaattagccgggcgtggcggctcatgcctgtaatcccagcactttgggaggccaaggtgggggatcattcgaggtcaggagttcgcaaccagcctgagcaacatggtgaaaccccgtctctatcaaaaaatacaaaaacattagccaggtgtggtggcgcacgcctgtagtcctggctactcgggaggctgaggcaggagaatctcttgaacctgggaggcagaggttgcagtgagccgagatcgcaccactgcactccagcctgggcgacagagtgagactctgtcttaaagaaataataacacaaaataaattgtattagagaaaagccagagtagtggagaactgcagaggaacgcggggcacctaca

SEQ ID NO: 296 - DNA, 31147 bp, Homo sapiens
ttccttcctaggcatggttacgtactttcacctttggatacctggttttgctatcctgactaaaccattatataaactcacaaaagcaaacctagctgaccccatcctaaatcctttcccccactcctctttccattccttaaaaacagccctagaagctgctcccacactagctttccctaactcatcccaaccctttttcattacacgtagccgaagtgcagggctgtgcggtcagaattcttacacaagggccaggaccccaccctgtagcctttctgttcaaacaacttgaccttactgttttaggctggcccccacattatttctgataccacacctgacccccgtgactgtgtctgtctaatccacttggcattcactccatttccccatatttccttctttcctgttcctcactctgatcacacttggtttattgatggcagttccaccaggcctaattgccactcaccaggaaaggcaggctatgctatagtatcttccacatctatcattgaggctaccgctctgccccactccactacctctcaacaagccgaactcatttccttaactcgagccctcattcttgcaaaaggactgcatgctaatatttatactgactttaaatatgccttccatactgcaccaccatgctgttacatgggctgaaagagatttcctcttctcaaggccgctttatttccaaaggaagctggagtcattcactgaaaaggccatcaaagggcctcagaccccattgctcaaggcaacaattatgctgataagacagctaaagaagcagcctgtattcctacttctgtccctcatggccagtttttctcctcatcagtcactcctacttactctcccactgaagtttccacatatcaatccctccctactcaaggcaaatggttcttagaccaaggaaaatacctccttccagcctcacaggctcattccattctatcgtcctttttaacctcttccatgtgggttacaagccacgagctcgcctcttagaacctctcatttcctttaagacatttgccctgcatttcactccatccttggctaccttccccttgttcttcggactctcctcctagctgtcctcttgcttgcttatacctggccccatgaatagcagtgaaaggttattcatagacactatgcgctttctcatacaccataaaaatcgaacctccccctctacccagttgcatcatcaatccccattgcaacctctacctcccaggtacaagtgattctcctgtctcagtccaagtagctcagattacaggcatgcaccaccatgcctggctgatttttttgtattaagtagagatggggtttacaccatgttagtcaggctggtcacgagttcctgacctcaggtgatccacccgcctcggcctcccaaagtactgggattacaggtgtgagccaccacacctggccagactacctgtcttttaactagctctctgagctctgggcagggcccacactgaatcctgggtttccaaaccgggagaattattctgaggctagactatctgatgtttttacagtgcacttaaaaaaaatttttttttaaaacaaagatatttctaagtgtctaaactacacccttctttaaaaacccagagtaccctgtgttgcaataattattatagtcaatatatccggtaacacaatacaaaagcaagcagcttaaaggctgagatgaacttgtctgtttacacttttggggttctataaggaataacaagtttctccccaaaagggagtctggcaacttctccgttttcttaaaggaaccccaggtgattgtaaactattttaggtccctcatgcagcagagggtacaagagaaaggagagacaggagaagtgaatgaagaaaacagaattcagtcaactaagaagaaaaaacttttcctcaaaaataaaggacaacgtcctaggacagaaaaaataaatgacggcctttgaatacaaacacacatatgcacacgtacacacacacatcttggatgttagcttttaattaagctgactttaaccattgagctcctttaaaaaaatgtttttaaatttcattaccatttttgagctgggacaaattgccgctgtttcagaagcacagccattgctctttcagtttcgcctgactagcaaaaaggtggcctcgttatgtaaataaagcccctaaaggggctaaagtagtcaaaatccaaaatctgtcctcttttctcccttttgctggctgtttttctccctcaccacaccgcctttcttttttttttttaattcaaccatttgagaggctttgttccacaaaatttggaactttcctttggatttgatcaagtcagatctttcacgcgcgtatgtgtgaagacatcaccaaacaggctttgtataagcaataaagctttttaatcacctgggtgcaggtgggctgagcctgaaaagagagtcagcgaagagagataggggtggggccattttataggatttgggttggtagtggaaaattacagtcaaagggggttgttctctggctggcaggggtgggggtcacaaggtgctcagtgggggagcttttgagccgggatgagccaggagaaggaatttcacaaggtaatgtcatcagttaaggcaggaaccagccattttcacttattttgtgattcttcagttacttcaggccatctggatgaatacgtgcaggcttgggctcagaggcctgacattcctgtcttcttatagtaataagaaaaataaaacaaaatagtgttgaagtgttggggtggtgaaaattttgggaggtggtatggagagataatgggcgatgtttttcagggctgtttcgagcgggattggggtggcatgggaacctagagtcggagagattaagctgaaggaagattttgtggtaaggggtgatattgtggggttgttagaaggagcatttgtcgtatagaatgattggtgatggcctggatacggtttggatgaattgagaaactaagcagaagatcctgctacagttaactactacagttaaccagcccaacctattcctttaattcggcccatcccttcatttcccataagggatacttttagttaatttagtatctatagaaacaatgctaatgactggtttgctgttaataaatatgtgggtaaatctctgttcggggctctcagctctgaagactgtgagacccctgatttcccacttcacacctctatatttctgtgtgtgtgtctttaattcctctagcgccgctgggttagggtctccccgaccgagctggtctcggcaagaaagaactaaaaagctaagggaataccaaaacaaccaaatggattcttggtttgggaacaaaatcgtagcatgagtcatccccattcctgggccatctcctaataatatgcccaggactaatgttcttaccctgcctaataaacttttttcaaggatttttaactgacaggatcatggccatttcacagacaactaccccaaaacatctacagatggcattactcctatagtcaatccgaaaccagaaaactctccatccccgtcaaaaggaagtagccagaaagaacatgccgcccctcttttttttttttttttttttgggggggacagagtctaactctgtcacccaggctagagtgcagtagcatgatctctgctcactacaacctgcgcctactgggttcaagtgattctcatgtctcagccttccaagtagctgggattacaggcatgcgcccaccacacctggctaatttctgtattttagtagagacggggtttccactgtgctggccaggctggtctcaaactcctgacctcagatgatccacccacctcaacctcccaaagtgctgggattacaggcatgaaccaccgtacccggcccttttttttttttttctttttttgagatggagcttcgctcttgttgcccaggctagagtgcaatggtgcgatctcggctcactgcaacctccgcctcctgggttcaagcaattctcctgcctcagcctctcagcttgctggcattacaggcgtgcaccaccatgcctggctaatttttctttttctgagacggagtctcgccctgtcgcccaggctggtgtgcagtggctcagtctcggctcactgcaagctccgcctcctgggttcacgccattctcctgcctcagcctcccgagtagctgggactacaggtgcccgccaccacgcccagctaattttttgtatttttagtagagacggggtttcaccgtgttagccaggatggtctcgatctcctgacctcgtgatccacccgcctcggcctcccaaagtgctgggattacaggcgtgagccaccgcgcctggcctaattttgtattttttttagcagagatggggtttcaccgtgttggtcaggctggtcttgaatacttgacctcaagctatccactcgccttggcctcccaaagtgctgggattacaggtgtgagccactgcacctggctgcccccgtcctttttatcactatagagtctggactgacggagcaggagcactgccatcttggacaagcactgccattttaagttttgccttgatcaaaaactgcctaaatccaaagggcatcagcctaatggctaaggtcagcatgaccataaaccacaaatgacatctctgaccagaaacgttccaagcccctccccagccagagacatgccagccccaagataacctccccttcggctggagaggtgtcagcctcaagataacctcccctccaaccagagacattccaactccaccataaacttctccctgacacagaaacattccaagctctctccaataaatactgttagtctgggccagacgcggtggctcacgcctgtaatcccagcactttgggaggtggaggcaggcggatcatgaggtcaaaagattgagaccatcctggccaatatggtgaaacccgtctctactaaaaaaaatacaaaaattagctgggtatggtggtgcgtgcctgtaagtcccagctacttgggaggctagcaggagaatcgattgaacccgggaggcggaggttgcagtgagctgagatctcgccactgcactccagcctggtgacagagtgagaatccatctctaaataaataaataaataaataaataaatagtctgtaagagagagcactcctgactgaaatcagccagaagcccctctcaggtttgatttttgagctgctttttgtgtttctttcctctttctttaactcttactgtgactttgaacggaatgggaggcagattggccctaagcagttcccagcttgacttttccttttagcttagtgatttggggcccccaagatttactttcctttcttactacccaggattccttggggtgagctgctcattgagtaggctgcctagcctttggcccatgccagtgaagcccctgtccccatctctctagtaggccacacaacaccttctgggaggtaccactggcattgtatcatgagataaaataaaacaataactaaatagccaggcatggtggtgtgcacctgtagtcccaagctacttgggagactgaggtggaaggattgcttaagcccaggagttggagcctgcagtgagctgtgatcatgccactacactccagcctaggtgacagagtaagacctcatctctaaaaaaacttttttcttttctttttttttttttttgagacagagtttctctcttgttgcccaggctacagtgcaatggcatgatcttggctcactgcaacctccgcctcctgggttcaagtgattctcctgcctcagcctcccgagtagctgggattacatctaattttttgtatttttagtagagatggggtttcaccatgttggccagggtggtcttgaactcctgacctcaggtgatccgcctgcctcagcctcccaaagtgctgagattacaggtgtgagccactgtgcccagctctgaaaaactttttaaaataaataaatattagaatatgtgggaaaataaaattaattaaaaaaaaaaacagtaactacaatagcaacagctactatttactgaacacttactccacctcacttaatcacaactctttgaagtaggtactattatttccatttttacagatgggcaaattaaggctcagaggcgttaagcaacttgcccatacagacagtaagtgttgctggtgattcaaacccaggtccgtctggcttttggaactcatgtcctcacattcactggtctgcagagtagcaccaagtaccttttaccaccctgaccagctcctgggtactgccctcctgcctgcaggcctgaacaccatgacatccagctagcccctgtcccctatgacatccttctccctcttgccaatgaaacccagtagatcaggctgcctgacaaaaaaatttcttgtgatgccttggactgtggcattcatcctaaatgcctccctaacagcatggcccattgctcctctaagagtctggctcacactcttactgagtttttgcttatgccctttgcccttcttggatgcccttccctaacccttcaagggccactcagttgaagttccagaagactacaaattcctcaatccagtcatctcacacaattctgggtttcagagccagaagtgcccccaccacagaaatctctggctcaatgccaagtcaggaagctgcaaagagcaaggagggcctgtgttccagtcctcaaaggatggggaaggggaatgacagccaggcagctgttcctttcagatcccgaaccgtcagatttttcctccaaatcttgcttgggacaaggggttaaatgatgttgacagaagggtgattgaagaaagagacaggactggttgagagattgcccaacactttgggaggctgaggtggaaagatggcttgagcccaggggtttaaaaccagcttgggcaatatagcaagaccccatttctaaaaaaaaaaattatttttaattagctgggtgtggtggcgtccgcctgtggtcccagctatttgtgcactgaggcaaggaaaatcgcctgaacccaggaggtggaggctgcagtgagctgtgattgtgccactccagcctgggtgacagagtgagaccctgtctcaaaacatataaacgtgtgtgtgtgtgtgtgtgtgtgtgtgtgtgtattccagggaacattaagacttagaggcaaactccagaacttaaagaaaaaacatgaaagtgctaaaaaattccgtgcttgtggagagagaattccaactctttccctgaacccgggctgagtcccttcgctgtgaggttggggggatgagtgggagcccagtgcctggcgccgagtgaaggcagccattgtgagttcctgggctggggaagggaggctcagtgcccaaggatgtgaccaggcgtgaggcccggggaaagagcagcgcggcgaccccgcagtatccgaggcgacagggtgtgggggagggggtggggagtcaaaggcggagtcacgggctccgccctctttctcctgcttggcgcgagcacaggcaccgcgtggttctcacaaccagcagctcggctcactgagacccggtggtccagacgctgctcctggctggggtggcgctgcagggagaaccgcgagctctcaggggtcggcgggtgacttctttccggaagaaagcgaggaacgcgctctgcggggtgagccggactccccaactccggacgatcagcccaggactgagagccccgaagtccccaaccacaagtaagcggccccagaaggacaagtctaggtcgccgtccagagcgccatggccgcgcccgcccttcgtttgtgccacatcgccttccacgtgcccgccgggcagcccctagcccggaacctgcagcgcctcttcggcttccagcccctggcttcgcgggaggtggacggctggcggcagctagccctgcgcagcggcgacgcggtctttttggtgaacgagggcgcagggtctggagagccgctgtacggcctggatccgcgtcacgccgtgcccagcgccacaaacctgtgcttcgacgtggcggacgccggcgctgcaacccgggagctggcagcgctgggctgcagcgtgcctgtccctcccgttcgcgtgcgggacgcgcagggtgccgccacttacgccgtggtcagctcgcctgccggcatcctcagcctgaccttgctggagcgcgctggctaccgcggacccttcctacccggcttcaggcccgtgtcctctgcgcctggccccgggtgggtcagccgcgtggaccacctgaccttggcctgcacccccggcagctcccccacacttttgcgctggttccacgactgcctgggcttttgccacttgccgctgagcccaggtgaggatcccgagctgggcctcgaaatgacagcagggtttgggcttgggggactgaggcttacagccctgcaggcccagccgggcagcattgtccccactcttgttctggctgagtcccttccgggggcgacgacacgacaggaccaggtggagcagttcctggcccggcacaaggggccaggcctgcagcacgtggggctgtatacgcctaacattgtggaggccactgagggggtggcaactgctggaggccagttcctggctccccctggggcatactaccagcagccaggaaaggagaggcagatccgagctgcagggcacgagcctcatctgcttgctcgacaggggatcctgctagatggtgataaaggcaagtttctgcttcaggtcttcaccaagtccctttttactgaggacactttcttcctggagctgattcagaggcagggggccactggctttggtcagggcaacatcagagctctgtggcagtccgtacaggagcaatctgccaggagccaggaagcctaaggatgcccagggctgggtgcagccagctgtcctgcagctctggggagaccagcacagaactgaggaacatctgcaggaggcccaactagtgaaaggctttgcctccggggggcaggtgtgacttccatttcatcagtgcctgccagaagctgtgtctctcattgggctccaaagaggtgggattttttaaaactaaaacatttcttatatacagtctataataaatatgtaagatacaaagaacaataaaagaattacacactaggaaatagaacataaccaatactttcgagtcctccctgtgtcccgctgtgattctatttcctcccacccactcctcaaatcctgtcattattagccctttgcttttctgtattgtttcactccgtatgtaacataaccctaaataaattatttcgtatttgaggtaggaatttaaaacagaacaaatcttctcctgtgcttcctctccccctagggagcgaccactcaggtggggaggggctgggtgagagttgagcccaactacctactccagagtgatgccaccactccaattagagctgacctgagacgtaaacagagggtgttgtgtgtcagccactggcaggttctccctgtagctgccttgcctttctcctgggggttggagggcagatcagtctggacagaacacccccactccaaccccatctgcccggggctggctgggagttcagccagagaaagtcagaaccaagcagaacgtcaccacttttctgggtccctccctcagatataaggggtgagggggctagggagagggtggaaggctgtccaaaatagctacaaaagggcgggcgtggtggctcatgcctgtaatccaagcactttaggaggctgaagtgggagaatcacttgaggccagaatcacctgagttcgaaaccagtctgagcaacatagcgagacccccatctcaaaaaaatacaacataaaataactacaaaaataagcactttactaacaacaggattctcagggaatgggggctttcagaggtgtcactgggctgcactgttgaggctgtgtgcatcagtggagatgtgagaccgaaagaaattatccaggacttgctggcccatgcggggctttttccgactgcacggagaggacacctgggaccttttggaaccctgtgaaaaaatggaaggagggaggccttgtagttgggggagggggagcagagaatcctctccttgtcctctctccctttccccgactctactgatctagctaggcttagcctggaatgctgtagagctttcatcctgcctcaagtatctgccccatcaatcaaccctccaaaaggctgcctgagggaatcgaattgtcctaaaaatgcaaatctgactcctctctcctccacctaaaatgagtcagcagcctagggctcacaccctgactgacccagcaggccctgctgacctttccagctaaaccaactgctcacagctccttgagcactgcagcctgcactgggctccacctttgctcacactactcttgggactggaaagaacatcgctacggttgattcccctcccaaacctgaagaaaaggattcatttctaggacgaagattaccagctgcttcctccaaacagcctttcctgatccgtctcccaattagaactgatagctcccatggatgggtgtggtggctcacgcctgtaatcccagcactttgggaggccaagatgggcagatcacttgaggtcaggagttcgagaccagcctagtcaacatggtgaaaccctgtctctactaaaaatacaaaaattagttgggtgtggtagcaggcacctgtaatcccagctacttgggagactgaggcaggagaatcgctttaatccagttgtgggagattgcagtgagccgagatcgggccactgcactctagcttgggtgacagtgagactgtctcaaaaaaaaaaaaaaaaaaaaaaaagaactgatggctccacaattcatatcccacaaaactcagtacaggcatttcacacacctgtgacactggagagtcctcatcatttttttcctttccctctaccctgcaccccacaatggaaggtctccaggtcaagaactattcctccctccagtgaagcctggagtggagaatgttcacccagacattcgttagttaactgactaaaaacctatggactcaggcctggggagacacggttgggagaggcctaggagacttaccatacaggtccctggctgttggccctgatacacacggaaaacctagacaagaagacagggaggtgagggctggcactttttgcaaaagagataaaccggtgttctgcccttaacttcatgtcccagtacttttgtttaaaatatgcttttttggccaggcatggtggctcacgcctataatcccagcattttgggaggccaagtcgggtggatcacttgaggccaggagtttgagaccagcctggccaacatggtgaaaccccatctctaaaaatacaaaaaatcatggctgggtgtggtagctcacacctgtaatcccagcattctgggaggctgaggcgggcggatcacttgaggtcaagagttggagaccagcctggccagcatggtgaaacctcatctctactaaaaatacaaaaattagccaggcatggtggcgggcgcctgtaatccgagctactcaggaagctgaggcaggagaatcacttgaacccgggagatggaggttgcagtcaaccgagatagcgccattgcactccagcctgggcaacagagcgattctccgtctcaaaaaaaaatgctttttttcctgtttacacagtaatatattcatgtagaacatgtaggaaacacaaggaagtacaacaaagacaacaaaggtagtgcctttttcatggcggtggaaacagctgcggtgtgaaattcctcctgcgtcagccagcgagcacctggtggtacggtggtcactggggtctgcccttccaaggccagcccatatacttgatatgtcagcttgatgtgagagaaggtgtggacaacctggaggaagggtcaaggggttcaaataggcctgtggatatagcctcaaaagccaacatccttggctattccgctgctcacttacctccccaaggtgccggaggtgcgtggctgggaggggcccagcccaacgctgtagttcctgcagcagggccttgcgctgaagctgctctgagggctcccaggtcacggacgggaactcccacagtcctgccagcagacctgagagggagggcagccaggcaggggtcaggcctcagctgccgattccctccattctctcttgttactcatgccactgccctccacgcccagtatccaggtacctgagttgggcctctgcaccagcagaatttgggccccaagggccccaggctgttccagaacacaggtggcagagctctcctccctggggggcttgcggctggcctttctggggaagttgaccactcccagggtctggtcccagggctccgagggaggcaggcacaggtggcactgtccagtgttgggagctgggaacggagatccccgaaccctactcaagccaagagggctttaggggccaacctagagagtgggctttggccgggttctgcagaatcttactcaggttagaggaagaactggaatggggcttctgactgggccaggaagggttggggtgggggctaggtttggtgctcaccacactcctccacgtcaggactgcccgacaggctccctgaggctaagagctgttcctgctccacctgagaggcacagggttgagtgtcatagggcagagtcactccttaggacttctcactgccccttccccagtaggcttactctctggcgtgcccggcacaggctctccacagggcactggctgcacagtgggcgctgtggggtacacactgtggcccctagctccatggctgcttggttgaaatctcctggccgggctgggtccaccagctgctgggctagacccctaaaagaagggaacactgctgtgaagcagagctcctttgcagacacccctgaagcacccttgttaccccaacatcctaccagagctgctgggaaacaagggtgctgctgggatcagcaccaatggctcggacacggcacagcacccgtgctacgttgccatccaccacaccggttgcctggcacagaggggccaaagagttagcctgggctgggaggaaggaggctgggcacgcacaaagtgggggtgggctgtgagatcacctggccaaaggcgatagaggcaatggccccagctgtgtagcgccccacgccaggcaggagctgctgcagggtctctgctgtacgtggcatgtggccccctagctcctctaccacctgattggagtgcaagactcaagattataagacacccaagactcctgggttcctaccctcctgccatccccttaccttccgagctccctcctgcagccgccggccacgagaatagtagcccaggccagcccagagttgattcacctcctgtgggtaggatcagaggtcaaagagatcacccgtcagtccctctattgttcctatttcccctaccctagggtggctctcacctccagggaagcactggccaggtcctgcagtgtaggccacttctatagccacaggcaggcagaaagagacaaggtcaagggtgaaggtggtagaggaagccttctctacacccaccccaaagtagaggctctcatctggggtctgacccatgacccttcccttcctcccctggagtcacctgcatccatccggtatagtagttgatcacagtggcaacctgggtctgctgcagcatgacctctgagacccacactgggggaaaggggttggcatgaggacactgctgacctgcccctacctggcccacagcccccagacccaagggcctcgaggcaaagtggccctgctctcaggagatgtactgaccagcatatgcccgcctgtccaggtccatctcatcttctgcctgtcaatgcaaccccagatgaggagttagggtggagggggctgggtgcctgcctcccacccactgtccctgctcctcgcctgcctacccgtcttctccatggtaggtcccgtttctcttggtcgtaccagcttagcaggctccctcggaaggctgtgacttcagctacgtctctgaatagatggtatgaggagacagaggcctgcaataccacctcttccggctgcctggccaggcctgctggggccccaggacactcagcaatcatccctgcacaggctgtgcatcagggtcttgggacacagcagcctgtggcagtatgctcccacttagggcttcccccaactaacccccttaagctttggagctggagtcagaccagagttatgtaattgtgtgtagctgtggctaagtttctggccttaattttctcagggtggtactactggcttgtctctgagccataatgaaaacctaatagttttagccagctagaatgtatactggtgcaggaccttcctattcacaaaacactttcaggctcataaactcatttggtcccatgaaagccacatgagggaggaaatgctgaactactgctccattttactggtaagaaagcagccattcagagcaattgtcccaatgtcacacagcaatacagtcagaattacaccctcagtgagtctcttttgttttgagacaagagtctggctctgttgcccagactgaaatgcagttgcattatcttgactcagtgcaacttctgccttccaggctcaagcgatcctgtcacctcagcttcccgagtagctgggactacagacgctcaccaccacgcgagcatagagaggggatttcgccatgttacccaagctggtctcaaactcctgggctcaagggatccacctgcctcggcctcccaaagtgctgggattacaggtgtgagccaccgcacctggcccttagtaagtctcttaatgtcttgatacgtatcacaatcccttcccagcctgaatctgcctttcatggccaatgagccttgggccacaacctagttccttaccatcacaggcagaaggcttggcctgactgttgttcttagcatgcttctgcctcccttcctggctggctgcctgcttcctgtgaccacttcccacggctgctcgtggcttcctcatgatggcctgaaacaaaaagacccagccaaagcagtcagtcacaatgaggccaaattttgaggccttccaagggtgatagctatctccctctcatccaccattcacatggggtccagcttctctcaagcactctcaagatgctcacgggtttactcttggctggctgcagcactgagatacaactagtatagctgagcaagtggcctcaagggggccggcgttacagccctggagacatgcaaagactgtgaggccagggctgggatgggtcaaggatgaaagcctcctgtttgggagcatttgtgtatctctgatgcttactgtgactgtgtgtgtggataggggttgtttaggtgtgtctgggagaatgggggtaggcggtttctctgcctcttagagatgtagcatggttacactgaaacagcctgtagtagtcattaagtccaaaaccttcattttatcctagaagaaaccaaggatcagagggacaaaagatctgtctgagaacagatggcaaatcagtgggagaacagagattagctatttttattcctaatctagtaaaccataggtggctgaccatcaacaatgagaaaatgtgcctggttgattttcactgctccctaactgttataatggccgccttttctctaacagctaaaattagttgatattttgtgagtgcctactctatgtcagaccccatgaagagctttaccggatctctcaatctcctggtgactctatgaggtatgtactagtatcacctccaccttagttataaggaaattgaggtttatggagattaagcgacttgttctttcaaatccacgaccagcattcttatactgtgataaaatgcagtccctgctaagcctctgtatcaaactctccccccaaacctttgactttaccacctcattttcatcaaaagagcttgcctcctccttcagaaaaaaaaaaaccaacttcaaatctacctccatttgcactgtcttaccctcctcctcttcagggtcctgctcctccaatcccgtctaactgttggaactcagaaactaataccccaggccaggcacggtggctcatgcctgtaatcccaacactgcgggaggctaaggcaggcagatcacttgaggccaggagttcgagaccagcctggccaacatggcgaaaccccatctctactaaaaatccaaaaaaattagccagacgtgctcgcttgaacccaggaggcagagcttgcagtgagctgagatcatgccactgcacagcctgggcaacaaagacagagcaagactctgtctcaaaaaaaaagaaaagaaaagaaaccaataccccaaaatatggccctctgacatgctgaactcaagaagccgcaaggtctctctgatccttccaccccagactctcccaaagccaggataaagttgttctctggaactctttatctgcctaaagtccaaactcactaaaaagaatacttgttttttcttcccctcccaataagactaacatgtaaccacacctgaacaaaccctttcacaggtattgtgtacctcaggatcactcaaattccaaagagaactattaacaagtcaacctctgtccccattccattctctctagtaatcctttattgcccttcaacagaatctccttctggccaaagttcggtttatttaaaaacaaatagagctggacatgctggctcaggcctgtaatcccagcactttgggaggccaaggcaggaggattacttgagcccaggagttcgagattaggcttgcaacatagcaagaccccgtctctacaaaaacagaaaaacagaatttctcttctaccccttgtcaggcctctgagcccaagctaagccatcatatcctcagtaacctgcacttatacatccagatggcctgaagcaactgaagatctacaaaagaagtgaaaatagccttaactgatcacattccaccactgtgatttgtttctgccccacgctaactgatcaatgtacttggtaatctcccccccacccttaagaaggttctttataatctccccacccttgagaatgtactttgtgagatccaccccctgcccccaaaacattgctcttaactccaatgcctatcccaaaacctataagaactaatgataattccaccaccctttgctgactcctttttttcagactcagcctgtctgcacccaggtgaaataaacagccttgttgctcagacaaagcctgtttggtggtctcttcacatggacacacgtgagacacccctcccataatctgttttgccagatggtatataaactcacgaactctgtagggagatgggtaatcactttatggttctcccaatgtgcatgttaataaatttgtatgccttttctccagttaacctgccttttgtgagctgatttttcagcagatcttcagagggcaaagggaaagattttccccttggctcgtaacacaatcaaatcccaccctccttcccttcatagccaaacttccttcaccaaacctgcttacttccacattcattctacaatctattctccaaagagcaaaggaatcttttccagatcacgtcacttccttccttataaccttcaatggtttcccattcttttttttttttttgggatggggtctcactctgtcacccaggctggagtgcagtggtgtgatcttggctcactgcaacctctgcttcctcggctcaagcaatcctcccaccccaataccccaccccaactccaagcagctgggaccacaggcgcacaccaccaccacatccagctaatttttgtatttttgttagagacagggtttcaccatgttgcccaggctagtctccacctccagagctcaagcaatcaacccgcctcggcctcccaaagtgctgggatacaggcatgagccacggcgcctggtgacaccccattatattcttttattttctttcttttctctttttttctccctccctctttccttccttccttttttcctttttctttcttttttaaatactgtaggcctttactatgggtcattaaattcttgagcaagctggttgtggtggctcaacactgtaatcctgctactctggaggctgaagtgaagaacagcttgagcccagaaggtcgaggctgcagtgagctatgattgtgccactgcactccaccctgggctcagcaagaccttgtctcttaaagaaaaaaaaagattgagcaaatatttatagagccccctaatatgtgccaagcagttttaggcacttggcatacttcagtaaataaaacatcaaaagttcctgccctcagggagcttatattctaatggggacagaaaaggaataatgaacataagtaaattccataagatgttaggtgataaatattagcataaaaagcaaaaattagaccaagaggggaaaaaaaagagtgccaaggtggggtttaatgttgcaattttaaagactgtggtcaaggtagacccaaagcattctaagtgagtgcaaaggccccaaggagggtgcctggtatgtctgtggtacagtaagtaggtcaatgtggttagaatggaatgagatgggactgagtggtagaagaggtcagagaagtaaaccagatgaggtggggagaggagggtcacaaagtaccttataggccattggagggatttggctgccacacccttgctcttagaaggcagtcctcttactacagccttgcaggtccagtgatccgggcaccatccgcctcatcccctcactatgctctagccaaggttgactgaatttagttgcttaaacacctcaagtgtgtctgcccaccttggggcctcacacaatccatttcctctgtttggactcttttatgcttttacctaacaccttatcatttttcaagtcttgactgaaatgtccaaatcaggtcccctcatcttatcctatcacatatttctgccttgtagctcttacctaatgtaattttacattactttgattctttccatcagtgtgtacttcctgaatttgactgtaaaaaacgacttgagtgcaaggactgattctcttgttgattggtgtgtgtccaaagtcagtgccaggtaaactgtacacaatagatacctgttaaatgaattaatgggatgggggatagtcaaaagagtttcccttttttaggataggagaaatccaaagagtttttttatttttgttttttttttgtttgtttgttttgtttttagagacagtgtgtccctcactttgctgctctgccactcaggctggagtgcaataagaacatggctcactgcagcctcgacctcctgggctcaagccatcctctcacctcagcctcctgtagctgggactacaggtgcgcaccaccatgcccaactaatttttaattttctttttgtagagacaaggtttcactatgttgcccaggctagtcttgaactcctagggtcaagcgatcctcccaccttggcctcctaagatgattacaggccataagccactgcgcccggcccaagcagttctgaataatgatgaaatgggctcagttgagagaagctgaagattaactataaacaatgagtaacaaaggagcactggaaggcagaggtggatgggaatcgtagtgtttacggagggactagtctccaataggaattttttttttttttttttttttgagacggagtttcgctcttgttgcctaggctgaagtgcaaaatggcgtgatctcggctcaccgcaacctctgcctcccaggttcaagcgattctcctgcctcagcctcccaagtagtgggattacaggcgcccgcaccatacccagctaattttttttgtacttttagtagagacggggtttcaccatgttggccaggctggttttgaactccggacctcaggtaatccgcccgcctcggcctcccaaagtgctgggattacaggcgtgagccaccgcgcccggcctaggaacctctttcaaattcaatcaccctctaggtcgactataccgcctagctgcttcacaatttgtcccttcctcgccatccatactgccagccttaattcaagttcacattatcacttgattggattattacaaaagcttccctaccaatcggtcgctcttacaccctgggcagcctcctccgatggcccactccccgcctctttcactttctggagatcactgagctctccatcctctctgggaatttaccgatgcccagaacgcccttctttcccccacacgaccctctcctagtctaactcctgggcgtgctttaagctcagctcaggcagcgtcaccttctctggaaagcccaaacccagccaccccactacccgctacccgcggcccacgctgatgaagacagcagaacacggaggccccgcgttcccgccgcgagagcaggagagaaagattacctcccgcgagctctagcgcgcccggctttccggcgcactccagggggcgtggctcgggtccacccgggctgcgagccggcagcacaggccaataggcaattagcgcgcgccaggctgccttccccgcgccggacccgggacgtctgaacggaagttcgacccatcggcgacccgacggcgagaccccgccccatccccgactgcctgaaccgcgccaggagacggaccgcaagtccagcgtacccacagacgactcaggcgggagacgagcggtgtcatggccgccgacagtgacgatggcgcagtttcagctcccgcagcttccgacggtgagcggcttcccagaggtagccttcaaagcctctgcgctctgggagaggggaaggcctcgggctcatagttctagaggctcctcaagcttcagaggactgctccttccgcctgaactagccacgaggagactacaagttccgttgtacaccgcggctccggctgcaaaagcctggagcgttgggagcatggggctgatggaggcatggcgggagatgtagtctggagctcataacggttagtagtaatagttgtgattcagttcagtggagtggattgagcgttgtgatccaaaggaaggtaggacgtattgggagctctggtgtggggcactgccaggctctggggcttactgggagctgttgcttgtggcgctggggcaccatgagaacagtagtatggatccctgtgggatattaagggagctgagatcctcaagccctacaaaatgtttcctgcaggacatgggaaaaaagaatcaaaggtcgtctagtccaactttctcctctacagattgtgaaagcgaggtgggaagtaatttacccaggctcatacaagccagtagaagactcaggcttcctctccccaaattcagggcattctccactccaaggcctgtgtgtagaacacgtgggttacaaaggcttgtgggaaaagctaccaatggaaactaccccccttaccaccatcaccgtggcctagcttggtgtctgttcccctgggctctttccttaagcatgaacatccatcaccctcctaacccccaggtggtgtcagcaaaagcacaacatctggggaggagctagtagtccaggttcccgtagtggatgtgcaaagcaacaacttcaaggagatgtggccatccctcctgctagccataaagacagctaatttcgtggctgtggacacggtgagagttgggaaacaaggagggcaggtggttgtgaaggggctggtgctagaggcctgtcacaactctccctttacctacccacaggagctgagtgggcttggggacaggaagagtttgctgaaccagtaagtataagcccttttctctttagtgccagccctcaactgtggagtgggggggtcacagacctgggtggtttgggtccttcataaggctaactcctagccacagcaacccccatacccaaccccaaggtgcattgaggaacgttacaaggccgtgtgtcatgctgccaggacccgttctatcctttccctgggcctcgcctgcttcaagcggcagccagacaaggtatgagctgatctcaccccaatcctaggtgtggctgtggggtggagggtagagagattctagggaacatcagataggaagcatttctctcccaaatctttttttttgacttgatagtttttttttttttatttgaataggtttatggggaacaggtggtgtttggttaaatgagtaagttctttagtggcaatttctgagattttggtgcacctatcacccagtgtacactgtgcccaatgcgtagtcttttatccctcacctgcctccatcctttcccccctgagtccccagagtccattgtatcattcttaagcttttgcatcctcctagcttggctctctgaaatcttgatatagcagacttctctttctcccagggtgaacattcctatctggctcaagtgttcaatctcactctgctgtgcatggaggagtatgtcatagaaccaaagtctgtgcagttcctgatacagcatggcttcaacttcaaccagcagtatgcccaaggcatcccctaccataagggcaatgacaaggtaggcctctagcctccctagccttgagtctgccctttctgtgactttatttcttcctaccctaggctggatgtctggggagaatctgcttcttagggagtatggggaatcactagtgacagggcttgggaaacaagactggtatgaggagggtgggcagcattgggtaaggtagagagagagcgttccaagtggggaagtctgggataagtgcccagcagaagaggctccctgggggactctgtcctcctcattgacccctttactttcatctagggtgatgagagccagagccagtcagtacggaccctattcctggagctaatccgagcccgccggcccctggtgctacacaatggccttatagacttggtgttcctgtaccagaacttctatgcacacctccctgagagtctgggaaccttcaccgctgacctgtgtgagatgttcccagcaggcatttatgacaccaaatatgctgctgagtttcatgcccgtttcgtggcctcctacttagaatatgccttccggaaatggtgaggaaatggttgagggaaaggggtggggcctgatacgagtttatttcattcacttaagatatttattgagctcctaccatgtgcccaggcagtgttttaggtgctgaggattcagcagtgaacaaaacagaccacaaaaccctgctcttatggagcttatatgctagtggaccattaccctcttgcgctgttgcagtgaacgggaaaatgggaagcagcgggcagctggcagcccacaccttaccctggagttctgcaactatccttccagcatgagggaccatattgattaccgctgctgcctgcccccagcaacccaccgtcctcatcccaccagcatctgtgacaacttctcggtgagagcacccacctgtttcttgggagggaaggttctgatgcctggagcctctttctaagcctctttcccacccctaggcttatggctggtgccccctgggaccacagtgtcctcagtctcacgatattgaccttatcattgacactgatgaggctgcggcagaggacaagcggcgacggcgacgacgtagggaaaaacggaagagggctttattgaacctaccggggacacagacctctggggaagctaaggatggtcctcccaagaagcaggtctgtggggatagcatcaagcctgaagaaaccgagcaggaggtggctgccgatgaaactaggaacctgcctcactccaagcaaggcaacaaaaatgacttagagatggggattaaggcagcaaggcctgaaatagctgatagagctacctcagaagtgccagggagccaagccagtcctaacccagtgcctggggatggattgcaccgggctggttttgatgcctttatgacaggttatgtgatggcctatgtggaagtgagccagggaccgcagccctgcagctctggaccctggctccctgaatgccacaataaggtatatttgagtggcaaagctgtacccctcacagtggccaagagccagttctctcgttcctccaaagcccacaatcagaagatgaagctcacttggggcagtagctgatgcaacttccaccttgctctcaggtggaacagaggtattttgggtctctctagcctgaaatgtcatcctcaactgctactgagtttaggggagggggaatgtcttgacagacatcactgcattgccctggaccgcctcctttatcccagtgtttgaggtacaagtaagaaggctgaccagcacctgtaacactgactttatttttaagtctgaaaatgtcttgggaaagttttacaaaaaaaaaaatcaacagaagcaagttatgaaaatatttgaccagcttcatctttggttatttcttattgcagctctgtaaggacagactgttcccaaagctccagccatggcaggaagggaagcaaatcagtccctgtataaaccatttaaccaattgaatgtatcacatgttgataaatacatagaagcaggccctagggcctacaaaaccagccccactcccaaccacaaggttgaaagtcttatggggcagaacattaagactcctttataaatatgaaaatagattaatcaacaggaaaaggtctttgaataggttagctaagagccatgaccaccacgctgccttgctgtccccttgcatagaaatgtagtgacgtggtctgaccatgcagtaagtgcaaacagcaattactcaaatgtcttagaatactggcaagaagcaccccaatattcaggtctgggaaacagccatgaccattacggcctcttgatcagctccatgttccactcagtagcttatatgccccaagaaaaggcaagagacagacctggggtggggaaagaaccggggtaatagctgcctgccagctcagcctagaactagacatcctctggtcctatctggggaagtacactggagagggtctggtgggaggcagacctccttgctggatttcagaggcttggtatcagctgttggccctaactaggaaggcctctcactgctgcctcccgtcatacacagccaatgggcactgggagcccagaagttgagcctggcttggcctagcctgcctgctctgtaggctccagggaagaatcaaggctgtgcacctagggggccatatggtttcagctgaaggtccatccccaaggtgaggcagggactaaaccccctcacccatcctgctttccctgggtttgcaggcctatgcctgaggtggagaaggtggctggagttgagcctgctggcctttcttctacctccatctcctcagaagcacccgcagggcatggactggtcccctggggcctggacccaaaaccattttcttcctggagaatggagcagtccatagcctcatgggcttgagcagctggtagggcagatgcccggaatggtgggatctctttaactctgtacttgagactacttaggcgtggtgggggcccatcagatagcgattcttcccggcccacaaatggacaagcctcttgatgcaagaactcaggcgaaccaggcaaggaacgccaccggcgaataggtggggccaggggctcctgccagtcagccaggggcatagttccgggccctggtgcatccaggtcaaataccagagagatgacagacttgctgggcaggtcaaaaaacttgatcttgccccccatgaggtcctggcgagcactaaaagggttgactttgggggtgcgggcagcaccatctcgtggccggtagtatgggtccaagacactcactgtacgtgggggcttacgggaaaagatatctgactggcttcgagacagccagatggtacgtcttgggcatggtgacttgtgggggatcttgtcatccagtgagcttagtcgcttcaccccaggtgctttctccaagagtcctgaagaataatcaagtctgggttactctcactagtcataacaaatacaagcagcattttaccacagaatgttttcactcatgaaagcaaagctgataccatggccctgttttaccaatgaagaaacagactcagagaggggaagcagtatgccaagccacagctcttaaaaaggccagtactttctgcatcatctccttcccctcccatttgtttctggacctgggatcctggcaatcacaaccctaagaggagaaggccccacatccgaatttcctcccttagggttaggttgggctccctggtctaatctcttacccctggctgtgggctgcagcttcctatccctctcctgctcttcttcctgtaggcggctcagaatttcctccagggtcttcccaatctccacaaaagatgggcgcagtttgggatccatctgtaggtatccacaacagccatgagctctgccctccatctcccaccccaaagatggcatttgagtctatttctggcatctttgaagattcagatgtgcagctgagagaccttttctaaaggccccagacaatgaaggtgatccctacagttcaggtcagggaaaacactactgtctactaccctccctgtcttagtgtttgtcttatcaccttgtcacagaaccttccaaaagtatgctcatattagtttattctgttcttgagttctgctcctaatgtgtttctgggaggtatctgaacaaagcccacctaccccttgatcctaacaggtaaggtccagccccagagctacatacatgaaggccaagaagagcctttctcatatgcctcaggaccagttggatccacagtccaacaataaaaccggaccagagttccatcaacacctaacgcaaggagtgatgggtctaccctacaggttgaggaccagataatacaaaacaacttctttctttcctttgtccagagctctgaataggttagctgccagagggaggaggaggaggtgtggttgctgtcactacagtgaaaatgaggtccctcatgaagctaattagcagcctctctgtacagtcctaaccaggtgaaaagggttcagccagcccctgatgaaaggcagagggagaaagacactcacgttacagcagttgaaagtaagttgcagaaaatctgggggacagtctcccaccatgtgctggaaagcatcatagtccagcccgaaattctgtggatgggtatggaaagcataggtagacagttcattaatccccccacccatcctagcctgctcagtagaagtggttgggagctgcccctgacaaccagcaacagagagttccagcaagtccatcccagggacagaacagttccattgcttcaaactagccccatcagtggcaatgatccccatgcttgcagctcacctctgtgcggggaagatagtccggatcggcctggatgcgggcgatgatctcgcagaggatgataccataagagaacacatctgcctggtgggtagtcggactttggtttccctcttaatgggttgaggggtagggtatctgcccctgcccctgcctcccctgcaccccaccatctaacagcccaggcctgggccatattgcccatacttcatcccagtcagtcactgggcagctgccaggtaccaccactgctcttggtaggaacatcttggacactctgctaagagtggattctagggagaatcagccgagcgcgatggctcatgcctgtaatcccagcacttcaagaggccgaggtgggcagatcacttcaggtcaggagtctgagaccagcctggccaatatggtgaaaccctgtctctactaaaaataaaaaaattagctgggcgtggtggtgcatgcctgtaattccagctacttgggaagctgaggcaggagaatagcttgaactcgggaggcagtaagccgagatcgtgccactgcattccagcctgagcaacatagtgagaccatctcaaaaaaaagaaaaagaaaaaaggagaatcaggccttgagatcctccaaacttaccttttcattatagggctcatctcggagaacctcaggtgccatccagaatggggaacccaccacggccagcttctcactccccatgctgtggggtgagattatacagaaaatgagcttgccaatggctggtgcaatggaatcttttgaccattcctccacctcaaggatgggtacagacgaggactaaacaaatttagggagctgaggttgagctgtgaccaagtcctggcctctggggaggaggctagaattttcccttagcttcagccccctgtcccttggaccccagcatccagtagggctacacacctgacatcggggatcttctcagccaggccaaagtcagctaccactgcagagtaaccattctcatccctctttatcaggcagttctagggttcccaggaaggaagagaaaataatgtggctcagaagcggggatcagccatagagttaccacccattccccccttcctatcacagggcaccttgtcctctgctccttggtgaaccgcactcaagctgaccccactggtcaggtcaggggctctaagacagccaggtgagatgagttagtcctgggtcttgggtggctgtcctaggatacacttcacattccaaacacaattactcatctttgctttctaagtgctaggcataattttaagtgctagaaatagctagatgaaaacaaccaaaacccttgtcctcttggagcttgcaatataggggagaacaacagactatcaggcccctggcctcccttcctccttcctcagaaacacagacccaaagcccaggcctgaccttgccaacttgatataagcacaagacaagtgtctaagccttcactaaccttcactgtccacaagatcacaaccaacctcttctctggcattaaaagtctatgatctggctttatccaactggcctagccgctgtccccctgttcctggtgcccctatgcacatatcctcatccaaacttgtcacagacaagcttgacttaccaaacctgaacaggtccttcaagcctttgcctttgcttacattgttccctttcatttgaaatattctcccaattatccttttcacctaagaaaattttgtattttaaggcaagctacctttttagccatgacctcatctttctccctctcatctcaactcttagctcctcctctatgccactcctcttacagtctagcagaaaagctatgaacccctcaggagcaagttctggtttgccttccttcctcacagctttcaattcatgagacaggctgagaacatgctcactgaaaaaatgctgtcttcaggtcaacccaagtgacctgtaaataaacaaaaagcggcaaccagctctccccaaatagctgctttcaaaatagccctacactgctctggctcaagaggcacctcaccccacccgcttccttcagaatagcagagagcagggatccttggctcacagaaacacttctggagccagcaaggccccatctgacccaaaccagccctccctcttccttgccagccttggtatctagttgctaagacatgccaagtcacctcctgcttactcctgtcaggtacaaatcaatcccttactctggccttgacatgattacactatttcccttccccaagctggaaggagccgtgatttcatcacttctaccctggatcacaggtagacatgcctcatctctggcttccaggaaggacagttcttgtgcttgtcctggctttggctctctaatcagtcctgctggctcagcactcgcagctccctgactttgactgtctgtgagaagatgggccctaggccagcctgcctattagccaaagccccagctatagggcaccagcctgtgaggcagtggcagctcagatatgtcacctatgtctcttccctcctagaagacttttgagtgaggtagccctgcctacactaagcagtaagagaggaccagtcagatttccctgaggcaagaggtgaccttttcagtttcagaaaacagcccaggcactgttgctgcctggttcccattcttcatttcctcacacctattatatcacactgcaacagtgacttacatgtttgcctcttcactggcaaggaatgatttcatttgcctctgtatctgtaacctagcacaggtacccagaaggagcttggcaaaagtgtgttaaatgaaagtttagtctgatgactgaagcaactgggcttcttttaaaagcatgtgtcaagctgggtgtgatggctcatgcctgtaattccagcactttggaaggccaaggcacgtggatcacctgaggtcaggagttcgagaccagcttggccaacatggtgaaaccctgtctctactaaaaatacaaaaattagccaggtgcagtggcaggcacctgtaatcccagctactcaggaggctgaggcaggagaatcacttgaatccgggaggcagaggttgcagtgagccaagatcacaccactgcactccagcctgggtgacagtgagactctgtctcaaaaattaaaattaaaaaaagcgtgtgtcaaacgtatacaataatcatacattccactctccatagtgaggactgagctgacaagagactcaaaagggtggccatggatgcatttcctggaaacctacacaaattcttcagaactgggccagatcagacacctgaaagtgcctgaggtgtcctggaacagctgcacagtcagtattaacactgaataaagccacctgagtgaagaaatgccaagtctat

SEQ ID NO: 297 - DNA, 39565 bp, Homo sapiens
attttcccagtatggtcagagaagacctgggtgcttgccaagatcctttgacctttaggaatatttccctacagccttacaaaacatcaattttggctgagcctagtacccaacactatattcagtttgtaagaaattaccattatcacatttcctgtttgtcttggagaggttgtcctatctcgcaccacatggtagggaattgtgaacaacactggacagaaagttaaagccttggattctgtactcttcattcctgtaaaccttgggtaagtttcggaattctctgtgagcttcttaaagtttttgaaagcatgtaaccggataagtgtatttttacaatggaggagttacagtcatcttggtatttgtgggagattggttccaggatccccaagcataccaaaatccaaggatgctcaagtcccttatataaaatggtatagcatttgcatataacctacacacatcctcccatatacttttaatcacctctggattacctataatacctaatataatgtaaatgctatgtaaatagttatactgcattggttttttaatttatattttttgttattttttaaaatatatttttaatccatggttggttaaatctgtagatatagagggccaactgtactgttagacacaagggtctcgaggcttgcagatagagactgaataaccctctccatgatgatcccttagagttcccccactgtgcctttttctttacatgtgcatgcaaacatgtgtctccacatacattttttttaacaaaaattgaattatgttgatatatgtcctgtaatttgtgttttaaacttaatatatcttaggcattttccctgtgtgtgtgtataatgcagctattaaaaatgagtctgaggccaggcatggtggctcacgcctttaatcctagcactttgggagaccaagacaggtaaatcacctgaggtcaggagttcgagaccaccttggccaacatggtgaaaccacatctctactaaaaatacaaaaaattggctgggcatggtggcagatgcctgtaatcccagctacttgggaggctgaggcaggagaatggcttgaactgggaggcggaggttgcagtgagccgagatcacaccctgcactccagcctgggcaacaagagcaaaactccgtctcaaaaaagaaaaaaaaaagagtctgacatacatatatataaaagaaactgttctaaaataccagaagtgcaaaggcaggggaccaattgcaacaagtagctggggtgataacccctatatatatatacacataggtcagtctcatttttaatagctacataatattccatagtataagtgattttactttaataccctattgatgataatttttccccagtttttttcactattccaggaaggagtatggattgaggagaggggaagaaaataggtcctcaaatgagagacaagaaacctgggttgttagcaacttttttctaatttgtgaccttgaatacatcctattccttttctagggtgaagtctcttgttaaaaaaaaaaagttttagagaatgtattttgagattatgaagactccttattccctgggaaataaaaaacatcccttatgattacaaagaatgttgggtgccatatccccaatatctgcctataaggctcactggagacttcttggactacatggatctattttaaggtttttccctgactccagaaaccagttgaagcagtttagatttgttgaagaagtgggttatcagcccagctacatgttgcagttggtcccctgtctttgcacttgtggcattttaggagtgtctcatcacatgaacaaaaagtaccctctgcaggctcaagcctcagcatgggcacactttgtagagctgcagagtgcctctggccagcttctgacacatgcatctactgagtggccatttcagcccagtccagaaggctgctgggctgctctgtaccctctagtaggtctgcaacacccttgccaccaggaaaccctgacacccatcacatcatcatgagtgaagttctcagttcctcacacttacctcagacggacttttttctagaaaatagagggccactgaggacagtggaaaaagatcctaatgttttttcattatttgcaaatttcaactgctaatatgtatttaatgtttgtcatgcttttatatacgtgtagaaacaatctttgcttcagaacaatttcggggaatggaagaagatgcaaagtccctttgcatacacacaagttgtgtttttctctggacccaagttcctcctcagcttggagcccgatctctcactaactctaccttatccactcctggctagccccacccacaccccaaaccttttctccatggtggaagtcatcagagaaaactgttaatagcacgttaatttagacttttagaatatatcctgtccccactgacagccttttttgttattaaatagagtattcctaacaacccaacccaccctatggtccccttctcagaataatgttttaaatacatacacatatcattgtctgttaataaggaactggggaggtggttccagagttactggaacagattcaaagacagttgctgaaactatgtcctggttgttgcttactctcctctagaaagaagtacttcctcactaatctggctttcagcctcagatctgccccattttaactgctgctactaacattcttcctctataggcagcaggttcttcctcctttcagacaacagtcacagagacacgtacttacatgagcttgaaagaagggaaattccttattcctgtgggcagaaaccaggtgaattgttagaactttggtttatcgacttgggcatagagggattcagggtacataatgcttgttaaggaagaatggcaactgttgggctgtcttacagccaaccccctcctacagtctgtcatgccaggcttagacccatgcagacacaacaggaaaagtctcagatttttcttggctgccataaaagatcattagccctttcagagggatttctctgtgacaaactgttctgggaagcaattgatgaggattgagtagttgtcaggctcttagtgccacagagttggttaatactgtcaaaggtgacccactggagaaagagaaacttgggagaggcaatctgccatgagccctgaatgttcctgcatgtatattcttgcctcatgtgaatgtaagactgaccattcttcttgggctgtacctcagtgttctgttagcagtaagctaccttgaaatgagcaaatttgcctgttgctcactgtaaaagttttgagcacccctcccctcacaagctgggggtctgcatatgtagtcatccatctaggcctaccctgtggcacttgggggtgtaggccatgggcagctggtgcaaacatcatgctcatgttgctggctataccataagtaataaagttatttgtctctgacccaggaatctcatgtcttctggcaacatccatgaaagcatcgcaggctaacttgttagcttacaagtaggataaaattcacagatgtgaaaattttagtaatgaaaattggatcctgaccaacatggttttctagaagagaaaggacaaaggcctttcatgggctggattaggggataaaagaaatttgctgggatctggtagcaagtcagatattcccaagtgagggaggaggaaagagtcctgagaaaagtcctacctgaagaaagagtcctacctgagaatattttgaggctaaggagcaagaggtaggattgaaacatgctgcccagattgtacttaggttgttgctcagtctctaggcaggaggcagaaaagatgttttgacaatgaggcagcaagctcatggctccagctgaaaggcagtatggccatggctgatgaatgatttcccaaagatgaaataaatgatggcagtgataaggatatagaactttgaactaaaaacattagctgtttgttgagtccaagtaggtagccacttgaattgaaagtaaatacatggccttgctgactgacacaaagccgttctccttatggcctacacccccaaaagtgccacaaggtagtcctagatgaatgcctacacatgcagaccccaagtttggtagtgggggtggagtgcttaaaacttacagtgagcaataggtaaacctgctcatttcaaggtagcttactgccaacagaacactgaggtacagcccaagaagaatggtcacggccttaaattcatatgaaggaagaaaatacatgcaggaacactcagcgttcctggcagattgcctctcccaacagtgtctccagtgggtcaccttcgacagttttatcaacctactctagaacttctgatccctctctctctacagctttaaggaaaaaaagctccccatctttggggaagggaggaatgccccttttacagctccgttcaatataggcatccaaatcactatcctccttggccccatggggacagggaaatctgcacatagaggtggtcaaaaatgccaaataccatggggcagatctacaatagcatgcaggagagcagcgaaaaaaaaggagccctgagccctgggggtgcttgtcagagccaacaggtatttgaaggaagaggcaacactgttctggggcaaggagtcaaagtgggattacttcctagtaacaactgtctcctgcaggctagcctcttccacctcctccttccaccacctctcacacttctggctgtggaaataacatcatttcttggctgtgatctccaacatacctatcttaaactgcttggtttgggtgcccataggggagaaaaagtacctgaattcaactggtagggtctgttagcttacaagtaggataaaattcacagatgtgaaagttgtggtaatgaaaattggatcctgaccaacatggttttctagaagagaaaggacaaaggcctttcacgggctggtttaggggataattgcatgggaaaggaaaattaaaatgacctgtggatggagcctctaaacatttaatgtactgctgttttatggctttagcatcaaagtgtgttgttaataccaatatacatttaattgaactaggaaagtttataagtctcccattcagggactactgcagtatagagagatgtagtctaaaagaaacaacatacaaccgcaagaggaaaagaaataaaagcacaggtttagttgaaaacttagttactcctgtagtactcaggccattttccattataaccagctatgtggactttgcagtcaccaaggtgaaatatcctgagtactccaagagtgacctttaaaaagataggcacctcttaggctgctactgagctcttgaggaaacaacagcggccagaggagcttcctgaaagcgtaactgattcatttatgcatactgcaggcagttatcactatcctgagagtcatcctattggaaatgttgataaggaatttgttcttgactttagctgcagtcatcagtgacaccacctcagctctggatggcacttaagtcagcctcaattcattggccagggtggttatgggtgatagaattgctcttcctctttgtgggccaaattggagtcagtgcaatcactaatacatcccactgtgactggattaatgtctcagaccgagtacagggtcaatacagaaacttgagaatgccacttggctttctaaggtagatcctgatggtttatgattgttggtttttttttcctaccttgttggatacaggcccttggatatggctgaagtcagtactgattggtcttatcctgttacatagagttctgttgatagtacctttaattaaatgtaataaaatactttgaatggacctggttccagtttctgtcagtttaattagagtgacaggtggagtggcatacttatgggagaattcatcaaaagccaagatggcatagaaatgaaaggtgcatatcgttgggagacaattcttcatgggtctctagcatttctgcatattttgcaaagagaggcactgactatctttgttccagactatttgtccaggaatgtttgtatagtaaacaaccttagaaggtatcagagcaaagggcgcacatgctcactgcccattattgaagattcaggttccctaacctcaaagttcctctcctttaaggcacttcattacatgtgcaggtatcatctggctctctgcgtcatcatatgggaattggggctcagaactggaacaaatgctggtactctggctactgctattgctgtaagtaacaaactatcctttttacaggtagtaacaggctatcttgttagcttgcaggtaagataaaaatctcagacccttcacaattcttgacagccccactcctacttctgcctgtcccatatcttggaagctccctaacttctgtaacaggaagttcccccgatattcctgtgccatcttacttgatcgcattacttaatacccttctgcatccctcttccttcaaacttttatataattctgctctgctaatacgggtgccaggcctgatcccctcgctttagttgctcacagtctgctgagagtgtcagacacttagacaatctgaacacagtagaaggaggtgcaaagtgctatgggggcttgaaaaggagtatttgttctagtatggaggtctgggaggtcctcatacaggaagtgaaaactgaaccatgagtgaggagttgggccattttacagatgaggaacctgaggcacagaagttaaataagttgccgagatcactcagctaggaagtgggaagagaggattggagccaggattctctacctctaaatatagaaattgctctttaacttcactttctcaggcataagatgagaccatctgagtttacctcaaagaattgagaaagatttggtattagctttgggtctataaaatttgagatccacagagttggtgattgtgaacttggagaagtctgataaagaaccccaggacatgacccggtttttataaaggaaatatttcagacaaataaggcttaaagaataataagatgaatatttgtgaacctactgccattaaaaatatatatattaccaatacagttgaagtcctcagggtatccttaatcatatcttacttcctgcactttcagaagttactactacctggaatgtggtgtttattattcgtaagcattttcttcatacatatgtgtccattatatatatggatatatacagatatatagagacatatatggttattttttaattttatttttacctccttgggagctcttatacaatatatatggttattgttttacctgtttttaaactttatatgtggtttttgattgagagtctcccaaacaacccctgtgttcaggtatttgctagaaggacccacgcgactcagcatatatgactaagatttattcttcgataaaataaggacacatctggatcataagggaaaaggacactggcagagtctggaggaatccatttgcaggcttccttatgctcttcctcccatgagggattgcaaagagcccactttgccccaacaacaaaaatgcagcaacacgtgtgtaatgtttctgtccagggagcccattagagagtacccacagtttattgaggtttggtcatgtgggcaccatctgcctagcacataataaagactcctagaaagcaagcaggtatccaccataaatcatactgcaatcaaacagtctacatagtcaactacccttttcagttaactggtgactgggaacactttgagagccaagtttccagacacctgtcaaaaaacaccaaccttgcaagcaggccttcctaaggataacctgttaggcctgctatggtaaatctgcacaagtaccattctctctgtattgtgcaacttgcttttttgttcaatattttgtttgtgaagataatttagattgatacctgtagctacaatttattctatttcactgctgtatactgttaaacatgacagtttatttaccctattaatggacatttaggtcttttataatttttcactattaaacatttgctgctatgagcattcttgtatggacacatctaatacaggtagtgggattccttggtgggagaggatatacatttttacttttctaggtattgctaaattttcctctaaagcgactgtaccaatttacattccttctattaatgaaggaaatacaagattggaataattgggatagttgtgttatctttgtgaatagattttaaaatactgatttagatttttaaatagttgtaagacttcacattttccatatcttagtttggtaactttttctaaaactgtattaactttatctagattttcaaacttaaggaataaagtttgtttaatatttatttctcatctctgttgtatccctgcatatagtctccttttcattaatatcatttataacttttaaaaatgagtcttgccagagggtttgtccggtttattagatatgtcaagactaatatttgcttttgtcagtcccctctattgtactttgcttcttgtttcatttattctgttcttattttcatcatttccttttctacctttttgggatttattctgttcttccttttctacattcttaagttagatccttaactcattactgttttgttgttcttatctcctggtatagggtctttatttgagttctcccagaggcaagttctgagaccaggacctgagggcaatagtatatgtgagagatgcagggagtgccataatgaggtgggaaagtaggaagggaagaaaaggtgagcaataagggtgtagcttttagtagctattgataattgctgtctagattcattaaattcattttgtcattaaaggacaaaatgatgaaattctatcattcatttggcattggtcagttaattattttatgaaggagaacttttccccatcaactatttagttacccagaaatagggtttgtacaggaaaggcagaataaaaagctgctttccttagcaaactctgaggtgaccaaagtgacatttttctccatatgtcgatatgaactttctttgcagtccttgttctttttgatgttctaatttttccatatttggccagtggaatcaccttcaaattgattcttaccttcttttgacatgacctgaaatagtcttttatggctttcttgctttctgttaagatgttctaggctaatcttataaattttcttccctgcacctaaaatcagccatttttttcatggaaccctggttcctttggggacaaaatagtattttaagacccattattgccaggcgcggtggctcacgcctgtaatcccagcactttggtaggccgaggcgggcggatcacgaggtcaggagatcgagatcatcctggctaacatggtgaaaccccgtctctataaaaaatacaaaaaattagccgggcgtggtggtgggcgcctgtagtcccagctactcgggaggctgaggcaggagaatggcgtgaacccgggaggcggagcttgcagtgagccaagatgacgccactgcactccagcctgggcggcagagacacactccatctcaaaaaataaaaataaaaataaaaaagacccattatttgggcttattacgatgagttggtctctggttctaggcctttttttttttcttttttttttttttttttttagaaaaatacagcaggttgtattgaggttggcacctatgttctttcaaagaaccctcatcattttgtgagttctttccttgtggcaccacgatgttccaggctcatcttgtatgttccctgcctcagcacaggattttttttaatgagaaaaatatcacgaattcaaatttacagaagctttacatttttatgtcctctaagttagcagtctgtctttccttttattggcgtttgtaaaatttcttctttttaaaattgttatattttagagacagggtctcgctctgtcacccaggctggagtgcagtggtgcaatcacagctcaccacagcctccaactcctgggctcaaggcatcctcccacgtaggccttccaaagcgctgagattgtaggcataagccaccaggcccagcctattacctttacgttgtacttagtcccagataaaaaatgaccttagatcagtcctttcctctttggctggggagaggggggcttaaattccggtactgtgaaacagaagaatggactcagtgctatgtgacaaatctatgtatgtaaatgtgtgtatatacacacacataaattatatatatgaatatattttcattttcatattttgcaaggagagtagccaatgctctggacctctggtcctttttgtagggtaccctctgaggccgggaacctttgctcaactctcaggctgtccagggaagctttaggcggtgataccgagctacagaccaatataagagctcggggctgtggcactgaagagaggaggcggccgttgggaactgaggtgggcccagggcttgagctgagttggcgagggtggaggtggtgccggtcccacgccgtggtggggaccgagctgcgggctggagggaggggcagcgccgagggggcgggacggggagggctcgcggagtaggccaacggttggccccaaccgccactgactacagcctgcgcccgcctcttttcgttgccgttacctgtttccggcagtcgacacgctcttcgcttctcggggcttgtctccgtgtcctccgtctcagttgtttctccctctctatcctcctctgtctcagtctccccagccttggggccggtgcctcttccgggcttcggcgaatgagacctgcggacctgcccccgcgccccatggaagaatccccggcgtccagctctgccccgacagagacggaggagccggggtccagtgcaggtgagcggggttgggagacaggagagctccccgaggaggactcaactgtggggacaggttgagcaagaccatctgcgtttgggaaatccagccttggattattgagacagagccacctagtcggctaggatctgacctggccagagaattcttggctagtcctatttttattcgttctcacagaagccgaacttaaacctcagaattatcactccagagatgaaagggaactgagactggaaaagccctgcttaccaaaggtctctgggcggcagaaagagccctgagcttcagtttcaacttaggagacctgggtcttggtccagattttactgtggagtggcgttcagtaagctttgtccccatcccgggcccgagttttcccatctataccatgagagggtttagactacagatcttcaaaggtctggcacgtggtaggtgctccttaaatattacttgttaggagtgaataaatgagataggaaggcctcctgggattcactggaggctcattgggttagttggaggctgtggaattacattattatagtctgagaagtaggcggtattatctccattttataagtgaggaaactgaagctcagaagtaaagtgacttgctagtaagtgtcaaagataagtcagacttcagagtccatgctaggctatactctctcccagtaagaaagcgggaaggacttgatgggaaagtgattatatcgagcagcaagtaatcatttgaattctctgcttaaatgaaccccagagcaggcccatatctgattattttctatcccgtttccagcacctgatttgtgtgaaacgttttgggtggcaatgccagaatcaccatctatattacttctgtcatcaacacgatcagcataattacaaaaattaatggctctaattgttatagtgataataaagcataaatgaaattgtgaggacatcaaaatttataattaaagacacctattaaaacagcagtttaaaatttataaaacacttttgagtggttcttcatattgatctgcttaggtaggtattattatccatagtttacaagcaaggaatccaagacctagaggttgagtaaccatcaaaacgtcatgcagcaagaaatggagctgagacttgaatccagcccatgtgacaagttgtgcttctcctttggtgattatttccctatttcctctccatttccttttttttttgagatggagtcttgctgtgtcacccaagctggagtgcagtggtgcagtctcggctcactgcaacctccgtctcctggtttcaagtgattctcctgcctcagcctcccgaatagctgggattacaggtggatgccaccatgcctggccaattttttttgtatttttagtagagatggggtgtcaccatgttggccagggtggtctcgaactcctgacctcaagtgatctgcccacctcagcctcccagagtggtgggaatataggcatgagccaccgcacccagcctcttcctttcctgttctgagccctaacccgctccatgcctatcctgtgctccattcttcttatcacctggagaattcctgtttagatttaactaatagtcacatgttgactgatgatagtagtgttggtttaacttgtaattaaggtgttaagagtttaaagtatgttctctttcagcaataaagggggatttaaatgtttttaagaaagggagttgtaattgttattattgtcattgttatccacaggattcaaggaataaaactagaatatacagtaattggtagtttaaaaataataactgtcatatattgcactcatactatgtcataggccttgtaatagccactgtagttaagcattttatttctatcacctactctgctgaattgtataggggaggatcctgaagcatagagaagttgaataacatgcccaaggtcacatagtcctggcctggtccaaatcctatgttcttaaccattacaccagcctggctcagagacagattgtttgcttagaacaaagcctgaccctcccggggaggagagcctgaattgaggggagagaagtatgctctagtattgagtgagaagatggtctccccttgcttatcttttgattctgctgttgagagcctgggattgaaatgaagggaggcttttcttctggactcagcaaggccactctcccagttcccctcatgatactgagcaatagttcttttcccttcttcaagttaggaacaagtgactaaatattcatatgctattgataaaagtttgtcttggttgacactaggaggctgtagccaaaagcagtgcaactttgccgtatggttcactgtcctgaaagcttcctggaagattggtctaaaatcatcatgccattcctctgtcaaaaattcttgagtggtctcccatctgtggaataaacaccttaataagttatctaagcctcccaggatctggactgtgctgaccccttcagtcccacctctgcccccatcccttgcactccaccttactgtagtcacactaaactactgagaggccccaaaactcactgttttctgttgcctataggcttttcacatccttgtcctctgcgcttctccttttaaccctcagttggctaatccactgttcattctttaagatctggctcactgattcattcaatcattcaacaaaaatttgttgagtgcctattacttaataggcatagttctaggtgtcaaggcggagcaataagaaaacagacatacccttgctgtttctggagcttccattttgtggtatgtattaaacaaatgtaacataggaggcatcaaagtgtgataagtggtgtggagaatagaacaaggaaagaagataggctggggcaaaggagttgacagagaaaccttcctgattggatgatgtttgagcagagctgaagaaggtgagggagcgttatgtggctatctgaaacgagtgttccaggcagagcctgtgactatatgaggcaggagttcttttggctcaatcattctctccaaaaatccttctctggtgccttgatctggatagatgccacttttgtgtttttctacttgctgttgtgtttacctctaaagtagcacttattacatcatgttataattgtccatgtatatgtctgtttccctcacttggattgggtttcttgagagcaggaacctctgatccttctctgtcttctcagcatctattttagggcctgacacagaggaggaacctagaaatatttattgaatcaattgttcttacagcctgataatatttacaaatgatttgtaaaattgggtttggatgacagttggtttgaggaaaaagtaattctaaggctgctttttgtctgtctggcttgattccccttttggacctctgagaagtggaacacctggttttctttaagaagaatacttggagactccattgtgagcattatggcagggtagccaacctgtaaaatggtgggtaaaatataacaaagccggccgggcacggtggctcatgcctgtaataccagcactttgggaggccaaggtgggtggatcacctgaggtcaggagttggagaccagcctggccaacatggtgaaacccgtctctgctaaaaatacaaaaaattagctgggcgtgctggcgggcgcttgcaatcccagctacttgggaggctgaagcaggggagttgcttgaacccaggaggtggaggttgcagtgagccgagctcacaccattgcactcaagcctgggcaacaagagcaaaactccgtctcaaaagaaaaaaaataacaaagccctttatagctgaatttgcaagaaagtaagagaaatctccagggacctagaaaccaagagtgaactgaaaaccagagtggttagctccttaatctgccctcagctgcactggatgtctcacctagaaacttggactttaataggcctgttgttataccaaatgaagctataggtccgcatgggttagactctagtgggttttttgttgtcgttgttggtgtttttttgtttttgtttttgagatggagtcttgctccgtctcccaggctggagtgcagtggggcaatctcagctcactgcaagctctgcctcctgggttcacaccattctcctgcctcagcctcctgagtagctgggaccacaggtgcctgccagcacacccggctaatttttttgtatttttagtagagatggggtttcaccatgttagccaggatggtctcgatctcctgacctcgtgatccgcccaccttggcctcccaaagtgctgggattacaggtgtgagccaccacgcccggcctggttagactctagtttttgacagaggatggcatgtgaaatactcacatgaagctaggtcccttgaaaatctgcaccctgtgtagggtgtataccttctgatagggtggactagtatcttaattcactttctgttgcttataacagaatacgtgaaactgggtaacttataaagaaaagaaatttcttgcagttatggagtccgagaaatccaaggtccagaggccacatctggtgagggctttcttgctggtggggactctgcagagtctggaggtggcatagggcatcacatggcaagggggctgattatgctagctcagatctctagttttcctcttataaagcccctaatgcactcccatgataacccattcatccattcatccattcatgaggacagagcccttataaccctatcatctcttagaggccccacctctcaacactgccatatcagggattaagtttcaacatgagttttagaggggacaaatatcaaaccagatctactaggaaaaaaaaaaattctccctactgacacagatagaagacaaagagattgccttttatcctaggctttcgtacagaaaaaaagttttcccagaaaattcttaaccataggcattcactcatacagatacccaaatggcctagaaactccaagccaagaagttgataataaaaaccacctcaggctggtaatacccctggatgcttggcaaaaacaaatgcaaaaccgctctgctccaagatacatacttgatacaggccacatagaattcccacagggtctggagttaatgaaattctcatttgttaaacaagaatgtatattgcttgctttgtgctattgagagcatatgttattcttgtataaagaaacatttgaatatatctgtgcccccccacctttgctctccagaagtgaaatgatgaagcagaatttatatgcaggccagcatctgggtatggacacacattaagcttccttctatccttgcagaggtcatggaagaagtgacaacatgctccttcaacagccctctgttccggcaggaagatgacagagggattacctaccggatcccagccctgctctacataccccccacccacaccttcctggcctttgcagagaagcgttctacgaggagagatgaggatgctctccacctggtgctgaggcgagggttgaggattgggcagttggtacaggtgactcttcatcccagatctgagtctgggcctcagtttctcttcacaaagctcagagctcttcaggatctgtgccttttctcatcagtacaggaaagccctgtgtggggagcagaggcagaaaaaacagcaaaaacaatggctctcactgagtgcttattgtgtgccaggggcacattgggtcctcacagccattctgtgtcgtaggtactgttttcagtcatattttacagacaaggaaactgagactcagagaggttgccatttgctcaaggttatacagctataataaagcagtagaagctggtttcaaactcagtcgctgactccagagacctccacagttatttagattcagctaacgtatgatgtgcctttcatttatattccatttaatcctcataaatcacccagggaagtaagcattggtagtccagttttgctgatgagagatcctagtgctccaagaggtaagtaacttgctcaggaccacatttagcaggtgacagggggataccagtaataaccacgcttctactactaaatgctgtatgtgaggtatattttattatccccattttgcaggaggcaaccaggcctgagaattaaggtcatttgctttggtcacgcgtctaataagtgggagaactggagttagagcccttcctcttcagtagaacattttgactgtatttttagtgaggaaagaagggttactgctctttggcctggaagctacagggttatttcagatcccaaataggcatacgtcggagatattgtggatttggttccagaccaccacactaaagtgactatcacaataaaacaagacacataaattttttggtttcccagtgcatataaaagttatgtttacactatactgtagtctgttaagtgtgtagtagcattatgtctaacaaaaagtacacaccttaaaatactgctgaaaagtgctaatgattatttgaacctttggctagtcaatctttttgctggagtgggtcttgccctgatgttggtgactgctgacttatcagggtggtggttgctgaagatttagtgtattattattattattattattattattatttttctagaagcatttcttacttacatagataatttcttaaaataagacaatgggctgggcacagtggctcatgcctgtaatcccagaactttgcgaggccaaagtgggaggattgcttgagctcaggagttcaagactggcctgggcaacatagcaagaccttatctctaataaaaataaaaaacattgggtgggtttagtggcacacatctgtagtggcagctactcgggaggctgagggggaggattgcttgagcccagaagttcaaggctccagtgagctgcgattgtgccactgccctcccgcctgggggacagagcaataccctgtctacccccaacaagaaataagacaacaatgaagtttgctgaaacagttgacacttcctttcacaaaagatttctctgtagcatgcaatgctacagaatttgatagcatttttcccatagtagaacttataaatgaatcctctcaaaccctgctgctgctttatcaactaagttgatgtaatattttaaatcctttgttgccattttgacaatgtttacagcatcttcaccagaagtagatcccatctcaaaaaactactttatttgctcatctataagaagcaactcatttattcaagttttatcatgagattgcagcaatttagtcacatcttcaggctccacttctaattctcttgctatttccaccatatctgcagttacttcctctactgaagttttgaacccctcaaaatcatgagtatgggaatcaacttctcaatgtctcttaatgttaatattatgacctcccatgaatcatgaatgttctgaatggcatctagactagtggaatttttccagaaggttttcagtttactttgaccagattcatcagagtaatcactatctatggcaactatagtcttatgaaatatttcttaaataatgaaacttggaagttgaaatgactccttgatccgtgggctacagaatggatgttgtattagtggccgtgaaaacaacattaatctcctcatacatctccatcagagctcctggatgacaaggtacgttgtcaatgaccagtaatattttgaaaggaatcttttttcctgagcagtaggtctcaacagggggctgtaaacagaagtgcttcatccaggctttgtttttagagcactggcagagtagatttaggataattcttaagagccctaggattttctgagtgataaatgagcattgacctcaacttaaagtcaccagcccgtcctttgaaggtttgaagccagacattgacttctctctagccatgaaagtcctagatggcatctttcagtagaaggctgttttgtctacagggaaaatctgttgtttggtgtagccacctttgtcagttaccttaactagatcttctggataactggctatagcttctcccatcagcacttgctgcttcaccttgcccttttaagttacggagacagcttcttgccttaaacctcatgaaccatcctctgctactttccaacttttcttgtgcagcttccatacctctctcagcctttgtagaactgaagagagttagaactttgccctggtttaggctttgtcttaagggaatgctatggctggtctgatcttttatccagacctctaaagctttctccctatcagcaataaggctgttttgctttcttatcattcctgtattcactggagtagcacttttaatttccttcaagaacttttcagcctggtgtggtggctcacgcctgtaatcccagcactttgggaggccaaggtaggcggatcacgaggtcaggagttcgagaccagcctgaccaacatgctgaaatcccgtctctactaaaaataccaaaaaaaaaaaaaaaaaaaaaaattagccgggcatggtggtgcatgcctgtaatcccagctactcaggaggctgaggcaggagaatcgcttgaacacaggaggcgggggttgcagtgagcagagatcgagccactgcactccagcctgggtgacaaagggagactctgtttcaaaaaaaaaaaagaactttttctttgcatttacagcttggctgtttggcacaagaggcctagctatcggcctgtcttggctttcaacatgccttcctcgtaagtttaatcatttctagctttgatttaaagtgaaagatgggggactcttcctttcacttgaacacttagaggccattgtagggttactaattggcctaatttcaatgttgttgcatttcagggaataggctgaaggaaaggaagagagatgagggaacagttggttggtgaagcagtcaggacacatatagcatttatcaagttcaccatgtaatatgggcacagttgtcatactccaaaacaattacagtaataacatcaaagatcactgatgaaagatcaccataacagatttaataataatgacaatgtttgagatattgtgagaattaaccgaaacatgacaaagacatgaagtgagcacatgctcagttcagggttgccacaaaccttcagttttgtggcaatatctgacaaatgcagtagagcaaagtgcaataaaatcacataggcctatatttcttattgttgctttcctctctcccagggctagcttaagtgagacaaatgagacaatggttttgagagtcttttgtaaaaaaaatatatagttgtgtcatctctctatatctacatagtaggcactttaatactcctaacctaccctgcttttttacctacagatgtctcaaatctgaccattaaatcttcatatccacagcagataaccttcttctgctgttaaagtacacagtgcaaatgctattctgctgaacatgggccttgccatcaatccctgtctttgcttttgataacattggctcacatttctcttggtgaagttttttactttgtgggattttcagttcctgctctttcaccttatcttctcatgagtctttctcatggcctcccaggaccagacttctgcatgtataactagcctccacagaggcccagccctacagcccagtagtacttgggattctagctctttcctttcttctaggacaagcattgcctgtggtcatcgtcatgttgcactgtttttgatcacagacagtaggctgttaagcattttttttaatcctattttttagagacaacttctatgttgcctaggctggtcttgaactcctggctcaagcaattttcctatctcagcctcctgagtagctacgactacaggtgtacaccactgtgcccagccttttaaattttaactgtctgtttgtctgtctgtctgtctagagacgagccctctctgcattgcccaggcgggagtgcagtggctattcacaggcttgatcattgcatactatagcctcaaactcctggcctcaagcaatcttctcacctaagcctcctgagtagccgccactacaggcaggtgccactgagcccagcaagcattttttatcagaccacacctgttgcataacttcactactcagtagtcacacacatccacaaacttgtccactttaactcattctctctttatttcattctctgacttatttaattgtacaatcttgaagttagaagaatcatgagcccaattctttcccaatatagaaatctgtattctattggtagttactgaaatcttagtgattaagagcatggctttggagtcagtcaagacctatcatttattggctttttggccttggatacttgactcttctctgtttcatcagctgcaacatataattaataatagatactacatagtaagaactaaacatttgtcattttccattaagggtctccttgcacaactcttcaggtgagcacctgattgctgtggcagctggtttttatgtgtgaatgagatgatctctacttctctataattacccattggtttgttctgccttctggggcagtcagtctatacaaaatgtagataaaatctctttttcagagaactactctctgaagtacctgaaagctgtattcatgccctctgagtagtctgttttctgggctaaacagcttcagttctttctgtaacttcttagggcacagtcctgatttggtttctggccccttgaaaattgtgattactgtcgttgggatctggtctgagatagcagtgtccttttttaaagtaggatactcagaattgaacttgggactccaagggtagacaggccagctcagcaatgaggtgagctctcctatcttgtattccctttaatgcaattgaaagtaaaatagcactttcttggtagctacatagcacaattgactaatgttgagtagatggtcagccaaaacctccaagtctttttcacatttgttattcttttaaaaaaaaaattaattgtagtaaaatacatctaacataaattttaccatcctaaccatttttaagtgtatagttcagtagtgccaggtatattcaaattgtgcacccaatcttcagaacttttgatttttcaaaactgaaagtctacacccattaaacagctccccatttctccctcctcagtccctggcaaccactaatctactttctgtttctataattttgactactctagatatctcatataagtggaattgtatagtgtttgtctttttgtgatggcttatttcacttatataatgtcctcaagtttcatccatgttgtagcatgtatcagaatttccttcctatttaaggctgaataatatatcattgtatgtatataccatattttgtttatacattttttttttttttgaggcagggtctcactttgttgcccaggctggagtgcagtggcatgatcatggctctgcaacctcgaactcctgggctcaagcaatcctctgcctcctgagtagctgggactacaagtgtgtgccaccatacccagctaatttatttatttatttatttatttatttatttatttatttattgtagaaatggggtttcagtatgttgcccgggctccattcatctcttgatggatactttggttgcttttgcctgttgggtattgtgaataacattgctatgaataagggtgtgaaaatatctctttgggaccttgcttttaattcttttggacataaacacagaagtggaattgctggatcacttggtaattttatatgtaatgagaaactggcatgccattttccatagtggctacaccattttatattcctaccaacagtacacagtggttctagttttccacatccccaccgacatttgtcattttctggtgtgtgtgtgtggtagctgtccaaatagttgtcagggtgatacctcattgtgttttttagttgtatttccccattaattagtgatgctgaacatgttttcatatgcttgttggccattacgtttgttcttgtttttctttttcttttttttttcttttttttttttttgagatggagtcttactctgtcacccaggctggagtacagtggtcaactcggctcactgcaacctctccctcctgggttaaagcaattctcctgccacagcctcccaagtagctgggactacaggtgtgtgccaccatgcctggctaattttttttgcatttttagtagagacagggtttcaccatgttggccaggctggtctcaaactcctgacctcaagtaatccacccgccttgacctcccaaagtactaggattacaggcataagccacagcacctggcctacatttgttctttaatcagtttaccccatgcaaatttttaagccacaacctgttttatctctgtcaagcctcagcttgttttatatgtcccattgctccagctagttgagagcatcttagattccaagactttcatgctatgtttactcttttttccatcttcatgtcaactgtatgttagatatacctggctcaaataattttcttctctcagccactaaggatgactaaacttctgacttctcaaaaactagactgcttaataagtaagctgacttgatcacatatctctggcatgtttagtgtgctcagggcactcaggtatagaatgggctgtcccagagatcttgaattccctgttgaactagcttagttcaaggacggaatggtcttttatccagaagactgcgaggggactcttccgtgggatgggagttagcactagataacccttatggtccataatggcttagatttcttttttgtttttgaaacagggtcttgatctgtcacctagggtggagtgcagtgattgatcatagctcactgctgcctcaaactcctggacttaagtgattctcctgcctcagacttccaagtagataatgtaaaaattatctagacccagatcatgtaaaaaaaaatgttttgtagagataaggacccactatgttgcccaagttgatctcaaactcctggcctcaggcaaatggctctgagagtctatgatctgcgcctgcttaatctgttttgtccatttatacagaaattaattttttaaatttattttttgttttaggtagttaatacatttcatatagctgaaaaataaaaaaagtataaaaagatatatatctcatttccattcccctacctcttataggcaatcactattgtttcttgttatctcttcagtgctgcttcatgcagtagcaaagcaaagaagtatgtactcttaatagcccttttaaaaacttttaaaaatgtgaagtgataacatatacagaaaacataaaacataaatgtcaaatgcacaaaacataaatgtcagctcaatgagcccttatgacaaagccaacacttgtggactcatatatagaactcacaactaatattccaagaaatagaatgtcgtcagcatctgagaagcttctcttatggccccaccctccttcccaaaggagaagttgattatattaagttgatttatagccctagagtttagttttgcttatttttaatctatgtattcttttggtctggcttttgttcagtattcttgagatttatccaaattgttgtgtgtaaccctaatttgtttttcattgttacatagtattctatcgtatgaacataccacaattaagtgatccattttactgttgttggatacttgggttagttattataagtatagattatactgctgtgaatattcttatacatgtttttggtactgcgggcatacattttgttgggtatgtagctaggagtggaattactggctcatgtggtatgtgtatgttctacctcaatagataatgtcaaccagttttctagagtgatggttttaagggttgttctgcctcagttccatccttattccttggatttggccctttaaggttccatctcaaattacatgacagtttaccaggccttcaagttttgtccttctgctccataaggttgtcaaatgacttgctcagcttctcagcctttcagttacttctttgagaattagtaggataccctaagggaaaaagggaccagccaacctctctgaaagaacttagcctgtcattcttcattctcttgtttgctctctggtgctttcagatattttgtttttgtttaaatattttatctatcttttcaagttctcagtggaaggattggtctaattatttagtttgctgtaaccagaagtccctttcctccacatttctgatgcaaaaggtagcatactacatacactattctgtattttgctttctttatttaagaataaattatgaaaatcaggccaggctcggtggctcacgcctgtaatcccagcattttgagaggctgaggcaggcggatcacctgaggtgaggagtttcagaccagcctggccaacatggtgaaaccccatctctactaaaaataaaaaaattagctggacgtggtggtgcaagcctgtaatcccagctactgaggagattgaggcgtgagaaccacttgaactcgggaggcagagattgcagtgagctgagatgacaccactgcactgcagcctggttgacagagagactccatctcaaaaaaaaaaaaattatggaaatctttccatatcactatatatggaaaaaaggtcttcccccatgtattgcatgttcatttcacccattctgtattgacgaatatttgagttgtttgtagtattctgctacttcaagcaatgctacatttgaataatcttatacatacttaatttgatgagcagatatatcttaggatgaattcccagaattgggcatgatgggaaaggataaatgtatttgtaattttgatatatgtcctacatacaggttgaaccatttgcacttcaatccatatatgaaagtccagtttcttcacatttgccaacacagtattgtcaagctttatgattttgctaatttgatagatgtaaagtgttatgtcaatttagttattttgttttatttttatttttagagatggggttttgccatgttgcccagactggtctcaaactcctggactcaagctattctaaagtgctgggattacagcatgagccactgtgcctggccattgtcagtttcgttttaatttgcatttctctcttatgagtgaagctgaacttttttttctctttctgtgagttgtctgatcttgccctttgcccatttctgttggattcctggaaattttcttaccaatttctactattgttttgaaaatatgttagggagattagacctttctttatttgcaatatgtctgattaggcattatctcattgtatccttataataactcctctgtgaggatgttattaaattttccatttaactgataaagaaattgaggtaaagtaagattaagtaacttgcccatagtcacaaaataagtgatgaaagcatggtttgaactaggtgtctctgaatctatgcttgagctttcaacaaaagttatgaattgccttcccagtgtagtacaggagggaaaaaaatttgtcttaaatttccttttatttgcttaaaatttctgtatttgtttgccttgcttttcttttcttccttttcttttttctttctttcctttcctttcttttttttttctttctttctttctttgtaaaaatatttagcacctattatgtaccaggggctggagaatcaatattagtaaccaatagtataagccctgaaaaggctcatagtctagaaaaggaagacagtcataaaaagttacaatgttatacaataaatgtattaggggaggagagtgagtttcatggaaggctttataaaggaggtgacttttgagttgggtatggaggatgatttggaagtctagatgaaatgaggaatagcattccagacagaggagacagcttgtacaacatttagcattgtctctttccagctttgtaagttatcctgtaatatccgagaatttagtgagtagttaggccttcgtgattttatagatttcaatatcatttatttcttatttatgaaaaatactaatacttttaatgagcttcatgttttcctattagtatctcactcctactttctcccttctccttgtctagtgggggcccctgaagccactgatggaagccacactaccggggcatcggaccatgaacccctgtcctgtatgggagcagaagagtggttgtgtgttcctgttcttcatctgtgtgcggggccatgtcacagagcgtcaacagattgtgtcaggcaggaatgctgcccgcctttgcttcatctacagtcaggatgctggatgttcatggagtgaggtgagggacttgactgaggaggtcattggctcagagctgaagcactgggccacatttgctgtgggcccaggtcatggcatccagctgcagtcagggagactggtcatccctgcgtatacctactacatcccttcctggttcttttgcttccagctaccatgtaaaaccaggcctcattctctgatgatctacagtgatgacctaggggtcacatggcaccatggtagactcattaggcccatggttacagtagaatgtgaagtggcagaggtgactgggagggctggccaccctgtgctatattgcagtgcccggacaccaaacaggtgccgggcagaggcgctcagcactgaccatggtgaaggctttcagagactggccctgagtcgacagctctgtgagcccccacatggttgccaagggagtgtggtaagtttccggcccctggagatcccacataggtgccaggactctagcagcaaagatgcacccaccattcagcagagctctccaggcagttcactgaggctggaggaggaagctggaacaccgtcagaatcatggctcttgtactcacacccaaccagtaggaaacagagggttgacctaggtatctatctcaaccagacccccttggaggctgcctgctggtcccgcccctggatcttgcactgtgggccctgtggctactctgatctggctgctctggaggaggagggcttgtttgggtgtttgtttgaatgtgggaccaagcaagagtgtgagcagattgccttccgcctgtttacacaccgggagatcctgagtcacctgcagggggactgcaccagccctggtaggaacccaagccaattcaaaagcaattaattggcttaggacccaatttccatagatgcaaatggcagttacagacaggttaacagaagctactgaagtctacagataatcaaaaaacttaatattctgttccctaccttttttcacttttcctcctccaaagagcaaaatgaaaattttgccttagctactgcagtggaaagagcactgaactaggagttggaagacaaggatgtggtcctggctctgccactggcttgcttttggaccttggatgtgtcacctgaactctctggacctcaggtttccatctgtaaaatgagagtattggttctaagatttctcatcttctcatccctaggacaagcatagtgcctgcatgcttcatgatcagtaagtcctggctgcataaaggactctgatgtcaaaatggaaaccaggggacttaccttttcacatgacttacccctcatccgagtgtgaggttacaagcaggtgtcatggcaggaaggaagaccagatctgtatgatttgttccatttttaataacaaaaatatccacacccttttaataatgctcagttctgtaggctctctatcctagaggaattgagcaaaacagaagaatcatgaagtctcctaccttctacagccttgtagttctgcttaccttctcttcctcatccagaaagcatcattttctagggagaacaatgagaatctcaatgccagtagtactggataatagtgcgtattgcttctggtggcattaccctgatgatgggctgaagttcatttattagggtggttcctgatgggaaaaggacatggattaggactttaaaacactggacagaatttcccacagtctttgccctcaaggagttcaccagtttatggggctagaagagcgagaaaattcaagaaaataaatgtagctggtgggagactttgtagatgttgggctatatgttggggtgatggtagctcctgatgtaattttcttagttgcatcttcaatatgcctggagtcgtctgtccaaggcttgtccaggcttctgggtttctctcaagtttgtttttctcaggatattgtcctggcccagctactcctttacctgtgagaagatcttcaccattaggaagatctctagacccccagatctcagaatcaggcctatttgtgtaggcccatggaaatcactacttgtgaagtagagatgcctttttgtctaatggttttcgtgctgaacttagttcatgctgagtctctcagatgataccacgttggttgttcctatcttagattgtttctcccatagcctgttattgcaacagaaattctatcatgagagatttatttttttgtccctattttaggagtctaatgcttaaactggtatcaactaaatatatttggtgttgtacaatgaccacagagaacaagtcttagtcatgaaatatagcctaggagactaggggttacagttgcactagttgggtagagagagtcctacaggataaaagtggagattaactttacctactttagcagattgcttaagccatggcttagagtggcttttaaaaatccccttagcctctcctacatttgccaaggtaatcttcccaatacacaattattcactcatgtatacatttatctaaatatttcttgagtgcctaatacaaggtactttctactgccattccttggctctaaatcatttgtggttctccattgcctattataatgtaaagatgtttacatttagcctggcatgtaggaccttccagctgttgggtgaaataatgcacactttcctctacttccttatatgaggcccactgtcagggaaaacctctgtcaagttggcaggtggagggtggtggaggtctagggatgggcaggattggtgcagggaggaattggggaaggggagaggattaaaagggcagccccctcctgagtggtagaaactccttgtttagcaaagctttcctgaacactgtactgcaagtggataggaatagggaggatggccaagtcgtacaaccagggctaaaggatgaaaagaatgagaatatcaacttctttttttttttttttgagacagaatctcactctgtcgcccaggctggagtacagtggcacaatctcagctcactgcagtctccgcctcctgggttcaagcaattctcctgcctcagcctcccaagtagctgggattacaggtgcctgccactacgcccagctaattttttgtatttttagtagagacggggtttcaccatgttggccaggcttgtctcgaactcctagccttgtgattcgcctgcctcggcctcccaaagtgctgggaatacaggcatgagctactgcgcccagccgagaatatcaacttctttaggactactcaagaagggagtcaaggcagggaccttggtctgtgccactgtgacgcagagatgtataataccagtactcataagaggtccatctctaaattgccctcctcttacttcttccccctgcctcatgttttttctctttaatgactagcatcgaaactctttaaatggggcaggcctgtgttcttatctcaggaatagtaagaaaagggggttgggaacaggggaaatccagaataaagacttgagaaaggaacagagtgggtgatggcagctatgaagaaaaaacagatcagaagaagagtcctggcaccttaggaagagaaagtgtcacagacacgaggcctaggctagagagatggtgtaggtggtagctgctgtgaagaagaaatgacaacaggctggagctgttccctgaaacctgtgggaaggaagagagacctgcacaggccggcacttagcttgtggagaaggtcctaactcaacactgcaactttaagctggcttaacttgtccaagttccagatgaccaacaaagacagctatagacactctaactctgtgccaattacccaaggccttcagggccctgggacctattccatgatagtggtaccctaactgaacccatttcagccactcagattgataggatggaaaagacagggcaggtggtagcagctgtgaagaaaagaggaaagcagaagggtggcctataatctacaggcatgtagagaggactacataggcctctgttctttgccctcaggagcccccttcctgtcccttggactcagaatggatccttccagcacacatggcccaacactgagagtgcaggaagcatgggtaggggcctcctgctgctggtatgtacccaggccagcctcctgccgacacagcctactggctgggttcatgttcttactattcacctcaggccattgtctgggtgcttaatttgacttgtttcccctggtcaccagtctcccctccgatattcacaggacatcaagcagcttcagccacgggtaagaggcttttcaccctgcctgttgggtagcccagaggacccacaaaggtcaacctgagtctccacagcctcctccccagggcagtaggaattgatatctcacttttgccagattaggcttctcactcttcttgagtaggccataatccacctcttcagtaggccatgcatcttgtctctgcagtgccagaattcacagtctgggcctccctttggtccttaccataggctgccatgtattattgtctatgttgtgccctgtaggcctctgctaggctgtgaactccttgactgactcctcactgtgtcctttttaccttgaatcacagtggcttatctaaaaatataagcttttttctgtcatattctgaattccctgaaggtaaggactatgtctgattcctctctttgtcctctgcacccagcgtagggcctgaaacagagtagctagcagtaaagatacactgaatgaatgaatgagtcaaccatccttggcctctggagctaattgagaaggctagggggagttccgctgtagggagaaggatgttgcatccctttgtagattgtgtagcattcaaaacctgctgaacactcaccctcaatgtatattctctgttctggcctgcttcaaggtcagttacactacttcctgggatgggcctttctctggcttaagcttggttgtccctggctttcccaaggatcacagcccaaaaggcacagtggggaaaatttatggcctattccagaagagtgagcagcctaatcaagccaagccttgatttggggttctcacttcactggtattttccctctgtccctaattgggttttctatagttactagttttccaggcctccaagggagattctgaggcttgatgtgttctgactgtgtcttggctttgtgatgctgagtgccagaaatactctgtactataaaaactaccatcgttctttgaaacaacaaagaggaataaagaacttaattctggtgactattgttttttttttcttaaactataagatgactattatactaatatctagtttgtacccaacttgttttaaaaaatgaatttgaggcaatttcttggtttttcataagaacttttactctcagaaactttactaatgataatcctttgcacttttacacattgttatttgaacttaattacctattaagggaagcagagcagggattacaatgcctgcttacggaatacaatgtcatacactagcttttaagaggaggagccagaggtacagagtcaccactgacagcagtgctggtgcttgccactgcatatcttacccttttttcaaaacaccttgagattattctcaacttgtagctgaaggggccacaaatatttattaacagccaaatcaagtggaatgatagctttaacttaactgctaatttttacttgactttgtttgttccattgagacgtttaaggcactactgaatttggccaaatttttcagcataactccttaagctctgtcagtaggtcagtctgctctcttaatttcactattggaaagctttcaggctgggcatggtggttcatacctgcaatcccagcacttttggaaagctgaatcacagaaaaacatccttggctggtggagaatgcctgtgtcagtagaaaactgaaagaagggagccaggcagaaactgataagggttgagaggcggcaagagtcctgatgatagccagtagggtccttcactgttgtgggaaccagtgacccaccagcctttatttcttaagctagcttgaattagacatatctatatatgtagcttgcaaccaaaagaatttaagtacccatcctcacagaaacttgattaattggtacctaaacttgttagtcactacctggaactgaaatgtaagccatgaggagttaactttttttttttcctaagtttgcatgcactctcttgcctctattgcctcaagaagccttgatagaatccccacttgctcattgcctggcttgggtgttacagctaccttgatctcctctttggttacgttgtatgcagtttgtaatccatcttcgtcctctttgcttataagtgccttcttgaggggtggctttgagactgcttcatcaacatcatgatctggcagttttgacaaagattccttggttgattgatagtccctgagtgacgtgtccagtttccgtctgcatgcatttacagccatgcagaggtttggggacttagcgggtggtaattcctcacatcctcgtagcctaaatactttgaggaaaggaaatagttcctcaccattttcctcaatcaggcatcttctgaccatcaggaacctcatgatgtcatgacctactccagtcaacaaagctgcatggttgaaaccttcctcaatgaacctatgcattgtcacatatggtgtcatttcagaaaatgtggcaatgagtttaaattggcttataaaggtacacggggtcatccgtaggcttgggtgagcatcaagtttaaaacgaaagtatgtgattttgatgtcaaggcctttgcatgctaaccatgatgcagcctctttaaagtcacacacaggatctagatcgactgacagagacacctccaggcctgacggtagatagtagagtattaaaccttttggcgatttgtcgcattggattgccactcagcttgcacacaatgtaatatatcagaagacagctttagcgactttgcacttgtgttgaagttgctcattttgttccagtcagccatgaaccatggagcattttgaccctcttttcccaagactgatctgtctggagtaatgaattctttaagctctggaacgagggtataaagttgatcaaaagtagcaacgagcactgtgatagtaactgacacagtacctcccaaagtgagagagtttgcttttggaattgaaggaagagctgtgcaacaggcagcgtacacatcttaagtgaggcaacacaatcacaggttgatcaccttcgctatgttctagtggcatgtttgcaggttccaatcactaggagctttaatggctttgttaacctgttggtgatgtcgcatgaagattgtctgacaaattactttaaatactaaagtttgataaacagtattacctaacagtacattaccaggagagacattgggctagaacagagagagaactggactaggaggagccaggagttcaaggtccttgtcctagagcttgtcagtgacctgatggatgactttgtgcaagtcactggccctcctgggaaccagttgattcagctctatcatgagcacaacccttgcccagccccctcaccagagagtggtgtagatctgatgagtcagtgaatcctcaaaagggtttagaaaacagtgaagtgttgtgtcaataggaagaagataaattgccatcctccctttgatctccattatccttcagcactggcaagatttgactgttggatgctaagaatgagagtgatgcagaaagaggggaggaaggcagggcccactgaggagggaactccaaggtggacgaccgtcatgccttgcctcagtccatccttagcaactgcaggcctgatgattttcaccaaccttctgactgtgccccagactttttgctcccctgctatgaggaacaacccagcctgggtatggaagagggaaatctcagccccaagtagttgggaagggacttggtctgagtggtctctgtcctctgcccaccacaaggccaggtatattacagtataggaagaagagtacaagggaaataacatttgtaaagtgcctactatgtactttgggttatacatacattctctcgcttaattcagcaagcctgtttagagttaggaaagctgagattcagcaaggttacacaatacattccaatgtcacacaaccagtaagtgtgacaaaaacctctgtttttgtcgtatagcaaagaagaggcagaactgaggggcaatgtttaccttgcaggttgatatgaggcaaagatagtgcctcttaagtccttggaacatggtggacattcagcagctggtaagaggcagctgatgaggcaactgtaataatgtatcttacagtgcactagagtcacctctcaaaccaaaggtttcccccttccattttatccaagagaaatgcattcatttctctccttggaagcccagacctagctggagattattttccagtgcccccaagcttcagatcagatggcttccaagactcagagtcatcctaaacatagtttctgttgtcaccaactaggaatagaatcagaaatgagaacctggattctcttaaggtgtaaacagaacttgatagcagatgaagctgacttagtgccagaggcctcagacacgaggcagatctctgagtcacaagttggagatagattctgtttgggactacagccagtaaccctgtctctgcctttccccactatggggcagtctctgaagctgtacccagtgactaggtctcagcccaccattgcaatgtggatgttccttcacacatcatccctaatcctcacaacagccaaagaagcaaggcattgtccccaacctgcaaatcaggaaactgagccctggaaagattgagtcacttgggaaaatataggtttttcatctgtaaaaactagaataggctgggcatggtagctcatgcctgtaatcccagcactttgggaggcaaaggtaggtgaggagttcaagaccagcctgggcaacatggtgaaaccctgtctcaacaaaaaaatacaaaaattagccaggtgtaggggcacgcacctgtagtcccagctactcgagaggctgaggtgggaggaccacgtgaggcccaggaggttgaggctgctgtgagctgtgattgcgccattgcactccaacctgggcaacagagtgagaccctgcctcaaaaaaagaaaaaaagaataataaaaataccttttatctctgagtcacaagttgcagatagataaaacttttttagataaaagtttaaacctttggcacatagaagatgttcaaaacatgggagctgccttgattattattttttcctacagtaatcatactagcccataatgtgtgcgcaatgtgtatgtgatggtctggatatatgtgtcctccgcaaattcatatgttgaaacctaacacccaagatgatggtcttaagaggtggggtctttgggaggtgatgaggtcatgagggcagagtcctcatcaatgggattggtgaccttataaaagacccgaagaggcttgttagcccctttgcccttcagtcatgtgaggatgcagcaacagggtgccatctgtgaggcagaaagcaaaccgtcaccagacaccaaatctgctggtagcttgatcttatacttttcagcctccagaacactgagcaataagtgtctgtttaaaaattgcctagtctaaggtgtttttgttatagtagcctgaactaagacgtgttagcaataccttcaaatttatgtgtgcatatgaatcacctgaagaggtttttaaaaaaacaaaaaaagtttcctggccccacccactgcccctcaagcttccccctccacaagaatttaattcggtaaatctgggatgggacctgaacatttgcatttgtaacaagttcccaagtaatgccgatgctgcaggtgcacagaccactcttggagtagaattatgttatggtacttacttcttcatatattaccttacctgcctcctactcacacttttgccagcctcatgaggtaggaggaatacagactgttactactactgttcctatggaatcaagcttcacttcccaaacaggtgtccaacttgtgtccctagtctgtcagtcagctgtatccttcctgggtcagaaatttagctttctcatgacataataattacctggaattcctactgatattctttccaataaaggtaacatcatagcatgagcacagatctggacaagtgggcacaggatgtttcaccacccatacagctggtctgtaagactctgggctcagccgaggactggatagtctgtggacaaagagacctcgagttacttgggctgccaaggactcagctgtgtggaaggggctttttatccttgcaaaggggagaacaagggtcagagcacagagcataagctatgtctggacagttgccaagctagagattgctgaactccatgggtttatgggtcaaatatgagattcaagggtgaaaactgtggggcttcattgtacccatcatccagacaataacctgaccctatgtctgatctggactctcatgttctgcctttggtggccacactatggccaaagacagaggtcctcctgtgtttcttgatacctctctccttagctccctcccctaagcgaccccagattcagatttctttggggtcaaggcattggaaaattgtcaagaagctgcagtgcccttcttgctactctatgtgcctggtttcaaagctcaggtttctgttttgaagttgaattatggttataggccatgcattttgggttaacaccaagtcctatgggcaggtatgaattttgaggggtgggtgccaagtttgtttgtttaccatattattccatcccctagcatagtgggacttaagtatttgttgaatgaattaatggccattctatttttaatcacttggagaagcagagatccttcaaaattggaaactcaaaggtaggtcctgggtaggataggacactcttgcctttcttgatgcactcctttcatttggctttatggcattgaagtgaccctaaggatgatccccagcagcccgagttaaagtgagccatggattcaggaagatgccattgagagaatcccagactggagctgaggaagatctactttgccagtccaatcatccaggttcataatgtgttctttgttgctactcagaaaccttttctaaagcctggtctgaacactctagcctggcatctgctgtgtcaatggctgtaaggaatagttgggtgaacacatccgacctagagccctgaaagtggagagtgaggctcccaaaggccagaatggtggtggcagtagaaatcagtgagggaagacctaacaggaaagataaatcttgaggccagagtcaagaatctccaccccttatatgaagatgctgacttggaggaaagctataatgtccttacaactcttgggagagtaggcttccatgtctgcttccaaggccagtgagtatcccagtgcttcaggcattccaaatgggagggcataggtcttatactaggcccagagttggggcagatccttgtgagacttccctgagcttgatggggtggcagacacacttatacttgctaaggtgctgaggctgatcccaccagctagggacggatgggttccagattcagcggctcagataggtggatgtgtttgagcagggctgctactgttggtgccccatacagaagtatctggccaaggggaaaatgaggcctgaaatccagccaagagtggagctcccagcccttgcaattataaggctgcaactgtcagaaggggcaccttttctaattagcacagggtagaccttgggaaatcctgatttggggtgtccgaggtaggctaatcatggctgcctgagtatgctgggctgaggagtccatgcctggcttctttggggatattggggccaaaggctggctctccttgcactgtctgaaagaggttgacctgg

SEQ ID NO: 298 - DNA, 28447 bp, Homo sapiens
gaaagctaagtgatttcactgactttcagtgtcagatgcccttgtcaaatttaatatatgcctcttattttacagtggagaaatctgaagttcagatagattaaatgacattttcaaatcacatagcaagtgaaccacatgttcaagacattgctcagatcttctaagaccaacttctatgcattactcaacaataaggccatgtgtagagtacaggtagctctccacacttccttcctcctgggctatactacccagtgaaagtagtgttgagaatgtggcagttaaatattgaaattggttactaggaaaccttgcattgtgttcttgcctagggttttaacaagcttaaataccattcagtttaagtaaaccaatacaagagtaaatctacttaaaacctacagtctggaagtagaaattgcctcctagtgtaatttttcctttttacaaattgtttatgtgtactgaacaccatgttcatctaagtgcacacattgtaaataccccttctattttcattgtgtattcttacctattgggcttctactggcagagaaatttttagattttgcagtctctggctctgcctttactggaaaattgctctttaatgtgtgtattgaacaaacaaacaacatctaaaatagagtataaggccctaggaatacagctaacaagggacatgaaagacctctgcaaggagaaatacaaactactgctcaaggaaatgagaagacacaaacaaatggaaaaacatttcatcctcacagatagaaagaatcaatattgttaaaatggccatactgcccaaagtaatttatagattcgatgctattcccatcaaactactattgccattcttcacagaattagaaaaaaaactactttaaaatttatatggaaccaaaaaagagcccatatagccaagacaatcctaagcaaaaagaacaaaactggaggcatcatactacctgacttcaaactatatacaagtctacagcaaccaaaatagcatggtacttgtaccaaaacagaaatatagaccaatggaacagaacagagacctcagaaataacaccacaaatctgcaaccatctgaactggacaaaaacaagctatggggaaaggtttccttatttaataaatggtgccaggaaaactggctagccatatgcagaaaactgaaactggaccccttccttacaccttatacaaaaatttacttgagatggattaaagacttaaacgtaaaaccaaaccccaaaccataaaaatcctagagaaaatctaggcaataccgttaatgacataggcatgggcaaagacttcctgacgacaacaacaaaagcaactgcaacaaaagccaaaattgaccattaaactaaagagcttctgcacagcaaagtaaactatcattggaatgaacagacaaccttatacaatgtgagacaagtttgcaatatacccatttgacaaaggtctaatatcaaaaatctacgaagaacttaaccaaatttataagaaaaaacaaacaaccccataaagaagtgggcaaaggatctgaacagacacttctcaaaagaagacattacgtggtcaacaaacatatggggaaaaaaagctcaacatcactgatcattagagagagaaatgcaaatcaaaaccacagtgagataccatctcatgtcagtcagaatggtgattattaaaaagttaagaaacaatagatgctgaagaagctgtggaaaataggaacactttaacactgtttgggattgtaaattagttcaaacattgtggaagacagtgtgacgattcctcaaggatctagaaccagaaataccaattgacccagtgatcccattactgggtatatactcaaaggaatatagatcattctactttaaagacacacgtacatgtatgtttactgcagcactatttacaatagtaaagacatggaaccaacccaaatgtccatgaatgatagactagataaagaaaatgtggtacatatacatcatggaatactatgcagccataaaaaggaatgaaatcatgtcctttgcagggacatggatgaagctgggagccatcatcctcagcaaactaatgcaggaacagaaaatcaaacactgcatgttctcacccataagtgggagttgaacaatgagaacacatggacacagggaggggaacaacacacactaggaccagttggtggtttgggggtgaggggagggagagcattaagacaaactgctaatgcacgtggggcttaaaacctagatgacgggttgataggtgcagcgaatcaccatggcacaagtgtacctacgtaacaaacctacacgctctgcacttgtatcctggaacttaaagtaaaataaaataaaataaaataaaatataaaactacaaatgcaaacaatatatatactgcaaggcaaagggatgggtaatgatatttctcttagactatcatcaattccttccctccattgtatatacgtgccattttctcattcacaggtagagtatattcctcttctccctttgtatatagtgtgatcttagagacttgtttcccccaaaggatcagcagaagagatgttctgggccttgagaggtcataagaagccttatagtttctgcctgggtcacacagaacactctcttttagaagcttttctctttggaaagctaaaatccatgttataagtctaaatactctgagactgtcatgtgtaaacagggggaagcatgagcttccaagtactatcaccaactcagctcaggagccaggacatgtgagtcaagttaccatcattcttcagttgatgccacatggatcagagatgaaccgcctaactgggcctttcctgaacttctgacccacaaagagcaacataaaataactgttttaagccactgagttttggggtagtttgttaggttgcaataagaaagcagggtaggatgatcacatgcccttttaatgtcacgttggagcatcatcttaagaccctaaaggtcagttgacttgccaggttaaagtgacttatttagtttgacttattgtgtgccctagattacagtccagccccataaagtttgatgcaaacttatagaaaattgtgaaattttatttttcccagcagagatgcaaataatttctgcctggtgagaaatataagtccaaaagttatggctttatagcacagcaggatatctaccacttttgcattaacacatcagtcttatccaggattcttcctttcactgactatatatgcattcacatttgggatcctactttgaaccagctttgttgttgtgccggttccctttaatttatcaattaaatagatctttgacatatactcactatatattttgtttgagaataatgtctttaactttggaaattatactttgacatatgtaaaagattgttcttcaccactgggttctacattgactcagtatcacatatcccagttaaatgcaatggagaaatatatttcataaagaagatggtatcccaatgctggctaaagccaagaagtatttctatctaggtttacaaagggttggggtacctcctccataaagcatttctctaattcttcccatacacaagattcatttaaaacaaaaacaaaaacaaaaacaaatgaccattcctccttggggtctcaaagctgctgtcagagtccactcagaaatctcaatctgtttaatgtatttctttatttaaaagcctgtgtacccttaacagactagagacaatcaatagcaggtctgtgtacaattcatctttacacggacagtgtctagcatacagtctcaataaagatttctttgtaggagtggtgcgtaataaaatcgtatatggattttatataattcctttgtataataaaagagtaatgagtcatgaattaaatgctacttgcattattcatttcatgttctgaaatttttattttgaataaaacatttcaccatctccaaaatgctatgtgaaaactgtatataaatctttcacttcccctttctcaggagatatcaatagtaatttagcatgagaaagagctttgattttacttgtactctttttaaaaaaattaaaacttaaatttgttttcagtgtatgattcaaaaatatatatcaaattatgtctctatatgctacaaggataaacacttattaaataaaattgaaatttctaaaatggtgcatgtttcctctttagccatgggtcttctgtgcatgtttcagataatcaaatgaaaatttgcattgattaaattctgaattccacttaaaaatgtcccttcctttgttcttagttaaaattcaaactgtgaatcatttgcatttaaatacccttttagatttggttccttactagtatcaatatccatttggatgattgctaaaaagtaaaaatctcagcaacatgctgcatatgttgcttataatcctgcttaattgctttgaatttgcaattaaaaactcaaaacaaaaataaaaagccaaatccacagaaataaaaatcatagcaaatgatatgcccagtttaggaagtagcatacgttttactttgaatgactacttgcttttcttgaataagacacctgccttattcatattgcatacaaatattttaagaaatttagcctatgagatttgtgaagttcacgatttgatgaccatttcttgcccattcaaactttactggactactcgctacaaatgaaggtcagagaaggaagtcaatttttcatcagaacaaacttgattagattgactagtttttcaaaaagtgaagttttttttaaaaagactattttaaagtagtacacttatatagacttttttatatgtgtatttgatgcagccccaattatatctgttcaggtattaactccttctgctccttctcctccatgaaaggaaaagcaggcatagatccaaacagaaatatccatatgacctattgagaatctatattataaccaaatggccattaggatatctaggttccataatttttgctacaaggcaattattgaaactttaaatactagttctacaagagggacttaataagcttaaaaatattcactaaacgtatcaagcatttaaataaagcaagacaatcagttttcaatatactaaataccataactacatgttcagctagtttgattattaatatttcctaactaggaactcattagtctttgtttgtttaacctaagaagttaagtacatgactttattagcttctctgagcttttcttacattactggagttaagataattcttccacttcagctggctgtgctcactttttggtcctgtgctcttcctcccttcctcaaatttcttccttttggccagtggcctgatttgtgggtttacttcttttctttgggaatcagcttccacattccagcggaactgcaccactttgttctgtctgtggcttaagtcaggttgatatggcttacaagttactcaataatctctcagggaccgctgatattaaggtgaggggaaaaaaaaaaaaacgaaaaagctagctttctggcagagtgaaaacaggaaaccctggaatccaaagaaacttattctcttgtgcttttttttcctcctgatttagtttccccacttcaatcttccccacctggggccactgaaattttatactgaacactttacgtggactccatgttacctgaagtatttgccttttcatggaagaagtttcttggttttcccatcattcaatttaacctttgtggttaaggtttatgtaatgtgaacttggcttaaggaaaaaattttaaaatacctcgctcttactccctgctggatttatgtgaaagaaataactggacaaaggtactgcaaatatatccaagatcatttctcacagttttgtccataacaacaataactcatgagaatataatcatacagtttatgactaggcaaccattaaaggaaggatgtatatttattatattaaggaaatggaaatatgtttttgacatatttttaagcttaaaagttgagaaggcaggctacaagttaattaaaagtagagattttacaccaatatgctgatgatggtcatgctggatgatgaaattttagactttatacagtccaccacttacgctccctatgtggttacagttgtcattctgtatactggggcggggggcggggagagcagctattggtttcaggacccctgcatatgccaaaatccttgcatattcatgtctggcagtcggccctgcagaaccacatatatgaaaaatggaccttctgtaaaggccatttcacatccgcaaacactgtattttccatttgtgtttgggtgaaaaagatctgagtttaagtggacctgtgcagttcaaactgtgctgttcaagggtcaactatatttagttttacattcaaattaactacaactcaataaaatttaaaatttcagttcttcagttgcactagccacacgtcaagtgctcaataaccacatatgtctagtggctactgtactgcacagcccagatacaaaacatttccattattgcagaaagttctgtgggactgcattgttttagataatgcctatttcttctatgatgtttttgtttattctaacttttacaatgattataatttttataatcaaaataacaatgaaattatttataccgtgggggaagcatctttgctgttaaaatgaaattacagtgcaggaaatctatatcatgattttctttatctaataagtatgtatcacaagtggtcctcaatactgatattattgaacttttttaatggagagcttttctgaaatttcatctagctatctaaaatatttggattgttcagttattcaacaaatctcttacttcagagtctccttgggaatatctattcaaccagaaatggaaaagaaaattacttatttggcaactaatctttggctgtattccttttgtatttctgtgcattgagaaatggtctatggggtaggggaaatggtagtagaactatgttttaaatatctaaggagatttgtcagacatcaaatactaatataacatgttacaatattggaggcccatgatgagtcaggctgctatctatctatctatctatctatctatctatctatctatctatctatctatgatttcttatttattttggcctgtccactaggagttttggatttttaaaaattaatttggtttatttaaaattcagaagatttttaacaatatggattttgcttctcttaaaaatcgtatctgacaatactgaatcaagatttttgcaggccagctgagtgtactctgagaagcaatctccccatttagctatagcatgtgtttttgtgctcttcaaggtgttatggcaatcaacattttccactctctcctacaacctagcatgctggtccatttatgtcattggccctaaccatgcaggcatctgagtttgagtctgttgtctatttgaagagcagtcacagcacatattctggttagaaatggaatttcctgagcaactaaatgatttgatacaaaagaaatcaagcatcaataatcttgtcctatttcaatttggattaatcgatatttcaccaccacttccacaaactcccaaactcctgtcagtgtcacaactgggtttatggacattcatcagagtggttcattgttactacaatacacaggatatgtatgcacatttaaggatatgaattagactgtgatgcacaaaagtgtcataagctaattcccacagctctccttgataatatgatacactatgaagtgactttcatttcagtttatcagtttctcatccaattctgaactttattaaaggacattaatcatagagaccatttactcttttgaggttgctgactagatgtctgtggaactatatgaatctactaagacaaacacacgtctataagagagtgaggcaaatagttggttatggctgctaatacgcttctgaaaggcaattttaaagaagataaaatgtgttttgtgcaatcaatgtcagtgaaatcagttgaattttccaaagcaattgctctaaaagacaacactcatctgttttgctggatatttgatttgtttttgtggtcgttgtttaaatccatttctactcttttaaagttataacttattggtatatggttcattcttcaccaatgcagatatattgagaagaatggaacctgtcacatataacacatatttgggcaaagagtactttcttaaggaaaaaacaaacaaaacaaaacaaaacaaaaacaactactaaaagactttaagtggaactgtgtagaacatgttaaatatttccatttctgtttacctttgtttctaggtatttgaaaagcccaggctgctttgttttataaacaattcctatactcctgtgggcataattctatattaactgaagattaatttcaggttacactgtaaaaatgccttacaaatgcaatactattagggtgtggaaaaccctgaaggaactgaaaatccaatccatttgagggaagcctttaattaacatcttggagaatatgtattacctttttaaacagataaatattttttttcattttagagtagcggaatctaatcttaatctaatcttttaggagtatatttcagagaaattccaagcacaccagtatgaccatccttatttcagaaatgacaatgcatagaggaaaagtaatgtgtgcaaagcctccgaagaggatggttaagtaaagacttaggttaccagtatcaggctttcgtttttgtatgtaggtagctctactgcctcctcttaaaaccaacaaaggaaagagagactggctgcaaacttttagaaggaatggcttcgaatagggttcctgggaggaatcccgaggaaatagacgctgctgctctgctgattgtctccactatcctgttttgctcctacccactaatccagcctgggaggctctgggcattagcggaaggcttcaccacaaggagacaggagcgagtattccataggcatgcgctcctagtggcacgagtggcttgggtcaggatcaaagagtgaaggattcggaagtcagctatctggagagagagagagagagattgtgttttattcgtgtcccatagctttcctatcctatccctatcctagcttttaacctgagccagagctcactacacaggttcctggctatcgagtctgaatctgcactactcaacttataaactgtctgcagacacctgttagggaaattgctgatcatgggcagcaggatctgaactcgctttaccttctcgtttggagcacagggaccgcccagctagaggagcaccagcgcactgcgccccagccctgggcgagggtgcggaggatttgttctcggtgcaatcctgctggcgcttttccggggttctgcgcggatccagctccccatctctgctcctacacacacaaaagaaaacaactctcgattggaagttgtggaattttctcagcccctacgaggcgcggggattctccagccccggccctcctcccgccagcctgaggtctccttcgctcgcctgccttgctagggaccgcagtccctcagccgcagctgggtctgtccgccccgcctttgccctcgccttttcccggggcggatttggtgaagtcggcctcaagtccaggaggtctgtcttcgccgggccagctctcgcggaactggggggtagagagcaaagggagagattcgtggaagggaagggaggtaggggtggcgcaaacgcccagagtatcaaacttgggggtggcacagtaggtgacagcagcagctgcaggtggtggctggggacccgcgagggggcgcccctctgggtagggtctggctgagcgggcttgcaagcccgggaggcggctgagagaccctggacactgttcctgctccctcgccaccaaaacttctcctccagtcccctcccctgcaggaccatcgcccgcagcctctgcacctgttttcttgtgtttaagggtggggtttgcccccctccccacgctcccatctctgatcctcccaccttcacccgcccaccccgcgagtgagtgcggtgcccaggcgcgcttggcctgagaggtcggcagcagacccggcagcgccaaccgcccagccgctctgactgctccggctgcccgcccgcgcggcgcgggctgtcctggaccctaggaggggacggaaccggacttgcctttgggcaccttccagggccctctccaggtcggctggctaatcatcggacagacggactgcacacatcttgtttccgcgtctccgcaaaaacgcgaggtccaggtcagtaagtgtaattcctaactctgatcacctcctgggaacaagaaaatccctagaggagcgctcggttcctatgaagagggacatgaggaggtcctcatgagtgtatggactttttcctcctcctttaggcgggaggtggcgatttggaggatgtaataccatccccattttctactttctctagattttcccttttctgttgaagattatttactatttccttgacccttctttgagataggtcattatctttccagaacagtaagttgttattgttcctgcctctttaaaaatcaaacacttgtctaaagcagaaggtcctattggattctccaaagccgttcaagaggagacacattcatttaagcgtttgctcattttccatcagaaaggctcacccactggcaggagcttttggtggcagggaaagaggcaaaattaaaagctttgagactttttgcaataggtacacatcatttaaaattcagtgacatgaaatggagatgctgtttccaaagaaaggcttcccacaccctttggtgaatattttcaactttctactgattagccaaacaatcatgtcttgtatgtagcattcttgaaacttcccttcttccccctcccctgcccccattcctagaactaattagtgtaggcaaatgcagggcttttgatttctgagactgatttctgagatatttttccctgggaaaaatgttctggaagacattgtgcttgataagatgtgtaggtttactaaggccaacctgtgacaatattgttgcaaaaagcccccacagatttaaacatctctcctcaaagcatgaactggtctctgactcaaataacttgaggttatttgaatctcgggtggtgggctgctgggggaagtcctgaaactcttttcctattctgcaaagaaatgtttctatgacaaagtttctaaggattcccttattcaggaaaattgtaccagtaaaagttctctttaaatgtcttaaagtaatgtaaatatctcattttgccttatttcaaagaaaggttattcccttgtctgcttgctgtttcctttgtgtgcttttgatggcaacttcctctgtgtaccattttcctttcccacttttccagaagtgctgtcatgaaatgatgcattttctgctctgggtaatgttttgacctggctgaagggagtaacctgcttaagcacagctaacactgtctatattctaagagcttgtagatcaacaaccattcctacagagaagttgtaaataaaagggcttcaaaatttataaaacaagactgagaagaaaaagcaaagcaaatcaaaaaatcaagtatactcttcctcctagtaaccttcaatctcatgcttcctctcaatttagtcaggtataacctccaaactccagcctcttggagtctctttaattctgtaaatggctaaatggcttgtcaggattgagtaactgtactctaaaaccagtctctttcttagtctaggggatatggtgtgggctatcaaacatacactccaagatatgaatgatttgtttcagatttctctaattactaaggagtggaggcacatgtgaaaagaggctggggctccttggaatgttctatgtgaaatttatgcagagggagcaggaatatatcagtacggcaaacacctgagtacatggaaactctcatgtctctctgtatagtaaggctcctgtggaagggtgagtggtgagagacagagagtgagggaaagatgcggaaagagaaaaaaaagtgagataaatggagcgggagaaagagagttgggggagcagaaacctttgaaacagaaagttttctttatgggttatactgacaatttaaaatgttataatcaggaattaatttaacagggtctcaggacaattttttttttgtataagcagttatctgattaagaataagaaaataagcatatggatgttatgtcatagggaagaaccctacataggcagttgtcttcagtaaaggaaaggatcaaaattatactttccatttggctgacattgattattcagtataattgtgctttcctttagctttatatttgttctgacaaattgctgagtacctttaatatgctatatagtgtgctagggattaaacaatggaggaagaaggtctaggttctgtcttcaaagagattgctgtggtgggtaaacgaaggaaaacagtcacaacgtggcatgtggtacatgcggcattagaagtgagcacaggggcttggggtaactgagaggcttcccagtttaaaacggggagggcagagaggcatgaaaaaggctcaggtgttactggaattggaagtaaggcagtatgacagaagtggacagtatatattgggctgtcagcagagatgaggccagagggatatgcagggatgagttcaagaaaagcctcgaatgtcaggctaaggagttgggattttcttctataggccagtgttgtcaacctgtgggtgcagatcctttggtgggagagcaaattaatgaaagcatacatgtatgttattatcagatcatgcaaaacagaatctattcaagaatgtaaaaaaggagtaatttaattcagatagttgattaaacaagtgatggaagccaaacaatggatgttgagactacctagggattaccaagagcaggaagtcattactgcctccagctggatggatatgaggaagaggtagtgtgaccaaggcccccggaacagggacaccctctggaatcagaatcacaataggtctgtcctatgaaaaccagagctacagaactgctgtagaggcactgccaagagcagagagggaggaagaagaatatagtggcttctcccttcctgctgcctgccagtgcctcccaccgaccaaacccagccagaatcccaaggacttggagcttgaaaatgtattctgtgagagtcagccctcctgtggtacagagcagaacagaacagaggaacagtgagggaaggagctggggggcacataggcccagccaagcattatctgtgggctgaataaatatatgactttcctaccaatggtgttagatgctattaattacaaacacattcattgaaaggttcataaaaacaaattcataaaagaagctctgaatgaacagtggcagccttttgtgattatgagcatatttgaaaggtactaccaccatggtgttgggctctgaatgctttaacagactgaaaaaatgaaacttatattaaaaaaatacatcgtaattgtttcaaacaatctggagacattgaggaaaacaatatgatcacatttgaatttcagaaaaaaaaattttaatatcagagtaggcattgtccagtaaaatgtgagagccttagagtagaggtactatcctcttgtcttcacccggcaaaaaccctagttcaagacataggtttttaaatgcatgatgcatgcaggtttgaagaagtaaaggcgccaggatggtaaagccacccctggcattgagtagacactcgattatttctgttaggtgaatgaattaattaataaataaaagcaaaagaggatgggaggtaagttagaagatgattagagtaatcatgataagagattaagaagaataaaaccaatgttgtagaaacgatgagaaaataggtggaagagatatgtaacatactagtctgcgggttctcttaaatgtagaggctaacagagattttgagaaagcatgaaatgttatatgttagttcagaagtttatttaagatcattcaaaaaagcaactgttccaacccaagtttccttagagcattgagtggataaagaaaacgtggtatgtaatacaccatggaatactactcagctgtaaaaaagaatgatatgatgtcttttgcaacaaattgaatggagctggagaccattattctaagtgaagtaactaggatggaaaatcaaatacaataggttctcatttgtaagtaggagctaagctgtgggtacacaaaagcatacagagtggtataatggactttggagactcataaaggagagggtgggaatgggagtgagggataaaaaaactacatattgggtacaaggtacactacttgggtgacagatgcactaaaatctgattttactaccatacaatccatctgtgcaaccaaaaaacatttgtaccccaaaagctattgaaattaaattttaaaaaagtaactcttctatatattttaatactatttttaatactaaatcctgcaccaaaaacagaatctgcttggtttatctgagataattcatagtcccaaggttcaggcaccagacaaatagttttaatatgttcccctttcttatacaatttgttgctgtatatttataaatttgaaacagtcaagataatgaaggaaactttacttttttatctacctgaaaattaattcaatgaattcatagtggttatacaattcataaagtttataatattcattccacttaaaatgaaattaatccatttgatagcattcactttgaaattatgtctatactatcggtattatactttaccgtcatagcatatatttcagaaacctgatttaattgatccatatttgacaatagacttattaaagggtctatttcattaaaatgttttgctatgcacaattttagagagtagaggatattttgatccctaaccaaaattaaaccagtccatttgtgaaatttctttgcttcacctttgtgttttcctcgttccattggtttttgttgttgttgttttgttttattttgttttttctttttaggttgtagactcttgtgctggttgcaggccaagtggacctgtactgaaaatgggtccaataggtgcagaggctgatgagaaccagacagtggaagaaatgaaggtggaacaatacgggccacaaacaactcctagaggtgaactggtccctgaccctgagccagagcttatagatagtaccaagctgattgaggtacaagttgttctcatattggcctactgctccatcatcttgcttggggtaattggcaactccttggtgatccatgtggtgatcaaattcaagagcatgcgcacagtaaccaactttttcattgccaatctggctgtggcagatcttttggtgaacactctgtgtctaccgttcactcttacctataccttaatgggggagtggaaaatgggtcctgtcctgtgccacctggtgccctatgcccagggcctggcagtacaagtatccacaatcaccttgacagtaattgccctggaccggcacaggtgcatcgtctaccacctagagagcaagatctccaagcgaatcagcttcctgattattggcttggcctggggcatcagtgccctgctggcaagtcccctggccatcttccgggagtattcgctgattgagatcatcccggactttgagattgtggcctgtactgaaaagtggcctggcgaggagaagagcatctatggcactgtctatagtctttcttccttgttgatcttgtatgttttgcctctgggcattatatcattttcctacactcgcatttggagtaaattgaagaaccatgtcagtcctggagctgcaaatgaccactaccatcagcgaaggcaaaaaaccaccaaaatgctggtgtgtgtggtggtggtgtttgcggtcagctggctgcctctccatgccttccagcttgccgttgacattgacagccaggtcctggacctgaaggagtacaaactcatcttcacagtgttccacatcatcgccatgtgctccacttttgccaatccccttctctatggctggatgaacagcaactacagaaaggctttcctctcggccttccgctgtgagcagcggttggatgccattcactctgaggtgtccgtgacattcaaggctaaaaagaacctggaggtcagaaagaacagtggccccaatgactctttcacagaggctaccaatgtctaaggaagctgtggtgtgaaaatgtatggatgaattctgaccagagctatgaatctggttgatggcggctcacaagtgaaaactgatttcccattttaaagaagaagtggatctaaatggaagcatctgctgtttaattcctggaaaactggctgggcagagcctgtgtgaaaatactggaattcaaagataaggcaacaaaatggtttacttaacagttggttgggtagtaggttgcattatgagtaaaagcagagagaagtacttttgattattttcctggagtgaagaaaacttgaacaagaaattggtattatcaaagcattgctgagagacggtgggaaaataagttgactttcaaatcacgttaggacctggattgaggaggtgtgcagttcgctgctccctgcttggcttatgaaaacaccactgaacagaaatttctccagggagccacaggctctccttcatcgcattttgatttttttgttcattctctagacaaaatccatcagggaatgctgcaggaaacgattgccaactatacgaatggcttcgaggagataaactgaaatttgctatataattaatattttggcagatgataggggaactcctcaacactcagtgggccaattgttcttaaaaccaattgcacgtttggtgaaagtttcttcaactctgaatcaaaagctgaaattctcagaattacaggaaatgcaaaccatcatttaatttctaatttcaagttacatccgctttatggagatactatttagataacaagaatacaacttgatacttttattgttatacctttttgaacatgtatgatttctgttgttattcctattggagctaagtttgtctacactaaaatttaaatcagactagagaataatttttgtggcatgttgtaacatttcacagtatttacaagctatttttgcacaggtacatagctctcatgtatttaaagaacactgcagtgttattttctttgaaattcatcctccacggacccattcatactaaataaaacaatgtaattacattaaaatggacctatctgtaagaggtactaaaaacactggattcatttcatcttgcaaatgttgtatttcaaaccagtttcacataagttatttgtcttcttttcaaaataattagctatatttttatataatatgaatatatacataaaaattgtttctataaattgtagaacatagatgctacagtattttttatttaattatattatgaataaaattgttatttcaatagtacccaaccaaagatgcttaaaaaccttctatgttcataaaaaataacaactgagatgttaaaatagtcatacgtctttagatgctattaaagtttcattagtcatatttttgtaaatatgacagaatttgtgaatatatttttaaagcaaaaaacttcaacatgcatatgatatatagttacaacattaattttatgaactggagagctttactttgtggatatatttaaaattcatattatagctcctattaaattccttccatgatagatataaaggactggtttttaagtgcactgcacttctggaatactgaaaaagaatgaaaacaatatgttagattaggtgtaagactttaagaagcgaacaaaaagtaatgtatatctgtaatatataatcaaatgattcatttttctgttagactaggcaaattgttcaaaaataacctttttgtcttttaagtagcagtcactttgcttaagatgctaatagaaaactgtggttaaagatttaccctccctcttggtgaattattacactgtaagaaatgtatatgctactgtgttacatgttgtattagtaaattattagaatccaattaatgattcaattaacatatatcttatccaattcattatgtcaattcattaataaaataccttttatgtagaggctttatgttgcaattaaaaagttgggaaaatgagagaaattgtgtggaattttatatcagagtgcttgtctaagacaaggcagtaagactaatgcaactaaaaaagaaaaataagggctgctgttccacagttagtccagctctctttccattctgtacctgaacctgagtcaatggatccactcttacgactgcaattacaatacataatatgaggatacgtggatcttcatttttcagacaagacctttcttcttaacttcaattctgtatctctaccggccaatagaccatgtccacatgggtgtctcaccagcaaatcaaatctcaaacagaacctgccatttcaatgcacacctcatcccatctcccctccacgttgtcttcccgtattctctgtctcaatcatgacactactatgtacctatttcccaaaagccttacattttggaatcaccctttacaagtctctttatcgcatgtatctaattaattcccacatcttgttttaattcctacgtgtttctttaatcgacttacttttttccattcccttggtccaggctatgattgtctccccagactgctattatgtctcatctggattaatataggtacttcctaattggtctctatatcttgctttcttcccatctaatctgactctaactcattagccatagtgatttttcaaaaactcagattttatcaaatcactcttctgatgaaaacactttaacgtctccttatatgataaactctgcatctttttatgacatggaaggttgtttagaacctgactgtgcctgtgttttttatctcatatagattctttttttccactaatatttgctgctagattttaagcatcatgagggccaggacagggactgtcttaaccattgtggttatcacagatacttgcaattcttgacatcaagttagtagtcaataaatatccttcaaggaaattgagtttatgaagtgaagtgtatttactaaagccaagacttgaagatagatttgcaaggttgtaaaccataaatgtttcccattttagcatatgtcttctaggaaaagaaggttttagctacacaagagtccagtaaagatatatttgttcagaatcaggttggttttctttcgttttttggaggccattaaacatagacacacgcgtaagtataaagggctctatacatagatttcattcatggctcactcaaaattagctagaactttatgaccagggaagaatggaggaggcagtcatgattcagatagctagaaaagccattgcaggtatttctagcagaaagttatttaattcaagaaattaaagtcttataaaaccactggaagagctagggaagttaaagttaggaaaagtatccactagtattgaagaaaccaggaagtgcaaaattgcaagaaactactattaatgtgaacagtacgaaagtggatgatgtacaggaaaagtacagatttatctataaaatcttattgtcgctcgctaagcccacactcctgcccatctctactgtagatccattaatgccttttgcttctcttctggtttccaaaatttatacaactctagccttactggcatggatctagggaaatgttcttaggtttcaaatccctaagatacaggggaaagcatggaggggaggatatggcactcagttgctatcagagagtctggcaatcttagggtgtaatttctagtttcaacctcatcttctccttagtacctgcgtaggttctccaaagttacagtgatgcaaattgactacatcttttccttttcttttaacaaggctcaggtgtcaaaaatactctttaaaactgccccatttgtacaggtagactgaggagtaaagtataaataaaggccatttttcctacaatgggctgattggaatggaggaagaaaggataaatccgatataattataccaatactggaacaatgatctgaaaactacagaagaatctaaattctggattagcttcctaggatgagcaaaaggaaataataatgtctcagggagagaagagtcttcaaaattttcaaattgataagagatgaaatattaatatatatggcagcaaaagacaaaaatgttattttttcttaagaaaacaaaaaaattaaagaaacaacacaaagatagtagagaacgcaaacaactcaatgattttatcccatgatattaaactcaggtaagaattttgttaaggagtttctaaggactgatttgaggatttacaaagataactgtctgttagaccattgacctttttctgccttagtacacttgaaagacgtccacagactccacaagttctcatagatatggaagaggttataaaaagaatagtctgcaggttataacaattcgcattcatgttatctgtaactccagctcttccttgctaacttgagattgtgtaattgaatgcaagtaagtgaaaatggctaaccctgaacctactctcctttataaacaaataattgccaatttttcaacactttaacaaattacttgcaaaacaccacgtggctgatcatgacaaaggattatgttataacagtaaaattaaaaagcactataacttcacaataaatgaaggaaaacaataacaagtcaataattatttttaaattaattttgcccttgtcatagaaaattaacaaactataaaaaaataagtacatatatgtatatacacacatatatttaatgacaaatatatcttcttgacgtacagtattatctaatatcacatattatctgtgtatagaacatctaactatctaaaagtggtgactagcctttttccaaatgacctatttatttccaccattgtccctacaggagtaactaccactgggctgtgggtggagtggggtgaagaggaaaggagaatgcactctggaatgtaaacaaaataatttgaatatatgcagtttgaaaaagctccttggtgagtgtggcctacttcccccaaccagttgataatcaaaaatgacagacgtcaaactggtgcttatcattttgaacactgacacgtttttaaatgattagtatccattaggatacacaagctacgatctgcctccaaagacttgtgaattgttggagggcacctattgtgcaatcattcctgttctctggtataagcaaatcagaacttgtttccagaatgcaactgagaagggagaaacaaaagacttcgagggacatacatagtgttagcactactgcatgcattgtgtataagttgaagccaaataccatcagtcaaaacgcatctacaataatctcttgatcccatcagaccatattgagggatgtaacaacaggatctagggcaacatagataatgtaattttatgttcactgaagcaataatataggtttgacactgaaggattgtttctgcctttttattccaggaaaaataatttactgaaaataagaacttcctacttacttacaaagataattccatctaaacaattgcctcaatagttttcccacaaatatggtgtactcagtaacttatgacctcaaaagctccacaggagttatacaaatctggtttgtctccaagatacggattttatatttactttctgatatttagcttaaaagtctaaaattagatggaggcattccttacctacaaggaccctcatgagaattgcttataattgtcattatatcccaagacagcacaaaacagtttattatagtcatgagtattagaatgttttttaaagcacaggccccccaaaagataatttcttagtggatataactaggaaatatgaatgacattttggaactgtcaatattgtgatgtggtgctaatcttattcaaaacatggttgaacatggtttagcgattttgctactagtgataatcacttgtcctgatatagtcaccatctgctgtggtttgtatatttcctccaaaattcaggtgatgaaagttaatggccaatgtgatggtattaagaggtagggcttttaagacgtgactaaattatgagggctccttccatcgtgaatgatattaaatcccttataaaaggggcttcatgcaaatttggctgttttgcctttccacctttcaccatataaaaacacagtgatatcccctccggaggttgcagcaataaggcgccatcttggaagcagagaatagtcttcaacagaccaccaaacctgccccatcctgatcttggacttcctaatctccagaatggtaagaaatgaattttacaagttatccagtctcaggtattttgttataacagtacagactgttactgaatacattttatccaccaacacattcttaaagatagttgcatgatggtgcaacagagttatgtcatcctcgcagaaaattcatggctttaaacaaattaacatcatcatgcacagaaagcaagtgggtgaatctgctttaggcaaggcttaaagctgaagctagagaatccagagcaacagccaagtctaaggtaacagactcttaaaggggacatggaactaagtatccgcacctgggcaggaacaggctcaaatcaggaacagatgaggggagagggaaaaggctgcaccagtgtggatatgcaatgctgagtgaagggtcctgggccaaggtgggaaaaatctttgatatgcctcttcttctgtgaactgagtaagcttatgacaccaacactatttttgttaaaatcacctaaaagctctcataatgctccagaataacattttaattatttttaaaatataacttattagagttccttctttcaacggttatatcatacatttgttgaggcttaaatagtaaattactgtgttaattggctcctgattttcacccagctggggatgagggtatgctgtagaaaagtatgaggagtgtgctgtagcaagagtgtttatcttctgtgggaagaggaagacatcgaggggaaggtaagaatggaaaggtaaagggcagaaaacagtctaaagaaatgggtcagaacatttccagtacttttccatttgcctagattcagtaagtcaaatgggtatctactcactggaagatgattattttggtcctcataattcacagagtgttggtggagtgcctagaagggttcttgcctcagtaatgagaaataattagacccagacaaaatgcttatctaattcttctcaacaaatcttaaaggcagcactggaaggaatcaaactgtttctaagaaatttaaatgtattacaaaatatagctcaaaacatttatcagtaggcaaaatatatataggatgacacaggaaaacatttacaaattctgtcatctaatcaaagattatcaggcataaaaaagcaagaaaataagacccacagtgaaaagagaaataaatcaatctaaattgatccagaactgatacatgtgttcaaatcagcaaagagctgatttatgttatgtgttaagcaaagagcttaacacataaaactattctgtactttaaaaaatttaagtagatgtatggaaattataaaaagttatcgagaccaaatatctggagatgaaaattacaatatctgtgataaaaactatattggaggggattcacagcagactagaaatttcagaagattagtaaacttgaagacacagcaatagaaattatgcaaaaggaaacacacagagaattttaaaaatgtaaagagattcagtgatttgtgggacaacttcaaatggctttacatatatgtaattggagtcaccaaaggcattgtggtgaggaagaaacaatattttaaaaaccaagttcacttactcctaatgccatcagcaattatgttgaatgtaaatgtagaggcagaaactagtagcacttacctatgtaataccagcgactccggaggcaggaggatcacttaagtataggaatgtgagagcagcctgggcaacatagtgagacccccatctctaaaaacattacaaaataaaattagcctggcatggtggcatgcacctgtagtcccagcttcttgggaggctgaggcaggaggattgctcgagcccagaagtttgaggctgcagtgagctatgagcctgtcactgcactccagcctgggtgacagaatgatatgctgtttctgaaaacatttttaaaatgtaaatagtctaaatgccttaatttaggaggcagaaattgtcgtatctgatataggttgttgcaaaagtattatggtttctgtcattactttttttttttttttccgagatggagcctccctctgtcatccaggctggagtgtagtggcgcaatctcagctcactgtgacctccacctcctgggttcaagcgattctcctgactcagcctcccgagtgctgggagtacggcacgtgccaccacgcctggctaatttttgtatttttagtagagacagcgttttaccatgttggccaggctgctctcgaactccttacctcaggtgaggaggtaagcctcgcaaagtgctgggattacaagcgtgagccaccgcgcccagcctctgccattacttttaaaggcagaaaccgcaattacttttgcatcaacctaaataaaagactcaactatatatcaataaattattttaaatacataaataattctacaaaatatgaaagttatgattagaatccagaatgcacatgttaataactttgttaatatagaaataataccatgacaccaaaactaccagagtttgtgaaggcaaattgggaaaaactgaaattgcacattttttaaaagtaataatagctaaattgacaatgtcgaaagcagctaaaccaacttatacattttaactataaagattaaatatatatatatgagaatggaacaaacaagatcaaattttagcatgtatgaaaatctctgatacatgttaaaatgcttattcttagatcctattctattcttacagattctgaattgaaattctcatctgggcccaagaaactgcctggtaaataattacccttggtaattccatgtagatggtgtctatgtatcacataaagaaatattctggtttaataatcaaaccagccaaaatgtgatggtgagaaaagatggaaggtaagagtaaaattaagttctttaaaactacagatgtatattcctcagaagcattatattaaaaagaaaatacaccatgacccagtgggattattttgacttaacattagaaaatctataaatgtaacttattatattaacaaacttaataaagaaaaagcatatagttatctcaataaacatctgaaaaacatttatatcaatttctgataaaaattgatattacaaagtctacaattttgatttttccattttaattatttttacccgctttatatttcatagattgagagacaagttaaaattttctggtgactattttatgatttatttttacctgtattccttaaatttctcatagagtttattcaaaattaattttgatgttaccttacttggtgcaaaagaaaattcatgacaattgaatctttatttttgccttgaatttgactttatttggtaataatattacaaacctgttttcgtttaattttcatttctatgttacatctatcaatttttttcacttcagtatctgtgttttgctttatgaggcatatttcttttgtacaacacattatcgggctttgattttaatctaagtctacattttttaattgactcatctcttttatattgattgatctggtatgaatgtatactccttaattctgatatttttttctatattgaatatggactttgttttttactttagatatctagtctatgcttcccttggtttggtggttggggttacagtgatggttttaacggtgataatgtatgtgttgtatttttgatagtttctgagacttacatatagtttttacatctccaaatggttttaatattattatttcttgatttagtaattttagagaatatctgttgatatgttccccaccatgaatgattaagcaaataaaatttaaataatgtaatataactacacactaccaaatagctaaaagtaaaatgaaaaaaaaaccaatgttgatgaagatttgaagcaactagaactctcaagcactgcatgagtaggagtataaattggtaaagtctcttcagaaagctctttggaaatgtagacaatagataaataattcagccttattaccaaggagttccatttctagatgtagagccaacagaaatgcaagcatatgtttgccaaaacacatgcactggaatattctttgctgcactattcataagagctaaaaattggaatacgactttagtgtacattgacaatacattggataaacaaagtatcaaattctatattcacagagttaagtactatagagcaattaaaagaaactatttttgcatgcatgcaacaatagtaatgaatcttacaaatattttgaggaacataaggcaaacacaaaggatttcatactttatttaattacttttatacaaatttaacaagtggtcaaaggcaggctatgttattagaaatcatgataatggccacctgtgctaggaggatctacaaggaaggcttctgtaatgcttttaacattctgtttaggtgtgttcatattgttaaagtttattaagctgtatatgtatgatttgtatacttttctgcataataattctgcaataaaacatttaaaaactagtagcattcggccaggtgtggtggctcaagcctgtaatcccagcactttgggaggccgaggcgggcggatcatgaggtcaggagtttgagaccagcctgaccaacatggtgaaaccccgtctctactaaaaatacaaaaattagctgggtgtggtggcgtgcacctgtaatcccagctacttaggaggttgaggcaggagaatcacttgaacccgggaggtggaggttgcagtgagccaagattgtgccactgcagtccagcctgggtgacagagcgagattctgtctgaaaaaaaaaaacaacaaaaaaaaacctggtagcattcagtgctggtgagattaggaaagctaggcatatgttatgctgcatatgtatgctgatggaaatgccaattaatataataattttggaaagcaaccatacaattgctattaaaatttaacatgaatgaataattggagccagcagtccacttttgggaaatctgattagtggaagaaaagcagcaagagagaaggatacattaaagaaaattgtgaagaattttaataactattattatgaaagtatttaaaataattatagtacagtcagtcagactgtgatatattatgcaactattaagtagaatatgttttatacataactgatgaactagaagaatttctctgaagtgttactaattgagaaatacctaaaaaatacataaaacatattcaagtattcatttagctatataaccagattattaatgttgtttagctaatgggagtagggtgggaaaggaaagtagaggggagaaaacaaaataatctatgcatgaagatctgtgtttctttttctttttaaataaaggcaaaatcttgaaagtaattctttgttcacataaagattgtaggaaaacacttgaacctgggaggcggaggttgcagtgagccaagatcatgccattgcactccagcctgggcaacaagagtgaaactccgtctcaaaaaaaaaaaaaaaaaaagattgtaggaaaaaatacagttatctggtgtcactaacaatattagtcattttggtgtgtgtgtacaagtgtatatattttgaacataaaaggatatttgttatttaatttttaagaaaaatttaaatattggttccatctacttataattttagataagtataaaaatgtatttgagtgatatacctcaaaacagtaaaagttgatatctatagttgtgggatga

SEQ ID NO: 299 - DNA, 57916 bp, Homo sapiens
ctgaggttgagaaaacctacccaaagaagagacaaacttagaagcaaaacttccttcccaccgttgagatccagaccttgttggagagagcaagatctgcagattactgtatggcgaagttggctgggtcctcttgtgccagagctcatctaaagtcagctagctgaggcaagcaaaggcgacgctgtgggccaggattgtcaattggtaagcctataacggaggtgattttagcaacaaaatttgttggagggtgagagtcactgaggattcctgatgcatgccataggtagccacaggtagttcggttactgcagcaaaaagagagaaagtgcaagaaaactagagaacactcattgtcctgcagtgtctctccagcgccctctactgacaaagtttatcatggtgacatccaaagaaggagatgtgttccctggagccagctccagcaaatatggttggtaaaggatagtcgtactcggcaaggaaaagcaacaagttactgatacattccacaatatggatggattttgaaggagtaggctaaataaaagtagccagacgcaacagactataaaccgtatgtttccatttttataaaattctagaaaagacaaacctatagtgacagacaggattaatggatgcctggaagcagattaggggcagagattgactgcgaagaaacatttgagaactttttgagattattaaaatgtcctaaagtttggctatggtagtggcacaactgcacacagtttcttaaacttaccaaattgtacttttaagatggatgaatttactatacataaattatatctcggtaaagcctcaaaaataattcctagtgctttttagtcttccctaagctgccttatttctttaaactctttggactcattaatttcattcttaaaaattttccatggctgttaatgttttcatctgtcagatttgtttaccagcccgtgtgctttctaatcaggattaactccaaggcatctacgtgcctcaacagggccatttttttttgttttttgcataaagaattttagaaatcagactcactgatttaattcagactgcaattgctaccgaagggttacttttttatcctctgagaatatacccacaacactatctttctgtaatcagatggcctttcaatgctttccagtgcaaaatgtttattttgttgatattgactggcctttccatgtatataaaacatatcttctggttactcattgagggcctgaagtgataatttaccagtacatatgcaacacacctagacactagcatggctttcttgactgtaagagttctaaataagagaaaggttttaattatttatcggccaggcaagacaataactgatgcctaggtggaaagtttaggaaaaatgttaccatcagtcaattaagataaggtccaactgattattcttagttaaccaaatttagtcatgggacttattctctagtttatgcctaggccagatacaaagtagattcctaatgtctcctagcattagtgattgtcctatgaaaataatttttaaaaatgaatagatgaggaagacaaaggctatatattcatagcttgctatagcaagagagtcagccaccatcacttgtgtcttgccggagactcaaatgcagacagaggagtggagaaaaaggaagatttcatgtgtgccttgatttgaggctgctgccatggggaagatgtagccatgctaactggattgggacagcctatgcaatgtgactgatgaggggtgcatatttggtattctccggatcatcctaaattggaagtgaaaacaaaaattagaaagctgacatttattaatcaagtcctgatcatttccagctgatcgttacaaaagttattgtgtagcttcctgaattgttaccaaaaatagcaatctggtttcctgccagtctgacttatggctgggtgacttcctaggctgtttattgtagacaaggggttggtttcctagaagggttactgtgggttcagaatccagagttctatttaacaacaacaacaaaaaatatattatagtgcttaagagcacagactctggactctggaataaaacccactgggttcaaatacagttttttttcacttactgggtaaggaacctgaggtagtttctcaacatctctgtgcatttgcttcctcatctacaaaactcaaatataacctactgtacaggactattataaaggttaaatgagttagtaaacttaatttcttacaagagtgcctagagaaatgcaactgtttgataaatgccaactatcattatgccctactcatttaatgattttacaaatttaatttaactaaacgataaaatgttaagaagcccaggagggacttcataatgactgactggaggcaccactcagcagcctccttcaaaatgaagaactaaaatagtgagtagataattacatttcaaatagtatatctaagagataatgctggaattcagtagagaagtaacaggaggaaacacaggaggtaccaaaggagagggaagcaagccagacagctttgtctggagaggccatatatgacaagcccacagctaacatcatacagaatggaaaaaagctgaacgcctttcccctaagaattgcaacaagataaggatgctcattttcagcactcctatttaacatatactaagccccgcacatgaacctgggaacttaaaataaaaactaaaattaaaaatttttgaaaacccataatactagaagtcctagccagaacagtaaggcaagagaaggagataaaggcatccatattgtaaagaggatgtcaaattggccttctttgcagatgacaggatctcatatttagaaaaccctgaagacttcaccaaaaagcacttagatctgatcaatgagtttggtaaagttgtaggatacaaactcaacagacaaaaattagtagcatttctatacaccaataactaactgaaaaagaaatcaagaggggaatcttacaaacaatagcttcaagaaacataaaatacctaagaataaatttaatcaaggaggcaaaagatctctacaaagaaaactacaaaatactgatgaaagaaattaaagaggacacaaataaacgaaaagacacctcatgctcatggattaaaaaaattaatattgttaaaattaccatactaccaaagcaatccacagcttaaatgcaattcctatcaaaataccaatgacatttttcacaaaaatagaaaaaacaattctaaaatttgtatggaaccaaaagagagcccaaatagccaaagcaatcctaagaggaaaacaaatagtgtaaaagctggaggcatcacattaccagacttcaaaatatattacaaggctatcacaaccaaaaagcatggtattggtataaaaaagcagatgtacagatgaatggaactgactagagaaccagaattaaactcatgtatgtagaaccaattgattttcaataaaggtgccaagaacatacatttggaaaagggcaccctcttcaataaacggtcctgggaaaactgaatatccatattcagaggaatcaaactagacccctgtctctcctcatatacaaaagtcaactcaaatggattaaaaacttaaaggtaacacatagaagaaagcaaaggaaaaacactccaggacataggtctacactaagattttatggccaaaaccccaaaagcacaggcagcaaaaccaaaaatagacaaatgggtcacatctaagtaaaaagcttctgcatagcaaaggaaccaatcaacaaagtgaagagataacttgttgaatgggagaatatatttgcaaactatttatccaacaaagaaataatatccagaatattcaaggaactcaaacaaccctacaaaagaaaatctcattaaaaatgggcagagaatttgaagatgtacaaatggccaacaggtatattaaaaaatgctcaacatcacgaatcatcaaggaaattcaaatcaaaactacagtgagatataatcttcccagcaagaatcgctattatcaaaaagacaaaaataacagatactggcaaaaatgaagagaaaagggaagtcttctacactgttagtgggaatgtaaattagaactgttttccataatggaaaacagtgtggaggtttctcaaaaaactaaaaatagaattaccatacaatccaggaatcccactactgggtatttttccaaaggaaagaaaatcagtatatcagagggatatctatgccctcatttgtattgcagcactattaacaatagctatggaatcaacctaagtgtccattaatggctgaatggttaaatagaatgtggtatatttatacaatggaatactatttggtcataaaaggcaaagaaattctgttctttgcggtaacgcagctgcaactggagctcattatgttgagtaaaataaaccagacacagaaaaagaaatattgcatgtgcttattcatatgtgggagctaaaaaaacattgatattataaaggtagagagtatgatagttaccagagtctggaaagaaattggggaatgcaggggatgaagagaggttgattaaagggtactaacatatagtcagatagaatgaataagttctaatgttcaatagtagaacagggtggctatagttgacaacaatgtatcacatatttcaaaatagctagaaatgaggacttgaagtgctcttaacacattgaaataaatgctcagggtgatggatatcctaaaaatcttgacttgatcattaagtattttttatgcatgtaagaaaatatcacatgtatcccatgactatgaaaaaatattatgcatcaattacaattttttaagttaaaagggttactactcatgttatttagttaaaagtgaaaaagcaatttatcactagagaaatgcttattcttccttagtaaaaatacctacactggactaaaaaatagtggaaataatgcagaaaagcaatgtggcaacaaagtaaaatgtgtttatttatcattaaaaaactttcatgatgaatcaatgaatagaacaagtagaggtatcactccatttgaaaataactattttcatcattgataggcaaggtattacagcaaagaaactgacaccaggagtgcatgaaatgcatgtcactgatgtgattagttttttaaaataaatatgatatttaaaatactagaaactttatgatatcttacaatgagtgaccacatgccacacggaggttcactgggaatcatgtcaatacttaaaacaattgctgaatttaggatgaattatatatttttcttctaataaaagataggttttctaaatttgctaatccattctctgatgataagtagctactcaacaaatatttttaaatgattaaaacctttattttgtcctttgatgtcagtatgatatttaactaagtgaactgtaactactatcaatatgaaattgtgcaacacagataaaatcttgaaacatgtttagtatgtttttctatatcctcatataatactctgggcaaaaattatctgataacatactaaaaactctcatgtttgcttattttttaaaaaatttggaaacacaatgtttccaccttcataaaaatattccacatattttaagagaaatttgaacttgtttttcaaatttaaaaatttttaatttgcttacactttttaattttcttacaaaacaactgattgacatcagagagtatggtgatttactggctaaatatcaggcaagccttttctaaattagtgtctagtatttaaaacaaagtgccataattttgtaaaagtacccaaggttgtacttttattttaaggaatttgtgcgtgtgaggaaaggaagaaaagaggatctaagagaaaacatggagaaagaacagcccgagatgtagcaataaacaagcattaaatcacagaagcctgagaagcaaatatgcttcagagtgtggtcaatggtgccaaatcataaaattaattagttaagataataatttaaaaaaatgctttaggtgtggtaattaggagttgagtagtgatcttagtgagagagtggcgatgagaacctccaactccttcctgtcatgagcccagactctggctactctggttcactctccattcactgaatatgctttgtgctttcaagtttccatgcttttacttctaatcatgccgctccttcaacctgtaattctttgctacacattcttcttgcctattgaaatttaatttatccttcaagaatcatgagaaatgtcattttgtataatgtcttctcttagttctctaagtccttctttgtgttctcatataccttgcttatagttcagtttgtaatacttaactcagcctgagtttctatattatatcattgtataagtgattttatcctctagattgggagctctctaagggcaggattatttcttatttatctattcaggttcctgccctaactcactcctaccacatacccctccttgcgcaatgtcttactccatgacttctctattgtagtcactctataatgttgaagttaatttaattgaaatttctgcaagcaattcaataagcattcaccgacggcctacattttctggaactatgagggatttgcagtgtggaaaaccaaaaagaaaatcaatctaagaataaacaaaacttgcacatgaagaacagctgaatgaacacaggagtgaagtacaattaagagctctttgcatcacacaaacagtcattatcttgcagatcagaaagttgaggatgtcttcataatgagaatcagatctcataaaaattgagtaagatttggatagaagaataaatcaaagagggcatttcatgtgaagagtagattctgagtaaatattctgaggtcaaggttaaactctaacacatcaaggaatagataagttataggcgtgtctctggagatggattcttaaaggtgaatggtagaaaatagccttaagtgatataagccctctgtatggagcccttggagtaccaagataaaggacaaaacttggtttgaagactaatgagaagccaaaaatatttctaatgcataagagcatatctacacactagagaaaagatggggataggagaccaattaacaagtaagttatcttatgatgatggcattgattatggtaatagttttgtgggtgtatacttatgtcccaatttatcaagttgtatacattatatgtgtatagctttttgcacataaatcatacctcaattaagttttttaaagttaccttatgacaaataagtgaaactgaagaacataatgtcagacttacttcagaggatgaatgtacaagatttgaccagattaatttggggagcaaaagaaaggaatacaaccctgggtgatcctgccacatttttgcctcttgtccacaaatacaaatctctcttcaaatctctgtttaacttccacctcaactgatcaatgtaaatctttttctctccatcatagttttcaggtaatcaaggggtgtgtgtgtgtgtgtgtgtgtgtgtgtgtgtgtgtgtctgtgtgtaagagaaagagagagtttccaagtatgtgaaaaatcaagatgaaccttaagctgtttttagtgatagcaattttgatttaacttccgaatctcaaaatgcatccatctttatatgctgtttgatttactggtgctgggggaaccatgctcatcagattagagtctctgcagaaacactctgatgccaatgccgaggaagtccctttagaatagaaaactttaactttgcctgagacttgcataactattgtcactaacctattggtagggagtgtcctagatttttataatttattccctaatgatttaaaaaccaatgtttttattcttaatttccctacaaagaaaaaacatcaggagaccagtcagctactataaaatgtttctcagtgaactcaaaatatgaggacttaattttatttactaatttatttatattatagtatcaaaatgcagaatataaattttctaatatacttcagtatttttattgtttttaaattttagccacttaataattctctttgtctctaaagtgaagccattatagaaagccataaggagacatagtaagtggataagtctgacctattctttgttcaaaagtaccataattttatcagcaaatacacagataaggctgatgatgtccttgtacagtaattctgcgatctataggcaaattaatttttgattaagttcaaaaattatattttacattggtgaagagaaaatgagattttactcattatattctgaaatatgatctatataaaataattattgataataaaatccatttttccacagtccacctgataaatattttcagttgattttccattagatgttactaaaataatgataaagagcagcattttatacttttacaaagtttttttaaaaatataattctgaaagattttttaaaagaggtatagacctaaaatataaaggacattttattgtattcatttgattacaagcctctagtgataaaactccagaaaacctcatcatattatgtgagtcaatagaaaaacaaaagtaagaaacagagaaaacctaaccaaaatgttttcaaagtaattcactggccgggcgaggtgactcatgcctgtaatcccagcattttgggaggccgaggcgggcggatcgcctgaggtcaggagttcgagaccagcctgaccaacatggtgaaaccccgtctctactaaaaatacaaaattagccaggcatggtggctcatgcctgtaatcccagctactcgggaggctgaggcaggagaagtgcttgaaactctgtctcaaaaaaaaaaaaaatgtgctttgaattaactatcgtaggctcttctccaaaattgtctgtttggagtatgctaaggctaaagacttttagaaacttctaaaagaaaagaaagttaattttattattctttaaaactcaaattgtttctgtacctgaaatattttaatgtacagttgccaaactataagaactatataataaatttagttgatcattaaactcaaataaatatatagccagtaaagagtagataatgagtttgtaaatttaaataaatttaaaactcaagtaaataaatggagaacctccatagaactcactgaaaatgaagacattactttctatgagagatgtttgagtgaatacaaaatagatatttaccatgaagaatattcacattatgagtggagattttgccaccaaatcttacaatgttggacatgcatgtaaaactcttaaaactagagacagaaagtattaggataagtgagcaattaagagtaataactccttgggaaatttgtcataccaagattggaatagtatctagaatatgttgaaatgaacataaaaatgatatccaatacaatgattaagaacactcatagatgtttcatattcttatcctctctaaaaggatgagtagatatctcataaaatatgcaattggtgaccttatctggaaagggttactaagctagcaaaagcattcttcaaatcactgtgtttctgtgcagtttttaaaatgtagacatttaaaatgccttaagagtaattcattttaagcgtcacattgatccaataggatacgatttaaaacttgtttactttttcctggaggaaaagataccataagaaaatgtcttaattttggaaatggaaaattatatgtactgaccacagattttacatcggcataggataattcatgcagataaagctttcctgccctaggaattcacacagatattttcagacaagccctgggtacacaatccatgatacattttttctcacttgatttgacccacagtgagtgtgctagtgtttaggagatggcacaggataatttgaagaagactttcttcccttttgtatacagggaaattagagggtgagaattagaaacattctgctttggaatcttacatttctttacaatttatgtctcagaagagaagccaggaatggctagggaaaatcactccttagcagctgaattcatcctcataggatttacaaattatccagagctgaagacgcttctgtttgtggtgttctctgccatctatctggtcaccatggtggggaatcttggtctggtggcattaatttatgtagagcgtcgtcttctcacaccaatgtacatctttctgggcaacctggctctgatggattcctgctgttcctgtgctgttacccccaagatgttagagaatttcttttctgaggatagaattatttccctgtatgaatgtatggcacaattttattttctctgtcttgctgaaaccacagactgctttcttctggcgacaatggcctatgaccgctatgtggccatatgccacccactgcagtaccacaccatgatgtccaagacgctctgcattcggatgaccacaggggccttcaaagctggaaacctgcattccatgattcatgtagggcttttattaaggttaactttctgcaggtctaataaaattcaccactttttctgtgatattcttccactgtatagactctcctgtacagatccttctattaatgaactaatgatatatatcttttcaataccaattcaaatctttaccattgctactgtcttgatctcttatctctgcatccttttgactgttttcaaaatgaaatccaaggagggaagaggtaaagcattttctacctgtgcatcccactttctctctgtctcaatattttacatttgtcttctcatgtatattggaccatctgaagaaggagataaagatacaccagtggcaatattttatgcaatagtaatcccattactaaacccttttatttatagtctgagaaataaggaggtcataaatgttcttaaaaaaattatgaggaattataacattcttaaacaaacttgctctatagcaaatttatttttaatttattaaaatgctttcataaagagggaacatagaaaaattaatatgtgattttacacaaaatgtaagcttataaatcattaggctatgtttgtttaaaaaatatatcaatggaatttcaaaattgtttcacaaatctttatccaaatcccacaaccagaatgaatcggggaaactcactggtaactgttattactacctttcatgactctcatggaattgtcagagagtattatcctaaacctcaattaatcaacatagcatgaaagttaaatgtttaaatgtgtagaagagtcttctttgattaatgtttcctagttaatggaagacattatatccaatcctatgtagcgtgtttgaaacatttaaaatttcctggcagaaaagtgaaatgatagttttctttcagaaaactgacctgagagacacatgtggattactttagagtggaaaagactagaagcaaactaattgcagtaatttatatttaaggtaatgaagttttatttagataagattgcaagaatgaaaaaaaatgaaaaggaacacacacacacatacacagacatatacagacacagacacacacatacacacatgcaaagaggctcacctacaaaatattctattttgcagaataattaattgtgacttataacaaattggacagagtagattaaggtctactttagccagaagcataattaagttccttttcattcttgaaggcatcaaccatgttattggctatgtattatatataactacagtttacatattaacactcattaaacattttaaaacatattaataatgacattgttttatttttgagtaatggtaagctgtaccaatattttatgtgtttattgaccatttttacttttatgaattgtcatttttgttttgtctgttttatttcttatttatatcattgtttacagagaaaagacatcacaactatttgtggcaaataattcttctgtgggttgatagtcttagtatttgtttctgatatttataaatattttaatttaatatactcatatttacttattttttctatgatctctttcatgcatttcatccagaatttcttttttaatccagtctactattaaccaatatttctttttctccttttcttatttctcttcttctccttctccctattttcctcctccttccttttttgatattttaaatttttgcaacttgactcttgattcttcctggaatttatttagtatatggcatattaaagatataactttatttggctgtttctctaaaaaatatttataaactaatttaattcaaataaacactcaggagaacttctttgggaacctggcaaaatgaatttaaaattttttcatattctagatttttctagaaaataaaaaaaataccttatgtgttatatattaaaatatatgataaaattccaataatgataacagtttggttttaaatcaagaatcaataaacaaaccaacagaacaaatcagattgttcaaaagtaaactctcatataaaataagaagggcatcacaaataacaaggaaataaaggattgttcagtagccgtgggacaactgggtaactatctcttccattcatgttaaaatgtatatcttcctgtcatttagatatatatttgtagacaaaatttgtatttccttcatttttcatagtttgatttttaatatacagcaaccaactggaatttattttataatgttataaagtgagaattaaaatttgatttatggctaaccagtagtcccagaagcatttattgacaaactcttctctaactgatttcttatgtctcctttttgtacatttatgctcatacattcacatgtacatgcatacacagagaggtctatttctagcccgtttgtacaacaaaaacaagacggttctagttcgtacacttctgtctcaggagggaagatggacattttaaaaggcaatcaaactaaaaagctataagttataattgaggaagactcttatgcttctacctaaagtctattgttagggttctataacatttatatataaaatatctattcactctattctttctttctatgtgacctcatctatttttttttttttggcctttaatttcatcaatatgaagatggctcagaatgtatatttccacctctgatatcctccctgctctccagtctcacatgtgcaactgcctacttcacataattacttaaatgttgcaaagacatctcaaattcaacatgatcaaagcacaagtcttgaatttcccactaaacatggtcctcccctggtcttctccattatgatggtcacatcctccaaccagctgggcaaggcagaaattaagagaaccccacacaactctgtctcctatcacaaccaaactttcatgatatctgtcaacttagtctctgaagtctatcttaaatgtgccaaatctctccacttacaccacatgtacataatttcatctctcacctgaacaatatcattagcttcaaactcgtctctgtgcttttgctcctttttattttttaatgtatatttacaatacgatttaaaaatagtactaaaaggtgaattccaaaaactacagtctcttgcctaccatgacttaggtatttcatccacaacaaccttctaattttttaaacgatttctctgaaaatttatccttatatttctcagtatcagttttaatcatattaatcaatttcccattacagtaaatgaatattaagttatttattaaacacctccccttcccttcattcttgatgatataacataattttttttttttgagatggaatgtcactctgttggccaggctggagtgcaatggcatgatatcggctcattgcaacctctgcctcccaggttcaagcaattatcctgcctcagtctcccaagtacccaggactgcaggcacataccactgtgcccagctaattttttatatttgtttctagagacgggggtttcaccatgttgaccaggctggtcttgaactcctgacctcgtgatctgcctgcctcagcctcccaaagtgctgggattacaggcatgagccactgtgcccggcccaacaaaattttttataattcaataacgactttttatgagggacatgcaaatacaagaactagtttaccatgcttatatttctttttctttacacctgtaaatttttttaaagttaataaaaacttcatattcctatttgctcattcacatccattatgtatccatcaaattaatcaaccatattaaataatcatgagttctttttttaccctggagacttcttttctggtggcctccaccctcctgctccagtctggacaatttgctctctagacccaatattcagccgtcctgctgagacttttatttttgatttcctgttttaagtaactcagtattcaagctctccatctttctcttaattgttcattccctctttttgctgactgctctttggcaatttttttccacatgattaataatttgatttctttaaaattctaggttataaataatttttcttctgaacgctgaagttatgcttcctttatactctagcatgatctgctgctttggagaaattgcacgttattctgattcccattctattgtttacctggaaacatttagaatattttctttatctctgactttgtgaagtatcggaatgaaaaaatttagcaatgttgtcatcactttttctagatagtagtggagtcttgtttcactcgttcttcccgcttagctgtcttttcttttcctttcctttgccttgtcttttctccctcttttctttcctccctgcttccctccctttttttctctctaaaaattcaaagttttacttccttaattaaggcaatcctgaatgtacaagacagataaaatttacatagaaagaggagaataaataaattaccagttttcagaatcataaatgttttcttaatgactgtgaaaacattaacaatttaaaagttgccgttatgaactcagcttttgttttctggaaaagtcttcatttctccctcatgtttgaaggatatttttactggacacactattccagggtaaaactttttttccttcagcacttcaaatatgtcattctactctctcctggtcctaaggtttcctctggaaagtctgttgccacacctattgtatctcctttgtatgttatttgtttctttttgcttgctgcttttaagaatcttttttttaatccttgacctttgggaatttgattattcagtgctttgaggtagtcttctttggtttaaatctgcttagtgttctataaccttcttgtaattagatattgatatatttccctaggtttgagatgttctctgttatccttttgaataaactatctaccccatctctttctgtattcctttttaagtcaataactcttagatttgcccttttgaagttgttttccagatcctgttgttgtacttcattatttttattaattttttttacttttctctcctgactgtacatttttaaatggcctgtcttcaagctcactaattctttcttctgcttgatcaattctgctattaaaggactctaatgcattttttagtatgccaattgcatttttcagcttcagaatttctgctttttaaaaactgtttgaatctgtttgttaaatttttctgatagaattctgaattccctctctgcattatcttgaatttctttgcatttcctcaacacagctactttgaattctctgtctgaaaggtcacatatctctgtttctccaggattggttcctggtgccttattttgttcatttggtggggtcatgattttccagatggtgtttatgctactagatgtttgtcagtgtctgggcattgaagaattaggtatattgtagtctttgcaagtctgggcttgttggtactagtactccttgaaaaggctttacagatatctacgaggacatggatgttttgatataagttttatctgctttggaggacacccgaagcccactaatgctgtggttcttgcagacttgtagagttatcaccttgattgtcttggacaatatccagaagagttctctgaattaccagacagagactcttgttctcttcccttgctttcctcaaacagatggagtctctctccctctcagttctgaatttgaagttggggatagggtgacacaagaacccctgtggccaccaccactaggactgtgctgagtcagacctaaagccagcacagccctgagtctcacccaaggcctgatgtaacaaccccctggctaccacttttgtttgctcaaggtcctggggctctacaatcaacagatggcagcacaagccaggcctgtgtctttcccttctgggtgatgagttcccctaggctcttagagagttttagaggtgctggccctgggagggttgagaggtgctgttcaaaaggcagggactggagtcaacaactttagaagtctacctggtattctattgttctgatgctaaactgaaactcaaatcacaagatacagttcttctcactcttctctcccctttttaaaggcagaggagcctcactctgtggctaccaccaccataggcccatggggaatactgccagactactgttgatattctcttaaggcccaagggctttgaagtcaccttgtggtaaatgctgcttggcctgggactcacccttctggtcagtgggttcctctctggcccagggcaggtccagaaatgccattcaagaaccacgttctagaatcagggactccaagagcccacttcatgctttacccacctgtggccaagctggcacttaagctgcaagacaaatccccttacttttctctcagctttcctcaagcggaaaaaaatcttgccccatagctgccacagctggaaatgtgttgagtctcacctgaagtctgcaagtctcacagtctcacccaaggcctttgatgtgtacctgtgtatcgctgctggcatttagggcccaaatgcgcttcagcttgttgatgatgaatgctgcccaggctggcagcattcctttaaaatccttcctttaaaggtagtggattcccttttggcccaggatgtgtctaggaatgtcatccaggaaccaggccctggaaaaagggcctcacatctctgaccagtacactaacttatgtggctgggttggtatttaagatgtaagacaaagtcccccttactcttccctctcctctcctcaagtggaagaaaggaatctcttttagagccatgagctgtgcagcctggggttactggaagggtgatgatgccagcactcccttatccatcctgactggtgtctgagtaggttgtgtgacccccgcattccactgcctctgagccaagttcagcactaggacttgcctccaagtttcagtgcctgtggcctagacatcctttcaaatttattaggtccccatagcactttagcctgtggtggcaaggcttgtgagaactcaaggtctgaccactgggatccacgactctcctctggctagtgctcgtttaaatgctctctctgagggcaggcatcagctgagttggtctggttttgctttctgttataacaggtcatcactgagttcaatgcctcacaatagtttcactcttcttctccccaagacacaacaatgttctctgtaccaagccactgccttgagaggagtgtgtgtggaggaggggtggcattggcacttgaagagtgttttttctatctcatcagtgcctctttcagtggcatgaagttaaaaccaggtactgtgtgtactcacctgattttttgttctaatgaaggtgcttttttgttagatagttgttaaatttgtgtccttgggaaaggatgatgatcaaggaagcctcttattccaccatcttgcttctaagtacttaatttgaggttacaaatggattcagagttcaattacttaccctaggaaatagttgtcacattgcaagtagttataattttcaacaaatactagaatggaagtcagcatatataagttacttccattcaaaatttgtgaaaaatttctggaatcctgagcataaccttgcaaaatcagtcatattctaagtttgaaactattaatcccttttaaatcaacactatctgtgagaagtaaatcgcatgtttgaatattattctcaacttcctttgaattcattcaaaagattatattgaatatggattcacatgggatttttatgttctaatgaagaaaatttttatatttactgatggaaattttaattttaaatttaaatgttttaattaaaattttaaaaactttctctcaagttctcagaaatagagtatctgtatgatggtgatttttctatctctggttgaaaataagtctatttttactgaaatgcctatggatttaaatttttcatgtagtttgcttaattgctcatcatatatgacagcgccatttctgactgtattgattaaatcaagttgcttttcaccctagtattatttcttgtcttatttgttagaaattccaccaatctgcagtgatttcaatgaatgttgttgatgtgttcatagcattcacagaaagtgatgctcatcatgcataagtgaggcagaaagtagtgaaaattcctaatagctaaacaaagctattaggtgaaggggtggcctgcccctccacacctgtgggtatttctagtcaggtgggacgagagactgagaaaagaaataagacacagagacaaagtatagagaaacaacagtgggaccaggaggaccggcactcagcataccaaggacctgcaccgacaccggcctctgagtcccctcagtttttattgattattattctcattatttcagcaaaaaggaatgtagtaggacagcagggtgataataaggagaagatcagcaaaaaacatgtgagcaaaagaacctatgtcataattaagttcaagggaaggtactatgcctggatgtgcacgtaggccagatttatgtttctctccacccaaacatctcagcggagtaaagaataacaaggcagcattgctgcaaacatgtctcgcctcccaccatagggtggtttttctcctatctcagaattgaacaaatgtacaaccggattttataccgagacattcagttccgaggggcaggcaggagatggtggccttcctctatctcaactgcaagaggctttcctcttttactaatccacctcagcgcagacactttacgggtattgggctgggggacggtcaggtctttctcatcccacgaggccatatttcagactatcacatggggagaaatcttggacaataccctgctttcaagggcagaggtccctgcgactttccgcagtgcattgtacccctggtttattgagactagagaatggtgatgacctttaccaagtatactgcttataaacattttgttaacaaggcacagtcctagatcccttaaaccttgatttcatataacacatgtttttgtgagctccaggttgggtcaaagtggctggggcaaagctacaaattaacaacatctcagcaaagcaattgtttaaagtacaggtctttttcaaaatggagtctcttatgtctttcctttctatatagacacagtaacagtctgatctccctttctttccctacgaaaattcctaatagctaaacaaaaatatcttttcatcacttaaaagtaaaaacatgaaagaaaactaatttatacacctatccacctatctgctatgcactactagactttttatatatataaactaccgattaggccttaattcttacacatttcctcagtagaaatctcgtatcttgaaatcctgaatgtcttgcccaaattcattcagctcatctggatagagatagactttgaatcaatattgccttttctttacatcctttggagtttagaaaaaggataacttttgtttcattaatcttttctgttattttattatcaaattcatttattttgctccaatcttatttcttttcttctaataatttttggtttcattttctgttgcttttctagatctttaagatgcatcattaagttgtttatgggaaactttctacttttttgatacagccacgtattgctataaactttcctcttacaccacttttgctatatcccatgggttttgatacattgtttctatttttatttattttgagaaatttctaaattttccttttaatttcttcattcatttaatgttgtttaggaccacattgtttaattttcatttgttcgtagagtttccgaagttcctcttgttattgattttttgtcttattccattgtggtcagaatatatacttaatataacttctttaaaaaaactgagacttgttttttggcctaacatgtggtctaagcttgagaatattccatgtgctgaggagaagaacatgtattctacaagctgttagataaaatattctgtaaatgtctattaggtccatttgatctatagtgcagttaaatctgatatttctttgctaattttatgtttagatggtgtgtccaattctgggataggatgttgaggtaccaggtattattatatctgtctttagcttgagtaatatcttctttatttcttctaatgctccagcattgggtgcatatatatttgcaatttttatatcttcttgttgaattaacccttttctcattaaataatagccttctttgtctctatttatagtttttatcttcaaatgtattttatctgtattttctgatagaaatatagctactcctgctttattaggttcttatttcataaaatgtctttttccatttcttaaattttagtctatgtgtgtctttataggtgcagtgaatttcttgtaggcagcatatggttgggccttgggttttatttatttatttattcagtcacatctttttcgggaagaatttagactatttatactcaattttattgatagtaagaattacactgttgttttattatttgttttttagttgttttgttggttctctcacttttatttatttattcctatttttctttgtgtaaaagtgatttttcttgggtgatatgtttacatttcttgcttttatttttttcatatcttttataggtatttttggatgttaccaggaggcttgcaaataacattctataatcaattatttccaactcatgacaacttaactgtgattacaaagaaacaaacaaaaaacaaaaagaaaagtaaaaaactctagtcttcaagtccatttcccctgccttttgactttttgttatctctatttatatctttttatctagtctatctctttaaaagttgttgtagctattttttttattaatttgtcttttagtcttcccactaaaggtatacatggttttacacattgcaattacagtgttagagaattctgtatttctctgtgttactgttactggtgagttttataccttcagatgatttattgttgcttgttaaggtactttctgtttagattgaagaactccttttaaaatttcttataagacaggtctggtattgataaaatattttagcttttgtttgtctaggaaagggtttgtttctccttcatgtttgaatgataatttaatgaatataatattctaagttggaatttttctttcatcactttgaacctttcatcccactcctttctagtctgtaaggtttcctatgagaagcttgatgccagatgtatcaaaactcttctatattttatttgcttcttttctcttgctgtttttagggtcttttctttatccttgatcttcgagaatttgattgtcatctgccttaaggtagtcttatttgggttgaatcttttgaggttccttaaccttcttgtacctagatattcatgtctttctctaagtttgaaaagttctcgctgttattttttaaataaactttctaccccatctctctctctgcatcacctttaaggccaataactcttagatttacccttttgtggctatgttcttaatcttataggcatgcttaaggaaaaataattttatttaagaaaaagtattatatggtcagttttgctttgcttaggaaaacaaaaactgagataatttttttaaattaaggttattacatccatgtattttcctgtatgttcttttaagtcattgtaacattgggttacagggttttaactcctgggtctaaaaaggacacagagtcctgctaaatcttaaacactgacagcaattaaagcctcatcttcaggccccatagaagatgccaatcaaaataaactacattcctgagacacaggacaaagaataagctattcaattcctcaaagcccaggccaaggactattgcagaacaagtgggagcataagattgtaagggcaaattttgaaagataaaataagttccattcctctataaattaatcattagtatagaaggcacagtgatgcaaaaccagtatatagactcccatgtcagatcaataaggttttcttgaaacattaaccaactccttaataaaggttataaaaggcttatggaagttatattttataatcaaaattaaattttattgattgtttacaaaattttgaaaaacaaatgtaattggcttcatgctgtttttaattagaatttttagttagaaaattaagtctccttgctcaaagaatgaaggtttttacttttttggaaatccttgaattatcactttggttaaatgactttacaatgacctgtaatcttattttgtaatatcaagtgtttaaaaccttttatatttgacaaactttccaaaatcaaattataaattatgtctttttgtaacctaattaatcttttaagacattaggctccttaaagtccaaaaaaatgacatagtttggcttactgggtataaaaattatacaggaagcattgtcaaatatgaaatagtgtttggttttctttgggctgtatttgtataaatatgttattagtatgtgttccaaaattataggaaactcctgtaattctgatataacttattgtacattatcagtaataatcataatcattatgtcaaaattagtgaaccacagatataacaaatttccttgtcaattgtgtcttttgactatgattgccttacaccttttttttcatccacagacaattgttcttggagtgttcttggacatgattgtcttgttttggtcttgtttaaaaggtagctttataatcagctataaaactcctacaggtgctcttaaatgcaggtttctgataactctggagattgtgacatcagaatagaggaaaaactttcaggactcatggagagctgaaatgttcacgggtgggggtaggggggcttgctttgagctgtctcagccttactggatggaactaatgtacttcttacatattgattgctgtctcatgtctccctaaaatatataaaaccaagctgtgccccgaccatcttgggcacatgtcatcaggacttcctgaggctgtgtcacgggtacatcctcaaccttggaaaaataaactttctaaattaactgagacctatctcacattttgggggttcgtagataagggagaatccgctgggttactaggaaacatctcttgctctcttctctctattttctgcaatcagaaggagtatctcttcaccctgggctgcctagagttggaggaggggtgatgggtgcacccttgtggccagctcagctggcactgtgcagggttgcacctgggtctgcagccactactacctggctggcttcaactgatatttattcaaggctctagaccacattagtcagcaggtggtgaattctgccaggactgggttcatcccatcaggacaatgaattttcttctgtcccagggtgggtctagaaatgtcattcaggagcaaagcaaagacctagaatccagggcttcaggaatctgcctggtgctttattttactggagctgagctggtatccatgctgtaggccatagtcctccacatctttccctctccatccaccaagcaggagtctgtcctggaactgcactgcctggagttggggagaggtaatacaggtgagcccttgaccactacagctggtgtcacacttggttacaccatatgttctctgcctccaagtgtatcaccagagcttaccctaaaccgtagaccttgtggcctgactagcactcaaattttttccaggccccagaccaccttagcaagcaaatggagaagccaagactcaagattttaccactgaagccgggaatctccctctagtccagggcttgttggaatgcttcttctgtgtgagctggcagaattctgctctgtgctatgttccactgtgacagggcagcactgagttccagtgcaaagttccacaatcacttcactctccctcccccaagcacacagattgtctctcccatgctatgctacctgcagttgagagaggggtggtatagacaacgcaggtctttacttcccaagttcttcagtgcctcttttcttaatgctatgtttaaaccaggtaccgaggtcactcactcaatttttttgttcctatgaaggtactttcttgtgtggatagttgtttaatttagtgtttgtgtggagagacagtcactggaggactctatttggtcatcttgctctacctccctctacttttactttattgattttgtagctcaaatcattccaattttggccaccgaagctatttccctcgcctcctgtgtgcttttgacaaacacccataattgtgtatatgggatgtgtttttgttggtttatttttggcacttttttattggctgctagtatatctcatatatttcccgcagcattcctagaatcagctatttctttcagaaggcctggatttttgtaattggaggatggtattacaaaccagatctgggtgatagatgtgctgactgcttctagagtattattgctctaggtgctctcagctgtcagagtgagcatatgtgtcttcttgctgctccacattcttgtcaataattgatatttaatttcttattgtaaccattctaagtatctacttattgttttaatttgcaattacctaaggaaaaataatgttgaacatcttctcatgttcttatttgccttctttatatcttctttggtcagatgtttgttcagatcttttaccctttttttttttttttttttttttttgagatggagttttgctcttgtcacccaggctggagtgcaatggcacgatctcggctcactgcaacctctgcctcccaggttcaagcaattctcctgcctcagcctcccaagtaggtgggattacaggcatgcaccaccgcgcccagctcattttttctatttttagtagagatagggtttctccatgttggtcaggctggtcttgaactccccgacctcaggtgatccacccgcctcagcctcccaaagtgctgggattacaggcatgagccactgaacccggctacctttttttaaattggattgtttctttgcttattgttgaactttatattatgtataaaacccttcatcagaaatgtgtttgttaaagtttacttagagtctacggcttatcttttgatactcataaaagtgtctttctcagagaagatgttttaaattttaatataacttaaacttacctatttttttcttttatggattgtgctgttggtgttgtatctaaaattcatgagcatactgaagagcacctacattttctcctatgttttcttctggaagttttatagttctagttttacattttagacttataatccactttgagtcagcacttgtgaaatatgtatggtgtatgtctaggcttacgttatttgaatatgaacatccaagtgttccagcaccatttgtgtaaagatcatcctttattgaaatgcctttgttagtttgtcaaagattacttgactataattatgtgggcctattatagtccatctattctgttatcttaaacttgtgtatattcttttaataataccatgctgtactgattaccttagctttatagaagtcttgagatctggtagtgtgagtgttccaaccttgttcttcttcagtgttgtgttggctatgctagtcttttgttttctcatataaactttaaaataatatttttaattatcaataatgctactctgaacatttgtgtagaattttgtgtatgagcaagtgttatcatttcccttgggtacatactaggagtgaaattgctgggtcatatgtcaactctgtttacttcttgaggaaatgtttgactgctttccaaagtagctgcagtgttgtatattcccagtagcaatatatgattcttccaactttgccacatcttcaacatctgttattgtctttcttattatagccattagagttcatgtaaactggtatctaattgtggttttgatttgcatttccttgatggctaataatgttgagcaccttgttatgtactattagctattcacatctcttctttggaaaaacaactactcagatcctttgacatttttataaagaagtaacttgtaattttattattaagtggtaagagctgttcattaattatagatatatttcccttatcaaacatatgattttcatatattttatcctattccattggttgtcttttattttcttgatggcattctctgaggtaaagtttctaattttgatgaagtctagtctatttttgatatgtcacttatgctcttggtgtcatatttaagaaaatgttgcaaaatccaaggccacaaatatttatatctgtgtttcttttaacacattatagttttattactaacacattatagttttagtttacaaataggggtccaaactcattttttacatgtagattccctgctgttccacacaatttgtttaggagactattctttcccaactgatttatacttccatccttacaccagtgccaaactgttttgattattttagatttttaatcattttgaaatcaagaaatgtgaatccccagctttatttttattattaaagaaatagactaataaaccaatggaaaagaatagaagcccacagataaaactgtgcatatataatcaaaaatcttcacaagggcatgaagaatatgcactggggaaaggataatctacacaatgaccaatgcttggaaaagtagatatgcacatgcaaaagaataaaattggactcttaggttacatcatacacaaaaatcagctcaaaatggattaaagacttaaacctgaaactgtaaaactccttaaaaataacaaataagttccttgattatttttaaaaatcacaccaaaatctcaagcaagaaaaacaagtgaacaaacagaatacatcaaattaaaaactgtctgcacagcaaaaaaaaaaaaaagaaagaaaaagaaaaaaaaagattaccaaaatgaaaaggcaaactaccaagtggaagaaaatacttgcctaccatgattcaataagacattgtctaaaatatataagtaatcatacaagtcaataggaaataaacaagccaatttaaaaatagaaaaaggacctccaaagatatttttccaaagagcatatacaaatgtccagcaagtgtaagaaaaggtgctcaggcaagggttggtggctcacacctataatcccaacactctgggaggccaagtggggaggattgcttgaggctaggagttcaagatcatcctggacaacatggagagatccgatctctaaaataaattttaaaaattagtgcttgtggtgggatgtgcctgtagttccatctactcatgctattcaagagcctgagacaggaggatcccttgagtccaggagtttgaggctacaatgagttgtgatcacaccactttgctccaacctgggtgacagagcaagagcctatttcaaaaagaaagaaaagaaagaaagaaagatagaaagaaagaaagaagaaagaaagagagagaaagagagagaagaaagaaagaaagacagacagaaagaaagaaagaaagagaaaaagaaagaaaggaaggaaggaaggaaaaagaaagagagagaaaaggaagaaaggaggaaaaaggaaagggagggaaaggggaacaggaagggaaaagaaaggaaagggaaaggggaagggaagggtggttagtcaatatcactaactctccaggaaatgcaaatcaaaaccacagtgagacatcacctaacacctgttaaaattgctattataaaaaaagacaagagataacaagtgttgatgaagatgaggagaaaggaaaacctttgcacatggttggtgaaaataaaaattggtatagccattatgtaaaacagtaagaatttcctcacaatattagaactagaactaccgaatgacccagtaatcccacttctgaatatttattcaaaggaaatgaaatcaaaatcgtaaagaaatacctgcattctcatggtcaaagggaaggggaagggaggggaggcgaggggaggggaggggaggggagggaaggggacaaggaaagaaagagaaggggaaagggaaagaaggaaggaggaaaggggaaaggaatagaaaagaaaggaaagaaaagggaaaagggaaaagaaaagagaaagaaaagaaaagaaagaaaaaataaaagaaaagaaacaaaagaaaagaaaaggtgctcaatattacctccccctgttcattgatcagtcctcctgctccagtccagacaggttgcactctagacccaatgctcatccttccagcagagacttcccttttgctgatttccctgttagatattctgtttccaaactctccatcttcctcttcatggttcattccatcattttactaaaaaatcttgacgggctctttggcagcctttgttcacacgcgatttatattttaatttgtgtggaaatctaaatttgaaataattgttcttctgcactctgaaggcatttttcttttatagtctagcatgctgtgttgcttttgagaaattgcatgttattctcattcccatttcttgattatctctctggaaacattaaggagattttctttatcccaggcttaatggcatctcagaatgaatatttttggcatttaaaaaattaatttttctagatagtgttggattccttgcatctgtcctccttccctgcctagctctattttttcctgttttgtctttactttttttactctttttttcctttcccatgtctttacttttcttttcctctttttctcctgtctttctctctctctatttttttttttttttttttttgagacggagtctcgctctctcccaggctggagtgcagtggcgcgatctccgctcactgcaggctccgccccccggggttcacgccattctcctgcctcagcctcccgagcagctgggactacaggcacccgccaccacgcccaactaattttttgtatttttagtagagacagggtttcaccgtgttggccaggatggtctcgatctcctgacttcgtgatccgcccgcctcggcctcccaaagtgctgggattacaggcgtgagccaccgcgcccggactttctttctctcttactctttacaaattcagttttattttctcagtgaatacaaacctgagagctccaaatagatacaatccacattaaaaagcagaataaataaacctgtcagttttcagaataataagtgttgtctaatagcctatgaagattattattttcaaaattatcactatgaattcatagattttaacatgttatcaacttaataaattataattattattctttgaccgataggagctcaaatcaaaaataccatattggtttctcagtccttcggatatgaccttagtagtctctgacagatttcttgttgtctggtacagatgtcaaggctgacaaagtgagactttgtctcaaaaaaaaagaaaaaatgtctaggctactcatgtgtattttttttctgcctcacaatgggatattagatatttttccagaggccaataggtaataattttcacagttttctggtttctaatttctttctttttttaaaaaagaaacaaactttccaaacacaaatatacacactcttatttccccttctttcttactcataagaccgtgtgtgtgtgtgtgtgtgtgtgtgtgtgtgtgtgtgtccaaacacatattttgccttgattttggcttttgctcttcatttttatttttttttactttacaaaataacctgtaaattgttacatatcagtaggtattaatattttcctttttaacactcacatagtactccactgtgcatttaattaactgtttttatatctatagatacagagtttctttccaatactttatctgatacatctcaatcatcactttatttgtaactttttgactctcctttgttttagctacatctcttgtacaaagcatagagctagattttttcttttgaagcaagtccgaaaatatctttcttgtaatagtttagttgaattcatttttattaacttcaatgactgacatgtttagtccaaattctatcatattatttcatttaatatttatcaatggtgttgtatttactgtttatttatatcttgttttatataatttttatttctcctggtatttcagacagtttgcatttttgttttagttatctttacattaacacctttattacatactcactcttctgtgtctgcacttataatgctatttttggtttctctgctttaaataatattttttgactaccactagtacttatattacaatcagtgagattgttctattttagctttctctctttacctctacttattttgtttttacttttcatttacttttttattatgatgcattcatcataataatgatgatgccttacttacagagatttaagatttacagaggagtcacaaagatggtatggagaggttttatgcagacttcatccaagttccctaatttgaacatcgtacataatcgtgacacacttatcaaaactaagatgttaatattgttgtagtaccattaactaaaatataggctttatgttgaacttgagatttttccactaatgtcattttcctgttttgagatcctattaggaagccaaagttgtcaactcttcttggattcctccaatctatgacaggttcctctgtcttttcttgccattcatgcctttgacacttttgaagagtactggctacatatttcatacaatgtcctttagttttagtttgtctgatatttgttcatgattaggcttttgttagggatttaagggaagaatatcacagaatggaagagtctttgtcattgtatcatatctgagggtacatgatatcaacatgatttactaccggttttgttagcctgtatcacttggctaaagaagggtctgctacttcattcattacatacatgacactaattccaggctgcactcaaggggataggaactatgctctattacctagaaacagaactatcaaataatttgtgaaaacattataacagcatcccaatattgaatgaacatattggggagatacattgaaactatacagatatcctgtttctcaaagttttatccactggctgaccttgttttcaataattataactgtgatgctctaatgctattttctatttctctgattctttccatatgtataaattggaaagtatagctttgctaggtgtaaaattcttggcacacacattgtgtatgagtttattgaaaatattgatccacagttatcttactttgcatgttactgttaggaagtcagataccagtttgattttctttccttggaagtgagtttgtattttcatgtgaaggtgcatatgatttttctttatcttaaagtctaacacttttattaggatgtatatttgagctcactattctggatgatttatgacaagtgtgtttcaataggcagattcaggtcttctgttatttcccaaagtttcttagattatcatttaaaatattatttcttctccattttcttcttttttggaaattccaattttatgtgttgtgtattgcccttgctaatctcataggctgatcaggttgactttaattctttttattacttttggtgtttatttttattcccctagtagttttattttctctcttcaacagcccttatataaatgatagaatctcttactccttgaaaatcttaaaatttagtattagtttttttaaataattacatctgtttctccaatttatcttttacatttagccagttcccattttatatatttcttcttgtccatctctgttctaattttttactttacataaaagatgattttacctatcaggaagtacatgcttaaatataatgaattcacgttgtggcattgtgtcagtttttctctctatggttagattctttaaaaaactttttgtcaaatggaatgctttgattttctatcttcctttaatattattttcatgtggatgtagtctattatttttctgtttgttttgaaacgccttttttcttaggatcataatgatagcttattctatcagggataagggaataatgtattttgaaagccattagtttgggacactatcttttgctggtacagtgacttgatatattttaatatatggcttatctatgacggttataaattgcatcttctgatcttgtaattttctattttgggtgtagcaaattgtttaatctacagtctctaggaaacagactctgagatggagatgtacatgtaaaaacttgttgaggaatatcctcaggcctatatttattaaggaaagaatagctgaatgtagtcacaacaaaagccttagccactactgcggggaagtgaggattttggatgtcccttcagagactgaattgcattaggtgtaggtgttcaggaatttacacctcccatgaatagtcattggttgcaagctgtccccaaggaagagatacaactttgataagacagctctcttcagctcaggccatttcctagcaagggactcagttgacaactgctagctgctaacactcttgcaacatttttctgtgagcagactaacatcttaagaaacttgctcccatcatcttctaatctctgtctcagtgctgtaatcaatttaaccctgttaccttgttaccctttcctgacagtgatgaagaccataattgttaaatatggtaatgctgttgttgaccccttgcattgatttacaagacattttattaaacaatcctgagttaatgctttttgtttatggatcttatgccaaaaatgcaaaaggaaaatacaaagcaggatatgctgtgacaactcaatgtgaactaacagaaaatgtaactctttccccaatttaagtcagcccaaaaggcagagctataagttctcacttggatctgtcagatatctaagggcaaatcagtcaacatttctacagatagtagatatattttcgcgtagtttataagtttggtatactatgaaaagaaagagggttcctcacctttggtggaacccccatcaaaaatgcgccccaagtagatgagtgtctttctgctgttttgctgccttcataaatggctattaaaatggaaggccacacccataaaactgaacctgaataccgagaaaataccctagaagtcgttcatgctaaataaactagtagtgataccactgagatgtttgaaagaaaaacactttgaatgaactccacaaaattgatccaaatctatgataatttgtttaataaagaatgctatgaacctgaatcagcaaaacaaacaaaattggctcttaaaagaatgaaatttaatattaaataggaactgactgagagcctgaaccactgcttcattctcccaaagtctttttttaaaatttaattttattttattattattatactttaagttttagggtacatgtgcacaatgtgcaggttagttacatatgtatacatgtgccatgctggtgtgctgcacccattaactcgtcatttcgcattaggtatatctgctaatgctatccctcccccctccccccaccccacaacagtccccagagtgtgatgttccccttcctgtgtccatgtgttctcattgttcaattaccacctatgagtgagaacatgcggtgtttggttttacgtccttgcgatagtttactgagaatgatgatttccaatttcatccatgtccctgcaaaggacatgaactcatcattttttatggctgcatagtattccatggtgtatatgtgccacttttcttaatccagtctatcattgttggacatttgggttgcttccaagtctttgctattgtgaatactgctgcaataaacatacgtgtgcatgtgtctttatagcagcatgatttatagtcctttgggtatatacccagtaacggaatggctgggtcaaatggtatttctagatctagatccccgaggaatcgccacactgacttccacaatggttgaactagtttacagtcccaccaacagtgtaaaagtgttcctatttctccacatcctctccagcacctgttgcttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcaagtccttcgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagcttaattagatcccatttgtctattttgtcttttgttgccattgcttttggtgttttagacatgaagtccttgcccatgcctatgtcctgaatggtattgcctaggttttcttctagggtttttatggttttaggtctaacgtttaagtctttaatccatcttgaattaatttttgtataaggtgtaaggaagggatccagtttcagctttctacatatggctagccagtcttcccagcaccatttattaaatagggaatcctttccccattgcttgtttttctcaggtttgtcaaagatcagatagttgtaggtatgcggtgttatttctgagggctctgttctgttccattgatctatatatctgttttggtaccagtaccatgctgatttggttactgtagccttgtagtatagtttgaagtcaggtagcttgatgcctccagctttgttcttttggcttaggattgacttggcaatgcgggctcttttttggttccatatgaaatttaaagtagtttcttccaattctgtgaagaaagtcattggtagcttgatggggatggcactgaatctataaattaccttgggcagtatggccattttcacgttattgattcttctaacccatgagcatggaatgttcttccatttgtttgtatcctcttttatttcattgagcagtggtttgtagttctccttgaagaggtctttcacctgccttgtaagttggattcctaggtattttattctctttgaagcaattgtgaatgggagttcactcatgatttggttctctgtttgtctgttattggtgtataagaatgcttgtcatttttctacattgattttgtatcctgagactttgctgaagttgcttatcagcttaaggagattttgggctgagacaatggggttttctagatatacaatcatgtcatctgcaaacagggacaatttgacttcctcttttcctaattgaataccctttattcccttctcctgcctaagtgccctggccagaacttccaacactatattgaataggagtggtgagagagggcatccctgtcttgtgccagttttcaaagggaatgcttccagtttttgccgattcagtatgatattggctgtgggtttgtcatagatagctcttaatattttgagatatgtcccatcaatacctaatttattgagagtttttagcatgaagggttgttgaattttgtcaaaggccttttctgcatatattgagataatcatgtggtttttgtctttggttctgtttatatgctagattacatgtattgatttgcatatattgaaccagccttgcatcccagggatgaagcccacttgatcatggtggataagctttttgatgtgctggtggattcggtttgccagtgttttattgaggatttttgcatcaatgttcatcaaggatattggtctaaaattcttctgttttggttgtgtctctgcccggctttggtatcaggattatgctggcctcataaaatgagttagggaggattccctctttttctattgattggaatagtttcagaaggaatggtaccagttcctccttgtacctctggtagaattcggctgtgtatccatctggtcctggactctttttggttggtaagctattgattattgccacagtttcagaacctgttattggcctattcagagattcaacttcttcctggtttagtcttgggagggtgtatgtgttgaggaatttatccatttcttctagattttctagtttatttgcgtagaggtgtttgtagtattctctgatggtggtttgtatttctgtgggatcagtggtgatatcccctttatgatttttttattgcatctatttgattgttctctcttttcttctttattagtcttgctagcagtctatcaattttgttgagcctttcaaaaaaccagctcctagattcattaattttttgaagggttttttgtgtctctatttccttcagttctgctctgattttagttattttttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttcttgttggtttcaaagactttaaaactactgctattaaaaaccctatctatactccttaactcttcatagtgtagagaaaatggtccaaattttgaaaagagtattggtgaggtgataatagctcttggattgaaaaattggtttataaccaaagtccagttacagatggaacgtctctgccacccactagaccagtggagcatctacacatggatttcgtgcagttgccactctcaatggcttaccaatatagtcttgtaatcgtattttgttctcaggatgaattgcagcctttccatgcataaagaccagctccataacagtagcaaattaaattactatggggcatacatagcctttatggagaatacctggagaaatttccagcagtaagggaactccttttactggaaaaattattaaacaatgaaataaagttttacaagtacgatggcactaccattgtccttatcatccctagtcttctggaaaaattgaatgaaaaattatatcttaaatctaagttgcctaaactaacaaaataatctggattgccttggccaaaacttttaccactggccttagttgcaatcagatctgtgctgaaaagcacatgctaacagcttatacaatagtaacaggaagacctatgaccttaattatagaacctcatttatctcttatacttctaaattctgtatgactaggtattgcaacatcttgatgcattatggtgaagaatatttccaccaagtaaaggaagctttctgtgacccactgactgatgaccagccttccataatatagaatctgaagattgggtcttttagaaatgacaccaaataaatacttctcttgagtctcattggaatgaaccataacaagttcttatcatcactcataaagcttcaggacttcaagacttgggttccagtctctcagctcaaaagggttcctcgagattgttggaactgtatgcaacctggagatctcgaagtaaaactgaccagggagatctctcccaccaaaagaagatggtatccttgaggtgaacagatttttaaagatcatggatcataaacctcttccctggcctctcatggaactccaatcttcttttctcttttggttctcactttttctttccatgtgtgcattgcaaaataatgctataattgaaattttatagtttgtagtttcagcagagattttaactgaatgttgtgtttgccatgccaaatccaaatcaatacatgaggaaaagaatgttctagcccattcttaactgattttaccagaatcccaaatttgaccatctgtttagattgcattactgatctacgttatgaagttagagttcaagacacattagttctttttaaaactttcttaattgatacataataattgtacatatttatggggtaaatgtgatattttgctacacacatagacggtatgatgatcaatccagggtatttgggtgcccaacaccttgagcgtttatcatttctttgtgtcaaaacatgtcaaatcttttcttctagctattttaaaatatataataaattattgttaactatagtcaccctattgtgctaacaaacactagaacatttttttctgtctaactgcatgttggtatctattaaccaacctctctttttcctccagcccactcttcccagcctctggtggctatcattctgctctctactttcatgaaaatcaacttttttaacttctacatatcaatgagaacatgtgatatttgtctttctgcacctggattatttcacttaacataatgacctctgattccatccatgttgctgcaaaaaatgggatttctttcttttcagtggctgaatagtattccattgtgtatatgtaccacatttgctttatccgttcatcccttatggacatttaggttgaatccatatcttggctatcatgaatagtgctgcaataaacacgggggtgcaagtatccctttgatatactgatttcttttcctttaaagaaatatccaataatgggaatgctggatcgtataatagttctatttttagttttctgagaagtctttctactgtttttcacatacatttcatgtgaatgtactaagttacattctagcaacagtgtaaaagagttcccttttctctgcatccttgccaacatttgaataagggtggtgtcagtgggcatccttgtcttgttccagatgttacaagaaagaatttcagctttctcccattcagtgtattaactgtgagtttgtcatatatggcctttaggttgacgtaatgtccctcgtttgtctgagagtttttatctcgagaagatgttgagttttatcagatgctttttggcatctattaaaatgatcatgttttttgtcttttattctgttgatatgatgtatcatgttccatgatgtgcatatgttaaacatctttgcatcgctgggctatatcccacctaatcatggtatattatatttttgatgtattcttggacttagcatgctagtattttcttgaggatttttgaatctatcttcatcaggggtattcgtttctacttttttatagtgtctgtctgtttttggtaccagaggaactcttcttgtcataacttaagccagaattgaaataccagatcctctgacagtagtctaagggagatatgcaacagaaaggaaagcttaaataaaactctttgcaagaatgcctattgagctacattttgatagcctctcagtaagtaacaactcagtatcagtccttggttagaaattgccaatgtctttattccaacaaatggctccataaataattcttagtagcactgtcagggtacacatttttatctgtggaagttttaacaagcaatcatatgcatgggtcactccatggcttaacaaacggagaatgaaaaactaatgcagactagtgccactgtcacttcataacaaatcagaaaataagcattggtcctctcctctaaacttaaactatagataaaaaaggaacttatcagcaggtatcaatcccgctgggtgtttccatggcttcaactagtataaataaaatttgtcattcacattagctagtataactgattccacaactaaggctatagctgacaaataaaaatctctagattctccagctcaagttgttttaattgctttagattatttgttggctaaacaaggaggtgtctgcaatggctaatatttcttgttatacctggataaacacatctggtgttgtaaaaattcaattacaaaaaaaattaataagcaagccatctagttaagacaggttaaattctcctctagttcattctttgatttatttgattgtagttgggttggttctttgggggcttggctaagaagcatactttagtttctttgtattattctcttaatagtaaccattctaatctccctggtatgctgtgtcctctcaagaaccttaaatgcatgctcataaccatcaacaatacaccagattatcttgttgcagtgagaacaaggaaaaagataaacaacacaagaaaagtttactcaatgaacctgacatcatgacttatgaattccatgctgaaacaaaggccaaccagccacgattgtgacagtcacacacacacacccaagttttggccaatcattaataaataagaggctgatcagaagggaggacttattaaaataatttaataggatgcctttagcctaaggtggaccctgagacctaggttcccatggaagcaaaccaaaatctaacgtgaatgtgtttgtcattaagtgactaacttagagaaagtaaaacttaagttcaaccaatcagaaaccatcaaataacctctaattacataactagggattgtccacataggtaattcaaataaggcaattatattactgtaacaaactgatcttttttttttttttgactttccttctctattcatcctataaagcttttcttttgagcatccccagtagacccccaaccacaatccttggttggataatgccagattcataaattgcaatttgttcaaatagcctcaaaaggactaatgtgactcaatttaagttttttaagttttccattaattccacttctcttccaacgtcatatatctctattatcataggtctgctaagtcatattgcccaaatgtcaggactgcttaagccacagcttgaaccgtggagagcccttttctgtcctggaacccactcaaaactgtcattattctcccatttagacagatgtgtctatgagtaggatttttacaactgtgtcagacattaagaaaagttttggaaaattttaaaataagtccttaaattactgcattacactgctggactaagattttaagagtaataagccacatatcatcacacttattttgctgaatataaaattattattactttaataatagtgcttgttaaacaatattttgtatcattactaaataaaattttaaaatttaattattttatttaatcttgtactttctaaatttttacttttgatgttgtactatacataataatttagtacagtgacatctatttaatatttacataagaatgtatatatatttaagatgtactccaaatgattttactgatatgaatgtacaataaaaatggttgtaaatcccccctctagtgaagccacaagagtatacaacagttaaaacataagagtaaatgagacaatctacggagaattctagaataaaagaagtaggccaagaatacaacagaggggaatagaagcatcattaagggaaaagagagaaacatggcccagcatcaaagactgaggtgagaaagtgaggaagatagaaccagtgagtattatcacagaagccagaggtgaagggactttcaatagcaccaaacactacagcttggttaggaagataggtagatgttctttgaaggtgacatttagagttcattgcgatcttactcagagaaaagtttcagtgaaatggtgagggcagaaaccataaatttgagggatctaagtagaacaatttgtaatctaactgcccattccccttatattgcttatgagttcttgtaagatgcagccaccctagtttacaaaccattttttgattagctcttgtgctttcaaaattccagacttttgtgatatgattccctcacctcttcctcttcttcattctctctgcctattataatcctacttattttgcaaagtttatctcaactgacacttccattgagaaatctttctttgttcctcgggtcactatgcactttcttctttatatttttataaaccttacttaccctttttttggccaggtgctgggattacacacccgtaatcccagcactttgggaggctgaggcaagtggatcatttgaggtcaagagttcgagaacagcctggccaacatggtgaaaccccgtctctactaaaaataaaaaaaattagctgggtgtggtggcatatgcctgtagtcccagctatttgggaggctgaggcaagataattgcttgaacccaggaggcagaggttgcagtgagctgagatgacaccactgcaatccagcctgggagacagagcgaggctccgtctcaaaaaaaataaaaataaaaacaaaaacaaaaaaacttatttacccttttttatatcacagcctgaattatactctagttagcaatctatgtgtctttcttcccaactagattatgagcttcttgtcaggagccatttttatctaagaagttcttatcctcaccctgttcataccccagtacccctatgccaattttcttttttccactgccctgtatgttgtaagtacttaataaagggaaaataaaactgaaattttagcaatcagtgtagtaagtatggattgagggtctgaggatctagctcagtttgctacaaagtgcccaaaagatttatgaattggtctgtgacttgacgatatttaatcaagatttacacaatcatgggatatactactcacaccttattaagtgataagtatattatagagcaggcaagtattgtgtatttcaagaagaagaaaaatcaatttgatttcaaagattaagaaaggctgcaagatcttctttgaactcaactattgagatggaaaagagggagaagctgttttagataagagaaacattactagcaaattaattgaagcaaatgcacaaggaacaaggaagggagcacatggccgagtttgctgagataaggaggagaaaacaagttgatgataagatacagaaaacaatgggatatctagaacaccaaaataagaaaaattgatttggtttgaaaagtaatgggaattttataaattcttgagcagtgcagtattattttttccccctttcattcagcaagtcctcaattagcactaaagagtgccagacacggccaggcgtggtggctcacgcctgtaatcccaacactttgggaggccgaggcaggcagatcacgaggtcaggagatcgagaccatcctggctaacatggtgaaaccccgtctctactaactatacaaaaaattagccgggcatggtggagggtgcctgcagtcccagctactcgggaggctgaggcaggagaatggcatgaacctgggaggaggagctggcagtgagccgagatcgtgcctctgcactccagcctgggcaacagagtgagactccgtctcaaaaaagaaaaaaaaaaaaaagagtgccagacactgttcaagatatttgaaatgcaggattgaatgtgtcaaagaaaccccttccctttaagcctatatgctaatgatagtgatgggacaggagtgaccgattttagatgtcctaacaaatatatagtatatcgaggagtgaagtgtgaagaaggaaacaacagggtaaaggacagctggtatgagcagaaaagacggtatagcaatctcaataattcatatggggagccagataataataatatcaaagtttccctgagggcattgtaggatgtgggaacaaattcacctcacagagtgaagaagttgatgaccttggccgcactttctacactttcttggatcctctttaaatactaattattttctacaaagcatattagtcacacttcccccagtaacaggtcaaaccagcctgagactattttctgcctgttttatcttgtatgttcagaatagtgaataaaattgtaaaaatgagatcggtttcatatgaatcagcaagatgatcatcaaacagactttagtgaaggtcatttgtttttacctcattatctcacaagacatctttaattaatttcaagtggtttatatatttttaggactgagtccacagaattacactgatgtcagtgcagagaaatccctttaggatttggtggaaagctttaactttgcagtgttacagatataattatcaacactgacctactagtagtctcctagattttcattcttttaatcccaaatgttttagaggccaaggtttatattctttaattttatgaaaaccacatcataaagctgttacaaagctcttctcagtaaaatctaggtaagagaagcgtgctaacttatttttacttctaattttagcaaccataaagctctgaattatttagtacctctgaattatttagtatcttttattgttcttaaatttcagcttttttctaatctttctagcacttttcaaaattgaatgctatgaagaactaggatgagacacaatactgcaatttgtctgactttctgattgtaacagaatttcaaaacacataagtaaagttacaaagaaattctgttaaataatttaggcatgtacatagaaagttattgctaacttaactgactacatggcttacatttattattttaaaacgaattaataaaatagtcagcccatgtttttgttttaatattttgaatataaaaacatgtctattttgaccatagaacttatatgatttgaattatcagtcagtatgtcctaatgaatcactatgcagggaaaggaaatagccttttaaagcaaaacaaaatttgacttcaaaaatcctattaagatataaaggattttctcctttttcctaagtgttagaaggctatagtataaaggtgagcttgcttttacttagtagcttttaatctgctatagtatacttcagaaaatcttatataattttctgaagaaacagaaaaatggtagaaaagagtcaatttagataaaagaaagacacctaaaattttatgtaatgattttatatatttctttgtagactttcctttaaagctaatagtctgcagaaaccaaagaatcattaaggatcattagtagaattcataaagcaactttactcattccaggtcatcagggtggagctaatactgaaattaatactgccttttcccccatagtattttacagctcttttcacagaagtataaatcacaactaacctcaaaatgcttacaatataagaaaattgaatagactgacatttttaaaaagcaatgtatatataggcaagaaattctgaattgtgtggagtatataagagagcatctaccgttcggaaaatggaaatctgtgtggactggggcaattagttaaaactttaagtagcattatataaaaagtattccttatcaaaaggaggaaggatttaggcatgtaagagaaaatcaacaggaataatagaatggatagagtcaatgtttatgaaatgggtgtgacactggggaaagggatgagacaagtgataatctacggatgtttatttctttaaatctccaagataattttctttaaagataaatattttcctcctcagttcttggtgaatttcatacagttcctaagatataaatttaacatatctgttatatgcttttttaaaacattcaatctactggaagaatatatagaaattattttcttggagagagatgtgtgtgcgtgtgtgtgtgtgtatatatatatatatagccccatataatatatatattctatattatatgacatatatatatatattataaatttgttttaaggaggatcttcaatacaaaactgacagtgaaattatttgagaacaatgaaccagataggggtcccctagttttttatgctatccttgcataaatttataaagatgaaccatttccactttaaacatcttccctggaattatcaaaatatccttgtgaatcctaagggtcagagcttgaggtcacagacactgacactttaggagaacaaatgtcccctagaagtatgtgaggatgtatttagaaacagcaggggaaatatgacaaagaaattcctctacttgttgtaaaaaggaaaaaaattgaaggaacaataatatgctctcaattacaatcaattacaatattataacccctcattcatctctcaacagacaaggtggagatgaataaggagaatcactccttgatagctgagttcatcctcacaggatttacatatcatccaaagctgaagactgttctgtttgtggtgttctttgccatctatctgatcaccatggtggggaacattggtttggtggcattgatttatatagagcaacgtcttcacacaccaatgtacatatttttaggcaacctagttctgatggattcctgctgttcctctgctattactcccaagatgttagagaacttcttttctgaggacaaaaggattaccctgtatgaatgtatggcacaattttattttctctgtcttgctgaaactacagactgctttcttctggcggcaatggcctatgactgctatgtggccatatgcaacccactgcagtaccacaccatgatgtccaagacactctgcattcagatgactgcaggagcctacctagctggcaacctgcatcccatgattgaagtagagtttctgttgaggttaactttctgtgggtctcatcaaatcaatcattttttctgtgatgttcttccattatatagactttcttgtattaacccttatatcaatgaattggtgttatttatcttggcaggatcaattcaaatctttactatagtcttagtttcttatttctacatccttttcacaatatttacaatgaaatccaaggagggaagaggcaaagctttatctacttgtgcatctcactttctctctgtgtcaatattctgtgattcccttctcttcatgtatgctcgaccaggtgcagttaatgaaggggataaagatatacctgttgctatattttatactttagttattcctttattaaatccttttatttatagcctaagaaataaggaagtaataaatattatgaaaaaaattatgaagaagagaaaattttgtcacattctgaaacaaatgtcatcccctctggcaacttgataatactttattttaaatcaagggatagtgaggcagtttacaaggccactttgaatataaaatattaaattatttaaaaataatgatataggagttcaaaatgttcagaaaggagaaattcctgtaaaatatacttcaaaatctaagctactagtgttcatcaaaagtgaactaaattattcatgaagtctcagattgtgtcagagtgtaattagttacaattttcagcaaatccaacaaatactaggaataaatgtcagtacatataacggtagtgtgcatttactattgttggcaaatttctggaatcttaaagcataattttacgaactcaggcacattccaagttctcaaacattagtccctttttaaccagaatcatctgtgagaagtaaattgtctgtctgaatttgattctaactttttttgagttctttcaagagattgcttgaaaaattattcatgcagaatatgtattctctaatcaataatattttcatatttagtgttagtcattagtcattttacattctcaagttctatgaaacagagtacctgtattgattgcttttccctttctataatgccataattttaaaaatgtatttctgggcttggcacagtaatctgggcttatgcctgtaatcctagcacttccagaggccaaggcaggtagatcacctgaggtcaggagtttgaaactagcctggccaacatagtgaaaccccatctctactaaaaatatttttaaaattagccaggcatggtgcatccttataatctcgactacctaggagactgaagcaggaggatcgcttgaaccctggaggtggatgttgcagtgagctgagatcaggccactgcactctagctttggtgtcagagtgagactctgcctcaaaaaatatatagaaataaataaaaagtgtgtttctgtgtcattcactctcaactcttagtaacactgaatcccagacatctattcagggaagagtttgtgacttatatggagccagtgagacagaaaaggtgattttttcctgaaaaatgagttttcttattttaaaagagatccacaaaaaatagtctttctctctctgagtgttacggtatgcggatatgaaacccagcagagccaattccctttcaccatcaagaggaaaaccagcctggagttgtagtcaatactcaaatgagggcatagctgaagaaatcacacagaaatagacccaaaatctctggagtaaaccatctcttctgactgtataatccaatagaccttcttatcttttaagcttatttggcagagatgttttattcatgactgaataaatactaacggatacattcctgcttcttgactatcactcgtatttgtctctttatattctattttaaattaatcctcaggtgatcttttagttttcaaataacttttcagtggtatccattttactgtacagcaaattaattaggttttttactcttattactattttaatttctaataaccttactttaaaaaaaatgagggacagagaaatttcttgtctacagaaatacagtggtagagctcaggaaccaaacccaggctatctggctccagaatccatggtcttaaccactaagtcatactgtacatagcacaaactaaaagcaggagaggaaacattttaacaatctcagctgtgaagtgggcagagaaatagggcagagattcaaaagagatatggatcaaagacatttacctccaaatttattttgaaaaatttcaaacctacagaaaagttgaaaaaagtatatgattaacattcatatacttcttttagccaattaagcaatcaaacaattgttaacaattattgaacaattattaacattttacaatacttgcctatcaccaaatgtgtatataggtatataatacctatatacatacttataatatatatatacattaatgcagtacaaatgtacatatatattacatgtccatatggatattatacaaatgacacatatacacataaatatatacttacaatacatgtatacatacagttaatacctatatacatagatacattttttaataatcaaaacatctaaatagggcactggcttgttattagcagttccaccaacctgaactactttaattgtaaattactgatgggctcacagcaataacagaacattaagatgctgttaggcataaatgatgcagaaaatagggattccaagcatctaaacaatatttatttattaaatacacaaatatgaaaaaaatttactgagaaattgctatcttgctatgcactaagctagtgtcaaagaaaaccagagcaggacaaaagttaaagtgctaaatacaaagttgattcaggactattgccataggggcagaaaaaccccagtgtagagcttcatttcaaatgcagcagggaaaagggaggtcttgtagccaaagaagcagggggtggccagcgaatgaaaaattattaagaagagacatcaaatctagggggaattctggttgaaccaatcgaaaaggatttatttattcttttatttatttatatttgagataaataaatcacattgtcacccatgctggagtgcagtggtatgatcatagcccactgaatccatagcacctgaatcctaacaggatttttgctgaaggcaagccagagtattcagataccaagaatgggaagggaagaattttgatcagatatagaaggtcatcaggtattgaggatgggaggattcttgctagattgtctttctgcattatttactagaactagattttacaagaaagtacacaagtcagccaaagagaaggttcagaagcctgaccgtagtttgttcaagggaaaaagaggcattcttcccttaagtttatttctcctccagtttgctcatttatgactagcaaaaccatctgcttgtacctggtgcaggttgctaattgtattgtgagatcaatgagacatttaatgagagggatacccataaagaaaaacagaatgataaatattagaggctgctctgctgggttttttttcttccaagaaggaagcttagaagcagtgttagcacacctctcccacttgaaaggacagaatagcatgtagagatttatgctgtgaacttttttcaagaagcaacacaggaacttaacaagaaaactgaaagaagcacaggctgtttgaaagaagtggcaggctacagcctacactgtgaaacagccaaaaaactctaagtccccaaagtgtgagaaggggacagactgcatccaggatacacatccccatcagggaacgtgaaatccaggccatgggggaaggcctttaccctacccagagctgggactgatttagggaatagtgagaaatataaaagtagaggcagtagtggaaagcaccttgcaggcattcccaatctctagcatggactgagggaaaccattcattccttattatacctcacagggactcagggaagtcagccaagtagctcagacagtggtcacagtttgaaagaagcctccagttgaattttgggatataatattgagtgggagcaaactcccttggccagaacccaggggcaagtgggaagtacactgcagccatgagtgcaggagccaggctgccaaggctgcctggagcttagctcagtgctgctagcagaacacttcaggagtgagaacaactttgccaactgtgtgggatctgggtgaggcttactgccacctgctactctttactccctgtgcaaactctcttctgtgcaacagaggcagttacactcccctctggagcattaccccagcagcctgataaatgccctctgaccctcagagaagctgcagcttgccactcatgtggagagtcagagcacagccccaacctggctgtgcccctccaccctccctggtagtgtaacacaaatgacagaaacatttaggagctttatggccctgcccatcacctgagaaaccagaatatctcctctgggcaaagcagggaaagctcaaatcctgctactattacaggagcaggtactctttggcaagtgctacctcctggctggaggccagccaacacagtccactacagcatctctagatagaataagagtgtgcccagaaataagaaaactggtatctgacctcagctaccaccactgcctgcaacacactggctaaccaggaggtctgagtctgtccacatgccgagttcactaccatcataatcaacattcaagaaaaacaacacactaaggctatctataatcaaggattctcacaaagtctacatcactcccctgccactcccatcacagccagtactggtaccaactgctgtggttttgaggaaaggtaacatcactagaaccctcacagactttccccagcaccagcctggagtatagcagccccaccgggtggttagacccagaagaacaatcactatagtctggctctcaggaactcatactcctagagtatgggagagagcacctcatcaatggaacaccccatgggacaaaacaatccagttcttctgggtgaatatctgtctcaaaatgcaaccatgtcaacatttccctggtcagctattttttttctgtaattccatatatgttcaactagtatgaaatctgtgcatattggaaccacgcaatgccaagactgcctacacttacttttgaactgattgtctaggttcctaataaagaagtctctacctaccatgaaggaccctgaagcaaagaagacaaaattctcaacagaatcaggagcatctctataaaaattctattgtttccttaacttgagttattaaaatacctgggacaaaagaatctggatggcaagccttaaatcccagatttttccactggtgggaagtttctttcagcagagacacaattgcagtgctgggctcaggagggaaattttgcagctctactttaacagtcaggcagccttggtgctcatgaaagatcttacagaaggggaattctttccttccttgtccgccactgcagacacagctggggcttctcccatgggagctcagcatgggtgcacctatagagagtgtcaggcctctgagcccaagccaagccatcgcatcccctgtgacttgcacgtatacgcccagatggcctgaagtaactgaagaatcacaaaagaagtgaatatgccctgccccaccttaactgatgacattccaccacaaaagaagtgtaaatggccggtccttgccttaagtgatgacattaccttgtgaaagtccttttcctggctcatcctggctcaaaaagcacccccactgagcaccttgcaacccccactcctgcccgccagagaacaaaccccctttgactgtaattttcctttacctacccaaatcctataaaatggccccacccttatctccctttgctgactctcttttcggactcagcccgcctgcacccaggtgaaataaacagccatgttgctcacacaaagcctgtttggtctcttcacatggacgcacatgaaagagagtcttcctggaacacttcagagtactgcattcccacagaaggagcactcccaagattcaggtttgcatgagaggcagagtcacaatttctctctatttggaatatcagcatccttacagatgaaaagaggtgcctctcttgggacacgagtgagtcttggaggtggatagctttactgctggcctggtggaagaactgaattggctcccatccttctccctgataagacctcagtgtgcctaattgagagctcctccagccaccttcatcaaggctaggacctttgcacaccattgggtattgcatttatccatatgctttagctacaacctgttcctacccagggacacctcccctactggcctgaagcctgaaccatcaactcagtaaataaaatactggaggtaaattaaataaattaaaaagtacataccatgggggaatgagataaacttcaacagacctctgccattccaattctataggagatagtgaacttgcccacacactgagtacattgctactacaacaaatatctgaggaagccgtcatacaaagactataatcaaggaactcaaacagagtcttcctcaaacagagtcttcacccctaaaagcaccatcaagaacaaaattagggtaaaaagaaaactataaacattaaagtcgcatccttaagggagaaaaaatgaaattttagaaaaagtcaaatcaaaaataaattcaagaacacttagaagaaatagtctacccaaataagaaagaacgagaggagtaattctggtaataaatataacaaaacaaggttctataacattctgaaaagattcccccagtaatgaatccaaaccaaaatgaaattgttgaaataccagataaagaattcagaaggtcaattattaagctactcaaggagatactacagaaaggtgaagaccaacataaagaaaattttaaaaaattcaggatacaaattaaaaaattctagacaaataggtatcataaagaaaaaccaatcagaagttccaaaaatgaaaaactcatttagggaattacaaaatgcagtggaaagtttcaactatagactagaacaagtagaagaaagaatctcaaaactgaaaggcaaagatttttaattaacccaatcagacaaatataaggaaaaatgaaacaaaagaaattaacaaagtctcaaagaaatatgagattatgtaaaacagctaaccctaacaataaacggtgtccctgagggaaaagagaacgcttaaaatttagaaaacttacttgagggaatcattgaggaaaacttccctggccttgctggaggtttagaaatccaaatacaacaaactcaaagaactcctgggaaatttattgcaaaaagattatcaccaaggcacatagtcattgtgctatctaaagtcaacatgaaggaaagtatactaagagctgggagaaaaaagcatcaggtaacttatagaggaaaatctatcagactaacagcagacttctcagcagaaaccattaaagctaaaaggtattggggttctatctttagtctccttaaacagaataactgtcagtcaagaatttttgaatccagcaaaataagttactttcataaatgaaagaaaaagttatttttcaaacaaatgctgaggtaatttgctattaccaaaccagcactacaataaatgctaaaaggagttttaaatcttgaaacaaaaccttgatatgcaccaaaatagaacctcttgaaagcataaaactcagaaaaaaaagtatgtaggtaacaatgaacatgatgaatagatcagtacctaacatctcaatattaacattaaatgtaaatggcctaaaagctccacttaaaagatacagaatggcagaatgtatacaaaatcacaaaccaaatatctgctgtcttcaagaggctcacctaacacataaggattcatataaactcaaggtaaaggggtggaaaaagatattccatgcaaataaaaaccaaaagagagtgtaatggtaaaagggtcaatccaacaagaagatattacaatcaatatcaaattacaaatttacatgcacctaacactggagctcccagatgtataaaacaattgctactagacctaagacatgagattggcagcaacaaaataatagtgtgggactttactattccactgacagcactagacatattattgagatagaaagtcaacaaagaaataatggatttagtctgggcatggtggctcacacctgtaatcccagcactttcggaggctgacaggggcagatcacctgaggtcaggagttggagatcagcctgggcaacatggtgaaactctgtctctactaataatacaaaaattcactggacatggtagtgggtacctgtaatcccagctattcgggagactgagcaggagaatcacttgaacctgaaaggtagaggttgtagtgagcagagatcgtgccactgcactccaacctgggagacagagtgagactccatctcgaaaaaaaagaaaaaagaaacaatggacttcaactacactctagaagaggtgggcttaacagatatttacagaacattctacccaacaactgcagagtatatattcttctcataagcacatggaacattctccaaaagagatcatacaataggcacaaaacaagtctaatacatataagagaattgaaattatattaagtatcttctcagattacagggaaataaaactagaaaccaactccaaaaggaatagtcaaaactgtacaaatatttggaaactaaataattttctcctgaatgatttttggatcaacaataaaatcaagatggaaattttagattattcaaacgaaataataatagtgaaaaagttatcaaaatctctgggatacagcaaaagcagtgctaagaggaaagttcatagcattaaatgcctacctcaaaaaagtcttgaagagcataaattgacaacctaatgtcacatcttaaggaagtaaatacaaagtaaacccaaaggcaacagaagaaactaacaaagttcagagcagaacaagatgaaattgaaaccaaaaagtataaaagataaatgaaacaaaaaactgattctttaaaaaggcaacaaaaatttatagatagacaatttgccagattaaccaagaagagagaagatccaaataaactcagttagaaatgaaactagaaacattgcaaccagtaccacagaaatatgaaagatcatttaagcctactatgaatgcctttatgtgcacaaactagaaaatctagaggaaatgaataaattcctggaaacatacaaccttcttaattgaattaggaagaaatagaaaccctgaacagatcaacaacaagcagcaagattgactcagtaccaaaaaaaaatgctaataaaaaaaattcaagaactggatggattcacagctgaattctaccaaccaatcaaagaatggttggtaccaatcctactgaaactactccaaaagattgagaaagagggaatcctccctaaatcattctatgaagccagtattaccctaatacccaaagcagaaaaggacataacaacaacaacaacaacaacaacaaaactacagaccaatatcccagatgaagatagatgcaaaaatcctcaacaaaatactaaatatctgaatccaacagcacagcaaaaagataatacctcatgatcacacgggcttcatcctggggtgaagagatggtttaacatacagaagtcaataaatgtgatacatcacgtaaacacaattaaaaacaaaagtcatgtgatcatctcaatagatgcagaaatagcattctatcagatccagcatcactttatgataaaaaccctcaataaagtagttatatcaggttgctgcaaaaggtaattgctgttttgccattaaaagtaatagcaaaaaaacacaatttacttttgaaccaacctagtagaagggacttacctcaaaattggtgagccattgatttgagagcagctgtgatgttgtccatggccatgatgaattgtataagtaatgactaaatgattctattttgttgagtctaactttttcagccaggtggtagattcctaggaatggtacccaaaggtggcaaacctttctgaaaatgtaatgagatcatgaaaggaacttgttctatagctgtttttcctaaattatctccttaggaactgagatcagctacaaaaatacctctgagtttctgaaaaccttatttttccaatagtgagaattaggtaaactggagaaggtgggtgatagttcaataaaagaagaaaattgtagaaaatcaagcaacataaagggattagtaaaattggtaagaaaagaagatctggttcagtaggtcagtaaaagacaagcat

SEQ ID NO: 300 - DNA, 20966 bp, Homo sapiens
ccagagctcatctaaagtcagctagctgaggcaagcaaaggcgacgctgtgggccaggattgtcaattggtaagcctataacggaggtgattttagcaacaaaatttgttggagggtgagagtcactgaggattcctgatgcatgccataggtagccacaggtagttcggttactgcagcaaaaagagagaaagtgcaagaaaactagagaacactcattgtcctgcagtgtctctccagcgccctctactgacaaagtttatcatggtgacatccaaagaaggagatgtgttccctggagccagctccagcaaatatggttggtaaaggatagtcgtactcggcaaggaaaagcaacaagttactgatacattccacaatatggatggattttgaaggagtaggctaaataaaagtagccagacgcaacagactataaaccgtatgtttccatttttataaaattctagaaaagacaaacctatagtgacagacaggattaatggatgcctggaagcagattaggggcagagattgactgcgaagaaacatttgagaactttttgagattattaaaatgtcctaaagtttggctatggtagtggcacaactgcacacagtttcttaaacttaccaaattgtacttttaagatggatgaatttactatacataaattatatctcggtaaagcctcaaaaataattcctagtgctttttagtcttccctaagctgccttatttctttaaactctttggactcattaatttcattcttaaaaattttccatggctgttaatgttttcatctgtcagatttgtttaccagcccgtgtgctttctaatcaggattaactccaaggcatctacgtgcctcaacagggccatttttttttgttttttgcataaagaattttagaaatcagactcactgatttaattcagactgcaattgctaccgaagggttacttttttatcctctgagaatatacccacaacactatctttctgtaatcagatggcctttcaatgctttccagtgcaaaatgtttattttgttgatattgactggcctttccatgtatataaaacatatcttctggttactcattgagggcctgaagtgataatttaccagtacatatgcaacacacctagacactagcatggctttcttgactgtaagagttctaaataagagaaaggttttaattatttatcggccaggcaagacaataactgatgcctaggtggaaagtttaggaaaaatgttaccatcagtcaattaagataaggtccaactgattattcttagttaaccaaatttagtcatgggacttattctctagtttatgcctaggccagatacaaagtagattcctaatgtctcctagcattagtgattgtcctatgaaaataatttttaaaaatgaatagatgaggaagacaaaggctatatattcatagcttgctatagcaagagagtcagccaccatcacttgtgtcttgccggagactcaaatgcagacagaggagtggagaaaaaggaagatttcatgtgtgccttgatttgaggctgctgccatggggaagatgtagccatgctaactggattgggacagcctatgcaatgtgactgatgaggggtgcatatttggtattctccggatcatcctaaattggaagtgaaaacaaaaattagaaagctgacatttattaatcaagtcctgatcatttccagctgatcgttacaaaagttattgtgtagcttcctgaattgttaccaaaaatagcaatctggtttcctgccagtctgacttatggctgggtgacttcctaggctgtttattgtagacaaggggttggtttcctagaagggttactgtgggttcagaatccagagttctatttaacaacaacaacaaaaaatatattatagtgcttaagagcacagactctggactctggaataaaacccactgggttcaaatacagttttttttcacttactgggtaaggaacctgaggtagtttctcaacatctctgtgcatttgcttcctcatctacaaaactcaaatataacctactgtacaggactattataaaggttaaatgagttagtaaacttaatttcttacaagagtgcctagagaaatgcaactgtttgataaatgccaactatcattatgccctactcatttaatgattttacaaatttaatttaactaaacgataaaatgttaagaagcccaggagggacttcataatgactgactggaggcaccactcagcagcctccttcaaaatgaagaactaaaatagtgagtagataattacatttcaaatagtatatctaagagataatgctggaattcagtagagaagtaacaggaggaaacacaggaggtaccaaaggagagggaagcaagccagacagctttgtctggagaggccatatatgacaagcccacagctaacatcatacagaatggaaaaaagctgaacgcctttcccctaagaattgcaacaagataaggatgctcattttcagcactcctatttaacatatactaagccccgcacatgaacctgggaacttaaaataaaaactaaaattaaaaatttttgaaaacccataatactagaagtcctagccagaacagtaaggcaagagaaggagataaaggcatccatattgtaaagaggatgtcaaattggccttctttgcagatgacaggatctcatatttagaaaaccctgaagacttcaccaaaaagcacttagatctgatcaatgagtttggtaaagttgtaggatacaaactcaacagacaaaaattagtagcatttctatacaccaataactaactgaaaaagaaatcaagaggggaatcttacaaacaatagcttcaagaaacataaaatacctaagaataaatttaatcaaggaggcaaaagatctctacaaagaaaactacaaaatactgatgaaagaaattaaagaggacacaaataaacgaaaagacacctcatgctcatggattaaaaaaattaatattgttaaaattaccatactaccaaagcaatccacagcttaaatgcaattcctatcaaaataccaatgacatttttcacaaaaatagaaaaaacaattctaaaatttgtatggaaccaaaagagagcccaaatagccaaagcaatcctaagaggaaaacaaatagtgtaaaagctggaggcatcacattaccagacttcaaaatatattacaaggctatcacaaccaaaaagcatggtattggtataaaaaagcagatgtacagatgaatggaactgactagagaaccagaattaaactcatgtatgtagaaccaattgattttcaataaaggtgccaagaacatacatttggaaaagggcaccctcttcaataaacggtcctgggaaaactgaatatccatattcagaggaatcaaactagacccctgtctctcctcatatacaaaagtcaactcaaatggattaaaaacttaaaggtaacacatagaagaaagcaaaggaaaaacactccaggacataggtctacactaagattttatggccaaaaccccaaaagcacaggcagcaaaaccaaaaatagacaaatgggtcacatctaagtaaaaagcttctgcatagcaaaggaaccaatcaacaaagtgaagagataacttgttgaatgggagaatatatttgcaaactatttatccaacaaagaaataatatccagaatattcaaggaactcaaacaaccctacaaaagaaaatctcattaaaaatgggcagagaatttgaagatgtacaaatggccaacaggtatattaaaaaatgctcaacatcacgaatcatcaaggaaattcaaatcaaaactacagtgagatataatcttcccagcaagaatcgctattatcaaaaagacaaaaataacagatactggcaaaaatgaagagaaaagggaagtcttctacactgttagtgggaatgtaaattagaactgttttccataatggaaaacagtgtggaggtttctcaaaaaactaaaaatagaattaccatacaatccaggaatcccactactgggtatttttccaaaggaaagaaaatcagtatatcagagggatatctatgccctcatttgtattgcagcactattaacaatagctatggaatcaacctaagtgtccattaatggctgaatggttaaatagaatgtggtatatttatacaatggaatactatttggtcataaaaggcaaagaaattctgttctttgcggtaacgcagctgcaactggagctcattatgttgagtaaaataaaccagacacagaaaaagaaatattgcatgtgcttattcatatgtgggagctaaaaaaacattgatattataaaggtagagagtatgatagttaccagagtctggaaagaaattggggaatgcaggggatgaagagaggttgattaaagggtactaacatatagtcagatagaatgaataagttctaatgttcaatagtagaacagggtggctatagttgacaacaatgtatcacatatttcaaaatagctagaaatgaggacttgaagtgctcttaacacattgaaataaatgctcagggtgatggatatcctaaaaatcttgacttgatcattaagtattttttatgcatgtaagaaaatatcacatgtatcccatgactatgaaaaaatattatgcatcaattacaattttttaagttaaaagggttactactcatgttatttagttaaaagtgaaaaagcaatttatcactagagaaatgcttattcttccttagtaaaaatacctacactggactaaaaaatagtggaaataatgcagaaaagcaatgtggcaacaaagtaaaatgtgtttatttatcattaaaaaactttcatgatgaatcaatgaatagaacaagtagaggtatcactccatttgaaaataactattttcatcattgataggcaaggtattacagcaaagaaactgacaccaggagtgcatgaaatgcatgtcactgatgtgattagttttttaaaataaatatgatatttaaaatactagaaactttatgatatcttacaatgagtgaccacatgccacacggaggttcactgggaatcatgtcaatacttaaaacaattgctgaatttaggatgaattatatatttttcttctaataaaagataggttttctaaatttgctaatccattctctgatgataagtagctactcaacaaatatttttaaatgattaaaacctttattttgtcctttgatgtcagtatgatatttaactaagtgaactgtaactactatcaatatgaaattgtgcaacacagataaaatcttgaaacatgtttagtatgtttttctatatcctcatataatactctgggcaaaaattatctgataacatactaaaaactctcatgtttgcttattttttaaaaaatttggaaacacaatgtttccaccttcataaaaatattccacatattttaagagaaatttgaacttgtttttcaaatttaaaaatttttaatttgcttacactttttaattttcttacaaaacaactgattgacatcagagagtatggtgatttactggctaaatatcaggcaagccttttctaaattagtgtctagtatttaaaacaaagtgccataattttgtaaaagtacccaaggttgtacttttattttaaggaatttgtgcgtgtgaggaaaggaagaaaagaggatctaagagaaaacatggagaaagaacagcccgagatgtagcaataaacaagcattaaatcacagaagcctgagaagcaaatatgcttcagagtgtggtcaatggtgccaaatcataaaattaattagttaagataataatttaaaaaaatgctttaggtgtggtaattaggagttgagtagtgatcttagtgagagagtggcgatgagaacctccaactccttcctgtcatgagcccagactctggctactctggttcactctccattcactgaatatgctttgtgctttcaagtttccatgcttttacttctaatcatgccgctccttcaacctgtaattctttgctacacattcttcttgcctattgaaatttaatttatccttcaagaatcatgagaaatgtcattttgtataatgtcttctcttagttctctaagtccttctttgtgttctcatataccttgcttatagttcagtttgtaatacttaactcagcctgagtttctatattatatcattgtataagtgattttatcctctagattgggagctctctaagggcaggattatttcttatttatctattcaggttcctgccctaactcactcctaccacatacccctccttgcgcaatgtcttactccatgacttctctattgtagtcactctataatgttgaagttaatttaattgaaatttctgcaagcaattcaataagcattcaccgacggcctacattttctggaactatgagggatttgcagtgtggaaaaccaaaaagaaaatcaatctaagaataaacaaaacttgcacatgaagaacagctgaatgaacacaggagtgaagtacaattaagagctctttgcatcacacaaacagtcattatcttgcagatcagaaagttgaggatgtcttcataatgagaatcagatctcataaaaattgagtaagatttggatagaagaataaatcaaagagggcatttcatgtgaagagtagattctgagtaaatattctgaggtcaaggttaaactctaacacatcaaggaatagataagttataggcgtgtctctggagatggattcttaaaggtgaatggtagaaaatagccttaagtgatataagccctctgtatggagcccttggagtaccaagataaaggacaaaacttggtttgaagactaatgagaagccaaaaatatttctaatgcataagagcatatctacacactagagaaaagatggggataggagaccaattaacaagtaagttatcttatgatgatggcattgattatggtaatagttttgtgggtgtatacttatgtcccaatttatcaagttgtatacattatatgtgtatagctttttgcacataaatcatacctcaattaagttttttaaagttaccttatgacaaataagtgaaactgaagaacataatgtcagacttacttcagaggatgaatgtacaagatttgaccagattaatttggggagcaaaagaaaggaatacaaccctgggtgatcctgccacatttttgcctcttgtccacaaatacaaatctctcttcaaatctctgtttaacttccacctcaactgatcaatgtaaatctttttctctccatcatagttttcaggtaatcaaggggtgtgtgtgtgtgtgtgtgtgtgtgtgtgtgtgtgtgtctgtgtgtaagagaaagagagagtttccaagtatgtgaaaaatcaagatgaaccttaagctgtttttagtgatagcaattttgatttaacttccgaatctcaaaatgcatccatctttatatgctgtttgatttactggtgctgggggaaccatgctcatcagattagagtctctgcagaaacactctgatgccaatgccgaggaagtccctttagaatagaaaactttaactttgcctgagacttgcataactattgtcactaacctattggtagggagtgtcctagatttttataatttattccctaatgatttaaaaaccaatgtttttattcttaatttccctacaaagaaaaaacatcaggagaccagtcagctactataaaatgtttctcagtgaactcaaaatatgaggacttaattttatttactaatttatttatattatagtatcaaaatgcagaatataaattttctaatatacttcagtatttttattgtttttaaattttagccacttaataattctctttgtctctaaagtgaagccattatagaaagccataaggagacatagtaagtggataagtctgacctattctttgttcaaaagtaccataattttatcagcaaatacacagataaggctgatgatgtccttgtacagtaattctgcgatctataggcaaattaatttttgattaagttcaaaaattatattttacattggtgaagagaaaatgagattttactcattatattctgaaatatgatctatataaaataattattgataataaaatccatttttccacagtccacctgataaatattttcagttgattttccattagatgttactaaaataatgataaagagcagcattttatacttttacaaagtttttttaaaaatataattctgaaagattttttaaaagaggtatagacctaaaatataaaggacattttattgtattcatttgattacaagcctctagtgataaaactccagaaaacctcatcatattatgtgagtcaatagaaaaacaaaagtaagaaacagagaaaacctaaccaaaatgttttcaaagtaattcactggccgggcgaggtgactcatgcctgtaatcccagcattttgggaggccgaggcgggcggatcgcctgaggtcaggagttcgagaccagcctgaccaacatggtgaaaccccgtctctactaaaaatacaaaattagccaggcatggtggctcatgcctgtaatcccagctactcgggaggctgaggcaggagaagtgcttgaaactctgtctcaaaaaaaaaaaaaatgtgctttgaattaactatcgtaggctcttctccaaaattgtctgtttggagtatgctaaggctaaagacttttagaaacttctaaaagaaaagaaagttaattttattattctttaaaactcaaattgtttctgtacctgaaatattttaatgtacagttgccaaactataagaactatataataaatttagttgatcattaaactcaaataaatatatagccagtaaagagtagataatgagtttgtaaatttaaataaatttaaaactcaagtaaataaatggagaacctccatagaactcactgaaaatgaagacattactttctatgagagatgtttgagtgaatacaaaatagatatttaccatgaagaatattcacattatgagtggagattttgccaccaaatcttacaatgttggacatgcatgtaaaactcttaaaactagagacagaaagtattaggataagtgagcaattaagagtaataactccttgggaaatttgtcataccaagattggaatagtatctagaatatgttgaaatgaacataaaaatgatatccaatacaatgattaagaacactcatagatgtttcatattcttatcctctctaaaaggatgagtagatatctcataaaatatgcaattggtgaccttatctggaaagggttactaagctagcaaaagcattcttcaaatcactgtgtttctgtgcagtttttaaaatgtagacatttaaaatgccttaagagtaattcattttaagcgtcacattgatccaataggatacgatttaaaacttgtttactttttcctggaggaaaagataccataagaaaatgtcttaattttggaaatggaaaattatatgtactgaccacagattttacatcggcataggataattcatgcagataaagctttcctgccctaggaattcacacagatattttcagacaagccctgggtacacaatccatgatacattttttctcacttgatttgacccacagtgagtgtgctagtgtttaggagatggcacaggataatttgaagaagactttcttcccttttgtatacagggaaattagagggtgagaattagaaacattctgctttggaatcttacatttctttacaatttatgtctcagaagagaagccaggaatggctagggaaaatcactccttagcagctgaattcatcctcataggatttacaaattatccagagctgaagacgcttctgtttgtggtgttctctgccatctatctggtcaccatggtggggaatcttggtctggtggcattaatttatgtagagcgtcgtcttctcacaccaatgtacatctttctgggcaacctggctctgatggattcctgctgttcctgtgctgttacccccaagatgttagagaatttcttttctgaggatagaattatttccctgtatgaatgtatggcacaattttattttctctgtcttgctgaaaccacagactgctttcttctggcgacaatggcctatgaccgctatgtggccatatgccacccactgcagtaccacaccatgatgtccaagacgctctgcattcggatgaccacaggggccttcaaagctggaaacctgcattccatgattcatgtagggcttttattaaggttaactttctgcaggtctaataaaattcaccactttttctgtgatattcttccactgtatagactctcctgtacagatccttctattaatgaactaatgatatatatcttttcaataccaattcaaatctttaccattgctactgtcttgatctcttatctctgcatccttttgactgttttcaaaatgaaatccaaggagggaagaggtaaagcattttctacctgtgcatcccactttctctctgtctcaatattttacatttgtcttctcatgtatattggaccatctgaagaaggagataaagatacaccagtggcaatattttatgcaatagtaatcccattactaaacccttttatttatagtctgagaaataaggaggtcataaatgttcttaaaaaaattatgaggaattataacattcttaaacaaacttgctctatagcaaatttatttttaatttattaaaatgctttcataaagagggaacatagaaaaattaatatgtgattttacacaaaatgtaagcttataaatcattaggctatgtttgtttaaaaaatatatcaatggaatttcaaaattgtttcacaaatctttatccaaatcccacaaccagaatgaatcggggaaactcactggtaactgttattactacctttcatgactctcatggaattgtcagagagtattatcctaaacctcaattaatcaacatagcatgaaagttaaatgtttaaatgtgtagaagagtcttctttgattaatgtttcctagttaatggaagacattatatccaatcctatgtagcgtgtttgaaacatttaaaatttcctggcagaaaagtgaaatgatagttttctttcagaaaactgacctgagagacacatgtggattactttagagtggaaaagactagaagcaaactaattgcagtaatttatatttaaggtaatgaagttttatttagataagattgcaagaatgaaaaaaaatgaaaaggaacacacacacacatacacagacatatacagacacagacacacacatacacacatgcaaagaggctcacctacaaaatattctattttgcagaataattaattgtgacttataacaaattggacagagtagattaaggtctactttagccagaagcataattaagttccttttcattcttgaaggcatcaaccatgttattggctatgtattatatataactacagtttacatattaacactcattaaacattttaaaacatattaataatgacattgttttatttttgagtaatggtaagctgtaccaatattttatgtgtttattgaccatttttacttttatgaattgtcatttttgttttgtctgttttatttcttatttatatcattgtttacagagaaaagacatcacaactatttgtggcaaataattcttctgtgggttgatagtcttagtatttgtttctgatatttataaatattttaatttaatatactcatatttacttattttttctatgatctctttcatgcatttcatccagaatttcttttttaatccagtctactattaaccaatatttctttttctccttttcttatttctcttcttctccttctccctattttcctcctccttccttttttgatattttaaatttttgcaacttgactcttgattcttcctggaatttatttagtatatggcatattaaagatataactttatttggctgtttctctaaaaaatatttataaactaatttaattcaaataaacactcaggagaacttctttgggaacctggcaaaatgaatttaaaattttttcatattctagatttttctagaaaataaaaaaaataccttatgtgttatatattaaaatatatgataaaattccaataatgataacagtttggttttaaatcaagaatcaataaacaaaccaacagaacaaatcagattgttcaaaagtaaactctcatataaaataagaagggcatcacaaataacaaggaaataaaggattgttcagtagccgtgggacaactgggtaactatctcttccattcatgttaaaatgtatatcttcctgtcatttagatatatatttgtagacaaaatttgtatttccttcatttttcatagtttgatttttaatatacagcaaccaactggaatttattttataatgttataaagtgagaattaaaatttgatttatggctaaccagtagtcccagaagcatttattgacaaactcttctctaactgatttcttatgtctcctttttgtacatttatgctcatacattcacatgtacatgcatacacagagaggtctatttctagcccgtttgtacaacaaaaacaagacggttctagttcgtacacttctgtctcaggagggaagatggacattttaaaaggcaatcaaactaaaaagctataagttataattgaggaagactcttatgcttctacctaaagtctattgttagggttctataacatttatatataaaatatctattcactctattctttctttctatgtgacctcatctatttttttttttttggcctttaatttcatcaatatgaagatggctcagaatgtatatttccacctctgatatcctccctgctctccagtctcacatgtgcaactgcctacttcacataattacttaaatgttgcaaagacatctcaaattcaacatgatcaaagcacaagtcttgaatttcccactaaacatggtcctcccctggtcttctccattatgatggtcacatcctccaaccagctgggcaaggcagaaattaagagaaccccacacaactctgtctcctatcacaaccaaactttcatgatatctgtcaacttagtctctgaagtctatcttaaatgtgccaaatctctccacttacaccacatgtacataatttcatctctcacctgaacaatatcattagcttcaaactcgtctctgtgcttttgctcctttttattttttaatgtatatttacaatacgatttaaaaatagtactaaaaggtgaattccaaaaactacagtctcttgcctaccatgacttaggtatttcatccacaacaaccttctaattttttaaacgatttctctgaaaatttatccttatatttctcagtatcagttttaatcatattaatcaatttcccattacagtaaatgaatattaagttatttattaaacacctccccttcccttcattcttgatgatataacataattttttttttttgagatggaatgtcactctgttggccaggctggagtgcaatggcatgatatcggctcattgcaacctctgcctcccaggttcaagcaattatcctgcctcagtctcccaagtacccaggactgcaggcacataccactgtgcccagctaattttttatatttgtttctagagacgggggtttcaccatgttgaccaggctggtcttgaactcctgacctcgtgatctgcctgcctcagcctcccaaagtgctgggattacaggcatgagccactgtgcccggcccaacaaaattttttataattcaataacgactttttatgagggacatgcaaatacaagaactagtttaccatgcttatatttctttttctttacacctgtaaatttttttaaagttaataaaaacttcatattcctatttgctcattcacatccattatgtatccatcaaattaatcaaccatattaaataatcatgagttctttttttaccctggagacttcttttctggtggcctccaccctcctgctccagtctggacaatttgctctctagacccaatattcagccgtcctgctgagacttttatttttgatttcctgttttaagtaactcagtattcaagctctccatctttctcttaattgttcattccctctttttgctgactgctctttggcaatttttttccacatgattaataatttgatttctttaaaattctaggttataaataatttttcttctgaacgctgaagttatgcttcctttatactctagcatgatctgctgctttggagaaattgcacgttattctgattcccattctattgtttacctggaaacatttagaatattttctttatctctgactttgtgaagtatcggaatgaaaaaatttagcaatgttgtcatcactttttctagatagtagtggagtcttgtttcactcgttcttcccgcttagctgtcttttcttttcctttcctttgccttgtcttttctccctcttttctttcctccctgcttccctccctttttttctctctaaaaattcaaagttttacttccttaattaaggcaatcctgaatgtacaagacagataaaatttacatagaaagaggagaataaataaattaccagttttcagaatcataaatgttttcttaatgactgtgaaaacattaacaatttaaaagttgccgttatgaactcagcttttgttttctggaaaagtcttcatttctccctcatgtttgaaggatatttttactggacacactattccagggtaaaactttttttccttcagcacttcaaatatgtcattctactctctcctggtcctaaggtttcctctggaaagtctgttgccacacctattgtatctcctttgtatgttatttgtttctttttgcttgctgcttttaagaatcttttttttaatccttgacctttgggaatttgattattcagtgctttgaggtagtcttctttggtttaaatctgcttagtgttctataaccttcttgtaattagatattgatatatttccctaggtttgagatgttctctgttatccttttgaataaactatctaccccatctctttctgtattcctttttaagtcaataactcttagatttgcccttttgaagttgttttccagatcctgttgttgtacttcattatttttattaattttttttacttttctctcctgactgtacatttttaaatggcctgtcttcaagctcactaattctttcttctgcttgatcaattctgctattaaaggactctaatgcattttttagtatgccaattgcatttttcagcttcagaatttctgctttttaaaaactgtttgaatctgtttgttaaatttttctgatagaattctgaattccctctctgcattatcttgaatttctttgcatttcctcaacacagctactttgaattctctgtctgaaaggtcacatatctctgtttctccaggattggttcctggtgccttattttgttcatttggtggggtcatgattttccagatggtgtttatgctactagatgtttgtcagtgtctgggcattgaagaattaggtatattgtagtctttgcaagtctgggcttgttggtactagtactccttgaaaaggctttacagatatctacgaggacatggatgttttgatataagttttatctgctttggaggacacccgaagcccactaatgctgtggttcttgcagacttgtagagttatcaccttgattgtcttggacaatatccagaagagttctctgaattaccagacagagactcttgttctcttcccttgctttcctcaaacagatggagtctctctccctctcagttctgaatttgaagttggggatagggtgacacaagaacccctgtggccaccaccactaggactgtgctgagtcagacctaaagccagcacagccctgagtctcacccaaggcctgatgtaacaaccccctggctaccacttttgtttgctcaaggtcctggggctctacaatcaacagatggcagcacaagccaggcctgtgtctttcccttctgggtgatgagttcccctaggctcttagagagttttagaggtgctggccctgggagggttgagaggtgctgttcaaaaggcagggactggagtcaacaactttagaagtctacctggtattctattgttctgatgctaaactgaaactcaaatcacaagatacagttcttctcactcttctctcccctttttaaaggcagaggagcctcactctgtggctaccaccaccataggcccatggggaatactgccagactactgttgatattctcttaaggcccaagggctttgaagtcaccttgtggtaaatgctgcttggcctgggactcacccttctggtcagtgggttcctctctggcccagggcaggtccagaaatgccattcaagaaccacgttctagaatcagggactccaagagcccacttcatgctttacccacctgtggccaagctggcacttaagctgcaagacaaatccccttacttttctctcagctttcctcaagcggaaaaaaatcttgccccatagctgccacagctggaaatgtgttgagtctcacctgaagtctgcaagtctcacagtctcacccaaggcctttgatgtgtacctgtgtatcgctgctggcatttagggcccaaatgcgcttcagcttgttgatgatgaatgctgcccaggctggcagcattcctttaaaatccttcctttaaaggtagtggattcccttttggcccaggatgtgtctaggaatgtcatccaggaaccaggccctggaaaaagggcctcacatctctgaccagtacactaacttatgtggctgggttggtatttaagatgtaagacaaagtcccccttactcttccctctcctctcctcaagtggaagaaaggaatctcttttagagccatgagctgtgcagcctggggttactggaagggtgatgatgccagcactcccttatccatcctgactggtgtctgagtaggttgtgtgacccccgcattccactgcctctgagccaagttcagcactaggacttgcctccaagtttcagtgcctgtggcctagacatcctttcaaatttattaggtccccatagcactttagcctgtggtggcaaggcttgtgagaactcaaggtctgaccactgggatccacgactctcctctggctagtgctcgtttaaatgctctctctgagggcaggcatcagctgagttggtctggttttgctttctgttataacaggtcatcactgagttcaatgcctcacaatagtttcactcttcttctccccaagacacaacaatgttctctgtaccaagccactgccttgagaggagtgtgtgtggaggaggggtggcattggcacttgaagagtgttttttctatctcatcagtgcctctttcagtggcatgaagttaaaaccaggtactgtgtgtactcacctgattttttgttctaatgaaggtgcttttttgttagatagttgttaaatttgtgtccttgggaaaggatgatgatcaaggaagcctcttattccaccatcttgcttctaagtacttaatttgaggttacaaatggattcagagttcaattacttaccctaggaaatagttgtcacattgcaagtagttataattttcaacaaatactagaatggaagtcagcatatataagttacttccattcaaaatttgtgaaaaatttctggaatcctgagcataaccttgcaaaatcagtcatattctaagtttgaaactattaatcccttttaaatcaacactatctgtgagaagtaaatcgcatgtttgaatattattctcaacttcctttgaattcattcaaaagattatattgaatatggattcacatgggatttttatgttctaatgaagaaaatttttatatttactgatggaaattttaattttaaatttaaatgttttaattaaaattttaaaaactttctctcaagttctcagaaatagagtatctgtatgatggtgatttttctatctctggttgaaaataagtctatttttactgaaatgcctatggatttaaatttttcatgtagtttgcttaattgctcatcatatatgacagcgccatttctgactgtattgattaaatcaagttgcttttcaccctagtattatttcttgtcttatttgttagaaattccaccaatctgcagtgatttcaatgaatgttgttgatgtgttcatagcattcacagaaagtgatgctcatcatgcataagtgaggcagaaagtagtgaaaattcctaatagctaaacaaagctattaggtgaaggggtggcctgcccctccacacctgtgggtatttctagtcaggtgggacgagagactgagaaaagaaataagacacagagacaaagtatagagaaacaacagtgggaccaggaggaccggcactcagcataccaaggacctgcaccgacaccggcctctgagtcccctcagtttttattgattattattctcattatttcagcaaaaaggaatgtagtaggacagcagggtgataataaggagaagatcagcaaaaaacatgtgagcaaaagaacctatgtcataattaagttcaagggaaggtactatgcctggatgtgcacgtaggccagatttatgtttctctccacccaaacatctcagcggagtaaagaataacaaggcagcattgctgcaaacatgtctcgcctcccaccatagggtggtttttctcctatctcagaattgaacaaatgtacaaccggattttataccgagacattcagttccgaggggcaggcaggagatggtggccttcctctatctcaactgcaagaggctttcctcttttactaatccacctcagcgcagacactttacgggtattgggctgggggacggtcaggtctttctcatcccacgaggccatatttcagactatcacatggggagaaatcttggacaataccctgctttcaagggcagaggtccctgcgactttccgcagtgcattgtacccctggtttattgagactagagaatggtgatgacctttaccaagtatactgcttataaacattttgttaacaaggcacagtcctagatcccttaaaccttgatttcatataacacatgtttttgtgagctccaggttgggtcaaagtggctggggcaaagctacaaattaacaacatctcagcaaagcaattgtttaaagtacaggtctttttcaaaatggagtctcttatgtctttcctttctatatagacacagtaacagtctgatctccctttctttccctacgaaaattcctaatagctaaacaaaaatatcttttcatcacttaaaagtaaaaacatgaaagaaaactaatttatacacctatccacctatctgctatgcactactagactttttatatatataaactaccgattaggccttaattcttacacatttcctcagtagaaatctcgtatcttgaaatcctgaatgtcttgcccaaattcattcagctcatctggatagagatagactttgaatcaatattgccttttctttacatcctttggagtttagaaaaaggataacttttgtttcattaatcttttctgttattttattatcaaattcatttattttgctccaatcttatttcttttcttctaataatttttggtttcattttctgttgcttttctagatctttaagatgcatcattaagttgtttatgggaaactttctacttttttgatacagccacgtattgctataaactttcctcttacaccacttttgctatatcccatgggttttgatacattgtttctatttttatttattttgagaaatttctaaattttccttttaatttcttcattcatttaatgttgtttaggaccacattgtttaattttcatttgttcgtagagtttccgaagttcctcttgttattgattttttgtcttattccattgtggtcagaatatatacttaatataacttctttaaaaaaactgagacttgttttttggcctaacatgtggtctaagcttgagaatattccatgtgctgaggagaagaacatgtattctacaagctgttagataaaatattctgtaaatgtctattaggtccatttgatctatagtgcagttaaatctgatatttctttgctaattttatgtttagatggtgtgtccaattctgggataggatgttgaggtaccaggtattattatatctgtctttagcttgagtaatatcttctttatttcttctaatgctccagcattgggtgcatatatatttgcaatttttatatcttcttgttgaattaacccttttctcattaaataatagccttctttgtctctatttatagtttttatcttcaaatgtattttatctgtattttctgatagaaatatagctactcctgctttattaggttcttatttcataaaatgtctttttccatttcttaaattttagtctatgtgtgtctttataggtgcagtgaatttcttgtaggcagcatatggttgggccttgggtttta

SEQ ID NO: 301 - DNA, 39208 bp, Homo sapiens
tcagctctagagaggagagcttctgcctccacctgggagatgtatcctgctgtgtgggggtgagtccttgtctgccatgcagacccagcatctgccacttacacctcagtttccagccttcaaactcattctccaggttggaagacgaggtacctgggttctggggcacactaccgggattgtctgaggggctcggggcaagagctaacctctctgaggccagcggcccctctaaaagatgaagacagtccctacttcagggctgctataaggattgatggcgttggtcaagtgcttggcctggttccaggtttacacatatgctctgggatatatctccccacccagccctaactagaggagccctgaagcccgcttcctgacatgatggtcttcacttagaggaactctactaaaacccaccttccagaaggctgggggttctcctgccttgtgtgggaggcctggcttggagcatctggtggccagggatggtgaggctggtgtccccttgctccccagaggtaaagcacctgtgccttgcctgacctcttcctccctccctgatgatgggcgtccccttgcaggcgctccatgaaatacacgctgtgcagtgacaaccatggcatcaagcccccgaccccggagcagtacctgacccccctgcagcagaaggaggtgtgcatccggcacctgaaagcccggctgaaggacacacaggaccggctccaggaccggtgagcgggtggccacgagcagccctgggggtaccccaccagctccacactcagggaaaccagggctctggggtgcctcttggagggaggagtggctgggggtctcccagcatccgtctgctctctccttcccagcaaagcctcatttgagcccacttgcagaccctcatccccagcagctactcaccttgactgctccacgaggctgttgggggccaggcgggagcagtttcccatgagggcctgtcctgtggggcctcctgcctgtgctgtcctttcccagcttcagcctggcagctcctttggctgcttcttttcctctggctcccatcttccaggagttggagcacagggcttctttctgacttacttgcctcttttgggggagaaacaactctttatccttcctcgcttcctcctgagtgagtcaccagagggcttgtggccaacctcgacttcaggccccagaagccatctacttcctgctgtggaggatgatgatgagaagccttttgctgagctcctccccagcccaggtgtctcccaggagcccccgcaggccgtctgagctcattctcaagtgcttaatcccaaccctcccagcttctaccctccaagcccagtggcttcatctttgtgatctacacttcagggcgtcgatctcccattgtcttaactatccttctcgggactgtgtctatgcaaacatgcagcctattgtgagctggccaaggtgctgtgtggggctggagctcagagcaggcacgatgatcgctccttttttcttttctttcttttttttttttaatacagcagctttattgcaatgtaacttacataccatataattcacctatcaaaagtgtacaattagatgattgttagtttagtcacagaattttgcaaccattaccactatctaatttcataaatatttctatcacctcaaaataaaccccattcccattagcaatcaccgccaatttctaatttcatcaatatttctatcacctcaaaataaaccccattcccattagcaatcaccgccaatttctaatttcatcaatatttctatcacctcaaaataaaccccattcccattagcaatcaccgccaatttctaatttcatcaatatttctatcacctcaaaataaaccccattcccattagcaatcaccgccaatttctaatttcatcaatatttctatcacctcaaaataaaccccattcccattagcaatcaccgccaatttctaatttcatcaatatttctatcacctcaaaataaaccccattcccattagcaatcaccgccaatttctaatttcatcaatatttctatcacctcaaaataaaccccattcccattagcaatcaccgccaatttctaatttcatcaatatttctatcacctcaaaataaaccccattcccattagcaatcaccgccagtttctaatttcatcaatatttctatcacctcaaaataaaccccattcccattagcaatcaccgccagtttctaatttcatcaatatttctatcacctcaaaataaaccccattcccattagcaatcaccgccaatttctaatttcatcaatatttctatcacctcaaaataaaccccattcccattagcaatcaccgccagtttctaatttcatcaatatttctatcacctcaaaataaaccccattcccattagcaatcaccgccaatttctaatttcatcaatatttctatcacctcaaaataaaccccattcccattagcaatcaccgccaatttctaatttcatcaatatttctatcacctcaaaataaaccccattcccattagcaatcaccgccaatttctaatttcatcaatatttctatcacctcaaaataaaccccattcccattagcaatcaccgccagtttctctccaaccaccatagtccctggcaaccactgatttttctgtctctatggatttgtctattctggacatttcatataaatgggatcacgctgtatgcatgaccacatcgttcttgaccacagctctgccaagcagccaatccggtttggatttgttgtggttttaaactacaggcggttacgggtagcattcagcgagcttcattgtcggcagagggaggatttctatttttattttccctcatcttcccaatgatgcccaggatctgcgtggccttttgcactaatgcctcagggagcagatggcccatctcccagcttcatttctagggccagccccatggcttagagcagaccatctgccctgtgtggtttgggcaggatgccctggtgtaggtgtgctaacaccttgactccctggtcactgtctgcctgttactcccacaggaacccattgcaggtctttacatgaaatactgtcactctccccacactctctccatatggagtttcatgcctgtgcttcctgcagtggcccaccttctgttcctcaaagacaccatggcttttgcacctctgtgctttcgtatctgtgtccccactacttgagatgccctgccttctatcttgctccctgggcagacttacccttcaagacgcacttcagatgtgatgcccactgaggcgtggacagggctcgaagccatggctccctggggtttggctgggccccaaggagagagaggcagagactggctgagcagatcatgcccagttccttctttcaaactcactctttctcccagggtgaggtgtgagtgaggagcagggtgagaggccaaaagggttacctagagtgggccccccacctggaggcaggaagggtgaaggccaagtatctcctgcccctcagtacctgttgccttgtctgttattggcactctaagcagctccagctgtgtcctgatgggtggatgggccccttctaggtgacaccattgctgacctttatggccactgcatcccctcagcccccagtccctccagcgtattgtggaatgagattcctgggcccatttcctgaaggaaaattctgatctggctttgaaaagtatatggtgcttgatctgggacggtcattctgctgggctgatgaaccccagagtgacaggcacggcatttgtagattttacggatgggaatgtagggtttaggctgagggggctcatgtgggctgccactaggaagtgagcgaaaatgcccaggacagggtttgacgtctcctggatgattttccttcttcctcactggtgttaatcagtcgccattctgtctcactctggttttacctctagacctgatggcatatttttctaacttacctccctccccttgcacccctggattcatctgtgactcgggaatttgaaaagcctgagcatttctggacaagagtctgccgactatcttgttcacctggtgcttgcccccgtcgctcaggagtaactctatgcctttctcgttgatcttttcagcttttcctctttaagatacaagatacaaggagatacaaagatacaaagaagcttctagcatggatagatgagagccaccctgttcttatcactctcccgttccacccaccacttctcatcgctctgcatgagggatgatgtaaaatcatcagcctcccccaacattgaaagctgtcatttctctcccctggggtctctggccaaatattcctccactgaaactttctgcaacctgctttagtaggtagtaggaggctacatcactttctatagagcagagatttcctgcctagtttttgttgtttcacattaagattttattaggtttttatagcagtagctataaaacttatgagcatctttgttgtctagtctcttctctagatgatggatttgaatgttgagagttgtcggcattctgggggtggtggggtgggggagggaatgcgagtggtgtctcctcccaacctttcttctctctccaggcagaggcttctcctgtcttcacccctcagcccctctccccagccactctcactccccactataataagaaggcattgagtttgtccttctgttttgggttctgagccacagcagcacagggcccttcatccttggcaacagtgtcctctccctgcctctccttggcggtgacagaccaggcaggcaggcagtgagcgtgtgtgtgtctcctcggctcgcagggacacagagattgatgacctgaagacgcagctgtcacgcatgcaggaggactggattgaggaggagtgccaccgcgtggaggcccagctggccctgaaggaggcccgaaaggagatcaagcagctcaagcaggtcatcgacactgtcaagaacaacctgattgacaaggacaaggggctgcagaagtacttcgtggacatcaacatccagaacaagaagctggagacgctgctgcacagcatggaggtggcccagaatggcatggccaaggaggatggcactggggagtcagccggtgggtcccctgcccgctccctcacccgcagctccacctacaccaagctgagtgacccggctgtctgtggtgaccgccagccgggtgatccctccagcggctctgctgaggatggggcagacagtggctttgcagcagccgatgacacactgagccggacggacgcgctggaagccagcagcctgctgtcgtcgggggtggactgtggcaccgaggagacctcgctgcacagctccttcggcctgggcccccgcttccctgccagcaacacctatgagaagctgctgtgtggcatggaggctggtgtgcaggccagctgcatgcaggagcgtgccatccagacagacttcgtgcagtaccagcctgaccttgacaccatcctggagaaagtgacccaggcccaggtctgtgggacagaccctgagtcaggggacaggtgcccagagctggatgcccacccttcagggcccagagaccccaactcagcagtggtggtgacagtgggtgatgagctagaggccccagagcccatcacccgtggacccaccccacagcggcctggtgccaaccccaaccctggccagtcggtgagcgtggtgtgccccatggaagaggaggaggaggctgccgtggctgagaaggagcccaagagctactggagccgccactacatcgtggatctgctggctgtggtggtgccggccgtgcccacggtggcctggctttgccgctcccagcggcgccagggccagcccatctacaacatcagctccctgctgcggggctgctgcactgtggccttgcactccatccgcaggatcagctgccgctcgctgagccagccgagtcccagcccagcgggcggcggctcccagctctgagggggcccattctggcagcggcgcctgcggcctgaccactgattgtagggatgccgttcccccctcccttctcccatgggcatcatcttatttatttagttttgggtgtggaactgtttctttttttcaagatgttaaaacagtcccgtggaaggagcaggggttggagaaaggcatcccaaagcttcgatggagagcagggaagggggacccaaggcaggaggtacaccagctggacaaattgcagggaggggagggagcgagggccaacccggcccctctgtccccttggctcttcagacagggccagccctgctcaggaagtctctggctgtcttcatgtggggaagccgggcttgagttgcccataggcccctgccctgcaccatcctgtccagtgccctgcgcactccatgccgtctcttccaagccaccttgcccgcagcccaggctcctgggccagtgctctctcctcaaatggaggcagccatggcctgaagtgcagatcactgacccagggctcagagcagaggccagaaccactgggccggccggcattccagcctccccagactgctgcccaccttgggactcaggagctcagtcaaggccacaggctggaggagagacggggctgggcgcaaggtggcggagggcagtgtgggttctgtgtctgtctgttcatcccaggctttcccgtcatccctttcctcttggcacttctgggtgtgtcagtcattattcctgtgaggtagctaagcccggcaagctcagtgctggggtaggagggcctgcctgagtcccagctcccagctggagaatccaccagcacaagaagaggaggcaggggcagaaacccaagggggctcccccagccttccaaggtgaggccatctcatctgcaggctgggaggcagggctggactcaggaacccacagcttactgaaaaagccagaggccatgactgcccccagaaacttgccccgagtttctctggggccctcgggcccaacttctgctttgcactatgttcactttggggttggttctcagccatccaagggtctccagtgaggtggctgcttgctgtctgagatgagggttcctaaaccttaaacctctctgcctctggaggagggtggggtattctggcaggatgaatcgcaggatggcgcgtactgaagccacgatgttcatccaggccaaagcagggtgtcctgggataggtttcctaggcaggggcgtggcagagcaggtaggcgccctgcagcctccctgctcccagcccaaggccagtcggcctgggaagttcactgccccaactcttttcccgggaccatactgagtcccccagccacgctgctgacattaccattattattttaccaagtaaactcactccttttcccccacaggggttacacccatctggttgtcccacccactcttcagaggctaggccccacctctgggggttggagggaccctgtgtcttactcgcccctctggcctaagggccactctggttatctgccaaggttgcttgccctcaccccaatgctccaacagccattgcctaactcatgggctctgcccttctgctcggtgccctccacgtgaggcggggcacctgcatgcactgggagggggcggctggcccagccctcggggcaggagccccctctgccacacgctttgtgcctccaaagctccccccgccttggtcagggcctcagaccagccaacctttgtggaataagccccagcccagccaaaccaaacccagatgcctgaggcctggctggggctgcccccgcaggacactgtggccatgccacggagggggcagtggacaaaaccaatccaaagccaagccgggactggctgcggacccagcctcctgtgccgcgcactcacggagctgcgtagtctcctcagacatagtcaaagctttgccgagaaaagaaatgtatgaactatatttgacaacataaaatctctctatttttcaccactggaatttagtcaagcttcaggcccctctgctcctgtctgtgtcttgcgtctgtggccttcctattgtgtcttgtgttttggtggatgtgacagggctggggccacagtctactctgtctctgctgctagagaagccacctgtggaggactgggctgtggttgggcctgaggcctgtggaggaggtgagtgtagccagcagcggccgtctactcctgttctggcctgagaccaccggtgtgggtcacgagggccctggcccacagtgttgagggtcctctctttcgggggctctcctggggccttcgatgggcttttcttcttgtcagtggagggagcagctccccactcagccctgggacaggccctgggactgtggtggccggtggccctggcccagctctggagtgcatgtgtgtgtgctcagatcccgcatctatgcaaaggtgcaggctgcctgtgaggctccaggcggtggaggtgcggcagctgctgctcaggtgccatgccctgaagaggcagggtacacatggggctgggagggcaaagatggggcggggcctccccctgagagagctcaccctccacagtgacccttttccttcctgcctaatacctcctcccgttgggctgtgacttttcctcctgccctcagcctctgaaacagaaatctttggggcctcccctttccccagcgtctggcaagagctgatgaggtcctgaggaacagtgtccccaggaaccaccttctggagcctagcggccagacgtggcttctcctgagttctagggctcgggccagagtggcactactgcccggccagtccaggctcaggcaggaatcggacgctggggcccgggctctgcacagagagctgggcttgagtggagtttattgtagatttctcccaaggggatcacttagcttctcactgacacacccttcccaattgccacaagcgcaggggtatcttacagcactttggggaggggtgggacaaactgcaaggttctggggccaaggcctacccaggggcctctgcccagagaactcacaaccccctctctgacctgggggacaatgcaaacaggtcacagtgcattcccatattaggccatccccttcacgaagaattcaggggatgtgggaagtggggaggcggggagggatcttgactcttgtctcctttgtccttttgttcagacagagttgtacctgcagcagacaactctgaattaaagcatgaaaacacagcaagccccttggcctgttttctttatactgggtggtttctctaaggggaggcagtgggagggttcacaccatcttcctccagcgcaggggtcacaacacccgcacgggaaaaagccacgtgggcagcgatcatctctgatgtgcagggaagcagagagctgtgtggggctgaggcaccactgccctcttggggtcaggctcagagtctggagccacctccccctgcccccacatggcacaccctgctgggcgccatgagcacatcgcgtctcaccttccccaacaccccctaaagtggcttctcatgcccactttgcagaagcagaagcagccacggtcacacggggggtgccccaaagccagtgctccctttgtcagccccactgccccacagtcctaccccatccccacagttccatcctgtccccagttccagtcatccccgcgccaggctggcaggtggcacgtgacagaggcagagccaaatcatggctctcagaggccacgcgtagaaaaggccctggtctcaccacggtttaagaggaaaccagccctggcacgtcaggggaccaaggattccagaattttcagttacctttttattttattttcaatagttttgggggaatcaattacctttgcggacagggttttgtttaaaatcaaatctttattcaaaagatagtcaaggctgacaacttatgcagtctgtgacaaagagcaagtcaaggcaaggaaaaagctctcacaaagaacgtagctctgttctcttaaaatgtgtaactgttttcctggtagagcaaaatttcttgaaaggggcccagttgcgactttaagcagcgtttaaacagcctgcctccgtgtccagcatttaaatcagcacaagagaatcggctgcctgtgggccctgcctgagcctcagcctagcttggagtctgaggctccaaggaggcctgtgtgtataagccatcccatggtcaccctcctggacacgcccccctcatggcagcccccaccttaagcagcaggccggctgcaacccatcatccgagggtggttgccctttgctgcaggagggcgggaagccccccctgcctgccctgccctgcagtggcttcaggcatctgggatggagtggtccatggtgtggtggagcaggactggaggcaacctggatacagcaacaacagtgaccaggttggcagctccttctctccaccctccagcaacctccacccccttccgagccagtgcatcccatgtgggccttcactcccagttctaagactttcgaatcaccagaagccacaagctaccttggagggaggggaagggaggatagagctggctgagcctgtgccctgtgtcagcactgagaaagtggaagtggctgagccaggtgcacctgggaggccgggaggtgaaggggatggcagaggaggggtgaggaggggtgaggaggggtgcagccttactttttgaccatgtgctcgtagatcacactggggatgatggtcagggtgacaacgttcccagccgtggccagaatctccatgatctttttgtcctagggaggaggcaagtaagcgatcaccctaaggattggggaccaggggcaactctacaggcccctctgtggagggatcagcatggccactgctagaggacaccactgatggctgactgcagggcagggctgcctcggaccccgagcctgtcagatgagggtcccagcagactcccaggtaaggtcttgcttgagtgagaacatgggtctcccacctgaggatctccttggtcaaatgagcatgcctcttcccaccctcagcttgaaggccagcggtgtgagcctgacgcgtaacagggcctcatcaatgcgattctcctcccccttccaagggctcccagagactcaccaagcccacagtcacatttgggttctggcctcaaagcataaatgcctccccatcctgtgggaggtactaggcgtacccatccaccctctggctcctgctgcctccagggccataaggatcctcctcctcttacatcctcttacatttgcttgtttgataaaaagagatgggcctgcagacaccacttagatcatgggaagaacaagaaattaaaagtctctacgcaaagcgtgccaggtggtccaaacactaacgttatggccatagaagagcctctggccctcactcagagcctattgacctttacattacacatgtatgttatctggttatgtgttttcttggttgttcgaaaataaatgtgagaagatgtgctagacaggactagtgatggccacaggtggaaataaactttgaaaagacaaacgatctcaagaagtgtggctggctgggacaaacccagttctgaagaacctcacgaccccatggatttctgaataacgattttctaaaacattcctaaactactgaacatgatccactataccaaaaaaagtgccatacagagcaaggaggtgtccatgcagccagcaatagctattatgtattaagcacctgctatgtgcctggcactgtgctcagagctctaggtacactgtcttttttttttttttttggagacagggtctctctctgttgcccaggctggagtgcagtggcatgatcatagctcactgcatccttgacctcccaggctcaattagtcctcccacctcagcctcctgagtagctaggactacaggtgtgcaccaccacgcttggctaattttttagttttttttgtggaaagagggtttcacattgcccaggctggtctcgtgctcctggacttagtgatcctcctgctttggcctctcaaagcactgggattacagacgtgagtcaccgcacccagccctacgaacaccgtcttactgaaccctcacagcaaccttaggaagaggatgctgaggctcaggtggggtaagcaagctgcccaaagacctgagccctcccaccacccggcagtccctccctggtgcggccaccagcctaccttcagcccgataacattctgcccgtccacctcacacacgtagtggttggtgaggagcccgttgcgggccgcagaactccctttgaccagagagacaatcttccccttcttgatcacgaagccgacgtggcccatgctgtccttgtgcatggtgacagtccgctggaacggcctggcaggagggacagtgagctgtcctggggacatggctggggtgagacggagaggctgcccgggcctggctactcacctgtcccgaaccaccacgacaatcttatcgcctgatgccttcttcaccacctgatgggctttgtgcgagctccacccagcacagtcacgcccgtcaatctgcaggagctggtccccaaagcgcagccccacaagggatgcaggggtgttggcctggaccaactgcacaaagagcccctgggggaggcagggccccagagtcagtgtccctggcccaccctaggcacagatccctcttccaacctgttgttttcctcctgatactccaggaacctacagggtgccagggacacagctctgcatggcaggcaccaaggttaccccatttaccggggaggaaacactctaggcctcatagttaggaagcaggtgagtcaggatttcaaccctggcctggggctgcactccgaaacactccactgtaccattcacaaaggcatgggcttccctggcgtcggctgtctacaccgtcgcctggaagctagatgccctgggcagcgaagggcaggtggggaagggaggctcctccgagcgacggaagcccacggagaggccagtggagggccctgcgcaacccagcaccagccccgcccgggtctcggggaggagggactgggggcaagagcctggccgctggggttaggaggcccgctctgcaccttccttactgtggacgggccctctgagctctgaggcctggcgggagagcgcgtgcagctcgagctcctcttcccacccagcccccgcgccctacctggtcgaccttccgcagcctcagcccggtcttgccgcgctcgtccttgcacaggtggatctcgcgcaccccgggcttgatctcagctcgccgcacgcccaggctgtacccggttaccggtgccaccatctggccgggcccggggcccgagaccgctgtctgcagacaccagggggcagggggtcagcccggcccgtggggaccctgtgcctcaggagacactggggtgggggtagggatggggaaaggaggatggagccgtccccgggtccccccacgtccccagtccacgcttctcccctaggggcgagaggagacgtggctccacgcggccactagggggcgtcaaagtccatgcccttaaaaagccaggaaaacggggagggaaggggcgaggatacaggaagaggcccttcatttcccaagggaaactggcatcaggaaaagcctcctttaaaacccacttaaaatagaaaaagtcacagtaaatagtgagcaacaggggataaaaggactggatttttgtcttgagaaaaatgtaaaaatatacaaattcatgatgcagaaaaaggcaaggaacttcactctcccaacactattaaagatggtactggaagacctagccagcacagtaggcaagaaaagagggggagtcacacagatcagaagagaagaaataaaacggttcctatttatagatggcacgatggtctactagaaaatcccaaagaatctacaaataaactcctagaccaaataaaagagtttagcaaggtcctgggatacaaaattaacacacaagattcaattgtacttctgtatactaacaacgaacacatgtaaactgaaatttaaaatacaacaccaggctgggcgtggtggctcatgcctgtagtcccagcactttgggaggccgaggaagatggatcacttgagcccaggagttcaagactagcctgggcaactgttgaaacctcctctctactaaaaatacaaaaattggctgggctggtggcaagcacctgtagtccctgctactcaggtggctgaggcaggagaattacatgaacccaggaggtggaggttgcagtgagccaagactgagccactgctcagtccagcctaggtgacagagcaagactccacctcaaaaaaaaaaaaaaaaaaaaaaaggaaaggaaaggaaaggaaaagaaaagaaaggaaaagaaaagaaaaggaatacaatacaataccacttacaatcactcaaaaaaaaaaaaaaaaaaagaggccgagctcagtggctcactcctgtaatcccagcattttgggagaccaaggccggaggaccacttgaggccaggagttcaagaccagcctgggcaacaaagcaagacccccatctctgttaaaaacaaaaacgaagcaaaataaaacctaaaaacaagaacaacaaaaagaaatacgtgtaaatctaacaaaacacatacaggaaccgtatgctgaaaacaacaaaatactgataaaagatatcaaagaagacctaaataaatggaagattctctgtattcacgtgttgaaagaattagtaaagctgtcaattgccaccaaattgatatacagatataacaccatttctatcaaaatctctacaagatgttttgcagatccagggaaggttagtctaaactttatatgaaaagacaaaggaatttagaatagctaaaacaattctgacaaaaagaatagcgagaggaatcaccaccaaatttcaagacttattatatatagctacaataatcaagacagtgtggtactggtgaagggatagacaagtatcagtggaacaaagtagaaaatccagaaatagcctcaaatgagtaaagtcaactgctttttgcaagagtgctttcaacaaatggtgttggctgggcgcagtggctcatgcctgtaatctcagcactttgggaggacaacacagggagatcagctgaggtcaggagttcaagaccagcctgggcaacagggtgaaacctcatctctacaaaaatacaaaaattagccaggtgtgctggaacgtgcctgtggtcccagatacgcaggaggctgagatgggaggatcgcttgagcccaggaggcggaggttgcagtgagccaagatcatgtcactgcactccagcctgggtgacagagtgagaccccatctcaaaacaaacaaacaaacaaaacaacaaaaaaagcaaatggtgcaaccatggcaaaaatatgaactttgactgaaacctaactccttacaaaaaaattaacccaaattcaatcataaacgtaaacgcaaaacataaaactataaccattttagaagaatacgaaggagaaaatctttcggacttagggctaggtaaatatttctttacaaagtatgagccacaaaagaaaaaaaaatcaataaactggacctcatcaaaattcagaactgttaagctacagactgagagaaaacataaaccacacatctgacaaaggactttagaatacacaaagaactcccaaaacactacagacaagccccagcctggccaacatagcaagaccttgtctctgcaaaaaataaaaataacaataataaaagaaattagctgggcatggtggtgtgcacctgtggtcccagctactcgggaggctgaggtgggtggatcacctgacccgggaggtggaggctgcagtgacccgtgatcgcaccactgcactgcagcctggacaatagagcaagaccctgtctcaaaaaacaagaagaagaaaacaagccatttagaaaatgagtaaaatatatgaagaaacattttaccggaaagaatatacagatggtaataagcacatggaaagatggtccacatcatcaggtgccagggaaatgcaaattaagaccatgatgagccatcattatacctatcatagtggctaaaatataaaatagtaataataccaaattctggtgaagacatgaagaaactggagcactcatgtattgctcacggcaaaataaaatggtatagccactccaggaactagtttggcagtttctttttgagacagggtctcactctgtcacccaggctggagtgcagtgctgtgatcttggctcactgcagcttccacctcctgggctcaagcaatcctcctgcctcagcctcctgagtagctggggctacaggcacaagccaccatacctggctaatttttgtattttttgtagagataggatttcaccatgctgcccaggctggtctcgaacttctgggctcaagtgatccacctgtctcagcttcccaaagtactgggattacaggcatgcaccaccacacctggtggcagtttctttaaaaaacttaaacatacatttgtcatacagcctagcaattgcactttgggcatttatcctagagaaatgaaaacgtatgtctatacaaaaacctgtataagaataactttgtttgtaaccaccaaaaactgggaacaacttagctattcttcaacaggttaaacaaaccctggtacattcacatcatggaatactactcagcagtaagaaggaatgaactattattgacacacacaacagcctggatggatctagagggtattgtgctgagtgaaaaaagccaacctcaaatggtcacatactgtacgattccacttatgtaacattctgaaatgacaaaattatagagatggaaaacagagggccggatgccaggggttagggagggtggcaagcaggcaggcataactatacagaagcagcctgggagggaggtggttgtggtgatgaactagttctgtatggattgcagtactggttacatgaatctacacactgatgaaatgacatagaactagagacacactgtactcgcgtaagactcctggttttgatagtgtactatagctatggaaaacataagcattgaggaaactgggtgaagggtactaacaacttctctgtactcactttgcatcttcctgggaatctactgtttaacaataaaaagttaaaagacatacaaaattttaaattataaaaatgtattcatcatcttatattttatcaaaattacggttgaatgcatttatgtcttaattataggaacaaagagtgatgacagtggggctgcctacagaaggaccttctttgcttcatgtctgcctttcacagcacgaccatgaagggggccactgtggagaaacaccccagggtgccatcagttcttctcagggtcccacatggcctcatccttgtggatttcctcctgtcagatcctcgttttggcagtggctttgtatgtgtctgtgacagttctctatcatcatatccatgaacttcatgaaattccccagccttagacaactttgcagtttgtactttcagtttcatcggctcaggacgagcctggcaggaagactgacaggtgggacgcagggatgctagagctaactggcaaggggcttaggcggggactggttctacaggtaaatatgttttcagtggcatatatttctgtgatggtgtcttttgctccccgaagccatggaaagcaggaattgagccttgttgtttaatttggggaccagagttgggtgacgagctcctgccctctcggctctgtttatccatgcaggcagccctgcttttgatgtccccaggttcacgctgggcttaatgacctcccttctcatccagctcaggcccaaggtcaaagggcaagccctggttctccatccccaaggcttgtgggaagatctgaaaccatgaaagcccacagtggttttcgtgaagcctcaaaatgaacggtgccatcaagaaacagagccagcagagtgctggggagaggggaggtccgagcacagagagaaagaaggtctgttgaaatggcaagaccaggaaaaagggaggattgggaggttctgcgcccgcagcaggcagaagccaaatacatacactgtcaccctctggaatctgaagcaggctctcctggacttcttggctggagagggaaagacccatataattttccagttctgccaagtttgggtacaaaactgatagggaaagaaggaagaataaatgtgtcattagaggacatgtgcttccctatgcctgcctggctcccctgtggctgctcatttttattaagaaatggagcctgggaatggtatttatttccaagactgtggggtatccccaggaacactcactgatgagcgctcctcagagggcccaggtgcagggtaggacaccgagtcctcatgcaccactttgctattcaactccactgactttatttgacacccagaaacctctgcatccctcagcgaatggttcccaccaggactggcagggtcctaatcccttcttataaggatttgtgtccttataagaagagacaacagagggctcatgcatgcgctctcatgctgtatctctctcgtgttctcgttttctctctctcttttaagcaagtacactgaggaaaggccatgtaaggactcagccagagggtggccatctgcaagccaggaagggaggcctcaccagaaactgaattggccagaaccttgatcttgggcttccagcctccagagctgtgggaatatacatttctgctgttgaagtcatccagcctatggtattttgttatggaagcctaagctgaataaggcaagtggggttctggccccttctctctttgagccgctatctgccgtccacttcttccccacctgcccccaccccaggccagccatagttccagcaaggaagtctgacaagtgtggtatttcattcccggggtcacatgagattggatcaccagaatggtgctgaaatgctgatttgaggtgactcaaatcgtttatatagacagaggccccacaaatgatatcacatcctcaaggcagccttgctgggggcatcagagaagccatagcttccctaacttgagctgggtttggaaggataaacaggggttcaccaggcagtcaaggagggaggggaacagcatgggcacaggctctgggaggtgaggtgactcagcccaggtcacccaggcagtaagaggtgggtggcaactggaagcctggtcctctcttcccaccatgttgagtccttaaccctggagcctcccatacctttggcattgccaagcttccctgatgatctcttccctgaaaggacttggcacccaggagcccctcatcccagcccactcacctggtggtggggaaatggctgttgcctggactggcagggctggcatcttgggtgaggctctgacctgggcctggggaggagcagggagcactggtcagctgtggccaggaccccaggaaccccagagcctggagctccatgaggccagggtctgggcattaggggtgtgagtgggcccggggtgtggggggagtgtgcaccaaccctcagggctcaagatcacgtaaacgtggcctccgcagatgtgtcttttcctgggaggaagttctgggggactgtgacccaccctatgtcacaacccatttactgcctgcaacaggcagaacatcaaggcccatctcccaatcaagttctcagctgaaaagtctccatttctcaaaacccactggaaccacagagtgctgggatggaggaggaagggggcttctgggggctaagcagaccaatgcctatgcccactagtcttgtttcctctgaaagcctgccttagagcatggagcccgcccatcctggagggagggagagctgggcctgggcaggacagagcaggcatgagagaggcatgcgtgcgctgcttggtcttttctattcttgctgtaacgccattggcattgccccctggatgtcttctctgcccagcaggccctgcagtggacacctacatgccctgaggcctacgggaatctccaagtggccccagtacccagcaccttccagggtaatccccaaggtccccttcagggaatccaggccaatggggcctggcgacttacctgaatggcttggtccacttttaggtcctctagagatgggtacagggatgacatggctgattctcagaacaccctgcagagtgcagagggtggggaaggataaggatgcagctgatgcccccttgaaaggaggcacagacatccgcaacagcaagcgggttggaacttaatattcaaacagaaaggcagcagggcacttagaatgcctccccgaactccacccctaatcccctgtcgatatttgaactctactgtattccactcatctccagcctcactgtcaacttttaatcttggccacaatgaagtaagaccagtaggaaatttataaagactctcacacaaactgtagcagaacttagacactcaacagggcactgctccagagggaggagggaatggggggtggagaggcaccatgagcacttatttactaaacaccttctcattgtcccagggagaatcagcaggacctctgagcaaggtgccccgagaaagtgaaaggaatgatgacctcttaagaaatgttttattcccttcctgacgaaatgtggggaaggagcagtctgcctttctgggttccttccctttactcactaaccactggctctgtcacacctccaggcttcgctgaggcagtccactccaactggagcccctgcccaacctccttgtcaccctcggttcctgtgggacacgcctcccctggctcccaggcaatacggtcactgcccctcccacccaggaccctgccctccgggacagctccgggacagcaccgggccagcctcttgcttgaactcgccacttgtcctgactgcagttctgaggggtaaaggtgtgtcctattcaccccactgaactcacatgtgatgggtacacatgataaaggaatgcccgctggtggcacaggaaactgagggtcctgtgcctgagcgatgtgactccaggcttcccaggatcagatccgctgggcacctccctgagtgaccacaggcacgccgaggacatactcatccatcactgctccttctcctccctctgcacctgctgccttgacccctgtgtcatccttggccccgcccccactatcccttcttgtctgtcatcaaatcccatctctcccacatcccgtgttgtgcaggtccccatcatctccctggccctctccaggtgccataacaccctccaaacacactgctgcctcccctcctgccgtcctgctgctctccagacagcagccaccaggccctttgtgtacacacttgggatgtcatgccctggctgaaagcccgccagtggcttccctgccttgggaatgtactctccttaaagaggctcacagggccttcacgattccaccagagattggaactggtgggcccagggccagatggaaatagattttatttgaccttgtggagtactgtaaacgttcagattagcagcttaaacacaaagctcaaggtactggatttaataatcgaatttcccactgctcccaaaaaacaggaagctttggcaaccctaggctatagcagagtagctacaattgagtagcagcagactccagggtgacccagtccaccatcctctattggctgttacacccagaccattgtactcactggtgccaagtcccaatagatatttgtttgcaaccctagtctacctctccagcttcatttcttgccttacgtcctttcagctgctactttcaactccagccacaatgagctacttccacgtccttgcatgtgattccctcctgtctcttttgcatgtgttattccttctatctggaatacccctcctctccctgctccttgcttggccaactcctaataattttcaagtctcagatcagggagctcctcttacaggaagcctgctttgatttgtgctccccctagcccctgctccatgtcctactcctgttgagtattcaccactcttgtggttgcctctttacttgtctgtctacctccttaggagttccaagatggcaggaacaggggcttctcatttgctgtgaagcctctaacccctagcatggaggctagctcaataatattgccagaagcaacacattctacctgggcttccacttttctccttgtaaagtaaagctctagtatcctaagaacacccaccttcctggatgaaacaaggaccagaagtcccaaatgtgcctctcacagtcctgttttattattattattattttgagacagagtctcactctgttgccaaagctggagtacagtggcgcgatcttggctcactgcaatctccaactcctgggctgaagccatcctcccacctcagcttcccaagtagctgggacataggtgcatgccgccacacctggttaatttttgtattttttgtagagacagggtttcagcatgttgcccaggctggtcttgaactcctgggctcaagcaatttgcccgcttcggtcccccaaagtgttgggattacaggcctgagccactatgcccagccttttgtttttaaaatctgaattagtgccaatatttaaaaatctggaaacacaaaatgcgtcacttcttacttggattgaaaaaaatataaacatttggcaaggcaagagctggaatagtgcatggcaacactcacccggctgagtcacagcctacctcgcaaatggggctgtacgtgctttcctgtttccgcaagtacccatcagcccttcactgatttacgttgcctgcttggttcctggaggcagccagttccagaccctgccctagcctggcctttggggtagaaatgaccatcccaacaggacaggaatttcctgggaggggagggagtctggctctgacttcctttagaccacctgggggaagagacccctttgcttatagccttccccactgtgtacacacactatgagatttttaatcttgggacagtcctgagcagctatcatctgccaaaacatgacctgccaccaggaccacgcatgaacagcagatgcgaaaataagcagccactcctgccctgattttcctaacatttaaccagtagagcacttatatttttgtcagctgtcccctgggagagcagggagtcagagatccatttcctggaaatcactcccgggccagatcacataaccctttttctgtgtctgagatcctttcaccactgccaccttctctggatcccatcttagtgctgggatgcggggaagtgagaaaacaggtacagtcgttccttggggtaggttccaggacaatgcccctcactccccatccctcggataccaacatccacagctgcttatgtcccttacataaagtggcataatatttgcatataacttatgcacattcttctgtatactttaaatcatctctagattacttacaatacctaatgcaatgtaaatgctaaacaaagttatattttatttttatttgaatttttgttgttttttttaatttttatttttaaatattttctgtctacagttggttggatccatggatgtgaaacctggggataggaaaggcatactgtatcccctgccttgtagcagctcacaatataatggggaatggttccctgccagcgaacatgctgtgtttcgttcaatcattcaaaacatttgagtgtccactgtgtgccagacgtgctggtccctctgctgtgcacatcatcctccttggtgtgatgctccttcgaggctcagttcagatgctacttctctgcttggcttttccagactgcatgatacccaggctgcctggctgggtcttcccatgtattccacccctgacctgtactgcccctgttgccaagctatttatcaaattatgtgattaatatctgggtattttcttacactggacctcactcataagggcaggagctctgtcccgttcacacacgatccttccccgccacggcactgcccagcacacatatgctagcaaaaattatttgactgaataaatcagtggttttccaaggaacagattggaaatttatgtgggcatttttgggtgtcacgagactgaggggacagtcatatccctgtcgggggtggggggggcagggatatgaaactcctgtaatggatgggacagtccattacagtcaccataacaaatggtcctgtcccgcacaactttcagatatcctgccaaactttcaagtaagccaaaaatccgttataattggttgtacatacaatcacaatgaatttttccctagttttagtacacactagactgtctggaaatgcatatatcaggttggttgtggggagttacactttgctcaccattctggaaaatcgctgcccaccctgctccccacgggtgagtcacccgaacagcatgctcacgtctgtgtacatgtgtagctgtcacagtgactccgcgcttttatataaatatatttagcctttgactcaagatgtcagatataaactgttggcaaaattcagctgaatattgtcttctagtaaacctaagctgattcctaagttgggtacaagcgtgatcgggtgtaagccagcctcagcttttacaaagtgaaatgcatattcttttattagaaattactttcatgtccctgccttctccttataaacaaagggcatcatattgattttttacccggggaaccatcacctgggctgcagcctcaggacgaacctgtgccttccctctgtctcaatttcctgctttgggaaataggagccacaagccacaaactccatccaccgcgccacaggagcgaggtccaacgcaacggtccctagggcctgcctccaacccagcctcagtttcctatctgtcacatcgttctatgatctcgaaatgactataacccctttcttagccccaaaccagccggaagcgacatcttccggttgctacaggttacggcggttgctatgggctacggcgcctgcgcagaaacaccgccaagcgactcagcaacttctagagcgcatgcgtttcgcccacccaggcccgggcgcggttaggggtgactcccacgatccctagcggctgcagagtggaacatggcggcctccttgccgcttgcgttaccagagtccacccggcctcgtgctttctccgggcgcccgtagctggcgccggcatccacaaaaatagatcaggtaaagcagcagagtaaggcataggaagacttggtcgggctccgcggcccctctttaccggattggaggctgcgcgggtgaaatcgagctttaaactcccctggcctcggaacaccatttgtagcctctgaaggaggaggacttataagattctgtactaaggcagccgtgggaagggaggagaaccaggtcggcccgcgcgctcccggctgcttttgctctccctttggtttcgaaagcgtcaagtcccaaggtatttcctaccaattgtgacgtcacccttcctcccccgtttctcacccgtttcttgtctggccgtgacttctgacccagtgttgagctaaaaatgccccgccccaccctacgcagattcaccccgcgtcccacccaccagtgactgagtgactgggcttctgctgcctagggaagggttcttggcttggccgggcaaatcaattcccacagcaaaatcagaccgaaagcctgttatgagggactcaggcagttggatgtggcgtataggaggaaggctagggcaatcaggaaggtctcctggaggaaggaagaagaccctgactgggccgtgtaggatggatgttcaagtgggaagagagtgtgctattccagggacagggaggcccaggcctgagagtccagttgccttctggatcccgtttacctcgcagattatccaaactggactcgtgattttccccagctgtgccgcgcctccccagcggtctcactgaatccacccatgggctatgtcagaaatctgggagttatcctcagctcctccctttcccttctgaagccatacctacttcttgccctcaaatctctgtgacctgacttctggtaatgtttccattctcaccatctcattcttctccacacttatcatgaagttcatttattccagactactttaggttgagtcctaaaagtcagcctgctagttcatgcctccatgcttttgcaggtgctattccctctgtcttaagagtcattcatgccttctctcttttccttgttgtgaactctttttcctccaatttaaagctttcccccacctgtacgcatggagattggcaagcctcccttctctagacgacagcatttcttgtatttgcctcttcatcatatattccacaagtgtttgttaatcacctactatgagcaaggccttctgcatttcctaggttggatttccactgtgctgtgtttgtttgctcatctccctcactggtcaggaaatgtcactcatttgttaacccccagtgctgagcacagtgcctggcacacaacaggcatcccattactatttctgaaaggagtggaaaagcaggcacagagagaagagaaagcctgatatcctaaatatacagtctttcttcccatgcctgtctgtgtttgcagtcaataagtagaaagtctttcgaagaataacctgggcctggaaaaggagagaaaccatggccctaacgagttaggttgaaaggctgcctggctcctataatctgacagtggaagtttgctcagttctgtgctgatggcttcccacaagtaattggttcctccgaaaggaaaagaacccacctaacccctctctctcagaggaattttcctctcccacagccctttccagatttccatccctgagcttctgtactttttgatataagcaataacaacacccacaacaaaccaatagctgggcttcggagatcagcagggctgacaaggggacttcagcccccatctttgaacttagagtgagaacactctttggaacactttgttccaaagagctgaagtgatggaactcccactcgttcctgtggacagctcatccgtcctttacaagacagtgcgcgggagggaagcgtgggttagagtgtcagaggaatagctcctggaaggccaaattagcccagggatgtggtgagtcggaatagaagaagctgttgctaggccaccagcatgtacccccactcctcctctcagtgctgcactgcctgctggggaaaagctgtgacttcctcaagcagacacgcctgaacccaggcccaggcagggcagggttcagactgactgcttctgacttgtgagagcacagcataggcaaatcccctttgaatgtcatttcttcctttgtaatctggataacaatagttgcatcacagttgtctggagactgaaagatttttaaaaagagttaaggtgtatatggaaagcatttagcacagcacctagcacataataggcattcagtaaaagttagctgtttattcattgtttcagcgcttacttactcagcacctgctaagtctgagtactgttctaggtatcagcagtgaaggaaagaagacttggtccccaaatgtactttctttgggggaagagctggataaataggctttgtgactctgtgtgctgtgttagatggtgggaggcactggagagaaagagcaggacggagggtcatgtcaggaggttcagaagccttgctggctgggtggggtgacattttaggaaaggcctaatggggtgggcacggccattgcagagcctctcaggtgggagttggtgttgtgtttagaggacatctgccagtgagaagccagttgtgcagagagggagtaaggaggagtagtggggaggaagctggagaagtgagaggggccagatcctggagggcctggaggtcatggtgaggactttggcatttactgtagtgagatgggagccactgggggatttgtagcagcagagtgccaaggtccaagggttattttgacaggcctcctctggctgatgtttggaggatgggctacagggcaggagtgggagcaggagcccaggtgggaagtgatggtggtggaattgtcatgagcttgggccactgtacgtgaagctgcctgtccagtgctcgcccagcccataccaggctcgttttctgccccattttctgagaccctgctgaggagggcatgcactggctcctgtgtccagtatgtccttccattctcctgactttgtgggctattttcagtctccagatgaagaaaccagttcttagaaaggtgaagcccctggcgcagttccccagcaggtgtttcagtgctgtggcaggaaggttttttgatagaaacagcctcaggccagagaagtcggcctgagctgtggattccttgggagaaatgggctttttgcctgcctgcagcctctggtttcggctggaattggcctttcaaggagcaaagtgtggatctcatctccttgagcacagtcatgggcagtcagaaggcatcgggggccctcatgatgtctgggtgaagaaaatcactcagcccttaatcaaacttggtccagggctgggatcagaagaagaaaccccacttcacacttgactgcttggagtgaagcacttcgaaaggaagctgcctgggaagtcccagaagggaaggggcagggagggaaggggacagggtgagagcaggtctcactcatcccaatcccagccaggattgggtcagggcccccagcgcttacctgcaggcaaggtgctgctccacgaccttctccagctgctgccgctgctgaatctgtttccctccctgaaacgtagccctgtctctcagctggcttcctgatctgggaagggtggtgcctgtcccctgttcagctgactcaccttggactgggatgggcacaggtgagggctgtggctgggtaaacaaggcaggttgccagcccagaggaggcctttggccttagtctggatttggaggtgggattaaggccctcacagctgctgttcagacggttatgaaccaagacttcttggccttttcttaaatagctctaaatttgggttggacacctagtcctgctgatcgaggcagttggctagagggcggtttgtgataggtatctaggggtctaggccaggatattaaaaagtggtcatatcctgtgacccagcatttcttctaggaatttgttacagtggagtcacagggcccatccatcactgctgcttctagtaaggaaaatgtagaaatcccaaatgcccatctctgtggtctgcttgaataaatcattgtctgtggaagatcacagagctattaaagtcacttaaggaagaaggtatgaggaaacatttctgagattctagtgagatgttgaaaaatcaatattgtgaatctcttcttgcattttgttttcattttttgtaaagtggatgtgcgttgaaagcagtctaggaggacatacgctaaaatgctgagtatctctgaatggcagcattgagggtgaggttttcagtttgtacttttgtgtgttccaaggtggtttttttttttttaagttagcttttgctctgaatgctcatgacttttgtaagggggaagcaattaagtttgattattttaatgggaatttagagtggttgtctcttgggagcagacctaaggagctgtgtgctgaggtggagatttttttttttatggcacatttttggtgtcttaaattttgaaaagtttaaatgtactacttattccaaaaataattatataaatttgaacagaaaaggaggaagaatttagtttagatcctggtgggtttggttgggtgagggtgcctgtcgcactgggtgcctggggagggacgagggactcgtgtgctgggcagtcccatgaggattgacgctgtacacactcagggtgtgtcagtatctgggctgcttcctgggccaggcaggcctacgtcacagttcccatgacccacctggcagagttgcactagccttgggtgtcagatcttgtgcctgccaatgaagagcttacagcccagagtcccacacaggaaacacacaataggaataataacaagaaagacatttgccactaattcagcacttactcccagagagcacagagattctacccctggcactttaaaggcattatctcaatggcttctcatgccatccctgcagagtaggtgtgactcacaccattcctccaggtggggacactgaggcacagaggcaaagtttctctctcaagttagctggaaagtgggccaagttcatgtcttctcttctatgggacatactgtttcagaaagctgaggtgtggggcaacctcagagtaagctgtgtgggcctgaagctgaggtaacgtgggtgatggacccaccttaggtcaggtgtccaaggccaaagcaaagtggaaaatagagatcctaactaaaccaagccactcctcccccacctcacttcattcagtcatgacctgaaagggcctttatagaagagggaggaggaagcaggcccttccaggtaaggggcttgcctgtggtcccagcatgtcagcatggagcccaggtcccctaactcccacctatttaatacctacagggactctctttctattccctctttggatagttgccacccatcactgacttccagccacctggaaatatctttcattgggcatgcccttgctcgaactcttcagtggctccctcctgcttcagggtctgggctaaactcccagggctgacatggagacctccacagcccactccctttattacctcctcagcactcccccagcacctctgcctcagctggactgggagccccaccattcctgccccactgcacacccacttcctacctgccctgactccatacctttgcctgtcctgctgctgcccctggaacaccttctcctgcccccacccacctagccacatccaccactgagctcctccaggaagcctctgggatcccccacatccatgtggcctctcccgcctctgactctggatcagacgctcctgttccattctttaataatcatcatcttgtactcatgtgtaccttttaggctactagttagaccctaagttccctgagggcagggccaagttattagctctacagtggtcattcttttgagacagcatttcgctctgtcacccaggccatagtgctgtggtgcaatcatggttcactgcagcctccacctcccaggctcaaaggattcttccacctcagcctccctattagctgggacgacaggttcacactgccacacctggctaatttttttattttctgtagagacagggttttgccatgttgcccagactggtctcaaactcctgggctcaagcagtctgcctgcctgagcctcccaaagtgctgggattacaggtgtgagaccccacacccagccagttactcttttcaaaataaggagtggaactgtgctctgaccagacaatatttctgctttgttatatatttgtatgaacaagtctaaaactttgggtggccagtaaacagcacacactcagaaactccctggtagcacccatggcaccctgagtaatcaaccactaatgtccttcctgctgggcccagaggcctctccggatcctctcgtcataatgctgcaggcagctaccgtcacctagagttggctcatgaggtgaagtctccatgccatctggaatgggtgctccatgatggcaggggcttgtcttaaccctgaggcctagtactatgcctggcacatagcaggctcacagtaaattttttttttttttttgagatatggtcttgctctgtctgccaggctcaagtgatcctcctgtctcagcctcctacgatcctcctgcctcagcctcccaagatcctcctgcctcagcctcccacaatcctcctgcctcagcctcctgaatagctgggaccacaggcgtatgccaccacagctggttaatttttgtattttctgtagagatggggttttgccatgttgcctaggctggttttgaactcctgggctcaagggatgtatccaccttggcctcccaaagtactgagattacaggcgtgagccaccacacctggcctcagtaaatattgactgagtgaataaatgcccctcctagaaaagtcaatcacagttagaaacttaaatggctgacccttatttaaaagatgggttgggctggggcatccgatctgagtcccagctctgtgatgttgcacatgttactaaacctctctgagctgtagtttccacacctaccttctttatagacttatcctgaagactaaatgaggtaaccatgtgaagtacctaggacacagctggcatttagtaaatgttagtttcctactttctcatggctacatgtcacagaaacagtcatctgattggagtgaaaatagagatgctcttcccagaagaagagagaatgtcggctgggcagagaaggagctgctctacactccagccctctgcatggaatctgggtagtgcagcaagaccctggcttatgtcatcacagctttgttcctactgctgaattgaaataataacaggaagcgtagcatttattgagctcctgcacactgggtgctctgctgggcactgggcatacactgatctcatctgttcaccataattcccagcttcagagtgaagcactttgcccaaggcaacacaccccaagagtggtaaggccaggccttggctctgaacctctaggagtctcctaccctagtgcagctgagtcacagatttctctttaagaaacccacaaagaagtccttaggtggcaaaaatttgatcacatggccacatagagctgcatgggagactgggaaatggaggcagtctattgttagcaggttctgtgccagcctctactatagcatgctgtgaagccctgccctttctggacctcagtctccgtatttggccagggaagagtttggatggattttctctgaggtttgccctaacggtactaaggccccacaaagggccaactctattgccacttccagtccctcctgtggcgtgaacaccaaagatgtccactatgagcatttggtctccaaacacaatgtccttcatgctatttctgagctccatcttggttttgctttttggagatgtgtgtgagttaaggtaggccaggttatgctgcagcaacaaacaaccctgaaatcttggtggctcctaataggaagtgtcattctcatgcacgctactacccgtcaagggctggcagggtccccatgtctccttactccaggactgggggtgatggagcagctgccatctcaaaggccgtcagaagccacggcagagggaaagagatctctatctggcaattaagtgctccagcccaaatgacagatgtcacttctcacaccttgttggccaggttaccccacctcccaatcacaagggaacagggagctgccatcccaccacatgcctggaaggcaaagagtaggaaatataggaggatgacattaataacaacctcaggcctctgttccagagtgtctgccagccagctctgatcatctgtgtcagggcaggggtagcagatgtggcctgggaggctgcaccgagccctgctgggacctacatggggagtgaggggctgaagagatggaaagacgtctgacattctggagtctggggccgaggctggacagcgcaacctgccactgtaggtagaattcctatgttgaaactgaatctccaatgtgatagtactaagaggtggggacttttggaaggtgattacgtcattagggcagagattaggactcttatacaagaggtctgagggaacttgtttgcccctttacgtgacgatgcagtaagaaaatgtaatctttgaagcagagagcaccttgatcttggacttcccagcctccagaattataagcagtaaattcctgttaaaaaattacccagtttaaggtatgctgttacaacaccctgaatggactaagacacagtcccaggcaggagcgttagtttccacttctgcaaaattggggcagtattccctaacctgcagaattttgatgaagatgaaatggatgagtaacagtggggaaacttctgtctactcccagcagccttctacggaaggtggacttttcagcagaagactctgcccagctgagccctatgctggatttgggtggtcaaatttgagagcaggagcttggcaaagaggggctttggggaggcagtcagtttggcgggggcatattgtaagactgtgtgcttacaaaagcacaatatattcctaagatttctttggggtgactttatttgggacagttttgggggagttgacggaggtgggggcactctggcccctgatgccttcccccattcaaacagacttgggggttcctgtggcaatgcacaagatgggggtgcaaaaagggggcaagagaaggaaggtagcatgatggacagaggctggaccagtatagtgacccccagggaaggtcccctgggagggtgcaggcaagtaggagggtactctgagaatagagtcaggttctgaagctgttgccttcctatgatgcaagcctcagctcctcctccatcctcaaatcttcagtaaacgccctctgttgacaggacattcactactgcacagtgggcactcagctgctgctttgtgtcatctcgtgtcatgacatgtcatgtcaaagccaacctgtggacacacaggtcctctcggcttccctcaggtgggggtggggagaaagcaggtcaaaagcccagccttggtgggaatgtaaaccagtacaactgctacggaaaacagtatggagattccttaaagaactgaaagtagaactaccattcgatccagcaatcctattactgggtatctccccaaaggaaaagaagtcattgtatgaaaaagatacatgcacacacatgtttatagcagcacagttggcaattgcaaaaatatggaaacaatgtaaatgcccattaaccaatgggtggatacagaaaatgtggtatatatacacaatagaatactactcagccataaaacgggacaaaataatggcctttgcagcaacttggatggggctggaggccattattctgagtgaggtaactcaggaatggaaaaccaaatatcatatattctcttggggtttttttttgttcttttgtttttgttttttgagacggagtctcgctctgtcgcccaggctggagtgcagtggcatgcgaactcggctcactgcaacctctgcctaccaggttcaagcaattctcctgccttagcctcccaagtagctgggactacaggtgcgcacaccaccatgcctggctaatttttgtatttttagtagagacggggtttcaccatgctggcccggctggtcttgaactcctgactttgtgatgttctctcttttaagtgggagctaagctatgaggatgcaaaggtgaagaagaataatataatggactttggggactcacaggggagggtgggagaggttgagggattagaggctacatactgggtacagtgtacactgctcagttgacaggtgtaccaaaatctcagaactcaccactaaagaacttacccgtgtaaccaaaaaccacctgtaccccaaaacctattgaaataaaaaagcctagccttggtcctgcccagcgcagagagacatgaagctatgacttggatttactcttccaaaagcctccaatagccagccctgatctgctgacacagttccccttctgagcagagaaatggaggagaaggcagcagaaagatgagaaagaatctcccatgagatcaggggctagctcattaatctaggtgagtatgccattttggagatagacaaactgagccctggagaggtcaaatgactcagtaatgcagccagactatggcacaggcagggtgatgagccacatctgccttcctgtagccaccagacaagggaagcaggggcacagaacagtcacatagcaattcagtagcagagccaggatccagtgaccccaaaccctggtctctcccgactgctagcctgggaatgttgcccagctctttcacccacttttggccttgcctcttcaccgcacctgaggatccagggaccccaagccctggtttcctggctgccagcctgggaacattgcccagctctttcacccacttttggcattggctcctcaccacacctgtgccagtggctggctgggttactcggagtcgtttgactcctccagggctcagtttgtctaatctccaaaatggcatgttcacctagattgaatagctagcttctaatctcagggaagtgtctatcttgtctttctggggagattctgggtgtcagatagggagaggcagcatgacctgagaaatctaagccccagacactagaggcggaactggtcccccctgcatcctggccggaagcagcatttgaagctgatcttgagcgagacagtatgaggacagccattgccattgttgcacacatgatcttactcaaccctcaggtggccctgtcgagtgggttccttcgttttctagtttttccattgagaaaacacaagtaggattcagtctgaagactggtagttcagtgctcccaacaaggggcaggaggggcctggctgagcaccctgagggtggagtcggggcaggtgccagaacacggatgctttcccgtctggctggagctgctcccgctgtgttccggagcagggcagaacaggaaggcaggaacaatgggcagccggcagtggcggggtgctggggttcctgagccaggggtggggaggctcaggcctggtcaccaccaaggctgggggtgcaagtttcctgtgcaagagactaacaagattagccactaacatttttgagcacttactgtatgtccggacccgtgttagacactttagatggattagcctcattttacagataaacaaattggggcacagagagtttaaatgaaatgctcaaggtaagtaagaggtgaaagatttgaacccaggcagactggcttcagatcctatgctcttaactactataactttatatgtgtatacatacatatatgattatatgcatgttatacatactttctcataattttcccctttcacttaatttaccattgccagttttctgtgtcatcaatatcatccttgtttacagtgctaacgtgccgggaagaccttgtccatgtgtcctggccacatcccagtctgttcttcccatgacctgaggggtctggatttccactgttggtgctgtcattgagttaaggtgcggtgcctctcgtttaaactgctgataacagtggtggcaccaaggtgtgggctggggggtgcttaagccccttttaatctctatcataataactcccttatccaaataaacaccatcgacataaaataatgtgcttttatgcaaacagtacttcaagacaggcctccctccccagctcaatcattgctgcacctaagcattcccacagagaagtcccccaggtagcctggctggtgggttaatgtcagagtggtgctggctctgaacgcagctgtgggagcactgctggtatcttaggatccggtggggtggagatttggagcccaggaagacccagcctgacctggtggtggtggcttcagaaagagctggagagggtagaggcccttgcctagggctcttactgcattgtatgtaagatgaaggccacagattggtgctgtcaagactgggaaggcctgtgggactcaggaccccagggtaagactgacctgcccctcctttcacctgagacagactgggagatcccagggcactgggggcaggggagcggaaggggcttgttgaaaatatccaccatggcagctaggagagcctgctggagccgctcctccgggggtgatgaacaagctggaggacccctcctggaaccccctttttgccctcacaaggccagctgggagcactggatagggaacgagacacctgagttttgtgttctagtttcatcgctgcctgtgggtggctatgtggccctgggcaagtcactctcccttggtagcctctggcttcccacccctaccataccagggaacaccatggactctcccgttctgccagatggtctaacaaagatgctttccctcttgggtcacctgggctggcaggtgggtgattcagaagtcacctttctgaacctccaactattattacatattaatatacatttacataattaccttccaggtatggcctttgggggtcacctgttatccacttccccttatggtagctgtcctctattttcatctggggaagcctcctctcctccacctcagccatgtgcagtggatggagttgactcttcttctggctccaaaaggggaagagaggcttgcggatctgtgcattccatttcccaaacctcagaggaatgggggttgggtggggcatgtgacccaattccagcccatggcatcaggcttagaactggtcctgattatggagaagtctggaagcgtcaaacctgaggggatttgaggttggagttaactggcagccatcctgcccccatggagaatggagccattgcagaaaaggcggagctggggatggagagagagacccagggcctcctgatgcagcttaacccctcaagtccagctgtgcgtgaagccaactgctcacccttaggcttttcaggtacaagacaatcaaatgcctttttcactgaagccagtttgaagtgggttt

SEQ ID NO: 302 - DNA, 31708 bp, Homo sapiens
tggtcattttcacaatattgatcctacccatctatgagcacgggatgtgtttctatttatttgtgtcatctatgagtttttcagcaatgttttgtagttttctttgtagagatctttaacctccttggttaggtatattcctaaatattttatttttttgcatctattgtaaaagaggttgatttcttgatttgatccccagcttggtcactgttggtgtatagcagacttattgatttgtgtacattaattttgtatcctgaaactttgctgaattaatttatcagttccaggagatttttggaggagtctttagggttttctaggtatatgatcatttcatcaacaaacagtgacagtttgacttgctctttactgatttggatgccctttatttctttctcttgtctgattgctcctgcgaggacttccagtactatgttgaatagaagtggtgagagtgggcattcttgtcttgttccagttctcagagggaatgctttcaacttttacccattcagtattatgttagctgtgggtttgtcatagatggtttttattgcattaaggtgtgtcccttatatgccgattttgctgagggttttaatcataaagcgatgctggattttgtcaaatgctttttctgcatctattgagatgatcatgtgatttttgtttttaactctctttatgtggtgtattacatttattgacaaccatccctgcatgcctggtatgaaacccacttgatcattggattatctttttaatatgttgttggattctgttagctagcattttgttaaggattttttgcatctatgttcaccagggatattggtctgtagtttgttgttgttgttgttatgtcctttcctggttttggtattagggtgatactggcttaatagaatgatttagtgaggattccctctttctctatcttgttgaatagtatcaacaggattggtaccaatttttccttaaatgtctggtagaattcagctgtgaatccatctggtcctggacttttttttttttttggtaattttttaaattaccatttcaatctcactgcttgttattggtctgttcagggtatctaatccttcctgatttaaactaggaggattggatctttccaggaaattatccatctcctctagcttttctagtttatgcacataaaggtgttaatagtagccttgaatgatcttttgtatttctgtggtgtcggttttaaaatctttcatttcatttctaattgagcttatttggattttctctcttcttggttaatcttgctcgtggtcttctttttttattttttccaagaaccagctttttgtttcatttatcttttgctattttgttgttgttgtttcaatttcattcagttctgctctgatcttggttatttccttttttttctactgggtttttgtttggtttgtccttgtttccctagttccttgaggtgtgaccttagattatttgtgctctttcagagtttttgatgtaggcatttagggtcatgaactttcctcttagcactgcctttgctgtatcccagaggttttgataagttgtgttactattacagttcagttcaaataatgtttaaatttccatcttgatttcattgttgacccagtgatccttcaggagcaggtcattttgttttcatgtatttgcatgattttgaaggttccttttagagttgatttccagttctattccactgtggtttgagaaagtaattgatataatttcaattttcttaaattcattgatacttgttttgtggcctatcatatggtttatcttggacaatgttccatgtgctgatgcatagaatgtatattctgtggttattgggtagaatgttctgtaaacatctgttaagtccatttgttccaggatatattttaaactcattgtttctgtgttgactttctgtcttgttgacctgtgtagtgctgtcagtggaatattgaagtccctcactattattgtgttgctgtctacctcatttcttagatctagtagtaattgttttataaatttgggagctccagtgttgggtgcatatatatttaagactgtaatatttttgtgttggacaaggccttttatcattatataatgtccctctttatcttttttaactgctgttgctttaaggtttgttttgtctgatataagtatagccacttctgtttgcttttagtgtctatttgcatagaatgtctatttccacccctttaccttacatttatgtgagtccttgtgtgctaggtgagtctcttgaaggcagcagatacttggttggtgaattcttatccattctgccattctgcatcttttaagctgagcatttaggccatttccattcaacattagtattgagatgtgaggtagtattccattcatcatgctatttgctgcctgtataccttgcttttttaattgtatttttgttttataggtcctgtaggatttatgttttaaagagggtctgtttttatgtgtttccaggatttgtttcaagatttagagctccttttagcagttcttgtagtgctggcttggtagtggtgaattctttcagcatttgtttgtctgaaaaagactgtatctttccttcatgtatgaagcttagtttcactggatacaaaattcttagccgataattgttttgtttaaggaggttgaagacagagccccaatcccttctagtctgttctgtagggtttctactgagaaatctgctgttaatctgacaggttttcctgtatatcttacctgactattttgcctcacagctcttaagattctttccttcatcttggctttagataacctgaagacagtgtgcccagatgatgatctttttgtgatgaatttcccaggtgttctttgagcatcttgtatttggatgtctaggtctctagcaagaccagggaacttttccacaattattcccccaaatatgttttccaaacttttagatttctcttcttcctcaggaatgccaattattcttaggttttgtcacttaacataatctcaaacttctcggaggctttgttctttttttcttattcttttttctttgtctttgttggattgggttcctttgaaaactttgtctttgagctctgaagttctttcttctgcttctttgattctattcctgaaactttccagaacattttgcatttctctcagtgctctcctttatttcctaaagggttgatttttatttatgctattccttcactaaagatttctcccctcatttcttatgtattttttttatttccttaaattggacttcacctttctctggtggctccttgattagcttaataactgaccttctgaattctttttcaggtaaatcagggatttcttttttgtttggtggtgagctagtgtgattttttgagggtgttaaagaaccttgttttgtcatgttaccagcactgtttttctgcttccttctcatttggatagcctatgtcagagggaagatctagggctcagggctgctgttcagattcgtttgtcccatggggtgctcccttgatgtagtactctcacccctttcctagggatgtggcttcctgagagccaaactgtggtgattgttatctggatctagtcacccagcaggtctaccaggctctgggctggtactggggattgtctgcatagagtcctgtggtgtgaaccatctgcaggtctctcagccatggataccagcacctgttctggtggagatggcaggggggtgaaatggattctgtgaagatccttagtttttgttgttaatgcactatttttgtgctggttggcctcctgccagaaggtgacactttttgagagagcatcagttgtggtagtataggaagaaccaggctgtgggtagggccttagaactctcaagagtatatgccctttgtcttcagctaccagaatgggtagggaaggaccatggggggaggggggcagggctgtgtgtgtctgagctcagactctctttgggcagggcttgctatgtctgctgtggggaatgggggtgtggttcccaggtcaatggagctgttcccaggagaattatggctgcctctgctgtgtcatgcaagttgtcagggaagtgggggaaagccagcagttacaggcctcacccagctcccacacaacccaaaagaccagtctcactcccaccatgtccccccaaacagcaccaagtttgtttataggcagtgggcaggaagggctgagaacttgccccaggctaccagactcccacttatgagaacaagtagggctttcacgcctatcggcctgtggagtctgcacaccagattcaggccctcccttgagttctggccaggagacttcctgttcagttggaattgttacaaggttcagctgggggtttccttctccctgtggtcttttcccagtatttctggcagccctccccaagaacacccatgagacaactctgaaatagctttctgagggtggaaaacccacaggcttttcctgctgcttcctctacccctatattttgcttggctctctaaattgactcagctccagataaggtcagatccttctcccatgatctagaccttcaggtgccccagtgagggtgtgtgttcagtgacagacaatccacctttcccactttcacagcttgggcactcacaatatttggactgtctcttgggttctgcaggagcaacctccttccttcagagggtttgtgggttctctcggctttcctggtttattcctgcattagttctgaagcaaagggtgaagatgcgagtgttgaacctttgaaatttttttcaaaggtccacacagtgctctgtccaagtgcgagctgcaatctagtcttgccttccgtctgccacttttccccctcttttttttttcttttaggctacgttctttattggtcaccctcaccgcaagaatgtgagagaggcacagtcatccctactttgtagatgggaaactgaggctctgtgaggttaagtcacttgctcattaagtggacggatggggccacactcagaactgggatcctatcccccagtccaagccttcactaccacaccaaaccattccagtattttgttgatgcttcaaataaaatatgatctgtgtatgaataaaaagattggaaggggctgggtgcggtggctcatgcctgtaatcccagcactttgggaggccaaggcaggtggatcacttgaggccaggagttctagaccagcctggacaacatgttgaaaccccgtctctactaaaaatataaaaattagcctgacagggtggcgggtgcctgtaatttcagctacttgggatgctgaggctggataatcccttgaacctgggaagcagaagaggttgcagtgagccaagattgtgccactgcactccagcttaggtgacgaaaagaaaattggaaggaaatttcacaaacagagaaagacctttcttcttactactttgagaaacctgtgaagtgaaatcattggctcatgatcacccatgtctcccaagtaagtagaacaagcttagaattaaatgagtatttatttatgagagaatctcttcatgacaaaattgaagtgacttttaagttcttctttgcagatttttgtattctccaaatttcttacaaagagcatgcatcttattcataattaaaaacaataaaacattattgttggaaagtagaatgatttaatagtacaagtaaatctcatcctaaaataaaaggtcattgaggttggcacagtggttccaatcaaggcacttgtaaaacataaagtctcctaggaggtcgaacctgattccctaaatggggtggaggtgcaggtgcccatgggtctgcatttgccactcttgccttgagtgaaactttcatgcgatgctgtaatactcatgcttgatattctgtgactgatgattttgcatcttgaaatgatggcccaaactaacggccacagttgattatgttcatgccctctctgtgttttcatgggcatgcaagaatcattttacaaattctccaaccacaagcctcaacctctatacttcacttcctgcccaatagggatgtcccacctaaccactccccacactgcagtactaaagtctctggccacatgttcctctcgctcctgtgcctctggaccagccccggtgcttccccgtgtggccctgtgtggtggggcaggccccttcctcttgggtgctcaaagtaataaactcttctttcaaaggcagatgtctctgtctgtcaccttaccatacccagtggaaatgatttcaaaacaaaatgtgaggtacatttaaaaacaaatgcgaaggattggcatttcaaaaaacagagctgggacctcagcaagttgatagaaaatgtcccacggctgtttttgtatctgcttgccaatgcaagtctgagtgggcaccaggttgccacctaagcttgctttcactgtaaagtgccactggaagcaaggctgtcggagggatgctgacagccgtcacccactgctgactacttggggttcctcatagtttctggaaaaaactagttgtgaacagcaagtgtcattagtcacttcttcacacctactatctcctttgtgctactgtaggacatcttcttgcctactctgcaggaggctggagccatgtctgagcaggtatgttccttcctgggaaggatgcctggcttctccactgtggcctttataatggagagcctgagggaagagcattgtgtataaaacaaaccttgcttcaggcagcgttgcgggagcccttcataactggccattggtccttgttctaagccagcacaggaaggccctgtggcttaggttagttgtttttactctttgagtgtcagctcttctgtttttgttttttgtttgtttgtttgtttttgttgttttgagacagggccttgctctgttgcccaagctggagtgcagtggcagcttgttctgtttgtgaaataaagtgggagcgtgagggccagggggttaggttcccctgggacttctgccagctctccagcataactcctttctgttttgtttctttccttataaaatagcatgagaaagcctacatgaggcccctggcacatccgaggtgtgtggggcaccggggcccccagaagaggagcctttggatctgatgggagcaagggctctactgaggctgccagagatgccctcggtaatgggggtgacatagaggtgccagcacagcctgtcaggcaacgagggaaggagggacggtgggtctgactcaaaggacacgagctgcctttgctgtagtgcaaccgtggcccattgctcattgtgctgctctcaggactcagagtatggaagcgggaccattgccgttacaaacccgcagggaaggggctgagcacccggagggctgtgtgtgcacacatgacgttatcggagtcaggaaggcagccagccgcgaggagatgggaaactggtccacggcacccggggagaccttcacagcccacgcattagccctcgtcagccggtgtcccggcgctccccacaaacccagactctctccttggctaacaatggcctccaccagccgacctctttgagcctctgtgttctcatttcttccatctgccacacatgatgccacaaggtccctgctctgtctctccaacatgccactcattcctgactcacagccttcatgctcacacccctcccttgtcctatcctcactctcagtcatcctgttcaatgccttcatggcacttatcataagctcttacgatcatgtttataggtctggtttcattgttgctgtaggggggtctgtctcccccatttaggcctaacaggccaggaatcttgtctgtctgatttactcctaacatatgttaagtgttcaataaatttttgctgaataaatgaaggaaaaaaatcatgcagcctctgagatgtcatgggatgacagcccagccatcgcgagttcgctagtaaatcattttcagattaggactctgttgacagatgaattcatattttagttttattgaatgtgttattgtaattctgcaatagaggtgcctaacctgggttggcgtatttccattcctgggagccccaaggaatggaaatatggtaacccagcaacatcccatgaagctagttacctgggagaatttgtggaaaagggcactgactggggttaatgggtgttggcttgtgactggggtccctgttgatggtttggtgattgagccttggaagtggcatccctgccagcgaatccagctccactggggtcaaatgcaccctcagaacagaaagagggatgtggtttgttatttcttgtgcattagcaatgtgccatcagttaacaggccatttcccacctaggatttagtgggattttccactttccctagaaagagaataccgtctgtggctttatttgtaatcatcatcaggaaggtcctattgaaggagacagtgaagtaagaggggccatccttcgatcggactatgaacttggtggtggtagctgctgtggcctcagtgccctcttcactgacatccagcacagccttgtgggttgcctgccaagggaaaaacaaacatcagtggccctagtggagacacttttacttaactgagtaaactaaactgagtgcttttgccctggaatggtgatgtctaccttgaaaggattcaaggttcaaatgcctggcattgggtttactcaatacattgcagtgggtgttgactatggcccattggtccttacaccgggattgagatggttacaaacacagagcaggaagaccggagtgagtctcagttctgccacttatggttgcaaaattattaagatgctgcgtgcttcaggttcccgatctataaaaggtaataataactgcatatgccccgtaaggttattgtgtaaattaagagagatcatacaaagcaagtgcttgtggacttgccagcagtagtaattgctgcagttcttgcatggcagacatgggtttgatatgactaaggttagatcccttctttgtcttctagggaagagattcttaacctggagttcctggatttctaagcttcagggaggcttgagctcctgtgactacaggcattatttttcataggctcacagatacactttcctcgagaaaatgtccattatgttcatcatattccagtggggcctctcaacattttctgaaaaccaatgacaaaggtccccttcagtggccccaggatcacttctattataatccactatcaaaataaaattttaggtcagggatcagtaacccatatgtgtgcaggggctaggcaggtaaccccaattaactgacggagacttcttgtaagagcatggggtgcccacattacctggaggatactgtctggttaaaaggggcactcatagctcagctcctgtgatggctgccatgtggacacataggctcactgttgccatgtgggaattagagttagtgatttatttcaagaggatcagaaatctagacttttagatctaatatactatgctttaaaactcctctctctctctctctctctctctctctctctctctctctctctctctccttacacactgaaggccagacaacacatctacagggtgcagatgacctatgggcagccacactgtgatgcctgtgtgagggcctaaacttcagggaggaagaaagtgaggtcagatcctgagggagcacttgctctcctgcagcaggcatgggggagcacctgactgctgaggatggcttcggaacatttgtgtgaagagggataacagatgctgcatgccagagggatggtggccataggccgcaagattcggttcttctggccgcagaagaccctgacttcacctttcaggcctctgtttccttatcaacgaaataagagcatgtgattaattctgcaggtgcttccagcttggacttttttgcaaatattttcattcaactcactttagaaacctgcagggagtctctctttgcaattccagaaaaatcagcatttttgtcaaagacattttggatgcccatcttcgggaggatggtttccagattgtaggaggcagaaatggaaaatctggggatgaacacctctatccacctgtggagtagggaaaaggaaacaatgaggtcacaagcccatggtgtctgcatctctgctcctagatgccattttgggagactccgttcttcctccaaccactgctaatttctgctaaaaaggtcaacacatcctagccaagaaacccaggttgctcttgaaataagcctcccagctgagcaggtccagcactaaaaacatgcaaggagatagacgagcccccagtgaagtgggtgcagaggtgaaaaagcagtcagcaagggagtctatggcagaaaccaacaggagacgtccagtagcaatggaagctcatcaaccacccactcactgtccggaatacctcctcagcagcacttcctgatgcaagccctgctaataatgccctagagcagcaaagtccagcagaacttcctgtgatgctgggaagatcctagacctgcactctccagtacggtagccattagccatgtgtggctactgagcaacttaaacagtggcttgtgcaaatgagaaactaaaatgttaattttactacatttcagttaacttaagtgtaaattactgcaggtggcttagcggctactatattgaacagcaccacctgataatttagcacaatattttttttcctctgcaatggtttccctgaaccaagagtaaacagcccacatgtgttgaacttcttttttttaagatggagtctcactctgtcgctcaggctggagtgcaatggcacagtctctgctcactgcaacctccaccccgtgggttcaagtgtttctcctgcctcagcctcccaagtagctgggattacaggtgtacgtggccatgcccggctaatttttttgtattttagtagagacagggtttcaccgtgttgcccaggctggtcttgaactcctgagctcaggcaatccacccgcctcggcttcccaaagtgctaggattacaggcgtgagtccagcctgaacatttattatatgccagacattgtcccaggcacattcaacaacacttcccccttttaaagacggtaaagcttacttttagtgctttgcccaaggttatgtacttagtgactcacagcaacgaaagcacaaaaatattggatggacacatttcagtcctcatctgacaggtgtcttgtgacccctcatgccagggacagctctcttttccctgccactgtcctctttccctgttttctctgtgctccatctgctgctctgtactctgtccctccctccctgaaattctgtgccacctcctcttcctatccccagccccagatgcagcctgagaagagaagaaatcgctgacacaccctgcagcatctcttcatccttaactttgagtttttgccagtgctgtgtcctctaccaaagctgcccttgccaagcctctgtgtgctcatatgctacccacatgtgcagctaaaccccaccgcctccttgaagctgtccctcagtcccagctgaaagtgatctctctctgctcagaaactcctcagcacctttcctgccctcccgtggggcattgcccaatctctttcttgaattccagttacactgcagccttccttctctcttcccagactatgagcaccagggaacgctgctaaaatcattctaagatgccaaaaatatattgctaagagacagaacataaaacgtggacattccttttttatctcatgattaatctttttgctattctccatattttttgtactcaccatactaattacagaactaataataacattattagctagcatttactgaacacttactatcttctaggaattcttctaagcactttgtaagtagcaggttactttaccttttcaccaacctttggatttggtaatattgttatcctctttcttatatgtgaccaccaatgcttttgtttgctagcttttatgggatcattccatagatttcaatatcagataggcttctagagccagctctgcaagcatataacagctacatgaccttgggcaattcacttaccccttggagcctccatttcctcatctgtgtaatgagtggtactaagactcctcatcaggtgatagtgaacttcaagtgtgaacatgtatagacagccccaggctctctgtcctgcatgcagttggtgctcactgtgcagaagtgattatccaacagctgttagcacaatctctccctcatctttgaatgtgtgcatcccctgcctcagggcccaggagattgacacagatgcccaccttttctggagtgagtggctccactttctcagtgttctggctgacaaggcctgttccagttgcctcatcttgcccttgctagggaggacaaagaaggccacggcatctcccttgtaatccatctgcagcacaaagcagttcagctctgtatccaccccaaaagcgaactgctctttctggtgcatcatggggacatgcacagtgacctgctcgcccaccaggaatgggaagttctttcttgtatattcagggtgaaagggcttctcccacttggctagcacaaagagagaaaagaagtctttatgtcaaagtacaattagtgaggcaaagacagcaaactgaaatggggaattacttctagtgggtatgaggtttctttttgaggtgacaaaaaaatgctctgatattacacagcggagtagttgcccaaacttgtgaatatactaaaaagcaataaaatggtgaattttatgacatgtgaattgtatttcaattaaaaatagaattagttaaatagaacaacataaactgaaggtaacttagtaagggctcaaaccataccagttttctttccttctctttcctctttgcaggatggatggataaatgggtggatagcctggcagatggagggtggatggatagatgaatagctaatggataaatggttggctggctgggtggatagatggattaatggatgaatggatggatggatgaaccgatagagggatagatagatgaatagattagtggataggtggttggctagctagatggctagctaggtggatgaatggatgcatggatggatggatggatggatggatggatggatagatggatgaactgatggatggataaatgggtggatagtttgctggatgggtagatgaagggtggagggatgaacaggttaatggataaatggttggctgtctgggtggatagatggatgtatgcatggattcatggatgaatgacagatggataaatgggtggatagtttggtgaatgggcagatatagggtggatagatacatgaatagattaatggacaggtggttggctagctaggtggatgaatggatgcatggatggatggatgaactgatggatggacaaatggatggatagcttggtgaatgggtagatggatagatgaatacgttaatggatagatggctggctggttggttaggcgcatgcctggatggatggacagataaactagtgcatggataaatgagtgaacatgtggatgaagggagggaggaaggaagggaaggagagggacagaggaagggagggatgatacggtggcatccatgaaaactctgcctggagatgccaggcacttctatctcaagcacaacctataaagttggctttatcatcagagtatccagtcagcacagagactggcacaggtcaggcactcaacacatggtaaatcttttagagacacatgctgaggatcatagagcaagtatggggtagaggtgaaattcaaattcaagttgtttgactttaaagctgatgtgcattccctgcaatacagtgaaactgtaaagctctaacatatatctacatctatatctatatctatatgcagttatatatgaaggagacttcatatatataagggatacgaatgacaggcacatcagcttgtctacatttctacacctatgaaagtgttcacactcttggatttgcttcttaaactgggttgtcagagagttccatgtttctttctaaaactttcaaggggcagtgggacagctgctggtggcaagagatcttttctctcaagtagtctccagatttttcctgtgggtttcccactgagtcaaatgtaaacacacctcaagacacttaatctgtctacccaaagagaactaaatgagtccctactgtaactggtaaacatgagctatcctaggtcctgcagccagctaattgcaaagctaattagagctcaggccctcccatttctccaccctgcagtctagggtttgtctggcttgtgtatttcactaagcaaaaatcatcatcatcatcataaaataaataaataaaaatcaacttctcaaatccttacctttaaagaaaatgtggttcaccagaaccatggccgtcagaaggtcaaggccttggattatgtctacaaccttcccttgggtcttctttttcacatggctgttgatcctcgcctgggcaatggaggggttggagaaatctgtagaaaagacttctgcttcatacagcctcttgacattgcccaagaaatttgcctgcagctgcagctccttcttgacgaagagggcacttcccatcttcaaggtcaggtctttgctgggaacagtcagtgagtgaaccaggtgctggaagccctggtggatggcagactctggtgtgtgtgtgaggttgaagcccaggccctggagaatctgggtcttggtgactgagtgggccccaagggagagcatggccagggaagtggagacactcacaggggagaagaagatgttctgactcggggtctccaaaaccagcctgcggtataggcggaaggcaaagtcggtgttgagggaatacacctgtgaggcaggggtgctctttgtggaggaagggcgggggtatgcactgggggcattggccggggacacacagtagattggagcacagaggccaacagcaaagagtactccataaaggtaagatgccattttggaacaaaatatgtctgcaagagaagtaagaaccattgagggggtaaactgagggtccaggccctgaatcagagaccctttaacacccccacgccatcagcagcagaatgaggacagataggccagttagcagagctctctcacataatctctgagcctcacaatattcccatgatgtagatcttattattgctgttttacttgcaaatgagtaaacaggccacagagagtctgtgcaacttaccccaaatagcatggttgacttgtctgtgttctgtgtgggcttcaaagtcaggtctcaaattccaaatcccatgctttttgatgtttctgcttcatggacttattttttaagaattgagtatgtgaacccagattgcattagcagccagaagtggtttctcaccctttggaggtccctccacacattctttatccattttgtgtagatctgattattttctcaccctggctgcctgttcccagacacaggcattttactaatgtgttcatatctctcaaaaagtggaaacctggagcaaaaggctgtcctttttgctgtgctccttcaggtgccctgagcactggcagtcagttgctgatgagctgcagttctagtcacatctgtctgcttccccttcaagcctcagctgacatggctttggccccaaggagacttcagactaaatgacctgatagcaatttcaaaccccaacagggctgggcttgaatctaaccctgacattcgtggtggacaagtaacctctctggacttctctgttttgcctttgtaaaacagagatagttaccttacagagttgttcagaggactgagtgtgataaggcacaaattgtgcagcacgggacccagcacatggtgagcgctgaatacattacttttactgttgttttgttgaagtcagagagaatttgattggagcaactctatcaagtactgctcacaggtctccccagccctgcctacagcaccctcacctgttcagtttcatcagaaagatttcatttcctttaacacaactttacagaggagctccaaccctgtgcgttgaccctgagatacaacagtaagtggtcattttagagaaggaaggtgtatgaatccaatgcaaggccaggggaggtctgtgctcagccagaggggaaagcaaagcaggtgtgtgctccaataggtcacatccgtctgaaggcttttctcttctcacaaattttataatttcccccccatgacctggatgtccttccccccatcatccttttcacaagcacagtgccttcataatcccccttgcccttcatcagactttgctctttagtcatttatactacagtgtgaatggctgccaccaactcttctcctaggagcaccggcatgaagtgttactcctgattgtgaaggaaagactttacccactggaacaagaattcagtcaataagtgaacaattattttgccagaaatggagaaggaaaagataagagaacctttgccaaaagcgacaaaaatattgccacacatagtcacttgtctatgtcagaccaagcataatgtgacagccacattcccaacaatttctctgtggaaatgaaatatgtaaatgaatcacattttattataccagatataatttaacttagatggaactttataaagaacccttttactgaatgagtaattcttttgcaaacctgttcatttctctccatttccacttatgtgattggcgatttctgttgtgtagttttgtatttgcctgtttgactaaagtggaattttctttctaagttacattcgcatccatccatccacctactggactctttgccaacctgttctgaactgacctccagagctgcccccaccctgagtgccccatctctccctttctccaagaaggccattttacccatgctgccatcttccaagtcaggagactgatggccactctgcactcttcggccaccctccttccccacatcgttcttcctccccgagacatcgcaagccccagcttctctccatctctttgcttttcccttggtccaaaccctccttatctctcccctggacaatcctgaaggcttctggactcatctccctcctctggtcatgcttcctcaaaacgtttttcttaagaaacttcaccaatttgactctgcacagagacgatctactgggagatagaagtgttggggctacaatgggggacagatagccagggtcctggctcttaaagagttctctgggaaccctatgacatgtggccttgagagttgactgcttcccctctcttcggccccactgctggccagtgaatttatctgcagcctctgcagtcaacaccaatagcaacagcccagggtccacctccctcccttctcttcccactcacctaccccttgctcaggcatagcatactctgctacaaatgcccctcctggatgccaccttcctttgctaatggaaaagcccttgtttctcactctggaagactctacttagctattaccggcttgagaggccctccctggctcccctctcctgttgtgacttcatcactctctcccttctctcttctggcacttctgaaatttactcgacttctattaccaaatggattatcactgaccacacgcgtgcctttagataatctctaggttctttgaatgtgtaatttatgcatttggtccattgggttgaacatgtacgcttattatgcaggtactataggaggtgttggggctacaatgagggacagagagacagggtccttgttcttaaggagcccactgggaagacagacaattagcaaacaccactagacacaagaagtgtgtgtgtgtgatgagtaagtacaggcattgggaacacctattccataacaagaaaggcttccagtggaagtggcagctgattgaaacttgaaaaatgttagcaaggtaaaagggaaaagcagagaagagagagattcaggctgggaggaccacctgtgcaagggcccagagggaaccagagccaggcagctttgaggaacagaaaaggttctgacacagatttcagcaccacagaagccggcaggaagggctggggagcaggagagaccagctgccgagagagggggccccatgcagggatgtgcggacttggttctgtgccctggaacccactgggggatggctgcagagaacctcagcagcagagaattctcaagactatccctgcacctgtctgtgttcctcattgctctacacacctgcttcctgtcctccttcccccttcccccaccagcacggaaaagtgcccaatgtatgggctcagtagacacttggtgtgctgccctgagatggagaagcatttacaccagcctcagaactggggtggtggctgggcgcggtggctcacgcctgtaatcctagcactttcgaggcaggtggatcacctgagatcaggagttccagaccagcctggccaacgtggcaaaaccccatctctactaaaaatgcaaaagttagccaggcttggtggcgggcacctctagtcccagctactccggaggctgagacaggagaatcacttgaacccgggaggcggaagttgcagtgagtcgagatcaggccattgcactccagcctgggcaacaagagtgaaactctgtctcaaaaaaaaaaaaaaaaaaaaagcaacaacaacaaaaaaccagggaggtgaaatgaaggaggcctcctggaatataagactgaaaccctgagtttctcttatttgatgagctctgtgacagactggggctcttcaggacgccgtgtaagagtgtggcatctgcaggcttccctgtgacaagctggggtctactgtgttaacttggggtctgcaggccctctagcctcaatggtgaagtggcagcacttgatcttgacggccactcagaagtcagagcctaagcaagatcatggttcccctcctaacctcagagcagtactttctgtttagagaacagcattgtcctcgaattgcttcatcttctgaattgcgtcaaccctgatctgtaaggagggcagttctgaggaagggcgagacaacgtctgcagaacgcccagtgcggcatccagcccatggtgggcaggagaccaaagctgcatctctcttgtggctcttatgattttgtgtccctcccttggaatcagggtgaaggaataggattgtccctggctattcatgaccatgggagaggagaccaggttgaaggaagaggacatcagccacatggaggggaagcgggtgctgccaggcgccaggatgccacaagcaccaggggtctgtgcccctttctgtggaggctggcagtggggcaggtggctctcagggggcccccactgacgctgggttgtgcctcctaaagaatccgcattcccatcagcagaggtggcctattagacgcggcctccacgccccaagtcttgtttcttttgggcttgggttgagtaggggagacccacctgaagtcggggagttggctagtaaatgtcctgagtcatcgatggtactggcctccatgtgacttcaggtaagtctctgcttttcacaagacttcaggaagaggtggtctcaaaaggccctctcttctgagtctgggatctatgtctgagggcccccaggtcattgctctcttgggggaaaaccgtggccaaagctcattcagtcagctcttaaaatccaccacactccccactttgcttctccccaccctgaactcctgtcctcctgtggccaccccttctctctcccagccctgccaaggcccttgcccctcttttggctgtggcccgggtttatgtgagcgttcggccagggggcactgctcgttggggtgacagggacactctgccgtccccagggcttgcctcttctggacctctccctcccagctaccacagcctgcattccaccttccattgtctctcactcactcccatctccaagcgctcctccaccctgcagacagggtgacctttccagatgctgatctggtgtatcactcacctcacctcgaattcctcaatggctccccattgagctcagaaaaaatgctcaagcccctgacattcaagagctttatttattgggccctgactcacctccccagctgcatctttgaggacccagctgtttgcattcctcaattccaccccatcccctatcttcgtttgcctctttatccagcttgggtgtcaagggcttcattttaatctactgtgcttcacccccaggcctgtgtcttcatgtcccagccctgtggcaaggctccatgtgtggtagaacctacctgtctgctccttccctgccaagtgctgctggaagaggggttctgcaaggcagcctcgtccactgtgggttcccaaccaccagcctttatccacccggcaacatgtaactcatcagctcactctcccattttcagggaaaagcttcaccttttccatgtccttaacctttttattccagggtggaatggatgcccaccctgctacatgtgtgctacatatgcatgtgtgcctacatgtgcacacacacacacacatacacacacacacacacacacacacactgagcagacaaccttgcctcctatctcacataaaagagagatcctatgaaaaggaattgtctcaacttccctcaaagggcatcctctctgcctatccctactttcccagtcgcccctctctctcccctacacctccactccaccaataaagcagaggatcggccctcctttgaggtccagtcccccttcctgggccttagaaagtatctcttctctccatctcaggacccttccacctctcttttctgcacttaaacactccctctcaagctgatccttgctgttagtttggaaactgttcaagtcttgctcgttaagacaaagaaaccaacaacgacacaacaacaaaaacactcctttcaccctctcatttgcttctagcagctgccctatttcaatactcctccccttgtggcccaaattttcaagagctgtgtattcatggtctctgtggccttacctccaactcactcactggtccactccagcctggcttctgtatccacaaaaatgtgacccagatgctactaaaagccaactaatgtgtctaggttctcatcttatttgacttcccagctgcatttgacactgaagaccatgctctgatccagtccttccctctggctcagtgacaccacattcccgatctctctgcacctcctccttacccacctttgcaggttcctcttctcctgccctgtccttgcatggttggtgagccctgacacttgcttacttggttgtagctctctcctcactttaatctctcctctccctccagctgatctcatgccacgacacccatgacttcattactaagacatgcaaatgatatattatttttattctccagctagacatgcaaatgatatattatttttattctccagctcaatcctttcctctgatctctacatgtctaacttcctacttgatatctcctcctgatgttgcaaataaaccttacatgcaatatgaaccacagtgaactcagactccttcccaagaaccatctcccagcaacagccacaaccgaaacctcttttcaacatttctgtcactgggtccaccattcacctggttagttgagcctaggaggggcatccttgcacttccttcttcttcatgtcaacttatgcccagttttgtcaactttacctcctgaatgttgctcaagtccatccacttttctctgcctccactctagcaggccagttgggctgtcattgtgtcttgcctgggctaccacagagcttcctaacagctctctctgcataccctgtcctgctcctccaattcactctgcacatgacagctagaatagtcttttaaaactcaaacctgactgtgtcacttagtatttaaaatgtctcaattgcctcccgtttcccaaagtaaacactgaagtcttaacttgcattgcctggcctctgcgggctcctctaagttcatcacagatcatgaagccccttgcccttgacatccatgttagcccattctgctgatttttttttttatgctcacatgtgatatttgttgtttcctactcctggaatatccttccaactctcttcatctgacttttcccctaattaatttttattcattatttaggccctagtttgtgtgatttcctcaaggaaactctctttgaccactgaaataagaaaactttctcccagcagctatttttatagtaccatcaacttctcagtgaaacacttatcactgtcatagtttcacatttatttgtgtgactgaacaattcatgaatcagggatcctgtctaccttaattttgtctacttgtgcacccactctttggccaatactcacggttcagtaagtggttgctaaaagaataaatgaattgaaataaaatgaaataatccatttatctttgaagagtaatcctgactggtaataagcaaggggaactcagggtgatggaaagtcctgtagctacttaaggtaaagttacacaggtatatatgtaaagtttgagttgacttacacttttggccaaaacaaagtaactgatattggttgcaaactgttgtaaacagaaaactagacaaaatttatgacactattgagatactcgaaaaatacatataacaattcagacattagagaacaggcagggaaggtaaaaaatgagataagctctacaattgtcccaattttctgcctaaggatactttctggacgtgtggaagaaaacccaaggagggcatgggaggcttgctgagcttaggagacagacattagagtttgagaaaactgaggaagctataatttgtgcagtgaagtactagaggagagctttagaaatgttcataggggtctctttaagtccaaagctaagtactaagctctgcatgcataaagtgaaattccacatggctggtccacacacacacacacacacacacacacacacacacacacacacacacacgaaaaaataaacctactgtgaaggtataagcaaaataatttccagagttcacaaagcataggatatattaaggttatgcacccaaagtggagagacctggaacattcagtagagacccagaagtgtcacatcttggcattagggctaaactaactttgaattaaagctgcactagacccaccctaacaaagtttaaaaacatgccttgacaagctcaaacagatctgtaagtaacgtattgcctgttaaaacaaatgtcaaacactgtaaaggaagacaacaaaattgtaatattatgatgtccagcatccaattaaaaattgctagaccttctaggactaggaaaatgtgacccatgaccagaagaaaaattaagcaatataaacaggctcagacataatagagattaaggaatttgtagacaaggactttaaaacagttacttaaaatatgcttaaataataaaaatgttactgtaatgtgggaaaaatcaaacttctagagatgaaaaacttaatatctgaaatgaaaaattcactggctgggtttaacagcaaatttagtactatagaagaaaagatctgtgatcttgaaaacatatcaataggaactattcaaactgaagacagcaagctggaaaataataataataaaaaacaagtcccagtgacttgtgggacaacatcaatggtctaacatatgtgtaattggagtcctaggcaaaaaaaagtgagggacagtggagaacagaaaaatttgaagaaatagtgggcagaaatatttgtgtactttatgtgaactatacctaaataaaaatcaaaatacaataagttgaaatgaatgccaccctgctgtttcttcctctactctctatgattacacacatatctcagttggcttggactacctatctcattctctttgcctgacacactccttcccatcctgccagctccagctcaaaatcacccactgcacaaagtcttctctagatcccacagaaagtctgcccctccctttacaaacacctggagcaaaccagggcagtttatcttcttatatgtcggtctccctgattagacagtctggactttgtgaggcatcctccagagtcgggactatgatcagtaagtaatagagaggtagcagattgcatgggaaggagaaagtgggagggatgttgggaatcctgaggaccaggcactattggctcatccacacccagggacttttgtagagactcatagttggtaaaacacagagaggcagcctaaagaagtatggaacttaccaagcgtaattgggctctcattaaaatgcaaatttccaggtcccatgcagaactacctaatcagattttccagggaaagatgagaagacttgagagtggggagggctgtgtgcttcctcttcctacccttcaccccaccttctgtccttgccccagagagaagctcttcagggtttcctctagctctgaggtcctcagttcctggggcctcagggccaccttgaaagtaaagacccatttctccccaaattcataaaaccaagcctgctggagtagcaaccagccaggagtagatccccatgggcccatcaagatggagccttctcccaagtccatactcctccatggagcctctcctgctatgtccaggcctttctgggatcctcttaggactctggctacaggatctcttgcctgcctcacacattcttatgcttctgctccacttctggtttattggagatactcatactatttaaaaaatctggctacatctttatacttttctatttcaatacttgttttaatatttcacccattgtttctcctaacagtggagcagattgggtacctcaaggctactcttggagtgccatcttagctagagggtacccttcggattgtcaagaagcctccccagctgagttccacagtcctcaccatggatctgtttcaggaagtgcagctccctgccaccctttctgctgcaacattgttcatttcctagcctgcccagtgtgatcccctgacttctaggaatctgaaccaagctgagggtagagatagggaagggagatagaaccagacaggaccccaagccttgaggaattttgtctgtctgttaattagtctagggttttgttttttttttgttttttggcaaggggtcattatttcaacatcatgggacacatgagattcctgccccagcagggatcttcatcctggagagcccctttttctgccttgcccaggaatctgtgattcctctgttcacatcatggtgaagaaaacagctacggaaaagctgtctgtgctggaaggacattcaatcttcatggaagcccacccagtggactacccttcctgctctggaggcctctaaaagccaatactctatggatgcatgcccagcagatgccaagtgggttcgtgtaacctatagcattgaattctcccaagaccctgaaagatcagtattactatccccacatcatacagatgcaaaactaaggactggtccaccaagggatgtgcctaatgtcacaaaccaaataaatggcacagctgtgaatttgacctcagcctgtctaactccagggcttcctaccaatctccagccacctgacgcatttttcaaagtctttaaaataaaagaccactatatgtgacgtgtatcctggattggatcctggaacagaaaaaaaaaatattcatttaaaaagatggcgaaattcaaataaattctgtagtttagtgaatagtaagctagcaacattggttcctcagctgtgaccgacgtctcacagtcatggaagatgttagcattaggtgaagctgttgaagggtgcatggaaactcagtggactctcttcacatcttttctgtgaagctacaattattccaaaatttaaaaagaagaaagtaaagccaatcagtcaaggacataaatcaagaaaacattccaaccttggccgaggtctccagggatcagggagatgactgctctgttcacaaggtaaacaatctcagtggtttctgcccacgatgtggaatcactcagtgtcaaagtcctccctcttccagctctcttttgatcattctgagttcccccaggagtgagtctcagcttgatgccagcccatctttaccaccatctcagacttgctgactttcctttctaacaagggtgagtaaaccacaggctgggagcctgcaatctgtgacagtcttggttgaatttaatcactgaattagttttgttgtgtgcatttttactttctacttgtggcaagttgtgctagtttctatgtatgactgcaatattaatttttctatttaagcaaattttcttttcctaacatgaattgatttaaggataggccttgagcaaataacgtacaaaagagaggggaatttagtcctaatcatgaaaatggtttgggagtaaataaaatttgagaaactgagcgctaatggagagctggtttcccaaagagaaagggcaccttggctttgcacccctgtgggaacacctgagcactgatgtggtgactcagtggggtaggatacgtgttcctggctggttctgaaggggagactagaaaatggggaggaagcagaccatgtgacctcagctctgcttgaacaaggttcctgtctctcctgtccatcctggcttctccatccctggaacacagcctggcacacagaagattcccagtaagtatttattgactaaacaaatgcaagggagaatgactatacataaaactttcgagccagttctatcatttccaatatgaacatcaaagtattgcccaaaatagaagggtcttctgggggcatccagggcaacctcatcattgcacaaatgggcagtggaagcccaacaggaagaaggtatttgctccagccacacagtcagtgtctgggaaaagcagggccaagaactaggacttcccttctgtgatcattcttgccaacacaccagtctgtcacttctgttatgcgcccacatgaatgacctcagcccaggcaggcagtgctgcaggcagagtgggggcagacagcaaaccagactcctggcacccagcctatgctggaagaggtagaaagtcccctgctcggaggctgcacagaggttttctgtatcgtgtaggtcaaactggaccacaccaaggcagcctgtctctcctgggcctctgacactgggcaccctcattcttggttagggtgaatccttcctttatgcatcaagtccacctttgctgtagggaaaagaaagagagatcagactgttgctgtgtctatgtagaaagggaagacataagaaactccattttgacctgtaccctgaacaattgctttgccctgagatgctgttaatctgtaactttgccccagccttgagctcacaaaaacatgtgttgtatggaatcaaggtttaagggatctagggctgtgcaggatgtgccttgttaacaaaatgtttacaggcagtgtgcttggtaaaagtcatcgccattctccagtctcgataaaccaggggcacaatgcactgcagaaagctgcagggacctctgctctggaaagccaggtattgtccaaggtttctccccatgtgatagcctgagatatggcctcatgggatgggaaagacctgactgtcccccagcccaacacccatgaagggtctgtgctgaggaggattagtaaaagaggaaggcctcttgcagttgagatagaggaaggcctgtttctcctgcccgctcctggcaggagaaactcggtataaaactcggtataaaactcaattgtacatttgttcaattctaagataagagaaaaactgccctgcggtaggaggcgagacatgttggcagcaatgctgctttattattctttactccactgagatgtttggtggacagaaacataaatctggcctacgtgcacatccaggcatagtaccttcccttgaacttatttgtgacacagattcctttgctcacatgttctcttgctgaccttctccccactatcgccctgctctcctactgcattcctcttgctgacatagtgaaaatagtaatcaataaatactgagggaactcagagaccagtgtcggtgcaggtcctccgtatgctgagcgccggtcccctgggcccacttttctttctctatattttctctctgtgtcttatttcttttctcagtctctcatgccacctgacgagaattacccacaagtgtggaggggctggccctcttcatttgcatgggcatttcccaggctaaagcctccagaggactgtgcagcagagatctcagagaggcgaaccataaaacccactgtctcagcctcccgggaggctggctgtgacccctgccagcgccactggcaccgctagtcacccttacccactccacttaatgtctcttctcttctctcctctcctttcttttttaacggagtcttgttctgtcacccaggctggagcgcagtggtgccatcttggctcactgcaacctctgcctcctaggttcaagtgattctcctgcctcagcctcccaattagctgggattacaggtgcatgccaccatgcctggctaatttctgtatttttagtaaagacggggtttccccatattggccaggctggtatgtccttatttcttgatcacacctattgttaatttcctgcctctcccgagtaacacgagacctctgcaagggcaaggatctttctatattttattcacaaaaccctaaaacccctctttgtccccgcatggagaggacactcagtgaatatttgttgaatggatggatgaactgatgggataaataaaagccacaagtgttcgggggatttgtatttgctcctacctctgtggcagtctagctgtgggaccttgtgcaattgatgtgatcttcctaagcctccgttttctcatcagtaaaatgggatggtcacaccaaccggaagggttgtgggccagtgagatggggaaagcacttgtgtcgtgtcaggctttgataggcatctaggaagtgtcggttatgtcaaaatcaaaatccagtcattcatacactcatttattcacaaggttggtcagcccacaaatatgtgacctgggaaggcttctgagaaggagaaggggtgaaccctctctgaaagactgagtaacatgctggaaggaagtcgtgggagtgggagaggatgaggagcaaggagagcatccaggcagggtgggaagatgtagggaggtggcacacagacctacaagaaggagcaggcatggtcacatcctagtgggcaggcctgcgggactaaggcatgtgactcccctcccagaggagaggggagctttggagggggctgaccgtgtctggacaaggatgattagcagggcagtttttctttccagcaaatacgtgttgggtgtgtgctctgtggcaggtaccggcctgggtatgggggatacaaggacacaagtctgcaggcagagggacataaaacacatgggctttcctgagtcactctcaaactgcacacctgctgaagcccgccagagttcttcaattaaagaccagcatccctctgtggcccatgagttcccacctacctcttggccccgctcccaccccttcttgcttactgatctcatttcagctcctcacccgtgccactcctgacctcaggacctttgcacatgctgttctcgctgcttggtggggcctccctgggctcccaccctcatttcttcctcttttttttttctttttcaaaatagaatttatttgtgcagtgaataatacaaatgtggctatgaaagcagaacatgatatttaaaaatatttaaggtatgcaacagtcattttaaaaacagaattagttaaaaggaagatgaataaagaactcgagcttatgcctgatttctattggtatacttagaaataccaatcagtatttaacatattattaactatgctggaaaaaacacctctatatgcagttttaattcctaactacagtttaaaaacagatgagttcccagcatttggagctcctcctaaatattacatcctggggaagcctttcttgggcccccggactggacgcgacctgtgacatgcgacccccggactggacacgacccttctgtgacaccctttgcaagctctgcgatgtctccttcactgtgcccactgcagctcatgacaaacatgtgtttattggattcatggtggcttccctcactgattattaaccccaggaaggcagaaaccggtctacatatatcaacaatgagctcagagattgcagcccagaagtcatcatttaatggaggactgactgcagcccacagggggctggagggaacattcagacccacctgccatcgccatgcatggatgtaagggttttggaaggctgcttggaagaggctgcttgggagatgttggaaaggtagagaagagttcataaagaggtcctagtggcctgggtattaaagggtgaggaagagtttgttaggctggaggagggaattcccattagaggagatggtagaagcactggagggggctggtggaggaccgcagcaggggctctctactgcatgcccacgtgccaggcacaatggccatgcaagctcacgtgatcctcagaggtagataggtagatagagggtattagtctctagcttagccgctggaggtagatattatgatcctctctcaataaatgaagcggctaaggctcagaaaggtttagtgatatgcccaggtcacctggccactcggtggctttcctggcagtgtcacttccccagtgtcatatgttgcgcacctgagaccgtagctaagggtttctgtgtctttctatacccacccctcaggctggggcaggggaaatgatgtcggcaaagggctcggccgggattcccagcctttttcccacgtctgtgtccctgtgcggggtctcaaccttctccctcacccccaccctctcgaaaaggggctgcgcaccctgggctcctgggctcagccctcaccaccgtccacttgccctgcccctcccccatcacccgcaggcagccttctccaccagcctttggggactcttgccttcctgccccaaaccagaagatggggcacttgctgcatgtggctaaccctgaggccacgagaaagccacgtcacctctctgagcctcagtttccatgtctgttatagggacgcccactctggctgctctgagagcacctgtgaccagaacacaaaggacaccatgagctgcaaactgctaaacacgcccgggaaatgataagtagtgccagtcgaggctcctcagtgccaagccagccagtatcctctcctctccaaaca

SEQ ID NO: 303 - DNA, 20794 bp, Homo sapiens
ggagtcagagctccgcagggccaagtcccgctcctgcctggtcatgtgcttcatgctcatagtcatgtaaccttctgcgcgatcaaggctccctgaagtggcatttctttatctcacccctgggggaacctggccactctaagaccacatgaggacgtgaaaaccaagtgacatttacacctgtcagctgttcttcctcactctccccaaccccttcctacttttgcagggagaagaggactgttgggtggttgggcggtcagaggctgaggccagagaggtagcagcggaactgacagggaggccaggggcagagctgaccctggagaggggtgagtgcctgagctggggagggatgtacaggggagcgggggcctgggcatctgggcctttgaggggaacagatcccaagatacagaaggtagggtcaggaaagttgggaatggagccaaaggggacagccctggtctctgggggtgggggttggcctagaatggtggcagcagtggtctgaggtcctagaagccaaggttccaactgtccccattctttttctgtttcccagatcctgatgtcctagacacatggttttcttctgccctgttccccttttctgccctgggctggccccaagaggtgaggtgggttgagagggcgaaagtgaaggggaaacgataaggaagggatggctgggcccccacagaggcttgaggggggcctggggcctgggcctcttactgctcctcttccccctagaccccagaccttgctcgtttctaccccctgtcacttttggaaacgggcagcgaccttctgctgttctgggtgggccgcatggtcatgttggggacccagctcacagggcagctgcccttcagcaaggtaagagcccttcagtgccctgccgctttctgtgactccagtgttccccaaaccttgtcctcccttctaacccctaatgtggtcctttccacgttgctgattcctttttcctaattcacttcctaccctacccccaaaagtatggaggccagagatcccaaggcacctccaaggaaacccccctctgttgacccctccctgcccccaggtgcttcttcatcccatggttcgggacaggcagggccggaagatgagcaagtccctggggaatgtgctggacccaagagacatcatcagtggggtggagatgcaggtgaggacgaagcacccactagagggacaaggtttgcagggtttgcaggagagaggaaggcaggctgagggaggagtgaggccagcaggtgtgacccttatagaggcagggccttcgacctgggtcgtgaattgcccccttccatccccaggtgctgcaggaaaagctgagaagcggaaatttggaccctgcagagctggccattgtggctgcagcacaggtgagtcatcgctgcctgccccccaccagctctagctcaccacctctggcttcctctgcaacccaggtcctggccctgcagccacaaaggcatctgccacccttcttcttcctctggttgcagaaaaaggactttcctcacgggatccctgagtgtgggacagatgccctgagattcacactctgctcccatggagttcagggtaagcctgggcgaggggtgtcggggtgagcagagggcagcgggcacctgtgcaggggcagggcaggggcaggacttctggtgctgctgccacctacatgcagactacctcgattcttcccttccagcgggcgacttgcacctgtcagtctctgaggtccagagctgccgacatttctgcaacaagatctggaatgctcttcgctttatcctcaatgctttaggggagaaatttgtgccacagcctgctgaggaggtaagagaaaacagaggtgcttgggagtagggtagtcaggtgtcagagggccaaggtggcatctggaaggaaaggaggcaggggagggggagtcaggccatcctgccccctctgcctgcagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggtgagtgaggctgggggaggcttggtattcccatgcctgcttctaattcctctggaaatttccaaggcagagagctctggagttaataagttcccaattgtcccctcagttaggagaggagaggagacgagggagtctcagttcccctcttcctgggactggttttggcagtgcagcccaggcactgttgcctgcctgtcacctggggagaggaggaggagggagacttctagaaatgtctgacaagtcggtgtcagaaggcagaggggaattttttcagtccctgtagttgctgagtttggcccatgggcaggctgcgtgctgagagaggcctgggagggactagcagcggtctttagaccaggggttctcacgctgtcctacgtccaaagcacctggagggcttgttgacggtggatcccccccgctccactgccaccccagagtggctcctttagcaggttggggtgggggtgggtggtgtaatgaatattcatttcttgtcccaagtggtgctgctgctgctggctgtggaccactgccctagctcagccttttaaaaacctctgtcccctgttgataagcaaaaaactcaatgatttttttccctaaactacatgtttccctggaaatcctgtccctgtgtactgcagagaattgctgtcctggagtccccttctttgtgctgagtgtgtcctgggactgtggatcatatcagaagtgctaagtgcttctgcctgtccctctctcccaggacccatggcctgccccactggcgggtagcagtggctgtagggaggagggctgtggccctggacctgtcctctgaccattggcttcctctccaggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggtgagtcccaagcaccttggagtgggtctgtgggtgaatgggggggagcaccttctgaaggggtttgctgcagggggctcatctgcaggaatggttcgtactttactgtggagccctggggaagatggattgttcctgcagggttgctgcgatgaccctagggtcttgagggacagtattagcgtagtgctcaagagcaggactctgttgctagactgctatttttgagctgtgtgatcgagcctcagtttcccgcatgtttaaactaggaacagtaatagtatatgttatggttgtgatgagggttggataagttagtaatagggtgtccccaaaatctcagtgcagctttaataacttcagaaggataaatgctatgaactcacccaaaaattattttaaaatttaactatttaaatttatacttatttggttttgagttttgactaattcattttaaattctaatttatttttggttggccatttcaatcacagcaactaaacaggcatcaaacactgatcatctaaaacctcttaaatgacgcctcactttttgtcatgttccttgagatagtggattttctgtggtgctgaggacagatctcattgccctaaggagatggggtggatgggtcgagaagagagccagcagggttggtactgagtctcccaggagcccctttgccaattctgggtcccccccattgccaggagcactggcgccagccagagctggagcggcgcttctcccgggtccaagaggtcgtgcaggtgctaagggctctccgagccacgtaccagctcaccaaagcccggccccgaggtgaggcaaggcgggtcctgggctcggatccctgcaggaaaagggggctggtggggaaaagagcagagcctgaagggccaacccccccgttaggaggtgcagggtaggaagggaggcaggagctgaggccttgcccctgacagtttctttctttccagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcaggtgaccagaggggatggggagggttagggcaggcttgggaagcatgctgggaggaagggaggggctgggctctataaagtaggggaagggaccttctaatggaggatggaggcctggcagcaggcggatgtctgagccttttctccctgttcttccccagggcctggtggacccgcagatccagctacctctgttagccgcccgaaggtacaagttgcagaagcagcttgacagcctcacagccaggaccccatcagaaggggaggcagggactcagaggcaacaaaaggtaaggctgagggaggcccccagaaggctccacccctgagggaatgtgggccaggaggggcctcattcctggatcctcacctccttttctcctcgtccagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatcccaaacatgtctgtttatggctctttggtcccctttgctcccagtggtgacttttgtgcttctgagttgtcccctgagagcttggtctgggaaaagaggaggaggggtcctcgctggaggaagaggaactttctagtcatgggtagggtatgggcacagtggttccggttctacctactttctggactaactgacagtgccctggcttttgcaggctctttctcctccacttctcactaaatggaagcttccccgctccttggctgtatccctagaggtgctgagagaagtaggacttcctccagacctgatgggctgcaggctgtgctgcagatggtgtgcccccaccttctgtgctctgacacctgagtgcccagcctctgagttacacattcacagcacagccagccaccttacccacgccaaacaccatctcatctccatggaattcaagggcctggcccttccacgcccagagtacattctgtccagcagctctgagtagcctgtcctgggctgggtcctctgtggtgctagatgtacaatgccatttaatcctactgaaaacctcatgaggcgggtgttagctccattttggagatttttatttttactttatttttgggacagggtctcgctctgttgctcaggctggagtgcagtggcataatcatggctcactgtagcctcaacctccagggctctagtgatcctcctgcctcagacttctgagtagctgggaccacaggtgtgcaccactgtgccctgctacttttttttttttttttttttttggaaacggagtcttgctttgtcacctaggctggagtgcactggtgagatcttggctcactgcaacctctacctctctggtacaagtgattctcctgccttagcctcttgagtagctgggattacagttgtctgtcaccacgcccagctaaattttttttgtatttttagtagagacaaggtttcaccatgttggccaggctggttttgaactcctgacctcaagtgatctgcctgcctcggcctcccaaaatgcttggattacaggcatgagccaccatgcccagccctgccctgctaatttttaaaattgttctgtagagatagggttttgccatgttggccagggtggtcttgaacttctgggctcaaataatccacctgccttggcctcccaaggtgttgggattacaagcataaaccactgcgcccagcccccattttggagatgaagacgtgtgctcagagaaaagtctccactgggacctaacccaataaattaggtgcaggctctttctggctgctgtaactaaacttcaaatataatggtggcttagatgaggtggatgtttcttctgctgggcataagtagtgcagagatctgcaataatgggagcccacacctccttcaatcttattttcctgccattctgatgcattgtcaaacttcatgtccaaggtctgcaccagctcccatcaccgtgtctgcatttccacccagagggaggagggaaagaaggggatgggcagttttctttttctttttactctgtttcagcaaggtgttttttttttttttttttttttttttttgagcacctgctatggatgggctgggccttattctggacacttagattcatcagtgagtgaaacaaaattctgtgcccttgtagtactttccttctagcaggacagtcagaaataacatacaaatgagtgaacgatatactatgtttgaatgtcatgaatgcaggggagggaaaaaggatagaacaaggtaaggggactctaatgtgtttgtgtggcggggggcaggttgtacttttaaatagtgggtcagggcagaactcactgtaaaggtgaggtttaagcaaaggcttgtaggaggtataggaagagcgttccagacaaagggaagggccagaggaaaacagatagaggcatggtcagacagctcgaggagtagcctggagaccagtgtggtggggcagagtgagaaggggaggatggtgggaggtggagaaacagaggtgagggtggggaattggtggggggtagggaagactcaaggcggacaatctggggcttgtgtccaaaatggtagccagttggctacctaaagcattaaataaaataaaaacgttcagtttcttagtcgtacttgccatatttcaagtgttttggtagttgcatgtggccagtggctactatgttcgtcagcacggttataaaacatttccatcatcacagaaagttctattggaaagcactgatctaagaccttataggctgtttcaagaactttgcttttcctcctctgaaatggaagctcctttcttttcaaggatactaccagaaagttgcccacctcctttctacttgcatcctattggacagaacgtgatcacatggccacagctagctgcaagggaggctgggaaatgtaatgatccacatgctgagttgaaatctacatgactatccaaaaggaggaggatggctgttaggggggccagttagcagtctctgccacccccaggtctggtgaaccccaaagcactcttcactgcactgctctgttttgagccttgggagacaattctttgagaaaaataatctggaaatcacatcctggtgatctcaggccctgaagtctaggaaccaggttgaggtgcatttagctgtctgctctaccaacctcttggacattcagatatccagtcccccaacttgtttggggatcctcacagctgccccatgggcgtcacctgcccattactgcaggctaggggcaagtcataaaatactagtctcctttggagccccctgctacctctccttgggggctaattgtcccaggacagttgtgaaggaaggtagaccaattttttaagtgttttttttccaccctgccattttctatgctcccctcatcttcagtgatgctccatactgaactcttgttgtcttctgtctccaaaggagtcagtctccaatttcatatggagataatggagggttgtgtaggtgtggggggcagagtgggtaccacagaggacagagagcaatcctatcagtaccccccactgctcaagtctgagctgcaagtttgtgttttgagagctggtgagaagtcaatttttttttttttttttttttttttgagacagagtcttgctctgtagtccaggctggagtgcatggtcttggctcactacagcctctgcttcccaggttcaagcaattctgcctcagctccccgaagtagctgggactacaggcacatgccaccatgtccagctaatttttgtgtttttagtagagatggcgtttcaccatgttggccaggctggtcttgaactcctgacctcaggtgatccacctgacttggcctcccaaagtgctgggattacaggcgtgagtgagccactgcgcctggccaagataatcttgagaaggtggtcaggagtgcctgcctcagaaatcagcataaggaggaccctgaaccccaggggactaggagttatatgttgggaccaggtttccatcctaacagcaatccctaccatcctgccgacgacctataagacaggctgtgatatgtccctaagtagcttccctgtgtgatcctcacaacaacctgatggtgcaggaataatgagaaaaactcagaattgtgtaaaaacaaaacaaaacaacaacaacaaaaaccttcccccaaactgggagggagctgagaggccaaaaagtgactcagacaagtccagcttggtgagtagatgagttttttaggacttacatacaaggcactcctggatggcagcaggacagctttagagatccgtgctgcctcccatgctaaagctgctttcaagctaattttctgactctgccgactgtgtgtgtgcgaatggactgttttccttggtgggttcccagatactctccgggatgtttgggttctcagggacacctgctcctcggccaggcaccgtgaccttggctcgccacctggccttcaggattcaggcagtggcatacaccgttaagtaacctggtaggggacctgtcacactacagcaggtaccatcattgttcccattttgcgagtgaagaaatggaggctccaagaggataagaaacatgcccaggaattcacatgtgggctggtgtcacctcatactcacatggttaaccaggacaggctcagcttgcacctggcctctcctccccagcacttgcgcctggctgggcatcctctcacaagctgaacccgtcatctctcacctgagtgcccacccacctcccaccccaattacctgtgtggatccatgggccaggggaaccatgtcctgggggtgttctgcctatgtctctttctttggtttttgagcccctggccccaatgcttaagcaaagggaaatgaaataaaaatcttgcttaaaccaagacctctgtctagtgcctgacttctccactgctattagatctcaggtgagtgacttgccctctctgagcttcaatttccttatctgtaaaataggataatgatacctagtatgccacattcaagactgctgcaagcatcgaaatagggatgcaggagaaaagcaggacttcaataaatgttgcttctctttattcccaggtgttccaaagatctcaatttggtgtgtgttcctatgcatgcgtatatgtgtgtggtgtgtgtgtccccaaacaactccccagatgccttgtaggcctgtgacactggtgttgagggagacattgtccatccctggaaccctctgctcaacagggggacagtcagagacttgagcatccaacccccacttcctgccagctctgtgctcagggacccacagagtcaagcaagttattgaattcagcataccgaattttatttattgccgctcaggagggtgggggcctgctgaaagacagggtcggggcctgcctcctgcatccccggcccaaaagcccgggccaagaaggacacaggcttcaatggctgtcatgtgttgcagacaacatggtgttgagatcttgcatggtggagggtgacgctggtccctgaagggagatggaggaggaggcagagctgggaacaaagggttaaagggcgccatgtaagagagctctccattcccaccacggagacatccagaccccagcagaggcccaaactgactcacaaacacacagccccatctttccccttccaaagaactaccttttcaagcaattccaggaagctggactcataggaggaatttgtcagaaaagactccttcagcttcagttgcaaagtcatacccggccctgcggatccagaagtacagcttaggacccagcagtcagggctgattcctccggagacacagaaccttcctgctcacgctccccggcacagttcctcttccccagcaatgcccctccagagcctcttggaagctcaggactggggtgtctctgtcactctcagggaccatgaagtcccaccccttttctctggcctcttcttgccacagggacccaggagtcctgccctctagccctcacctgttccatgtgagctgccaaggagggtcaagaggaggacaaggggcagcccagaccccatagtggccactgcgctcctgggatggaggagacactgaagtcccggtggcctctccttaacaggcctgtttctacaccccactcaagccttagcataagtgtttgaggggaaatgggaggaggaatctggtcaactggattttccagttctcccagtaagagaggacccaggagaggaccattcactgtgcttttggggaaaatagaaggaagtcccctcttttccactctgtgtcccacccctcccttgtgtctccaggtttgagggagtgagtgcgggtcctacagacagggaaatggagagggaagcggggaccagggaggcgtccctcctgcaggtgtctgggcccccacccatgcccgggcctcccaaggatctttagagattaattattaactgcagctaattttcatcattcttgacaccgaagggctcaggaatgtgggcccaaaagggaggggtggattaagccaagtttcttccagaacccaggtgtcctgctccctcaggttttttttttttaaacactagtcaagtgcagtagtgaaaagagtagaaggagtagaacaaggagttgggtctataatggactgtgaacactgcttccccagccttggtggctttctagatgagaaatctggtcatgggaacttccattgctgaacattctgttttacttgctctaacgcatcctggattgtcagggggagacacgagtttcctcagacatcctctcactcctgccttgtgcacccatgaaaaggggacacccacctactcccggccgagatgcctacaggcaagcgctgggacaggcaagcacaggacagatgtgcagagggagttactgaccctctttagaaactaggaaagtaaggcacagagagggtaagtgacctgctaaggtcacccagccaacaagtagcagagagattagaacccatccctctagccagacaaagagacacaccagccatggaaacttgcttgaacacacaagggcacaggccagcatcttcctatctgccacttccctatgcagcctctccaccttccccaaagccagcgggactgagcacagagagacagaggcagagagagcactgggcagaggtggggagagcaaaagcaagatggggaaacagagatagaggcctggtctgcactgtaagtgtaaagtgaggcaaccaatgactcccagacttgcacaggacaacaggaagaccacagtgggaagaaagcatggaggagaagagcagcaggcacaggagggacgagcaggaggtagaattgggaacacagagagatcttcctcggagaagagtaagggccctccctccctccctccctcccttcctccctcccttcctccctccctccctccctcctttccttcctttttttttttttttttttttgacagcgtctcatccctgtcgcccaggctggggtgcagtggtgcaatcttctcctggctcagcctcccgagtagctgggattacaggcacccgccaccacagcaggctaatttttgtatttttagtagagacaaggtttcaccatgttggccaggctggtctccaactcctcacctcaggtgatccaccccctcggcctccctgagtgatggaatcacaggcgtgagccaccgcacctggcctcccccacactttctacagccatgtgctaggctcatcactaagtattcctttatagcgcataagcgcctgtgaagtaggtactagattaccccgattttagaggtgaaattaagacttaggccttgtgacttgccagagaatgcacagctcagcagtggtggattccagtgcagtggactcagccctggtactgagcttctgaggattcagggctgtctggctccagagctggggtctgaccttccatatcacactgtccccaaacatgacacgtgtcttccttggtgccccttatctcccctttccccttccctgtcaaaggaatggaaagctctgtcagctgcagccatctaggtgagacacggctcaggtattgaccttcccagcccactcttaggtttccagaaggtcagatgcagtcctagaccctcatggttcccctacaaccccagcttccaaatcctgcttccctgagggactcatacgtcctgacttccaacggttgtacttctaggaacaagaggatgaccttgggataggtcatttgggtctccccttttaaaggagggtctgggctgtgaattgactcagacctgggggacaggtccctagtccaggaagagcccaagggccaggtgggggagcccgcaggctcttactcactctccccctcaccctgtgcttcctgggatcaggctgggacaggttaatcccctgggacaacttggcgacctctctctggggatggagattctggtgttggtggaggccccggcacaactggctctcccgggactcataataggccccagagcctttaaagagcctgggagatgggcctggccaacacacttcaactggtgccatggacactgtgctggtgctgctcctgggcctgcaggccttggccggacccagtgagcacttgggcccagacagggggtcttgaggaaggacatgaatttgggacccagtgggatggccaactcttctaaccctgttctatggtttatcttcttttttcaacagttcagctgaccctactggggacttctgacacagtatccccaggtctcccctgtctctggaagtctccccactgtctctggaagtctctcctctgtctctggagctctccccggtttctggaagtctcccactgtttctggaagtcttcccactatctctggaggtttccccactgtttctgcaactgtccccactatttccaaaagtttccctactgtctctgaaatcttccctctgtctctggaggtctccccactatctctgcaactgtccccactatctctagaagtctccctactgcctctgggagtgtctcaacagtttcttcaaactctgggagttttcccagcagtcctcagtctttagctccagccgtttctgggagcacttcaggaacagtctccacatcatcaggtgatatttctgttgctcaacccatctcgggagaacccttcagctcggtctgtagctctggggtggggcttcctgcaagcctggcagttttccagaacctcagtggaagcagctcccttgcctttgtggctatacaagggcctctctttctgttttccaattcatcacctttttctgtcatgattagttcctgttgtatcctaagacttttttggctacttcaaggtcatgaaaatattctcctctgcattcttccagaaacgttattattttagctttcaaatttaagtctattatccatctcaagttaatttctgtgtatggagcgaggtggaagtcaagattcattttttcttcttatgaatatccagaaccattatttccaaggaccctcccctgtccctgccattgaacggtgagcacctatcctgaaagtcaagtgactatttgtgtgggtttttcggtaagttttttttttttttgaggtggagtttcactcttgttgcctaggctggagtgcaatggcgcgatctcggctcactgcaacctccgcctcccgggttcaagcaattctcctgcctcagcctccggagtagctgggattacaggcgcctgccaccacacccagctaatttttttgtatttttagtagagacgggattttaccatgttggccaggctggtgtcgaactcctgacgtcaggtgatctgcctgtctcagcctcccaaagtgctgggattacaggtgtgagccactgcacccggcctatcagtcagttcttactccagggccacagtgcttaaggactacagatttgtagcaagtcttgagatctcatagtgtaagttctccctttttttttttaagagagtgtcttggttattctcagtcttgattttcataacattatttcatcagtttattccaaaaacttgctggagtcttgcctgtgggtgcatttgatgtgacctctgctttgctcttgcttgaatctcttctgttttttccctctgccctcttaggacctgcctcatccagtgctcccggaacagctccaactgtgcctgggactttagcactgagtgttgctgtcttaggagttccactgccaccatggctgggtggccaccacgtcctctgggctcagcatcctggccagttaagtcactcttctaggcactgggtcacttacagtaaaatgttggtgggcctattctctctcatttccctgcagccacccctggctccttgggaggagttcagggagagtcattagctcctgctttcaactgtattttaaacctgtctgaggatgtgtctgtagctcaaaggggttttggtggcctctggtcagaccaactgccagatgcctgttacctggctgctttctcgaaaggttttcatctttcttcctcatgatctaatctctctgttcagggcgagaggcattccttccagagatcacccctccttcttccatcatcctcctcccctccctttcattcctagaaggggagcatagggaataccacgcgggaagtctgacggcaggaaacgaatggaaggaagacaggagatcaggctctggttccccttaaggacaagaatcagggtggagtggtggggagaactggggcttggaggaaggagagtgcctactgaggaccctcccagtgcagaagcatcacagacccagggatgcagaaaatagggcccgagaaagacagtgaggtgcggacctcagtgatgagtctgggactgacagacgtgtccacagggaagaggcaattgagacttggattgaagccctttaaacccccacccccacccctgctgagattctgctcccaaggtgataggagaaaacaccagagagatgaggtctcagagtcagagacatcagtcacagaaagaaagatggaaagtcagagggcagtgggggtctggggggctggaggcaccacttacctcagtcactggccctgtctttgtgccccaggtccgaagccccagaaggactctgtctcagactgggccattgtgttgatcactctcactttggtggcagcaattgtcagcctaatgtacggtatcaagaaggtgagcaatgccatggtccaatgtgtgggatccctgtgccagtggggctgggacctggtgccccaggattcagaggagaacagggctttggggaggggaatgacagcttgcagggcttgttgcagggagggcaaagagagcccttgtctcagtggccgagaaaaacaccggtctggcagggatagggggttggggccactgaaagaggcgggggagtgctggaggctgactggcacgtggaagcactcaactcagctctaggcaatgaaggaccagttctgtggagccacattcacctgggcttgaatccttgtgcaagttacttaatctgtctgtgctccggattcttcattaataataatacttaaataataataatattacatcgcactgattatgtgctaggtgtgctaggtgctgtacatattttagttcacagcaagccagtgatataggaaatattactcctcattttacagatgaggtaattgagtcctggatgaaatgagaatgatggcatccatctcaaagggtggttgggaggatcaaataagcttatgcaaagagagcactaatggtgcttggcatgtattatagtaagtgctcaatatacagccttattcattattattgctgtttttgctcaaagaggaatgctgagtgcctgggttgccaagaggaagcagcagttcatgggaagagctgggctgagcagcaggttcccgggtccctagattaacccatcgtaccctcccctcatctcacaggcctgccagttccggagggagatgagtctggggtgtggctgtggctctgtgaccccttacagcagccaccatgagggggaggctgccagccagcgctactcttgtcaaatgaaaggtggggctggggcagctgagcgcctaccctttggccttccttcttcctctcccagatagtctcattcccagactcccctatcccattcaccttagctgggaccatttcctgcaggtagattcctggggtcactggcccccccaggtctcttccacccacagcgtaaggaggagtctactgtcagtcacaagattctgctctctgtcctgccgccagccatgcagactgcgggaaggtgcccagcttctccgagggcagttttctcatctgtagaaggaaggaccagggctaagtggtctgcaggcaccttccagccctcacggagcccaggtctggacagctggaacccctgcccctcaccctctcttcctagtcccaccctcctccctgacgaccagagaagctctttagctgaggacagtctgctcacggcttcccttctcacttccctccacagggagccccctcaggctggctcttgagcccccaaggccctctgattctctcccctcagggcaggtgcaggaccctcctctgtggtgccccctcggtctgctatgggagggtggtgaacaagttattgctaaataaaatggcacttcctccacttgtctcccagatgctgtgggtttgcccaagtgcatgggcttttgtgtcatgtgggcccggaagggccaagtctggtctctgccagttaccagggcaagtcattccctgatccgaggctcatttatcctcatctgtaaagtgagggtgacaggtgataactcataggtgaggtgcttagtacattcttcagtacatagaaatgcccaaacaatggtagttggcagagttgtttcgtgactggcctctcagcctccagctcagatgaagcaacatagactgactgtaagagactgttttgggcctccacctacctccaggtttctccatcccagacatcagcgtccttggggtggagttgtagctcagagagaagggaagggggtgttcattcacaaacactggttagtgcttattctaaagcagagatcctccacttcagcacaattggtgtcctgggctggataattctttgctgtggagactgctctgggcattataggatgtcccacagcatctctggcctctaccccctagatgccagtagcatcccactccaaattgtgacaaaaatgtctccagaaatttccaaatgttccctgatgtgggcaaaattactcctccctgtacagaaccaccgtcctagaggcttgggtccctggggaaagggggggggggaaggggaccagtgaaaagggggactgtcagtcacccgagtctacatggagttgcagaggacagcctgtgtctgccttagtttctccatcctgcaggatatattgcctgggaggcaggctgcccagttctgagtagtcagtctttggcctgactccacggagcctcattaatctcccattaatcacattaataagcagttggcctcctctcctcttcccacctattccagccctgcccagggcttagggacaagtcacaccaagtaaggagaggaacccacatgtccagttctctagtcctctcatgagcccaaatgccctgagggcctggcctcctgccctcaggtcctggacctctctatggcctttgcctgcccccacttccctcagaaaggcatcctccggccctggcttccactccatccaggcggagtggaaacatttattgattgcctactgtgtgccagacactgtcctaggctctgatgacacagcagggatccaaggtgcttactttccatggagacccacagtgggcagaaaggggttgtgacttctctgtgctagagacccagggagtctgtcctcccctactccagccccaggcactgtcactggggagacaagggagtctctgagctaatgcttgctttaggcaggaagtgaggaagggaagggggagctctggggtgctcctaaaaatgagatgtctgcatttctgtataggagtgaatggggacttcgagacaaagagacagccgctgagctgaggtgggagggaagaggtagagtgaaagcagaagcccctgtacaccgagcatctcttggccaaagatcttggcctcggtccttctgggtggcctgacctgtctgtgtccctggtgaggggtgtgacatatgtccctgtggttctgtgtcttgtctctgtcactgcctctgcactctccacatattgttgtatgacctctgaacatcatgaagcacctttctctgcagcgagggtcattcgagggctttctctcgcctttgctctttcacctgatcctcgcggacagctccgcccaaggtggcaagaatgaccatgtgtgaataaggggtgtggaagctgggctgatgcgggagaggtgggagggtgcgcgtgaagctggacacagatcagaacgtgaaccccaccccatcctgctcccagccagagctcagtccttctagaactgagccatctgctccccacttccccagagccctggaggcgccaccctcacttccctccactggggctggctcaggtgcctgctcctttctggttcctctgccctgcccccagatcccacccctcggcaggcacccaggtgcctggctccatgacgcagcagctgcggtctcctcttatcagggctcccctgtgggttggggtggctccatttgtttaagacttagtcctgaggagccccagcccccatgacgtcaagattggctccatataaggtgaggggtccgcagcccatggtccccaagcagccacccagctccgacatggcccagccggtccacagcctctgctccgcctttggcctccagtgctgcctcctcttccttctagcttcttggggggcaggtaagatgcccacaggggatacagaagacagaaacagcttgtttcttagtgttcatagcgttggacaacaaatagaaatgaatgaagggggcgggcacggggctgctacagacagttgtctagagtgttctctgctcaagtttgctggctaagggacatgtagtaggagatgaaatccagcctgtgctctgctctttaaaacatggctcacagggctgcacccatccagagggggtttcttcaagtttgcataaagacactgtagaggctgccagccctggatggtgggggtaggcacctgacattcattgagcaccgtgcacggaattcacagctgctcatggtgatttctttcttcttcttcttcttcttcttcttttttttttttttttttttgagaaggagtcttgctctgttgcctaggctggagtgcagtggcacaatcttggctcactgcagcctctgcctcccgggttcaagcgattcttctgcctcagtctcctgggtaactgggattacaggcacctgccaccacgcctggctcatttttttgtatttttagtagagacaggatttcaccatgttggccaggctggtctcaaatgcctggcctcaagtgatccgcctgcctcggcctcccaaagtgctggtattacaagtgagagccaccgtgcccagagactcatctcatttcatctcagcatcccctgaggtggctaataatatcccatcttatagttgaggagagtggattcacaatgattatgtcccatatctcacagctagagggaggtaagcagggattccagctccactgcccccagccctggggggacaggtggagcttctctcctgagagctctgttttgtgcagacctagcttccagtcctgactctgacccatttgcctactctggccttccacaccatctgtaaaatgggctggatgctgctgcccagccgtaccagtatttgatgcctacagagcatttacactgcaccaggtgttgctctagggacttcatccacatttactcatttaatccacatggagactcagaaaagtgtgcgt

SEQ ID NO: 304 - DNA, 246182 bp, Homo sapiens
ggggagttgtcacagggccaccattatcctatagtgttttcttgcaaagtagaaaaatgctccccttcctccaggtagtccaacttcaagccaaggcacatgcttgacttggcatacagagcacaggcttggttttggcctccactggtcccattggttgggcagctgtgtgtactgcagacgcagcactccttaggcattacatgagctgaagctttccctaggcacatggatggaaagatgcagtgcaggcaccaaggggggtggtgtgtgagtggcacagctacccctctatcaaaggacaactctagaggatgatgggtaggggcaggcactttgataaactgataaacatggcttcatggccctaagcaagtcatctaatttctttaagcctcaaattcctcatctgttaaatggagacaataaaagtacctacctcactgggtggttgtgagaattacaggagataatgcatgcaaagcactttagtaagcatgtagtatacactcaacccacattagctattatttcgactactaatactgataaatgagatagcacatctaaatatggaaaagggtattggctgtgcatgctcttaagttggccctcttctccccttaaattctctccaccccaaacatcagcaagaaaactggtagccagagacagcagtgaggagagttggataaatcacagcatcacagaggctggctctggctactcgccttatcatagtgctctggtgatacgtgttcatggggcagggccactggagggagctcctgcaaacagcattcctgtgggaagcgggtattccctccagagtcccccactcccacccagtctcatttcctccttacccattcctctctcctcagtcggcccttcctttaccatcccatcccatcatacactgcccctcctcttcccctctccctggagaggaaggttgttttgcccaatacttttacccttgttctctggaagtttccgggcagtggtagaagtgaggggaagtccatttgggtggagaaatattcagcacaggcagtcttgtccgctgggccagctggggctaggctttctggggagcagcaatggcctggcaagttgttgagtggctgtgggcaaagagaagaaggtgaagggacagcaggaagacatgtggttctgggtctgtttggtgaaagaccaagctcagggtaaaggatgaggctggggccagctgcggaaaggtaagtgacctgcacagactgttttggtcgcatgagcactcagaacattttaataggatgagaaaagaaaaggcagtgccagtggcagcaactgtataagctggtccagcaggcctaagtctctaggcagagggtaccaatgtatttcctcagagaggctttctccaacagccctctctaaaatgctacccagcaccagcacgtccagcccccatcctgtgttctttaccctgcttatttttcttcatagcatttagcaatatctaaaatcaaatattgggggttttttcgcttcagtgtactgcttttctccagtagactttgtctcatgtgttgctctattttcagcatttagaacaatgtttggcacacagtgggtcctcaataaacaaaggttaaatgtaagaatgaatgctcaccatcgtcattcaaagaagaatcgagacctcatggatgggcgaataatcactgtgtctgcgctgtgctcagggaatgagccagtcaccctctggtctagcagactgccaccatgcttgtctctcttggagggtgctcagcagctttggatttgaaatgacattgcaaagatcctctcctgaaatcacatgggttgcatagctaggaagggatgctgccctttgtccaaatccctaaggccctttgtccaaatcccaagggccttttgtctaggggagtgtatcagtaggttcctcctacatgtgaatgggaggtctgtgttggtcagttggaagttgggcccctaaactgggaaagacaggcacttggaaggtttccagaggttagaagttgacttcatacccttggcataggagcagggctaattattctcttgtataatagagaggtgctataagaactaggagtggttatccttccacactgcctagaggtgagaaggcctacaggcactcatgtgttttgcaggtcacagagtaaccagtcattgctctagtggccaggacattgtccagatacaaggcaacagaaggtgctgttctttttcacacactaggaagtactttcctactatacaccttcatataagggagaggatgaggtcctacctagtaggtatctgtgaagctgacaagaagacacctgggtgaaaagtgaagaataccagcaatcccacagacattttatatgcataaggccaagcatccatctaactgcatttactctgaaaccagagatttggtgtgatatagactcatacttcataatattctatatatgcatatgtacatatagtttttaagtcatttatgtcttctatttgtaagcaatacatttcgcatttttatactagccacaggtttttgcagatgtcattcttcttatctcaaggttggtccagggctcaattttttttcttgtttgcggatgccctgtcttgaatctgtgtactgattggatgtttgagtattacaatagtaatacacaccttgttcttaataagtgccatgaggattgagagtcatcacatcagggatcttcttctcactgccattaaatagctatgtgttttagtgtaggtcactccttgggcctcagtttcccaactctaatttgaagaggctgggttagagagttattaagttttcttttagaggcaaagaatccacaattcaagtaatattttatataaacactatacttcttttcctcattgtagaatgatctatgtcaccatcatatgtagggcatctatttatgggactgatccacgtccaaatttgagcatcaaatatttcactacataaatatgtttatgttaagattttgttgtgcttaccagttcctttctaaggaattgagtccattaagatatttcatgctcagctaacatgtccattatttttagacagtgtgcttaaaataaaagagaggactttatttgatacctttatttatatgcaaaacagcgcaccattcatgagatatgaaaaactcgtcagatagaaaccagattatatctattttcactacaaaatattgcattatataaagcaacagagacacaaaaaaaccctgaaaaagactaaaatctttggatagcagatgtggtttttttcccttgtctctaaaatacactccttgttttaagagtttcacagcagagaacatgaaacattttcaggttatagacttttctttttggtgtcacagaggaaagtagttctgaattctttttttcttttttttttaggaaaataacttaatttgctaaattcatcacacgcacaaacatcacacacacaaagaagctactctccttataaacagcttgtaaaggacttctcagacataactacagataagaataatacactttttaaaaaactataatagtgaagtgctagtgttgctgatctcacaacaaaagaacctttcaagaacaaacatcttaatatataaaatatgtttagaaacagggagaagtgggaaatttgttatacaagtgcaatataattagagcagaaagaaagaccacagtataatctcaacaaacacgtaaaaagttagacataattattccacaggaaaaagtgtaaacacttgactataaataaattggcacagagtatccaaagtaaaagtatcaccactctgaaaaataaatgtcttgaaaaaaatactctactccttctaacataaataaaaataggttgtctttttctaactgcacctatgggtccacatgtttaaggtcacaaatagatgtttttggatatataaaggggcacttcgcctgcaaaagtaatcagatattaaagtttccatttaaatatggattttcctgtctaccttggtgtcatatcttggggataaaatatcaccaagctcagatcctcccacagtgtgtctacttgttctcaatttgtctttttaaacttactaaatattcagggtttatttggattctaatataatctttattttcacaacagaaaggaaagtttccagtcgcacctttctgtgccttccatctctatgggagagatccctcctctctcctccttcccagtgtttggtgatttgtccattagaaaaattccagatagcctaaagttatgagcctgcatactctgaacttctgccctcattctttcaacacattaagatttgtggcggatgaatgtaggagaactcaaagtctccagtgggttaaaaccacaacccttggggagccccagaagtggctcatctcgggtgtctccacgaggttctcctggcctggaaaatcccccctgcgagcccccgggctcgccagacaaccccacctgcctgcgtcggaaaccttccctcgtcgccctgctgaccagagagaacaggtagcgagcttcttccccggccgtctctcgaggcggccgtctcgctgggccaccgcagcctccgccacccgagcgacggcgcccgtccggatccgtagcgtttcgcggacgccgggacaggcggccccccgcggcgcaccccgccctacacgtccaggacgtggttgagataggagatgtagcagatggccaggcgcaggatctcgatcttggagagcttcttgtccgggggcagcgtgggcagcaatttgcggagctcggcgaaggccaagttgaaggcttccacgcggatgcgctcgcgggtggcgtgggccgagcggtacttggccgtggcgcgccggcggcggcgcttctcctcgcggctcagctgctgcgggtgcgggtagagcgcggctcggctgccgcccttgccgtcgccctcggcctcctccaccggctccaggtccgacacgctgccgagcaccttggtgtccgtgccgcccagggactccggatccgagtgcgccgagctgggatggtccgaatctgctgcttggtccggactcagcatcattttggaggctgaggaggggtcggaaaattaatcagtaaaaggaatcagggtattttgctggaaggatggctgccgaggcctaccacgccggtcctcccagcggacgcgcggcccgggccccctccccacagcaggccggcgcgcgacgcgggagggcgccgataggatctggcccgagggcgcgagccctgcgcctcgccctggcgcgggagccggcggggacgcggttgacccaggccgcatactagactggacacctcgacttgcagacggccacagcgggcctgtggccctgggcctggggaacaaccgcaggcctgtggggtcgcgactgggtttttgtgcctcttccggccaaatgccaaccgcgctattcctcctccctcccttcgtccccttcccggacaaacgagcgatttcgaacaacgaatacatctgggttttcacgggggcggggagacgcggggtgcacttctcgccccgagggcctccggcgaagcaacccggcagccgcggcgcccgagggcctggcgctggtctggggctgcgccgggggcgcctggctctggggtgcggccggtcaggaatccccatcctggagcgcaggcggagagccagtggctgggggcgggaaggcttcttggacccctcgcgcttctccgaaatcgtaaagaaatgactaaacaaacgtgggggagcctttaaaaagaaaattgactccgatgccctcgcaggctcccggagcaccatctgtcacgcagacagccacacacataggggacctagggacacggcgacgtgggatcagacaatgcgcccggcagtctggcgaccaccttgcgggaaaatgccggcagccgggccgctgagggaggagaggatgcagagggaagggaagagaagggaagggcccggggcggggcaggcggggactagcgggtgcagcgcgtgttgtcccggcgggagctgcatctctgccggcaaagttcgggcgctcccggaaccggagctcggcaggctgcagctgtccccgggtggcctggccaagtccgggcatgtcggtgcttagccttcctctaacttaactgtgccctcttggaaacgccacctggccaggcttctctggggcgcctggagcactggcccggactgtgcgccttctgggagggggccgctcagaaccgctgggcttccgggtaattcgggcttcgagaaagggcccggcaggaggagaaaggcccctgcaggggctgcacgcaccgcccctgggcgtcgggagtgaggaccaggctgagaactcggggccccggcgtgggcagcctccacgacgctcggcacgggagaaatccgcgtcggcgacgtataggagcgtttgcttctagagaaacaaaagcaaggggatgggtgatcggttcccagcaccgcacttgcagaggagcgaattgggccaaaacagctttaatttccctgcgaggaaatcaggtcctctacggcaaaataaaaacaaatgctcccagagagctgcatgtgactccctacgggcttttctcgggtacgtttatgagtagaacaacttgcacctacacagtcagcttgaaagggcagaaataaatagacgagtaatggaaaatcacaataagccactaaatagttgtagttctggtaaaaagttcctgggttgccctcaaagcacattaaattctcctctagatctttaaaaatattcataaatagtatgccgtgtatgcgttttatctctttatggaatgaactgcatctatagatacagtatgaataatctaacttatttcaagctgaaaaaaattatttaaaggagtcttaccttgcaaaagcctttttgataatctgttctccaatctttagagttaaaattccaaggaatagcgaggggagattccggaaaatattaaaagcagcaaatatttattacattcaaaaatgaaaaagcagctgtcatctcgctggtgtccgcagcgagggacaataatatctcaggatgtagacgatatgaatgattgttcacttagttgatagattttttaaaaaacgctttttccttttaattgttctcaaacattgcaagaaattcgttgatgatttttttaaacgatgtgttgaaaagtctcgtgccttttttcctcttctaggtctctaaaaataacaaaagagatgcagagataaacacaatcacatcaaagggctgattcctccactttctaatagcggaataatcaataagaaagatggttaagataagattccgctcctatcgtatgcctttcttttccttaatacggctgagcagaaactgggaagtgcaggacagagatgtgatcttgctcagaagtgattttttttttttttttgagataaggctttgttcagctgatatctccccagttcccaggaacacaatactgtaactaggagctaaggttgcctcttcctcttccctcacttacttgtatgttgtataaatagacacctattttccagtttcaaagtctttcaaggtttggctatatcccccgtccccagcccctcttctctttaccttgtagcaaaatatatatagtcagtggcttggagatgcttggagaaaggttggtgaaaagtgaacgtctcctggagtaacagtgacaaggaagcagagaaagacgggaagagggtgggagagccagagcaaagaggcagagatgcgtgtgtggcttctgggctctcctggtaccaattgattcagcctggagatggtggaagagataaaggcttaggaagggggatggaatttttttcccctaaattgatatttaatgggaaatcctattggacagaaacctggacatgagtcacttaattggacttgacatctgtcacagtgtgggagttttcacagcccaaatattttagcagatcagattcccactgaatctgtgccataaaatataacaattgaaaagcagttcatgatagaaatcttagcctctaaacagtatctagccgtagtcaggctatttctcttttccagattattgatgaaatatttaagtacaaataaacaatatattgactatcaaagaattcccctggcatattacaaagccaccactttcccttaatatttagaaaaatatttgtgtccagaacatggaaatatatactatataagatgctgcaataaagtatttagacatgcaacagccaacatttattagagatcatttacattttaaaagatacttcagtaaggtttgattaagcatattaacatttttgagaaatgatctgctatgagactaacttatcaatagatggtaagaacctttcaatagattaagccattggtggaactagaaagagaatccacatattcacggaccacgacatgagataattctacttttctgtatgtttgtttttctctccacccactcattcattcaagctgaaatatgacatgctacatgtgttgattattgcacttcattcttgcccatcttaacatgctaatatattgtactgcgtggcagtgcttgtgccaagatgtaaacacaaattaccagtgtgtcccagtacataatgcctttgccttacatgatcccatggccctgaatttgtataccttataataaaaaataaaatctagttcaattattttgccactttatgaagatactcatagttaatatcaataacatattatttgtgattattttagcttgttttgatcatacaagcttaaagaaataaaagagcattacagccttactcccaccccgccagttcctaggggaacatttgtggagagaggagtcctcacttgtcttccttaattttgccctaaaagcagattttatcaccaggggaggcacattgagcagcccacccctgggagtgaccctccgggtttttcatggcttccacaagtactatttgcctttgcccacatttttgctcctttgagagattcctggaccacaatggggcaggggtcggggaaaggagggagtgcctccaacaaataagggcaccaacactccccagccttgcttctgcctaaccccagcacagaggtatattttagatatccccagaacgttaaagtgaagatggaagccggtcccatacaggtggcaatggaaatgggtgagtggataaacaccccaaggtggtgacaatgaagggagaagggaggttttctcactctagttaggaacagccaatgctaagcattcacacacaaccagaagtgtgcacacagatgcacacccacagacacctgtacctcctcccccttcatcatacaagctggctggctctattagaccaccacacatccatactgatggattgaaaaaaactggtgggtctaatcaccatagctctagagtgggcagctgctacagtgggaaaggaccagcatctctggttcccctggtgttggggagtcatgacagggtgtgcctatcagggcaggtccaattctgctatggtgtgtgtgataccagacaaattcccttttatgttcaggcttactcattctataccagcagccagcatacacaaaaattaatgcttacagaagtaagcctgtataaacaggtacacactcagatccatacttagtgatgcctagccacactgtcatagacacagacatggattcacattcacacacacacattctttcttccatcaaagcctccccctcccccacccctttgccttttctaagacctccctggcacagatggcccctccttctgtgctccataagcactcctttcatgtctcccttagagactacatattgtgtaccgtgattcttggttcttggttaccacactggtctctcttcctaggctatgatgcttccaggggaggtctgtagcttatatccccagcactaatgtctgagcttgacacattataggtactcagttcatttatgatgtgactctatgtacagaggtaccccagatatttgtaacatagaaacgcttccactaaaggacacccatggttcagttctatcaattttctttcctgtaaaaatgagaataataatattgcacttctcatttcacaggctcgctatgagacccaatgtatttgaaaatatttgatgaaatagtaagcaccatacaaattatgatattatagactataagagtaatattaaataatattattaaatgaatggggaggtgataagtagtgacttaaaaagtccggctttgtggctctgtcatatgctagctgtgtgaatttagttgtaagttacttaacctttttggaccttagttttctaatctgtaaaatgagaataatcaaagcatgttatgtaatgttatgtcatgtttttttctgaaggtgaacaagataatatatgtaaagtgcttaaactaatgcctagaactcatgttcagtaagtgttggctatcattattattattattcagtataaatacatattgaggaacagatatatattgacatagaaaaataaacatatccagatatactcacccgtgtgtgtgtgtgtgtgtgtgtgtgtgtgtgtgtgtgtgtgtgtgtgtctgtccatagctctggtggccaaactacaatgagcattttccatgtgtcagacctaggtatagtgactttgctcatattaacttatttaaccttcaccacaaacctgtgaggtaggtaggtactgttgtcccgattttgtgtataagaaaactaggacatggaaaagatggtaatctactcaaggtcacatagctaataaattatggagctaagatagagattcaggtggtctaaattcagaaactgcactctcagacacaaagtactactgtttctgtcattgtatcctacacagatatactcacacagaactattcaccaaaatgcatatggcaagggagaaatacacgtacacacaaaacttagataaatggccacctttgcattcaggggtggttagtgagtgatatggtttggctgtgtccccacccaaatctcaactggaattgtacttgccataattcccgggtaggaggtaattgaatgctattctcatgaaaagagtaagttatcatgagatctgatggttttatagggagcttacccctttgctcagctctcattcttctctctcctgctgccttgtaaagaaggacatgtttgcttccccttccatcatgattataagtttcctgaggcctccttagccctgaggaactgtgagtcaattaaacatttttcctttataaattacccagtctcaggtatgttcttatatcagcatgagaatggactaacacagtgtcagtgtagtttaaatacttactgcacatctagtgctttgccagatactgttggactacaaaggctttgtaattatttgttacttttatgagacatctgtttccaacctattttttaaaattttgtaccccatagataaaaatttagggcatacatactgagtatatgtatatttatatgtatatacccaattataactacataatatactagtacagtagtacatgtataagctttgtacatgtactactgtactagtatattatataattatgatatacaaaagataagcaaagatatgataaaaatatttattttaaaatttgtaagtatttatcaatagatacatttataaatttaaatattcatatttattattaaatatatgataaacttaaaaataatattaataaactaattaattttatttattaacagcacaaaaaccaattaacagcataaggttttattgatcatgtataacttctgagagcaataagcttaattttgttaaactcattgtttaaccctttgagataatgatttgatcatctggttttaagatcaatttatttagaatctgttttttggctgatatagcagaaagagatgtaatacaaaaattcagatggtatcacaaaatatgataagcatgtgaagtgatggatatgtaaattagcttgatttactcattccacagtgtaaacatatatcaacacatcacattgtacatcataaatgtataccatttttatttgtcaatttaaaaaaaaataagaaaaagtggaaacatcccaaaggtccatcaactgatggatggataaacagaatgtgatataaccatacaatagactactattcggcaagaaaagaaacaaagtactaatacatgtgacaacatggatgaacctcaaaaacattatgctgagtgaaagaagccagacacaaagaccacatattgcgtgactccattcatatggaaaggtacagaatgagcaaatctatagaaacagaggtagattaatggctgtgcagggataagatcgggtaaagaaaggtaccagggagtgattgctaatcagcagagtttcatcttgggatgatggaaatattctaaaattagattttggtgatgatttcatgactctgtaaatatactaaaaaacattgagctgtgtgccttaactatggtatgttaagtatatctcaataaagctattagaaaattcagaagacataatgtgtgatatttatgtcactgtagtgggtaaagggcgtgatgtcttttctcacccatcataagggtcacagctgacactcctttaacaaaagacaggttaacatgaaaagcataacatatttatctaatcagagttttacatgacacaggagtcttcagaatgaagacccaaagatccaaaggaaaactgtccatttttatgcctagatttgatgcagagtggatagccgtgcagaaatgcgactggacaaaaagggaatgatcttacagcaacagactgaatgaggaaacccaggaaagcctgcctgttaagattctacttggtctctctgtgtggcattcctttttccagggatagtgcaagaccccttttagaatgagggtcttataatctacttgcagacagagtaggtcagagaatttctgtatggtcagctcttacacagaaaaatgggagaatgttagaatactatttctaggttttatggctggctttggagagaggggttctagtttctatgatccaccttggggaagagaaattctagtttctatggcttgcccttgggggagaaaagggagcaaggagaaaggagggcatgagaagttcagagagagactttgcttttaagggattttcaatcaccttttgttcaaagtactcagcatgccaaagtgccatactttgagttatcattttctgaatcccaacaattcctattttcactgtacttctctatttattattttatctagtatatatttttatttattgttattgattatatcataaatggtgagggtttttatcattttttatttgtttgctttctttaaaggaatagaagagactaccaccagttgtagcagtacttttgaaaacttaccatctatgtgacccgaaccgtggtaggagtgagcacagtcagaggttaaagatagacaatagtatcccctagtttgctctgtacttatctatggtccacttgtgctggtgagctgatatgtgtggtggataaccattcccaattttttaaaattaaagtaaaatttccaatttattttatataagccaatattatcccattagtaataattacaggggaaaaaacagaaactcttttgtgacaaaagtattttagcatctatataaacaccataagtgataggacataatttgagagctatttattttcactaaacatatattaataaaacaatgtttccaatccctcaacccattcagacatatacacattgttgtgggagatcatttttcttatgaaagaataaaatgtgtgctataagaaaaaaaatcaaaagtctaacagaagttaatcactgattgtgttaactaaattattattctcatttttcttacttatctatgaaatattccaaagttttattgaaatttggacagtaagtctctttctaatgtgaattagtttttcttttaacaatgggtttaaaatccataaaactcttgatttggaaaaatttttaacagcttagatatttatgcttccaagtgtttcaagtgttcagatataacagattttaatatatgtcacattttcattatttggggtagcaaaaatcacataacaatggaaaaatttctaaattaaatctcttcaaaatgccttctccattgcacaatgtttttaaaagttaccatttaattcatttaaaaatagtacttaaagagacacgttgcgtgtgcattcatttttttaatctgctggtagcataccattgacattgtcataaaaaataactttggaacacttatcttaaagttgagcaactctttaagtactctttacatactttaccacttgccaaacagcacttttcgtgtggaacagtagaattttatggcattttccagtttcatttattgcaaagattctataatattttaaaagactcatatttctaaaactaactacatgggtacatcttgcatactttggcttcaaattatgcacatttcttgcatagtaattacttggtgaataaattttgtttgtgatggtctctctgactccaggctgtttatatttatttgagttaaagcagccttttcctcagtagttacacttccataatttttccataaattattccttctattgaagatcatttcagttgtgaatatatctgctcccatacatttttccatttatatccccttaaaaagagttcttcatgtatttcaaaagattctgagacagaatctataaagtaccacaagttcaaacatgttagaaatagctgctgttttttaatccacataaatagcaaacttacataattacaacactgcataaattgatctaatacttgtttcttcaaattttcaggaatgttcaggagtgtttcccaggtgtctatcaatggaatctgtcaatatgagaaaggattttagtttatcactttactggtttctgagtattaattcagctatttccccaacagtttggcttttgctataaaataagaaactttagaagaggtttctaaacatttatctttatatttagtgaaatgttttaaagtactggattgagtgtggtataattttacatatcactggaaaatttgagagatttgctttcctattttggatgcctaatttttaaaaccagtttgctgaagtataatttatatacagtaaaactaatccttcagaggtgccctgttttacaaattccacaaacgtattgagtgtgtaagcaacacactcaaaatatagaacatttccattaccctggcaagttccctgtaccttttagtagccaatccttttacctgcatccaacctcagacaaccacagatctgatttccgttcctatagttttgccttttccagaatgccataaaaatagaattgcttagtataggaagtatagactttcaagtctggtttcttttacttagtacaaagtcttttttattattcatccatgttgttgcacgtatcagtactttattcttttttattactgagtagtattccattgcatagatgtagcacaatttgtttattcactcacaaactaatagacatttgggtggtttctagtttttggatattaagaatatagctaataaatttggtataaccgtgcacatacaggtattatgagggcacatgcattcagttctcctgggtaaataaccaagaataaaactgttggattgtatggtgagtgtatgtttcctcagcccacaggaaaccactgttctactttctgttgctagacgttatttggtgtttttagaattttatatattgaccatacaatatgttttggctttgtctgcttttttttagtcagtcgttatgttgagattcatccatgttgttatgtattagttagctgttcctttttattgctacatagtattcatttatccttcccagagctcttcagtcgattgtgtagatccaaatttctatgtggtaacgtaatccttctgcctgaagaactttaactattattacaaagcaagtaagctgtcagtgaattttctcacctattgtttttatgaaaatgtctttgctttccttttcaaaaacttttctttgtgtatagaactctaagttgacagtggtttttattttttcttcagtactttaaaaatgttgcttcatttcttttttggcttgtatagtttctgatgaaaagtctacactaagtagtctctttgttttgctgtatataatgtgttcctcatcctttttccccagctgccttcaaaattttctctttattttagatttttagcaggttgattatgatgtatctaggcatgtgtaaggttttctttgtttgtttgtttgtttggtgtatatcctttttgggttgtttgagcttggatctgtgatttactgtcattcactatttttggaaaattcttggccattcattatgtctccaaatatttcttcttccccattttctttctcttatccttttgggactccaattatatgtacattattatgtttgatataattccacatctcttgaatgccctgttctgattttattctcccactcttcttctttctttctgtatttttgtttgggtaatttctgttgacagatcttccagttaattgattctttctagctgggttcatacttctactaaggagtatgttgaaagcattttttatctccactattagttttgtttttggttttttttgtttgtttggtttttgtttttgtttttgtttttgtttttgtttttgttttgagatggagtttcgctcttgttacccaggagggagtgcaatggcgtgattcggctcactgcaacctctgcctcccagattcaagcacccgtgcctcagcctcccaggtagctgggattatagtcacccaccatcacacctggctaatttttgtatttttagtagagaaggggtttcaccatgttggccaggctggtctcgaacttctgacctcagatcatctacctgcctcagcctcccaaagtgctgggattataggcatgagccaccgtgcctggccaatattaggttttaatttctagcagtacacagatgttgaaactagcatgcaggaactttacaataactatgattaatatgtgaaaggatatagtagaaaaggtagcatgtataaaagatggggaatttcagaagaaagatgtcttcttctgaaaaagatgggagaaattccctatcttttatacatgcttcttcttctgaaaaagatgggagaaattccttatcttttatacatctttcttcttctcaaaaagatgggagaaattccccatcttttatacatgctaccttttctactatatcctttcacatattaatcatagttattttaaaattcctgtatgctagtttcaacatctgggtattggatgttgacttcattgtttcttgatcgtaggtagtgtgtgtgtgtgtgtgtgtgtgtgtgtgtgtgtgtctgtgtgtgtgtgtgatgtaatttttgagtgaatgccagactttgcatgaacagtagagacctggggtaaatattgttaaaatattgttaacagtggaaaatgagaatgactcttcttgtgtaaggccattaatatggagaattgactcgatctgtcaggagttgagctgggtttaggttttgttgttgctatggttaccatcagtgcaccacaggcttctaattcttccattggtgggccgcctttgccttgtgcctagagtggacactggtatgccagagtcttctctcaggtttattgttctaccatcagctttcagctttcctgaatgcctgtaccacagggaagatctctcaccatggattttccccatccccagtcttagactactgttgcttgttactttttgccaggtttgtgttcagggtagatggatttatctgttgttctactccagtctatgtcttagggagggcctctgaaattgggcctctctctgcattcctgtcactccgtcttgtggcagccaaattctgctttgtattaataatagttgatcttgaacaagagttttcttcgcctttcctagtggtagaaaacctctgccttatatcagtttgagatgttaggtccaagatgattttgtgcatctccccagagatagccttttcttatacccctaacccctctccataatgcatcttttcctgggctttgggcaacagtctttgctgccactcttccagaagtttaaagcttttgcttcacatgagaaaagagtctggggagggaagtgtatggtgttttgtgtctggccacacagacctaccagttactttctgtatacctgctacacccatggtcttttcttcctgatttaattgatacacaataactgtacatattcattgggtacatgtgatattttgatacatgcatataatgtgtaatgatcaagtcagggtgtttaaaatatccatcacttcgaatatttatcatttttttgtgttgggaacatttcaaatcttctctggtagatgttttgaaatagacaataagttattagtaactatagtcaccccactgtgctatcaaacactagaacttattccttctctctaactgtatgttttcatccattaaccaacctcttttcatacctctaccttttcccagcctctggtaaccatcattctaatctctacctccatgagatcaacttttagttcccacatatgcagtgagaacatgcaataactgtctttctgtgcctggtttatttctcttaacataatgtcctccagttccatccgtgttactgcaaattacatgcttttattctttttatggctgaatagtattccattgtatatataccatattttctttatttattcatggacacttaggtcgattctgtatcttggctattctgaatagtgctgaaataaacatggaggtgcaggtattcctttgatatactgatttcttttcctttgaatacattcccagtagtgggattactggatcatatggtacttcaatttttaattttttgagaaacctctatgctgttttccataatggctgtactaattgacattttcaccaacagtgtatgagtccctttttccacatcatcatcagcacttgttattttttgtctttttgacaataaccattctaactggggtgagatgatatctgattgtggttttgatttgcatttccctaatgattagcaacgttgaacattttttcacatgtctgtaggccatttatatgtcttcttatgagaaatgtctattcacatctgttgcccgctttttaatgggattactggcttttgttttgttttgttttgttgctgttgagttgagttccttgtatattctagatatcagttccttgtcagatgaatagtttgcaaatattttctcccattgtacaagttgcctctttatcaattgtttcttttgcagtgcagaacctttttagcttaatatagtcttttctgtctgtttttgtttttgttgcccatgcttttaaagtcttagttacagcagggcatggtggctcatgcctgtaatcctagtggctcaggaggctgaggtgggaagatcacttggggacaggagtttgagaccagcctgtgcaacatagtgagatcctgtctctacaaaaaaaaaaaaaaaaaaaaaaattagctgagcatggtgttgtgcgcctgtagtctcatctactcaagagtctgaggtggaaggatcacacaagcccaggagcttaaggctgcagtgagccatgatcatgccactgcactccagcctggacaacagaggagaccccagatctacaaaatttaataaattaaaaaataaaggctcatccataaaatcttcacgtagtccaatgtcctacagaatttcccctatgttttcttttggatcttatctttaagtctttaatccattttaagttgacttttgtatatggtgagagacaagggtctagtttcatccttctgcatgtggatatccagtttccccagcaccatttattgaagaaggtgttctttccccagtgtatgttcatggcactttagtcaaaaatcaattggctgtaaatatgtggatttatttctgggttctctgttctgttcccttggcctatgtatcgatttttatactaatactatgctgtttgggttactatagctttgtagtatattttgaagtaaggtagtatgatgcttccagctttgttctttttgcttaggattgctttggctatttgaggtcttttgtggttccatacaaattttagaattcttttctatttatgtgaagaatgtcactggtattttgatagggaatgcattaaatctatagattgttttgtgtagtatggccattttaacaatagtaattcttctgatccatgagcatgggatgtctttccatttgtttgtgtcctcttcaatctctttcatcagtggtttttgttgtagtggtctttcattaaattcattcctaggtattttattttttgtagctatcgtaagtgggattgcttttttgatttccttttcggctagtttgttattggtgtatagaaacactactgatttttgtatgttgattttgtatcctacaactttactgaatctgtttatcagttctaagagttttttggtggattcttcaggtttttcgtgatataagattatgtcatttgcaaaggaagatgacttcctcttttctaacttagatgccttttatttttctgttttttgattggtctagctagggcttccagtactatgttgaataagagtggtgaaaggtggacatccttgttttgttccagttcttagagaataggcttttagcttttcctcatttaatgtaaagttaggtgtaggtttgtcatatatggccttattatgttgaagtatgttccatcagtgcctaatttgttgagagtttttaaccatgaagacatgttgaattttataaaatgattttttgcatctattgagattatcatatggtttttgtcttttattctgttgatgtgatgtatcacatttattgacttgcctgtattaaaacacctttgcatccctgagataaatcccacttgattatgatgtcttatatttttgatgtgttgtttgatttgttttgctagtattttattaaggagttttgcatctatgggatattggtctgtttcctttttttttttaactgcacacatacatggaaattaaacaacatgctcctaaatgacaattgggtccataaagatattcagaaggaaataaaaaaatttcttgaagcaaatgaaaatggaaacacaatttaccaaaaccagtgtgtttcataccactggtttttgttgttgttgctattgttgtatccttttctggttttgatatcagggtaatgctgtccttgtagaatgatttagaaagaattccatcctctatttttgcaacaatttgagaattggcgttagttctttacaggtttggtagtaaagccatccagtcctggtcttccctttactgaaaaaccttttattactgattcaatctcattatccattattgttcttttcaggttttttatttcttccttgttcaatcttggtaggttgtgtttgcccaagaacttattcatattctttaggttttgcagtttgttagccacatcattggtcattgtttgtaatagttgtcagtgatctttatattgttgtggtaacagttgtaaggtcttctggtttctgattgtgtttgtttgggtcttctctctttttttcttagtctagccagcagtttatgaattttgtttatcttttcaaaagccaactttttgtttagttgattctttttttcttttttttgtccctattcattttgttctgctctgatctttatcttttctttacttttactaattttgagtctggtttgctcttgcttttctagtttattgaggtgcataattggttatttgaaatctttctacttttctggtgtaggcatttattgctataaacttctctcttagcaatgctttgcagtatcccattggttttggtaagttgtgttttctttttttttttcccaagagaattaaatgggttattgattacacatgacaatggatgatacacaagctttattcccatctataattttatctggtaccattattcaatttagatacactgcataggatgtgccaacaaacttttttttttttttttttgagacagagtctcgctctgtcgcccaggctggagtgcagtggtgcaatctcggctcactgcaacctctgcctcctgggttcacgccattctcctgcctcagcctcccaagtagctgggactacaggcacccaccaccacgcctggctaattttttgtatttttaatagagatggtgtttcacaatgtaggccaggatagtctcgatctcctgacctggtgatccgcccgccttggcctcccaaagtgctgggattacaggcctgagccaccgtgcccagcccccaacaatcatttttataaccaataattccatgattttgcttgggcaatcccttttaatggtgaacttcaggtcacaacagtaactgtcagttcaactacaccaaggtttctgaagacagtggcttcttcacccaagcaggttgtatataaattccaaatagaacctggtatcaccctgaaggaattctaacttcacactgttggggaaatttaccaagatggcttcagagtagactaacttagcatgtttttttaaaagacacatttattcagcatcacaatcagaccattatatttagcaatcaacagcatgggtggaaaagaaaaaaaaaaaaactggccgggtgtggtggctcatgcctgtaatcccagcactttgggaggccgaggcaggcggatcacgaggtcaggagatcgaaaccatcctggctaacacggtgaaaccctgtctctactaaaaatacaaaaaattagcccggcgtagtgactggtgcctgtagtcccagctacttgggaggctgaggcaggagaatggcgtgaacccaggaggtggaggttgcagtgagccgaaatcgagccactgcactccagcctgggcaacacagcgagactccatctcaaaaaaaaaaaaaaaaactacattaaaaccctttgttggaatgctttacactttccgcagaacagaaactaaaataacctgttatacaattagtcacaaatacagtcctcctcaagtttttttgcccatacacatgagtatttgtctcaaacatgtcttctttatagtagctaggccctgccaccactgtgcttggctgagttcacaaatcttttgtaacctgtagcttccctgtcacttccctggctctcctctcctgctaagatttgtttcctggcagtaattaaaatcttccgccactgccatagctctgctgctactggaaccaccgtagccaccttggtttcatggtttggcaaagtattggcctccaccaccataggggccagagtttctgcctccaaagtctcctgccttcatgggtccaaaatttgaagactgattgttgtaactgccaaaatcattacagcttctaccacttccaaaattgcttccatcattaccaaatccattatagccatctccacaaccattgaagtttcctccatgaccaaagttgtcattccaaaaactacctccatgaccaccaccaaagtttccagaaccacttcgacctctttggctggatgaagcactagacatctcttgctttgacagggctttcctaacttcacagttgtggccattcacagtatagcatttctgaatgacagtcttatccatggagtcatagtcgtcaaaggttacaaaggcaaagcccctcttcttgccactgcctcggtcagttattatttcaatcagttccatttttccacacagttcaaaataatctcttaggtgatgttcttcagtgtcttctttaataccaccaacaaatatctttttcacagttaagtgggcacctggtctttgagaatcttctcttgagacagctctctttggttccacaactcttccgtcgacctcgtgtggcctcgcattcatggctgcatccacctcctccacagtggtatatgtgacaaacccaaagcccctggagagcttggtgtttggatctctcattaacactcagcccgtgaattccccattgctcaaaatggctcctcaggctctcgttggttgtttcaaaactcaatcctccaatgaagagcttcctcagctgttagggctctttaggagattctgacttagacatgacggcagggggatgagagactttacaatgcttcctcggcggcatccatgggcagaaagaacatgtttccattttcatttgcttcatgaaatttttttatttccttctgaatatctttattgacccaattgttaggagcatgttgtttaatttccatgtatttgtacagtttccaaagttcctcttgttattgattttcagttttattccattgtgagctgagaagatacttgttatgattttgatttttaaaagtttgttaagacttgtcttgtggtctaatatatggtctatcctggagaatgttccatgtgttgatgagtaggatgtgcattctgcagctgttggatgaaatgtcttgtaaatgtctgttaggttcagttagtctctagtgcatactgagtatgatgtttctttgctggttttctgtctagatctgtgcaatgatgaaagtgagatgttgaagtcttcaactgttagtatattggagtctccctctttaacaatattggttttatatacctgggtactccagtgttaggtatttacaattgctatatcctcttgcttaattgatccctttatcattttataatgaccttttttgtccctttttatgttttttgactttaagtctattttgtctgatataagtatagctacagaagcatatttttggcttctgtttgtgtggaatatttttgtctattccttttctttcaatctatgtgtgtctttacaagtgaagtaagttttttaggcagaatataattgtgtctttttttttgatctatgcagccagtctatagcttttaattgaggaatttaagctgtttacattgaaggttgtttttgataggtgacgacatgttattatcatctcgttgttttctgattgttttgtattttttgttttattgttcacgtctacagtttggtctgttttgtggtaataacagttgactcctttcttctcatttgtgtgtctgctttatcaacgagttttattttttgtgtgttttcatatatatgtagatgtagttcttttgcttccagatgtaggatttccttaagctcctcatcatttattttgttgaatttgtcattcagatcatgaattctttccttgatttctttgtaccattcatttgggttgtcctatctcactgactttttctaatgtcattattttgaagttttttccaggcatttcataaatttccttttctttgggctctgttactggtaattataatgttcctttggaggtgtcatgttttcttgctttttcatgtttttgtgtccttaccttaatatctacacatctattgtaacagtcacttcttccagttttatcggttggcttttgcagtgaaatatttttcctgtagatgtttctgtagtgttggttggaaaaggcattttggcattgattcttggtgggggtagtagcgtagcctttgtatgatttcttcagctgtaatcagctcatcagtggcatctgtgagttcctcagtggcttaggctgcagttgttagtggaggctgtggtgacactttgctgatgatgcgaatgccagatgggccagtcctcgggcaacagtggtggtggtggtggtggtgtgctgagcatgccagtcctcaggtgccaaagtagtatatgtgggcaccagcagtgacaagttcaggagggcagagcctggggcccccagatgttgtgcgtggtgccagcagtggcaggtcctgaagggcaggtcctctggtccccagacagcatgtgtgatgttggtggtggcagtagcagcggcaggccaaccctcagaacaccaagcagtgcacacaggcaccagcagtggtggtggcagtctgggtgtgctggaccacagtctcctgggtggtacatgtgggcaggggctggtagcagcaatgtcagtgtagacaggcaagtacccctgcttttaggaggtgcatatgggcacaagcagcatgtggggtggtcctgtccttatactgctagacagcattcacatatactagtggcagcacacagggtgggtctatacccaaaccactgcacagtggatgcaggcccacgcactgactttttcatgagcactcagtagagtccacagataggagttggtgaatgaatattaactcccttttggtgccctcactattctagactggcacactaacccacacttagcctttggaagctcctttaaaatgtgattggtttcttcttccccacttgtattgtggcctacagctttttctcatgtggtttgctacaggtgagagagtttatgtcttttatctctccttagaagggtttatctctctttcaaactcagataactctattttcctcagttttctgattggttcaataaagttatgattttgcttttttctggacttttctcattgttgtgatgagaacaatagtctttgcagctttttaacacaaagcagaagtgaaaattcatgcttaatttttaaaatttctatgataatgatgacatcgaactattagtaagtgtatctcaaggtaaaaggtgttcttaggttgagtttcctaattaattaatattctagatcatttaaaattttggacaagttcttgttagatctgtttagacaaacattgctttttattgaaatatggctgaaatgttcattattaagagtggagagaatgtcagctgacactttcttgtttgctcgtgcttgcattattagtattacctttaaatgatggtatctttaaacgaattttttttaggccactagtctctttgtgagggctaattttcttaaagctagataatagcaaacctcttaaccaagcacactcaaactgcaatacatcacattacactgaaagtgattaaatggcagaggtttgtactgtcagcccctatgagtttgagaactcccactctgcctcaaagatccttttgtattatacatgatatatgactgtatgacatagttaccaactgagagaatcaggatcaatccacatattaaatatttataaagcttaatttctttccttagataaaaagtttgctagaatattagaaacattagactattagaaacaaaaattagaaatattaggaattctaatattttctcactttaatagatcttcttagatactccctggcttgcatatccccgacttaagcgatgctgcactcgtgtatatgcttctatagagtagaacttctgtctcaatcgctgtttgttcctcccaatgccttgtataggcctgatactttatacgatggcaatgcatacttacttgatgcataaatgaacacatggtccctgacatcaggaagccttgtcattcaccaaatggatccatccggtcaattatgacgaacatgtgaaaaaaatagaaacctatctaagatgatatattataactaaattgtaccatagtgatgacatccatttgatttttaaaaaggcagttaaatacaaattgatatcttggagaaaagtacatagaaaaagtccacttgggctgagccttgacattggggagcattgcagtagtcagaaataaaaatgttgttttccatcaaagagaacaacacaagcaaagtagagcataagcagggtctggagagttcagatcataaggagtgggagcagccgtccctgcaatttgaccacaccagcagcatgggagttgggagggctgagaaatttattcaggcagagacacactcactggccctaactgtgattgtcacttctggtcttcagtgccttctagctggttcagcagaagccaatgcactggagcagccacagaaccacagaagcccaagcagaaatggatatcgccatggcctcttctccctccatatcactccctgctgcatgaatttgtccttgcttagcttgcttaccttaaaaaacaaatatttacttagttattaaaatgaggcaagtactatacaaggcatcaaagttaatgaaaataagatgtaattcttgcctttaaggaacttagtcttatgagagagacattgacataaagtgaatatttaaaatgtcatgcactaagtaccaacatagagtttacacaacacattataggagatcagaggagggataagtaatccagttctgggggaaagggaggtgggatgaagagaaattgtgcaatagagataatttcttagagaaaggtacaagaaagctgagtcttcagggttgagtaagagttatttaggtaatgagggaataagagagctacttgaagcagaagaaaaataaatgctactagattaagaagtattaataaaaggcaggtagtagagaaaaattggtctagagagttaagcagggacctgtgcattgaagtatcttttaacaacatgttaaaacaactgtagtgatttagctgagagatgatagtgacttgagttagggtagagaagaggggacagatacaaaaatatagcaatggtgacagcagcacatgactacttggatatgaaaccacatgaatctgaaatctctaccttgaaacaagttggaaataatgaaaagaagaaaagatttttaggtagataatgtgtttggtttcgaagataatgagtttaagggaccagtgggacacccaggcgaaagtttccatcaggcagtcggaccacaaagcccggatatgaggtgagtaggctgggctggaaataattctcaatacacgtgtaatagctgaaaccatgagatgtggatgagatcatccccagaaccctgtgcacggttaaaagcagtagggcaagtacaactggataaatgagccatattccagtgagtgacccaggaatcctgccaagacccaaggacatatccctgaaggacccgcaacatttaaaataggcttggaggacaaaagtccacaaaaaatcagcaaaggaagttttgagaaaaataaagagcatgagagggtgggatcacagaagccaagatggtaaaacattgtaaaaaggacggagtaggccaggcatggtggcttgcacctgtaatcctactcaggaggccaaggtgggaggatcttctgagcccaggagttcaaggcttcagtgagccaagattgcaccactgcactccagcttgggtgacagagggagactgcgtctctgaaaaaaaaacaaaaaacaaaaaggaggaaagagtgatcctggtgtcaagtgtagcagagactttcagaaagagaagaatgttccttgagtttagcagtgtcaagatgaccagcaatctcagtggtggaagcaggatctggagtctctcaggtctgggctgaggaaaggaagaaggatcccaacaactctcaggcatcgagtctgctctgagactcaggagaaagtttggcaggagagtgggaaggagaggcagggctgtgtccagagagcggggctgctccagtgagctctccctgccccgtgggaagggcaaccaaagagaacagtggtgacactgaggacgtcagggagcagtcaggctgggagctggactggctgtccacatggaaactgatgtcactagaaaatgaacagggatactgggaggctggtcagttttcagtgagtttggggaaggacaggaagtcagtaagtgatggagatgaaaagggtggaagatggcagagcactgtgacacctacctgagagaagccaggatatttacctgagagtagaaggaagtagtctggagcagccttgggaaatgaggacaggtaaaggtttggggatgtggagaataagcagtctccctgagggagggccccaggggaagacctcagtgtcctcaaggaagagacagattttccttaaggccatgaaaactgtgacatgaactttcatatgcctaccatgagcaagagtttctcaggacactcagtgaaaaggtctgagaatctaagaggagaaagcacagagcagtttgggaagagtgtgggagaggctgcaacaggaagatggctaggagctgaagctgggggcaggatgctggggtcagtggtccaagcgactcggctggacaaagagctgcttttgtgagtgaggaagtgatccgaggtccctaaggtgggaccagaggcctcgccaagccagggagtgggagtctgtggctggggaagctccacatgtctggagcacaggcttcagctgcagacccagggccataggaactgaggctattgaaagaggccaggaggatgactacatgctgctatcctagcccccaggccttctcagcctccatggtgccacactgatttttctttttacctgttccccgaccctcagcatatccccagcctggggccatggcactttgtaacactggcactaccaagggaaaaaagagtgtctatgtaagcccattttccagatgatagaaactcagtcttttgagaatcaatttcatactttaaaattttttgatagaaattggccaagttggccaggcacagtgtctcacgcctgtaatcccagcactttgggaggctgagacggtgggatcaatttgaggtgaggagttcgagaccagcctggccaacatggtgaaaccctgtctctacaaaaataacaaaattaggcaggtgtggtggtacatgcctgtagtcccagctacttgggaggcctgggtgggaggattgcttgagcctgagaggcagaggttgaagtgagccaagatcacgccactgcactccagcctgggtaatagagtgagactctgtctcaaaaaagagagaaagagaaagagaaaaggaaggaaggaaggagaaagaaagaaagaaaaggaaagaaagaaaagaaagaaaaaggaaggaaggaaattttttttaaatcatcaattctgacagaaatgtttttaatgggcattgtttgtgaaaggacaattttaaatacgatttttttttttttttggtaatgattaaggggccttgtgtctgttttgaaaagacgtagcacataaataagtgaatgatgatgactatggtcatcattattgacatcagttacatgtcctgttataatatgttgatgctcagggtcttttgagacagactagtagcagcctctatgctgtggttactaagcagtccctaaaaaccggctcttggaccactttgttgttgtcgtcattgttctgctgcctccttgactgcgctcattacttccctgcttcttctaatggttgcctcattcttcacagcattgtttaggtaaagtcctgaaagtaattctgcctctctaatgggatcacccacttagactttgtgactgctgtttgctgttcagagaactttgtgctttcttccagaattggaagcttggcccatgttgccagattttatttatttacttaaaaaaatattgactacttacctgccagattctgagtgaggaactaggggcatagcatacaggaaaacacaatctttgccatcatgaagcttagagtttagaggcagaaacagaaacagacaataaaccaacaaacaaaaattataagttgagaaaaaataaatgaaagaagcaaacagaatgacaaaatggagaatatcagtctttctttgggtggtgtgtgatggaaggaggggttaatttagattgagtggccatagaaggcctctttcagaagttgtatttaggataagccctgaaggatgaagggagtctgccaggcagagttggagcaagagtgaccccggagagaagactgtaaatgcatggcccggaggaaggaaggaccttagtgcttatgagggactgaaaggaaatcagcctggctagaacatggtgtgtgagaagaaaagagatactgtaaatgagtgacaagaggacaggccaggtgatgctgggtggtggacaccatggcaggtactattcagagtttggatttaattctgagtttagttggaagtcactgaaggtatgtgagcttgaaagtgacatgatttggttttgtttacaagatcatttcaactgctatgcagggaacagattggaaaaagggaagtggaggtaaagaggtcagataatgggtgttgcaatactccaagtgagagatgatggtggactatgtaagttttatggatcaacaagcaggcatcactcgtgtctctttttaacttctttttttttaactttttattgtgaatcagtttcagacttaccaaaaatataaaaatagcacaaagaatttctttataccctttacacagcagccgcatgtattaacatcttccataaccacaattatgaaacccaagaatttaacattgatacggtagtattaactgagctacagtgcttattcataaactgccaattttcttttttgttgtgtaggatctgatccaggattacacattgtcatgtcatcttagtctctccgatccacagtggttcttcactttctttgtttttcacagtcttgacaattggaagaatactgaccagctgttttgctcaccacccctcaatttgtgtttgtctgctgttcccaatgattatattcaagttacacaagaatgatactaggctctttttactgcatcatatcaggaggcccatgataactacttgttgtatcactggtgatgttaacttagtcacttggttaaaaaggtacctgccggttttccccattgtaaagttattacattttcttttgtaattattaagtgtcttatggggagatactgtgagactatgcaaatatcctgtttctcctcaagccttttccttccaatttgtgtatacattgatgattcttgcctacagcaattattactgtagtgtatatgttgcgggggtaggggttaatttagattgagtggtcacagtaggggttaattttgactgagtgccaaatgtataaagaatcatgaaatatatttcccaaatatctagtagagattttctgttttataacttggcctagttgtaattacaacatttactagttggaattctatggtaagacagtgttttttccttattcatttattcaagtatgtatttatgtaagtacggattcatggatatttgttttgttctatgggttatatccattctatcactattggttttgttgcttagattttccagatttggccattggggacaacctcaagttggttcttatgtcttttcaacacgttcttatcattttttgagcattatcttaccttcttcaaccttaagtgttccaggcttatcttgtactttcccagcccgagccatgaaatcagtcatttctccaaggatccctgtttctgttcttggagaatgaattttagaaacaaagatctgggctctgggtatgttcactgtttcttagttttcttggtggacagaatttaaaaatataagtatgaatatacacacataataatcatgtatctctctctctctctctctctctctgtattaaaaactggttcattccaaccttctctctttccttatttgtaattcctttctctgacagcaagaaacctgactcacattagtcactataaacttgttaatttgctgagtcctagaatacacacaaatattgccaagtcatacccttgtggaaaaaaaaaaaaacttaccaactagactacagtatctgtgtagaggtttttttttctttagcctgatagtatttgtgatggtcagttttatgtggcaacttggctaagttacagtcctcatttattcgagaaatcaaacctgtaaagggattttgtagatggatttaaagtctataatcagtttattttaagtaagggagattatcccagataatctgggtagacctgattcaatcaatcgaaaggccttaagagtgaaactgaggcttccctaaagaagaaaaaattctacctgtgaatagcagcttcagctcacaccctagagttccagcctgccctcctgatagcctgccctgtgaatttctaacttgcctagacagcccctacaacattgcaagcccattccttacagtaaatcccttagtatatatgtccttttgatctgtttctctgggtgaatcctgactgatgtattagccaaacaaaataatgttttctgctttccaaaatcacttagttttcacccaatcccttcagtgtaattatattactcatttgtaattcagttaggttcatttgttagtgtttgggttccattttgccttcccctatattgtggctgattttaattatttatctaatttttgagtatattaaaaacatgggtttaaagatcagaactagacaaaaatgtatacccagaaaagtcactcatccttcatcccttctgcttcattcccatccctttattctatctactctatttccatccactttctgtaagtaatcagtcccgatagtttctggtatacactttctctatttctttcatttgacacaaatgagcagatatatgtatatttcttatgttctcttcttacagaaaagagcataatatagatgcctttttcataacaatatatcctggaaatcactctactccagttcataagctcctcttcattcttttctatagttgcatagtactccattatgtggatgtcccatagtttactcaaccagtctccggtgaaggggcatttaggtcgtttccagtatcttgcaattataagcaatatcttaagcaatatcaagttaaaaaaataaaatggtgctctcttttcatacttttctgagttggtttataaatcttgatgtccagagagggaaaatgttgaaaggcatagaagacattgggaaatgggcagcagtgtgcaattcaaacttagcgatggaaaagccacactttggggaaaatcgccctgcattacggtggatacagcaatgaaaagaaaggcagatgaactggaatatattcttttagtcagtggtccatcaggagaatatgtactccaagggaagtacaagttaatcctttagggtacagaaagaaaatattcaggccaggcgcagtggctcactcctgtaatcccagcactttggaggcccaggtcaggagttcgagaccaacctggccaacatggtgaaaccctgtctctactaaaaataaaagaattatccaggcatggtgacatgtgcctgtaatcctagctacttgggagcttgaggcagaagaattgcttgaacatgggaggcagaggttacagtgagccgagatcgcacaattgcactccagcctgggtgacaagagggaaactccgtctcaaaaaaaagaaaatattcaaactttattttatatttaagttttagctaaaaatgagatgtgttactattatttaatacacaggttgacagtgatgacttcaccgtaccagtgtctgttggtcacaaaccacgtgtatactctgcagcaaggatgggctggcagtgaaaacctcatgtgtcattttgctttcagcgaattgtaatgtaccatagtctaagtgctataggatgtcactggtatggctggatttattaaagcaagacttaaaacacggaagaagctttacaatgcatttttaatgacataaggagtgactatgaacatcttttgtatctcagagaaatttactgatgaatgcataaaaaattactttgaagagctgttaacttagagatggaatttaacattcttctgttacaaaaaaggaagtgctccaaagtgaccaacctttctttaataacatatgacattaagttgttcataatcaagcatatattttatattttcaaaaaaccccacaacctgcttcttcaaagtaacaaagaatgagaaggtaacaatatttcaaaagaacttaatgctttgagaaatcatttagaaggatagaaacatgatttggtcatcagaaaaaaaaatgtgtgtcatctatttttaaaaatacccttatatctgtgcccttaaaataatttagaaataattttttagtctccttaaaatttttccaaaacaaaggcttttaatgagttttaaacccagatattttaaagttaaaagtcaatgttttctgatttgtttgcaaggaaaagtggtcagagctggggaaaatagaactttactggccaaatttcagtgaaaaccggcatgtgcaggcaaggatacacctcttccatttggattagacatattgcaagatatcttctcatttatagcactctttaaaaccaagaatctggatagactaagctgggaaccagaactttggattgttaaatcacaaggtattaagccaagatttaaaaaatttaactaggcatattcaatcacattactctgtcatttgttaacattaattttagtaagattaaaaagggattttaagggggggagcagtggctgaagactctaatcccagcacttgggagaccaaggcgggtggatcacttgaggtcgggagttcaagaccagcctggctaacatagtgaagcctcatctctactaaaaatacaaaaagtagccaggtgtggtggtggcatgcacctgtagtcccagttagttgggaagctaaggcaggagaatcgcttgaactcaggaggcagaggttgtagtgagctgagatcatgccactactctctgcctgggtgacaaagtgagattgtctcaaaaataaaaataaataaaaagatattttaaacaattattaaacaaaaagaatattattttaaaacgtgatttatttaccatttacatattcccttttcaggaatatggatgccttataatacatataatgtatcagtatattagtacttatgtgtaaattataaataaataagcgtatgctgagggagtgtgttcaatttttaactgattgtggtatgtgaccaagatgtctgaaaaacacctaaagattatgttttgcaaatgaccttttcaccattaatacctggctagcagacttttaaaaattatttcatttcctgattttcagagtaataggtttgtgttctatctacctctaaaggtgacttttattatatatatataatgagattttatttgctttctccctctttctatgtgcgtgtatccatacaaacatacacatgtatacacatatgcatataatcttttttaaccattgagaatgagtagcagattgttttcctttattcctaaatatttccgtgtatatttcctaagaacaaggacatagccatagtacagttatcaaatcggagaagttaatgttgattttgacagcagaatttaaagatcttgacttaatctgatcagataataaacttaaaactgaagaaaaaactaagaataagtccaatgtatttacctgaattgtctcatctgtgatatagaaactaacacccactgggccaggtgcgatggctcatgcctgtaatcctagcactttgggaggccaaggtgggtggatcacgaggtcaagagtttgagaccagcctggccaacatggtgaaaccccgtctctactaagaatacgaaaattagccgggcgtagaagtgcatgcctgtaatcccagccactagggaggctgaggcaggagaattgcttgagcccaggaggcggaggttgcagtgagcagagatcatgccactgcactccagcctgggcgacagagcaaagactctgtctcaaaaaaaaaaaaaaaaaaaagaaagaaactaacacctgctttacatactcaacaaaagtgctatgaacattaaggaaatgctgaaagtactttggaaaacaaaaatgttgcgtaagttaaatattgtcataatcattttctataaattttatcgttgatgtgtaagaaggtggttgctcttaaatataattattttaagcattgttttaaagtgttaggctattttaattttaaaaacatacatatatgtgtgtgtacacatatatgtgtgtgtgtgcatatatatgtatatatatgtatctccactaattaaatttactactgcaccaagaataaaagtcttaacgtatgcataatataaatctacaattatgactaggagcccagcaacaaaataccatgcaaggcaaaaggtagaacgatgaggatgaagcattgccattgtgagtgtgtggacagacagctgttcctgccttaccgtgttaaccaaaagagactgtacctggttcacagctagtgcaatttactgttaattaccaatgccttgcagattagcagaagttaggtgagacggggtggaaaacagccatgtcaacttaatggcactcttatcaagagtccccaagaaaccagaaactcagaagaaaacaggagcggaaatggagagtaaccagagaagtttgttttgaacttgattctcaggtggtaggagcatcaaggaagcattctggagtgtgttcacttggtctctctttctctcagatgtgccataaatgccactgatctctctggagaagacaaagggcttgaggaaaaacttattgctgcctttagcagagaggacaaaaagattccaggaaaaataacctagaatgtagtaaaagtcgggggaagtttttacgaaggcagggtaacatcttaacaattgtatggcttagagtcaaaagtaaaggaagaagcttttcagccttggagctggctcccccagccctgatgaccctcctgcttaggatgaatccagatcttctgaggaaaaagcaccagcactgccctcaagaataatcaagagaatatccaggtattgacaggtgtaagaaatcctgacctggacatcaggcagagcaatgactggaaaatggttccctccttcctgaatcggatgaaggaacccacccaaatctcccaaggcagatcagggtttctcatttctgcttccacttgaggtttgtaattttggaacagatgagaggagagaagaaatgagcagctggctacatagatggtatccaaaaacaggatttggtcttctaaacagggctgatgatattagaatgataggcttctggcaagaagaagaaggcgtctctcaaaaaccaggataaacatgtttggcaagaagctgtatgatctgatgaagaggacttcaaaatgaaatttagggcaaggggcagggaaatgtgcttatataatgctctgaagatactgccattcacattcaggtctgctctctgccattctccccctgctccgtgcctgggaagttcacagtacagactgcgtcatggggctcccatcccttttctttggcttgtaccaatgagagccaccatggagaaactctgggttcaagtaaccacaccttcctctttccccttcagaccaaggagttgtaacaactctgtgtggttgccactaaagctgctacattatccagcctcagtttcccctaatcatctctacactttgtaagtaagatctttaaaaactgcttctcaaattgcccttacgtataccagctgtttcttccatgactctaacatacagttatctatatggaggatggtgagtgcaagggaaaagaaggaagtgtttgggaggaagtttctggtgattttctataacaaggtgaaaaggaaacaagacaggagttgtgccagttgttggcaggagcactgatatctgtggctacagaagactgcacggccatgaatgtatttggatgatgaaatgaagcagaacttttaattcagcttgttaaatacaacccaagcagtgaagcttgtcactgcagggcaggagttcaaaagaaactgatgaatcctagggttttggaatagcaccggctgtcagaaaggtgcacacctatcttagtatccatttgactgaggatggactcagctaatgaatgaggagggagaagggaggcgtgaaagtatgggactgtctatactagcgcttctcaactaggggcagttgtacccctcatgaaacatgtggcaatgtctggagatgtttttggttatcattgttaccagaaaggggtcctgatccagaccccaagagagggttattggaccttgcacaagaaagaattcagggcgagtccacagagtgaagtgaaagcaaggtttattaagaaagtaaaggaataaaagaatggcagactgggcgctgtgactcacgcctgtaatcccagcactttgggaggccgaggcgggtggatcacctgaggtcaggagttcgagaccagcctggccaacatggtgaaaccctgtctctactaaaaatatgaaaattagctggccgcagtggcgcacgcctgtaatcccagctacttgggaggccgaggcaggagaatcgctttaacccaggaaacagaggttgcggtgagccaagatcacaccactgcactccagcctgggcaacagagcaagactccatttcaaaaaaaaaaaaaatggctactctataggcagagcagcagcatgggctgctcaactgagtatacttacagtttcttctttattgtatgctaagcaaggggtggattattcatgagtttttcaggaaagtggtgggcaattcccagaactgggggttcctcccctttttagaccatatagggtaactctggatgttgccatgatgtttgtaaactgtcatggtgctgatgaaagtgtcttttaacatgctaatgtattagaattagcatataatgagcaatgagaatgaccagcagtcactttctttgggatcttggttttggtgagtttttgccagcttctttcttgctgtttttatcagcaaggtccttatgacctgtattttgtgccaacctcctatctcatgctgtgactaagaatgcctaacctactgggaatgcaccccagcaggtctcagccttatttcacccagcccctattcaagatggagtcgctctggctcaagcacctctgacatcatgactggttggagatgaagatgcttctggcatctagtgggttgacgctaggaaggctgataaacgtcctaaaatgcagaagacagccccaaagaaactttcagccccaaatgtcaatagtgtggaagttgagaagccctgatctacggcctggccagccaagtggaagctgtggaccatgtgtctattataatggttaagaatgcagtctccggaattagctagacctgagtttgaattccagctagtgatgttgggcaagtaatctaacctctctaggcttcagtttcgtgttcttttcagctttcaagcaagatctattgaacacccccttatgccacgtcacactatgtggtcagcaagtacaaatgatcacagtaacatttaagttagctagaactcccaggaaacaggacattctgagtcatggacatttccggttgaaaactagtgttcattcctgtctcataatatatgtagaaacaattttcttgctcccattctgttattgttacatattatggcttttataaaatttactggatcgtgggaaacaattttcatgttcccagtagctgaggcagccactatataccattcaacagccagagcctttttgtgagagtgatttctttgtgttttttaatttattattttaaaattaatattattttaatagaaagataattgtatatgtttatggggtataatgtgatgttttgatatacaatgtgggatgattaaatcaatctaattaacatatctattacctgacattatttttcatggtgagacatttgaaatttattctcttagcaagtttgaaataaacaatatattgttagctgtagtcaccctgctctgcaatagatctcacagacttatggtctctgacgttaaccagtatccccctatttcctcccagcttcagtttcttatctttaaaatggggaaaataacgagacccacctcacagagctgtggagcttatatacatataaattgtttagcacagtgcttggcacatagttaagttctcaagaaatggttactcctattatggtaattgttaccttcccagtacagattataattccattaaaactaatttatgaggcaagaggaaagtttccgtggagctgataggttttgtaattaggtagttagatgtgtgtgttcacttcacagaaattcactgagcttgcaggatgcagtggctcgtgcctgtaactccagcactctgggaggtcaagatgggtgaatcgcttgaggccaggagttggagatcagcctgggcaacatggtgaaacccatctctacaaaaaatatacaaaaatttgacaggcaaggtggagcgcacctgtagtctcagctactcaggaggttgaggtgggaggatcacttgagctcgggaggttgaagctgaagtgagtcaagatggcatcactgcactccagcctggatgacagtgagaccttgttgcaaaaataaataaataactaagtaaatagattgagctctagctctacacttatgatttcggaccttttctgtacatatattataacttttaaaaagcttacttaaaatgattaataggagtctcattctgcctgccttcaaaaagccccatgatatttaataaattcttgactttccttgccagtgattcaatctctcagaagttgaaagatgcaatgaaggacagttactctccactgaccagtttgctctccactgaccaaaactgaggaactgggaagaaagatgagaaattgacagcaatgtcatatacaagggaccatcatattatagtataggaagaaaatgtttgttgaagtgctaacatctaatttaggttttaagaaaatagaattcaaaaaagtttggagaaaaaatagctgtgaccatgtagtctgatttcaaaaagaccgagtgacttaagaggaatggcaggttctaaacagaaattctaactctttagtcataaattatcgtgataagagagaaaaatgggaaacagtgtgtccatagagggagctcccagatgatctcaggtatttaaaggatctgcgtaggtgaatgaagaacactgagctgagggctaacacagaatgacacaagtaggtattattcctgcatggtaaaggtcagaactaggcaaggttttgtgaagcatgccaacgacaattgaaaaagctttttagctatgcttggtgctggaaagacaaggaagcatatggccatttgtcaatttagtgttaacagcagcacaaagaaggcagaacaattcatttcataattttttttaattttctctatcaaggaaaatgattttctaatgataatggataccatcatattggctaggaaagaatttgagcactaactagttgaataaatactaagagccccctccttgtttttcatgggctcaaatctgctgctggatgaaaaatgtgcagatgtgattgggaaacccttacctcaaccttgggtgaaagggcacaagaacctgcctgaaagctgagagaaggaccagtgtgcttatttttaacgtggggaaatacatatttcagaatctgccaccctgtgagcttgatgctgatacccgggaaaattctgggttgatttaattaaattaggtagtttatgaatacttgatggaataaaggagtgaaaagccctgcactcagcctgattttccagggaaaaatgttatactaataatatactgagcaccacctgccagcgtgtctccaagcactccatttcttcaggcctcaaagaatcctgtgaggcaggtcctgagacagtcaaatcctaggcagataaaaaggagtcccagagaatctctgaccggcttcaaaagtgtttacatcagatgcttttgtgcagatgagggctagatgcccagggcttgtctgtgcatgcacacagctgactagaccctggcgtgtgcactgggggaagtgggtggagccacaggaaattcacacattatgcatgggaagagcctgctctcttcagctcctgcggtgacctgggaatcaatcagtgaggtagagggcctgttagcaggggtccatcacacattgctgagatcttttttttcttttctttttttttttgagatggagtttcgttcttgtcacccgggctggagtgcagtggcgtgatctcagctcactgcaacctccgcctcctgggttcaagcgattctcctgcctcagcctcccaagtagctgggattacaggcgcctgccaccatgcccggctaattttttgtatttttagtagagacggggtttcgccatgttgggcaggctagtctcgaattccttacctcaagtgatccgcccgtctaggcctcccaaagtgttggggttacagtcgtgagccactgcgcctggcctctttttcatttttcacctttcacccaatacaatcctgctctacacaccctttgatgtgtccacgtgcctaagttttcctggttgtgtgacaagaagccaggttttagctgaactaaggagtaaaattcagcaacagtactaccattatctctatttccagatgagaaaacagaggcacaggggagtcaatgaacttgccagaggtcacacagccagtgtaacagagccagagctcaacaggcaggctggctctggagcttttgctcttccccttgactctgagaggctttcagcaaagcaatggataatgagcatcaacatgcctttcatgacaacaggaggaaatgcagtctgcacaggctgcagtgaggcacagtagcactcgtttaagcagtcgcaggaagagaagttcaagtgaagcctccctgccattttggaagtcctggaacaataccttaggctgcagcattaaatactggtgatatgtgagcacttttgacctataaaaatggtagttttacgtgttccagcctaatactttatcctctcttgcctaatactttttcatattcttttacctggacgtgtgtagtgcttgttggaccattttcagatgtcacatagctgggattgatacctagtgagataattgcaatacagaaaggtcattacagtttggagaacggggatgaaactatcacaaaatgaattttaacagaaataaatgtgaagctctgaattcagttttaaacatttagtctccacaaggatagggtgagagagacctgattaaccaaagttcctgtgaaagcacaggatttttggtctccaccagctttcttgagtccccaggtgctgaggtaattggggcggtcaaggaatacggggctggataaaacaacctcacgttgatcatttaactctgtctaggggaccaaagtgccagggttgggggcagtcctctgacatgcacaaggtgttaaaagaagggtgtttattgtacaccgagcagtggagaatttggaatttttagcctgaagaggcttggggaaaactgatagcagccttcaagtatttaaagggatactattcataaatcaagaaacatttactgagtacctgccacatgaaaggaggagcactgtgtgctgtgagagactgaaaaatgagaaagaatgctatctgacctcaagaagtttattaatagagaggggttgtctgacccagagacaactaatacagggggtaaatcaacagttgctataatagagacacaaataaatcataatcattaagtgttctttcctttcttaacagatatttgtagtacaaagaacttcaaatatctgaaagaagtagagagaggtataagaggtgttaggagacttaaggagaaacaggcttctctgacctacagggaaattgttgcctgtttagtccagtctattttccattaaacattctgtcttgctcagcttcacgaataaaaacagggaaataaagcaactttcttttaattgtatttactacaagacttatttgatggtaatttccttcagtacaattatttatggatttacttatattctgcttttcagcttcttttacttttattttttgagatggggtcccgttatgttgcccaggctggtctcgaactcctgggctcagcaatcctcccacctaggcctcccaaagtgctgggattacaggcatgagccactgcgcctgacctcagcctctttttttcggcctgcatacacatgcacttacatgcacacacacacacatatgcacacacacacacagacacacacacacacacacaagcacagtgattccaacaaggagatctagtttttacttaaacaaaggaaggagtcacctctatagtgtgatttgagggttgaggtaccaaggaaagcagctacccctatcccaatcttataaaaccacttcttttgtcataggatccaacgctaccattcatgaatcatcccttgagtgccccctcctggctccccagagagtcctggggggagttcctctttgaagtcttcacaaccaatttaagttgtgagctgccagtcttctttgtgacagccaagtgtaccatgagagtaccacaggagtgtatggtgggggttgtatttcaggaaatagaaaggatgaaatattaggatcaactaagcagatttcaccaaccttacatttttttccctgcagttaactcatcattatcttcattcatgttctcaagacaatccttaataaagtattaaacaatcatttggggccgggcacagtggctcacgcctgtaatctcagcactttgggaggccgaggcgggcggatcatgaggtcagaatttcgagaccagcctggccagcatggtgaaaccccgcctctaccaaaaatacaaaaaattagccaggcatggtggcacacacctgtagtcccagctactcgggaggctgagggaggagaattgcctgaacccggcaagcagaggttgccgtgagctgagatcatgccactgcactccagcctgggcaacagagcaagactccatctcaaaaacaaacaaacaaacaacaaaaaaaaaaaacagaaccaaaaaaaatcatttggatttgagctatattccatgttagtgtttccctagtatttactagtggttctaaaagaaagtgtgcattccttgggctcaacagatggtagaaagagatggctggaaagttgatgagaaaccaaaaacgagcattttgcatgggaaaatccaaaatctccacaaggacctagtctgattgcttatgataaagttctagcactggtccaccaatgaatcacaatgaaaatttccagtaattttgaatttgccaggctattgcctactgattttataacatctgttaacatgttcaggtactggggcatgatgagtgtctatttattcataagactgttgtgggggtgcctacatgctttagtcaaatcatgtaatagttctatgcctcacaactgaaaaccaaatagttcctgtttttcttttgcatacagtctcaagtgttgatggagtagcactgtgatgttcattaaggttagaagacgctactcatgaaaactcttgtttgctaggcaggtgggattatgggtgggttttattattctttcaaaaaaatttttttaatcttgacataaaattccttttaaaataaacatttttaaaaggttatgaaaaggtctttccaggaagaaacagaatattttggagagttcccagccatgaggtcatggagacaacaaacaaatgggtcaagaagtgccaattgggcaaacaatttcaacatataaagagatcactgcataacttctgtgaataatcaagcatatcaaagttgttacatcaataaaacttacatataattaagtactgcattttttcatccagatgttccagtggctagcagataaagcctcaaaaaaaaaaaaaaaaaaaaaatagctcaaggggcatttcaaagccattgtttatgtcagcataacgtacctgaaaaaagtgtgaatagctcatcttgtccatcagacttggcttgtctttgtcttgcttctgcagggctgtgagtgactagggttaatctggtaaactgacctgtattaaggtgattattattatattcaagtatcttggtttttttcgtgatttaaacaaaatgaatttgtgaattttcggtccctggaaacttcatgtaagtggagattggcaaaggtgcaacttgcatttcacgaattaggcagcccctacctctagttccccacagtctaaagatttcttatgcatgattggtgatggggacccattgggactttgatggctttagaggctgttgtaggctgaaaaacagctccccaaaagatatccacttcaaatccctggaacttgtgaatgctaccttacatggcaaataaatgtgattaagtaaaatatcttgaaagaaggcacttaccttggattatccagatggaccctaaatacagtgtagcatgtgtcctcatgggactgaggtaaagggagttttgagagagacacacacacacagagaagacagagcagagagagacgtggccacaggctgaaagatgttaacaatcaccagaagctgggagaggcaaggaatggattctcccctagagactctggaaggagtgcagccctgccaacaccttgattttggacctctggcctccagagctgtgagagaatacacccctgtttttataagccacccagtttttgattatttgttacagcaaccacaggaaactaatagtctagattcaaatcctggttcaaactgttaactgctcatgatcttagtttgttgtgaaccacagtttcttcaaacagttgtccctcagtatttgcggggggataggttccaggacaacctgtggatactaaaatctgagaacgctcaagtccctgatatcaaacatggtagtatttgcatgtaacctacataaatccttctgtgtactttaaatcatctctagattacttataatatctaatagaatgtgaatgctatgcaaatagttgttatactagattttaaaatttgtattattttttatcgtgatattgtattttttatatatttttctgaatattttctttttgaggttggttgaatcctcggacatccatcccgcagatacagagggccaaatgtatataaaatgaaagtatatgtgtaagatgtgtactatgtagtgtttggcacatagtaatagttcatgacatgttttttgtgaaaaaaaaaaaaaaagtttcagtggttaaagctcacatcatcatgtccacaaacataatgtggttctcagcttacacacatgttttataagcatgtagaaaagaagtgcctgtgttggtgatgggagagggatgacacataaaggggcaatgggccagttaggaaagcacgtgacagaggcacgacagggaatcagtggataaaagattgtgtgggaggtcaatgcagggatcatgggattcttacatgattataaaggagatggacgaaagtcctcagaatttaatgggaaaattccctggtttcttcttgaaggacttagctttttatatccacatccatattttaaacctcataactgaaatctaagtacactcttcatttgtagcttgtcagctgagggaaaattacagaatgggtcacagcagcgggaagattatgggttgcatctgataaatggctatttatatgtactgagctggctctggggtattctcagggtataatttcatagcagagttaacatcatctcataaaatatgacaacaggttttacactgcctatctgaaatgaaattgcagccttttgtaatgagcaagtgcagcccagaaggcaggatggattgagtttccctggtacctgccatgtccagtctcaggcctttccagtggagagaggacacatgggcacattcccaattctctgtggcacccccagtcggctttgggaagagcagtctcccacctccacactctagggacggctcccttctttctaaagacgcatttcctgaagcactgggcgtaaatcacaatcacatctcccccattggctcacatcatcatttccaagatgatttacctttacttctattgatcttcaattggcaagaactccataactctccctctctgcaagccctgactcagtgattaatgatttatgaaggaaatctaaatgccccagaggtggtccacacttgaaggaactgccgaagtaaatattttaagtgagccctttttgaaatgaaaataattacagcagtgttaatctctttggtcatttgggactttgcttcccctcgttttgggagggaagggactgtttgtgcgttgtttggacagcacacctgtattttccaagcgaatttttcttggtgaatgagttggtctgactctaagtgaaagcaagacattctgttttcagcccacctggccccacctgggtttccacgtaggaaacttttcttcatggagttctgccctggagtctgagcacctttgatagaaaggaatgtatactagggtattaagttccataaattcgttattactcagttattttatatccatctattctcttacagctggtcagtaccaccaatctgtccccttttggtcattctagacataaagaatcttggccaggtgcagtggctcatgcctgtaatccgagcactttgggaggctgaggcgggctgatcacctgaggtcaggagttcgagaccagcttggccaacatggtgaaacctcatctctactaaaaatacaaaaattagtctggtgtggtggcaggtgcctgtaataccagctaccatggaggctgaggcatgagaatcacttgaacctgggaggcagaggctgcagtgagctgagatggtgccactgcactccagcctgggtgacagagcgagactctgtctccaaaaaaaaaaaaaaaagaatattatttttacttaatatgcagggtggtcagcaactgcaggattaggaaactctgcccctgttgctctggggcaggatggtgtgtcgacccagctgtatctactcacagagcatctgctcagtgatgtcaagttagttctcagcaccaaccttgggtgaaagagatatttttaaatgttccaatcaaacaccttttctagagtcctcacctacttcttactcccattagcatcacaagtaacatccttcttttcccttgccagcagatatagaaagtcttagaataaatctgttagaaagagaggccatttggaaatgaaaattagactcaaggaaatcttaaaagttacatttttacattacagagtttaaatcccctttcaagcattaaatcatctttttatttttagagtttatggtacataataggaacactgtaaacattttttttttctcttgagacagtctcactctgtttcctaggctgaagtgcagtggcatgatctcagctcactgcaacctccacttcccaggttcaagtgattcttctgcctcagcctctcgagtagctgggattacaggcacccgccaccacttacagctaagttttgtatttttagtagagtcggggtttcaccatgttggccaggctggtctcgaacttctgacctcagatgatccagccgcctcggcctcccaaagtgctgggattacaggcatgagccagtgtgcccggcctaatcatttctttagttataaaaattacaaagagtgaaattcacttttttatgtacacgtctataaattttcacacatgcatagattcctatagccagcatcacagtcaggatagagaacaatttgaatatcccaaagatttccctccagctgcctttttttagttaaaccctttctgtattcctaactcctggaaaccacagatctgtctgcttttgccttttccaaaatgattcctaaatggaataaatctgtaacatttagatactgagatttcactcagcataatgcatttgagattcacctatgttattgtctgtatttgtaattaatcatttttattgctaagttgtattcccttgcataaatggaacacggtttgtttatccattcagacattaatgctaatttggttgtttcctgtgttttggtgattatgaataatgctgctataaacacttgtgcacagatttttgtgtaaacatgtttttatttctctaggataaatacctaaaagtgggattgctgggtcatctggtaaatgtacatcaaactttataaaaaactcccaagcaattttccagaatggctgtaccatttcactttcctgtcagcagtatagaagagtttttgttgatttacattctcaccagcacttaaaattgtcatttaatttgcatttcactaattgattatatttaagcatcttttcattcatcttattaattttattaatcttaagcattatatttgctatccatatatcttctttggtgaagtgtctgtcaaaatcttttggctattttaaaataggttgcttctaatcactgaattttgagttctttatatattctggatacaagtccttcatttgatatgtgattataaatattttctccttgcttataacctgtctttttattgctttaacagtaaattaattttgaggccggacgcggtggctcactcctgtaatcccagcactttgggaggccaaggcgggtggatcacgaggtcaggagatcgagaccatccttgctaacacagtgaaaccctgtctctactaaaatacaaaaaagtggtggtgggcgcctgtagtcccagctggtctggaggctgaggcaggagaatggcgtgaacccgggaggcagagcttgcagtgagcagagatagtgccactgcactccagtctgtgcgagagcgagactccgtctcaaaaacaaaacaaaacaaaacaaaacaaaaaacagtatattttgtagagtaataaaggcttttttattcctacgaagtcaaattttgccatatttcttttatggattgtcttcttatatctaaagactctttgcttaacccaaaatttttaaaatatttcctttgatgagttttatagttttacatttcattctatgatccattttgagtcaagttttgtatatggtgtgaggtataatttgatgatatctccaatttgctattgagtctcttcagtgaatttttcaattctaaaatttccattttgttcttttatatagcttttatttctttgctgagaacttctttccatttatttaaaaaatatttactttgcttattaatgcataattataatagctcctttaaagtctttatctgactatttcaatgtttaagtagctccatgctggcttctgttgattgccctttctcttgacacttgtttaagttttcatagtcctttgcatatcaaataatttggggttgtatctaggacattttgaatgtaatgtgataaaaccctgagtcctatttaaatcttctgaaaagcattgacttgtttttaaaatcagtcgggcaactcaggtttagactcacaacctggccaactttctaaagcatttacagtgatgttctggtccactctgcctatacatcacccagctgcccgtctgaaacctgggcaatggtctactccatagttcagcgcttaaagtccttactgtgctaattccgctcagcttcacacatgctcagttcaggagtaagctcaacactttcttatacacagctttaaaggatccttttctccagcaccttcttcataattccccactctatcctgcagtctctggcctttagggtttccccttcctgatgtctggctagaaagctgaggcattatcctacctatagggtctgctgtactggtgaggaagggaagaagctctgcctcttgctggcatttgcctggtgtagggcagagagactcaacaggactctgcccctcagggaccacctcagctaccagtgagagtagcagggggaaccaattctttgctggtgtttgcctggagtagggccgataaagacaaaaggatttagaccgatggggtcctccctttccagagactctggcttcctaagggcttatttctgtctgtgtccagatttcaggctgcttcagtacccagaacaaaatctatgagaggtcaaaaaaaaaaaaagacacaaagacacaagaaaaatgtctttagagaaatcaccaccaaatcatgcttggagtccagttatccttacccactctgactgctttcatccacttttcagagccttttgatagttggattatgtgtgttgatccagagtttttaattgtagttaccaggagagatatggctgagtgtgcttacttgttcttgcctagaaccaaaagttcatataaatatttatgaatgaggctaggcgtggtggctgatgcctgtaatcccagcactttgggaggccgaggcgagctgatgacttgaggtcaggagttcgagaccagcctggccaacatggtgaaaccctgtctctactgaaaatacaaaaaaatgagcctggcatggtggtgcatgtctgtaatcccaactacttgagaggctgaggcaggagaatcacttgaacctgggaggcagaggttgcagtgagccaagatcacaccactacactccagcctgggtgacagagtgagactctgtctcaaaaaaaaaaaaaaaaaaaaaaaaaagaatgaatgggcaaaaggaaaatgcttaatatctattataatatctaactttttggaaagctgcccatttttaattcccagacctgtgtatatctaaaaattttagcctttcttcttgtctcttatagataaaaaatctatttagaatttaggctccagggatattaattttatattttatttaaatgactaatattgcactgccagagttaccactgctctttctacttggcacagatagcctggaatgagggtaagagcatggcgttatagttctggctcagcaactctctggctgtgtgactttggaaaaattctttaataactcagagctctgtccacagcacaaatgactaggactagatagtccctaggttttcctgcagtcttcccattctacacctccaacccttggtaagcctgatgttaccatcacctcctctctccagcctgggacacactatgctcctttcctcttgtatattgtttgccccaagatctatgagatttgccccctgctccagctctctgtacccatcaacatgggtccattatgcaattcttgaatctctcttctttgaactacaagctttagctcttcttctgttaagaatcttgactttcattttcttcatgaacttagtaatggcaaaggaggtttagtctaagcaaactgtgcagtcacacccacaattcagggatacaggccacatgaggttgactgtcaaagtccattctcttgaaggtttacgctgtgtggaactttaccactttgggtgatttctcctgacacacttgtcagataacagcctggaatcatcagagcatatccccataggttccctgaatttctaagctgttccctagccagaatctttcagcactgtcctttttattggccttcgattcagtggttctccaatgtgggattttgacacattggtgttctggagccaattttggtttttctgctggttacctgttactatccatatttaaaatctggtgtatacaaaatgttttcttttcattttttaaactgttatgtatgactatgtatgagtctagtttgtctacacaagtctgaaagtatttcactggacattagcaccacaggttggaaatagggtttatttgaaaataaaatgcctccacaatcacagaaagttttagaaatattaagctaagcaattttcctctttcctgtagaacttaaccttgaatatagctcatgtactgtggctccccaagggttctagacattgtacaactgctgcataaatttttttgaacacaatgctttttgaaagggacatctcgagggacttgtgtttagaggaactctctttaggaaacagtggtctcaactgtttctccttcccattagcacagtacatcaggaactgtgtcctccagagtcgagttactgaaggtcattgctgtcctttcatgtacacgctctcccttcttggaccacatccaatgattcacacaatattaggaagggcttctttcatcaatggcttcttattactcttgaaataaaactaatattcctttttttttttttgagacagagttttactcttgttgcccaggctggagtgcaatggcactatcttggctcaccgcaaccttcgcctcctgggttcaagcaattctcctgcctcagccttctgagtagctggaattacaggtatgcagcaccacgcccggctaattttgtatttttagtagagatggggtttctccatgttggtcaggctggtctcgaactcctgacctcagatgaccacctgcctcggcctcccaaagtcctgggattacaggtgttagccactgcacccagccataaaacgaatattcttaacatgacctaaagcatagctttgtcttgaccactctccctgctctatctctacactacagtcaaaattttattttttaaaaaattttgtattcattatacaccctctcgctccagatcctttctttacccccatatttctttttgcctgaaaatactctcctcctttccgcaaacttgatttgatcgatgcctagttattctctaggtatcagctccaatattaattccagaaagcctcccctgaatctctggtacatcccctcccttcaaagcacacatcttgattttaattataggcttatttatgtgtttgtttaatattagtcctctccccacctctgcactggtttgaaagctccatgagaacggggaacatgttattagtcagtcaccattatacattgtcaccattagcaatgtttgctaaatgtgaacaaacggtgtctgttggcttctgaatgattaattcacagtcaatagaaagaaccttgtaggcctgaagcagtccggtaactcagctcacagtagccacaggccaatggaaaaatggactgcagccatgtgtcgtgctcatgccatggatcttgtagatttgctgttgatccacaggagtctactcttttatctcatgtgtacttctgttacaccattggagctatttcatttggctgtgttattgttagcagcagcaaagaacccaaggcaattgattcacatagcagaaatggtgactgaggtggttcttccttttgggactctgacatcagaaagtacatagttgagcgatgccctgaaacccatgtgggggcctcaactagtaatcttggaagtggcccaggcagagtcactttagggacattccccagaagctgattggattgtttacagatattctgcttctcctatctccaggaaggtgaaaacttgcaattccttgcccacttaaggtaaggtgtaatcatgagacttgcttcagccaacaaaatgctggaagtgacatctgagaagaaacctttaagaccagtgtacattttgtcttgtatccttcattgccactgtaatagacagttatccaaacagtagaagttccatctgcctaaatccttcagtaaggagatatgggacagagccctgtgctgatgctttacagctgagcagcaaaaaaaaaaaaacacatggcagagttcttagtgttgggtggacaaagctgttagcgagtatcatcagtttcttccccctgcatttatggatctcagtgcaagagctcatgatgattagccttgtgctacttgaccttgtatgcatggagaataaaacttttccttaggagacacaagtatttgggggttgcctgtttttgaaacatatccgagcccatcttgattgatacattatgtctcagggtctgatttaaacattttaggtatatggagtcatttactttttacaaacacactgcagagaaggtactagtatctccattctatgcatgtgaaaaccaaggcacaggctgggaaaagtggctcacacctataacttcagcacattgggaggccaaggtgggaggataatttgagcttaggagtttgagaccagcctgggcaacacagtgaggcctcatctgtacaaaaaattaaaaattagcttggcataatggtgcatgcctatggtcccagctattcaggagcttgaggtgggaggatagcttgggcccgggaggctgaggctgcagtgagccatgattgtgccactgcacttcagcctgagtgacagagtgagaccctgtctcaaaaaaacaaaaaacaaaacaaacaaacaaacaaaaaaacaaaccgaggcataaagagattagatgaaaaatctaaaatgtagtagagctaggattcaaacctagagagtttggcttcagagcctatagtcatgaccatgatgctcctgttcctcttgataaccctctggcctgctatcttttgctgtcttcctgcacccttggacttgatgctgcaaatgacctatcttcattcctagagctctgaactctaggctcctagcttgtctgagaaggagataaccgaatactccttggagaaggttcatgtacatcaactgtcctctctttctcctatttgagcacttggagtttgaatactccatttaagattctataacaggacatccaaattccaggttaccagattgagacaaaccctaaccaacttattatttaatcagtgacacagaggcaatttcttgtccatcaatagctcaatcactaacaattagagataaacgtataggagcataggagagaaaataaatgcattttgggccttatagtcacagaattacattaatcataatccttttttctcataaaatactgtcatttttaatttattgacttaactttcttaaataatataaaatattggcagtagctcacatgtgcttatgtgccccttctgcatcacttaactttcttaaataatataaaatattggcagtagcttacatgtgcttatgtgccccttctgcatcctgtcctttagtgaagcccacccgctctcctgactcaagtgtatatcatttattcacttttcaacatgtagtttcaccatctatattcctgaaagatgttttaggttttttgtgcctagctatttttaatcttatacaaaaaatgttatcccgaatgcattcttcttattttttcccactcaatgttctgttgctaagacatctgttgtggccgctggaattcctcagagatctctaactactgggagtgtaattgacaagagccccacttctatgctgcgtcccccattgctgagttgtcctaaggccacattccccactgctcctggggccctgctcccagccaatgactgagtgtggcagaggcatagggcagccccattcctgggagagatggggctccctgacacctgatggcttaaggacacctaggtggccttgccaagtcttccttagacctaacagcaatgtagttcacttccattccaccttcttttcctcttgcctaaatctaggtcagacttgcatggtagtctgatgattcccccacccttccagggctccgtctccattttctctcatagtcattgcccttaaaaaaattttctatgtttaatctcaccttgtcatcttcttctcagaaacctggacaaaagcaacattcacatgttgcatataattgaaattcattgttttgactgctgcataatatttaattatgtgaatatactaagaaagtggataaatacattgtggtatatttatacatagtcatgtactgcataacgacattttggtcaacaaaaaacctcatatacaacagtggtctcataaggttataatggagctcaaaaattcctattgcatagtgatgtgtggtagccatggtaacgctatagcacaacgcattactcgtgtttctggtgatgctggtgtaaacaaacctactgcgctgccagtcatgtaaaagtgttgcacaggctgggcaccctggctcattcctggaatcccagcactttgggtggtcgaggcaggcggatagcttgagctcaggagtttgaaatcggcctgggcaacatagtgaaacctcatctctatcaaaaatgcaaaaattagctgggcatggtcatgtgtgcctgtagtcccagttgctcaggaggctgatgtgggagaatcgcttgagcctgggaggtagaggctacagcgagctgagatcatgccactgcactccagcctgggtgacagagtgagaccctgtctcaaaaaaaaattttaataaaaataaaaatataaaagtgtaacacatacaattatgtatggtatgtattacttgataataaatgactgttactggtttatgtatttactatatttttagtctgtattttataatatactctttctacttattaaaacaaatgttagctgtaaaacagcctcaggcaagtccttcaggaggtattccaaaagaagggattgttaccataagagatgacagctccatgcatattattgcccctgaagacctgccagtgggacgagatgtgcgggtggaagactgtgatattgatgatcctgactctgcatggtcctaccctaatgtgtgtgtttctgttttagtttaaaaaaaaaaaactttcaattttttaaaaaaacaaaacatttaagaagtaaaaaataaaaatataaatataaaaaatagaaaaaattatagtataatgatataaagaaagaaaatttttttgtacagctgtataatgtgtttgtgtttcaagctaagtgttattacaatagtccaaaagttttttaaaaacttaaaagtttgtaaagtaaaaaaaaaattactgtaagctaaggttaatttattgttgaagaaagaaacgtactttttatcaatttagtgtagcctaagagtacagtgtttataaagtctagagtagtgtacagtaatgtcctaggccttcacattcactcaccactcactcactcactcacccagggcaacttctattccttcctgcaagctccattcatggaaagtgtcctatataggggtaccattttttatcttttagaccatattttcactgtagctttttatgtttagatacacaaatattaatacttaccattgtgttagagttgtctacaggattcaacacagtaacatgcatatagtttgtaacctaggagcaataggctataccatgtagctagatgtgtagcaggctatagcatttcgctttgtgtaagtacactctatgatgttcacaaaatgaccaaattgcctaactctgcatttttcagaaaatatccctgttgtgaagaaatgcatgactgtaattgaatatttagcttgtttccagattttacgattttgaagagtgctgctattaacatccttgtacatgttcaacaagttgtcttagatatatatctggaaatttatgcatatattatatattaaatatatgtatatatttacagatacatatcttttatatattagataaatatatgatacataatattacatacatttaaaatataaatatatttccaggtaaatatcttatatatatgatatgcttatatatccagatatatatctaagatatatctatatatttatatatcttacatatatctaaatatatatgtaagacaaatagccagatatatatatctggaaactactgctttttttgttgttgttctgtggcccaagctggagtgcaatggcatgaactcagctcactgtaatccctacctcctgggttcaagcaattctcctgcttcagcctcccaagtagctgggattacaggtgtgcaccaccacaccaggctaatttttgtattttttagtagagacggggtttcaccatggtggccaggctggtctcgaactcctgactttgtgatctgcccacctcggcctcccaaagtgctgggattacaggtgtgagccactgcacccagccatgaaactactgctttttaaagagtttgtacacatttacatttctaccagcaaagtagagaagattttgtggttccatatcctttccaatactcaatatagttgggcttttttatttttgctaattaaatggatataaaatatatctcactgtggacttgacaggtaattccctctgactgaacatctttttatgtttatttcctcttctgtaaaatgcctatgtatggcttttgctatttttcttctggaatgtctgttgtttgtgacaactttgaaggagtttttaatatgatcctgatataaattcatcatcagttacatgtattgaaaatatctttttctaatccaatttgtaagttgtctttcacattcataaggttctgttgatgaacagaagtttttaatataataacatttatcaattgttaattttatggttagcatttttgttgctaaattttttcttatctcaagattagaaggatatttacttatcttcgctccttaaaaaaagatagaagcttagcttttgttagttatccctgagtaatctgtaattatttttgtgtgtggtgtgaacttaagaactaatttcacttttttcccgtagctattcttttcccccgtcccccaggttaatttattaaattgtcttttttccctactgaccttccataccagctatctcaaatatcaaagttctatatattcaagggtctctttctgggttctctattctaatccattgaccagtttgtgtctacactagtaacaccctatcttaatatagctgcttatgagtcttgatatctggtagtataagtccatcttcctcattcttactcctttaaatttcttggctaattttgatccctttattcttccacataactttttaaaccctcttttagattacattttctaggtattacttgctactgtataagaatgcagttgactttgtattaaaacaattctggtgaaaataatgatcatgatagcaactatctattcagtatttcagctatcatttacttagtacatattctctgctggccatgatgctaagtgcttatgtgcattttcctcctttattcttaacacaggcctgtgagtttgaaaatagctagcagattagaaaaccaaggtacagagaaatgaagcgcttatctaacatcatacaattagactgtttagtaactaggattcaatcttaaactattctgactttaaagcgttcactcttaatttatacaggttatgacagtgtccttaggtttcaggagaaacaataataacaaaacaaacatcgaccactccatcatttctcagcattttctattctcccaattagagcttccatatacagatgatatcttaaatgtggtttacattgaccatctataaaaggtgtgaaaaactggttctctaagagtacggtctccaatgtctgtttaatagatcagtccttgcattcttcactggctacagcctccacatatttcagtctgtccctgttataatcaagatcccatgatttaagaggggttaaggagagggctgtgactcccagaatctgatttcttctcagagagagttgttctgctttgtttatttttatgtggttttactgatcatatgttaaatgtggcacacacaattcagccagcctcgtgattagcaagggaatgcttttgtttgtgagtgtgatatgccctccactccaaaactacatagcagaggaaacacaaagtcacacaagatttaaatcctaccgtaataacaagccagaatagtagacacataatcatccctgagacttgcattgcaaaacaatttcacagtgcataactagctaatttaatcttccctaaaccttgggaagcaaatggagtaggtgctactatgcccattttataaatgaagatgagatgcagagaaagtgacttgtccaaggtcacagtgcagttgagaaataagagctacaactaggtctatggagacagattttcagcccggagctgccttcacctcttcttgtttcctaccctgaagctttgacattccaaggcacccagggaaaggcattccctgacacctcagatttgctgcttcaaaagagggttcatttcctattaaagcagagaagcaactgaatgagatagcccccaccatcagaatcctgacaaccattggctgtaacattttcttgctcagtttaaattcagatttcttctttacaagcattatttgaatccaacagctctaaagtggcagaattccacctggtcttctctaagaccagggttctttccactgtactttggaagaggagtgtcacgtaggaatgcctttagcatcctctggccctgggagaaaacctggcagtgcacttgtccctgagtggtcctaagtgccttctggatttgtgagtgagatgcccccccttgctccatcaccagaccttctgcaccccatagtgataaacagccttcccttctatgtcaacccacggccgtgtggaatcagcttcccagatgggatagtgtcctaatccgggacttctagctctctcttgagacaggattcagtaaacatgtatattttatttcagtatttttctatgtatgtatgtatgtacatttgactcttggacaatgagggagttaggggtgccaacccctaacaacagtcaaaaatatgctattttttttttttttttttttgtaggcagagtctcactctgtcacccaggctggagtgcagtggtgcgatctctgctccttacaacctccacctcccggcttcaagccttcaagccatcctcctgcctcagcctccctagtagctgggactagaggcgcatgccacatgcctggctaatgtttgtatttttagtagagatggggtttcaccatgttggccagactggtcttgaactcctgacctcaggtgatcctcctgccttggccttccaaagtgctgggattacaggcatgagccaccatacccagcctgctataacttttgattctccaaaacataactactatagcctactgtttaccagaagccttaccaaacgcaagaacagtgattaatacacattttgtatgttatgcatattatctactgtattgttataataaagcaagctagagaaaagaaaatgttattaggaaattcataaggaaaatacatttacagtacttatttatcgataccattaagtttaagtcatctgtttacaagctgaatcatctatctgaaagggtggcaatcgcaactgcatacttcaatctacggtacattatcaagcaattcaactttttcttttaatgttatgacttttctctgcttcttgggagcacttccagcatcactagtggcacttcctatgggtcccatggtgttattcaaggtttataatatagactaaacatgatgaaaaatatgtaagacccaaaccacaagagatcactttttactgcgatatgcaatttaccagaaagaccaactgctcacgtggagatttttagggtcacacttcatttttagtggatactcacaacccttgagctcacggcaatagcaacagaaagtggctattaaattattatggtagtacagtattactaagttaattttatacagttatgatttaatactgcatcttcatgtttgcttacatttttctcaactgggaatgataccatgtactatctctaagtgtttgtgtatacattttgatacattttaacttctataatagacctgtgtatattttatggtggtaaattacacaatagactagcatcaacatatactttctgcattcataacatacctttttctttttctttttctttttttttttttttttttttttgagatggagtcttgctctgttgcccaggctggagtacagtggtgtgatctcggctcactgcaacctctgcctcccaggttcaagcaattctcatccctcagcctcccaagtagctggaactataggcatgtgccaccacactcagctaattttttgtattttagtagagacagggtttcaccgtgttagccaggatgggattgcaggcataagccaccgcacccggctgatgcctgtaatcccagcactttgggaggctgaggcaggtggattacttgaggccaggagttcgagaccagcctggccaacatggtgaaactccgtctctactaaaaatacaaaaattagctggacgtggtgacaggcgcctgtaattccagctacttgggaggctgaggcaggagaattgcttgaacctggtatacgcaggttgtagtgagccagaatggtgccactgccctccagcctgggtgacagagtgagacttcgtctcaaaaaaaaaaagcaaaaagaaaaaaatctgaatgtaagtggacgagtgcagttcaaaccagcgttgttcaaggatcaactgtattctgtttcattacgtagtgaaataataaagttttgtatccttttcaattaatatattttgggcatttttgaggtctttaaagttttttcaaaattaccttttcaaagctgcaaaatatttcatcattttgatatacaacaatttatccatgcagttgcacatcattcgtcatttaggtcgttttccttttggctaaacatctttgtgcataaaaatatgttcatacttttaattgttttaggattcacacgtgtggaattcttcatcaaagagtaagaacactttgaagatttttgatacaagattgcctaattgcttttcagaaagaccacaccaatttacacactccctccacaatggggaaaaatgctgctcttaccagattttgaatcttgtcattttccaaacacttcgttatttcgataggtttttaagtggtatctcgaggttattttatttggttgaatacttgtgaggttagcttttttcctcaggtctgttagtcatttatattatcctttagctactttttaaaaaatgtgatcttagcattcttcctcacttctttagttattagggatataaatcctttttctgaattatttgtaataaatgctttccacatgattgttgtaaggtttttaagtattgtaatgacttttttgaagtacttaagttttgtattttcattaaggaaatgattactgttttctgacttcctctgttggttatctgttcaaaaaatcctttcctactcaaagctctaactaatattcatctcaatattttcaagttttggtttcacttaaaattttctcttttatacacttgggtttattttgatatatagtgtgggaggctatacattttttctttgtttgcaaatagccagatttttcaacagattgcatggacagtgtcttgatgttaaattggacaacattttttaaaaaggcaatgagaggatttggtgctggagaaattcattcataagcttggcgtattcagaacactgaagaattgttgggtgagtaccaggaaagttgtcaggacagacaagtattcaacagccactgggaaggttctaaactgtgccccctttccccttctccataataaaggggtctccctttaccaaaatgaactgtcctaaatttaagtagccaaaagtcagagcagtcccagaattgtttcttggtgtcaaggcctcaatcaaccaacagaaaatgagatattcacagatcgagttgacaaagggatgccagaagggacaggaggtacaactgtcagatagattggtcttgttggccacccagctgtttgtgccacttgtatattctcccacagcactctctgcatgtctccagcacattacaacgtcgtattctaattttgtgttatgtgtctttttcttttcctctatcctgctccttgctttaaaaaaattattaatggatagtagctaattttctcatttgaaaaaaaatacacttaactctatgcagtttactaaatgttattatacctccatttgataaatgtgaaaactcatttaacacacacctcaaacatgacataaaatgttgccattattctagaaaattgcttgttctttttgtagtcatcaccccctgcccagtcctgaggtagccactattccaatttctgtacccacagaacccacagacaagttttggttgttcttgaacttcatagtaattgaattttaaagtatatattcctttgtctcttaactccttcttttactctataatatttcagacattcattcatgtctattcctttttgttgctgagcagattccagcaccatttgttgaatagattgtccttttctcatcaatttgtcttggcacctttgtcagaaaacatttgattgtaattttttttctgtcctattgatctatttgtctattttaacaccaataagacactcttagaaactgataaattaatactaacatgtatatggaaatgtaaaagaccaaaatggtgtttaaaaatatgataaaactggccgggggcggtagctcctgcctctaatcccagcactttgggagtctgaggcgggtggatcacttgaggtcaggagttcgagatcagcctggtcaacatggtgaaaccctgtttctactaaaaacacacaaaaattagccgagcatggtggcatgcacttgcaatcccagctactcaggaggctgaggcaggagaatcgcttgaacccaggtggcagaggttgcagtgagccaagatcgtgccattgcactccagcctgggcaacggagcgagactctgtgcaaaaaaaaaaaaaaagatgaaacttacagtgagacttaaaattgggtcatgtaaatcctccaactattttattttttaaaaaaatcaatttctaccaaaaaaaaaaagcctgctgggaatttgattgcaattgcatttaatctatggatcgattttctgagaatcagcatctgtacaatactgattggcatctctttattaggtcttaatcaccctcaacactgttttatggtttcaagtgtagaagtcttgtataacttttttttaaaaattttgaaggtatttgttatactaatactgttataaataatgatttttaattttttccaattgtatgttgatagtatataaaaataaaataaaaattttctatattaactttgtatcttaaaccttgctgagtttacttattagatttagtaggattagggagtagattcccttcaagtttctacctgcaaaatcatgtcattgtagagaaagataattttacttctttctcagtctttatgacttctatcttttcatacctaatggcaagacctcaagtacaatgttgaatagcagcatgagagtggatccctaccttatttttgaccttagagagaaagtgttccatatcttatcattaaatatgatgttatgtataagcttttatagatgcattttatcaaattgaggaaattctgttctattacttgtttgtctagaggttttatcatggaatagtgttgaaattttcaaaatcttttcctggatctactgagatgtttgtatttttcttttttatactgttaatgggatgaattacactgactgcttttctcatattttaattgatcttgcattttttgtgataaaacccacttagctgtgatgtgttatattttttaatatatagatggatctaatttgctaatattttgttaaaaatttttgcatctctgttcatgagaaatattggtctgtaattttcatttcttgtagtgtatttgttaggtttcggtattatgaatatgtcagcttccaaaaagggttgagaggtggtccttcctcctgtttctataagagattgtttaagattggtattatccctttctttgatagacttcaccattaaagctatctgggccagatatgttctttgtgaaaaaaaatgtaattgtgaatttaacttctttaacacatattcaggttacttatttcttcttttgtccagttatgaaaagtcctgttttttaaaggatttatccatttacatggtcaaacatgttggcataaatttgtttacaataccctctcatcatccttttaatgtctgtaggatttgtgggaatagcctttcttttctctttatattggtaattcacattttctctctttttttgtttcttccttcttcagtttaactaggagcttatcaattttattgatcttttcaaaaatcggtttttggctgcattgattttctctattgttgtctgttttctattgaattaatttccactcttgtctttatttccttccttctattttggacttactatactgttctttttctagcttcttttttttgagacggagtctcattctgtcacccaggctggagtgcagtggtgtgatctcggctcactgcaacctccacctcccaggttcaagctattctcctgcttcagcctcccgagtagctgggatgacaggcatgcaccaccatgcctggctaattttgtatttttagtagagacggggtttctccatgttggtcaggctggtcttgaactcctgacctcagagctcaggtgatccgcccaccttggcctcccaaagtgctgggatcataggcatgagccaccgcgcccagcctttttctagcttcttaatgtggaagcttagctcattgatttcagcactttcttattttctaatacaagcacttaaactctaaattgtattcttagcgtcacataagctgcatctcacaaattttgatatgctatacttaccattcagtaaaagatatctaattctcctagagtttttctttagaagtatattgcttaatttccaaatgtttaaatatttgctgggtatctttttgttattgttttataattcaattctaatgtggccagaaaatataatctgtatggtttttatgttacccaaagttttcttggtgttaccatgggaacgaagatctactagaatcttttgcttgctaaccagaaacagctcttctactccctttactccaactaacttagcctcttcaaggcaggaatgatatcatactagtttctctatgacagtgcttgccacataacagaaattctataaatgtaagaatttatttatttatgctgaaaattgtacaaaaggaggcttatgactaaaacatggacttgccctcaagtatttcatggtgtcagatgaaggcaatgtgtaaacacacgtttccctaccatttttaaaggaactgtagaaaggcagaagaagggtgtgaaatctaaacacggaatctgaaaaatatgattgaaatgtatctcaatttgtagtgatacagtaactatcattttcattgtgctttactgtttataatttataagccttttcttaaggaagggaaggaataatatagaatgatccatatgatttttaggaactccactattgagttcataaattgaattaacttaaacaaaagaaggaaagatgggtgcaaaaccaagagcaaatataaaagaatctattaagaaaatgaatgctatcaggaaaggtgaagtggggaaggatgatgataatggtgctgataataatacctaacatttattgagtaattaaggttttgtaggcatggtgctaagcagcttatgctcccagcaaccctacagtgttacgcttaccttatggaggaggaaactgagacttagagaggttagttgacttgcccaagattatgcagttaaaaagtaaagaagtcagggttggaattgtgaaaaaattgaggagtgttccttattcactgagacttgtcttagatgggggcctgggccctgacaggtaagagataggttttacactcatattttgactgtttttccagaagtagagtcagcaagagatttttcaatgtacacaatatactgtcaaataccagtatgtttatgtgttggggtggatcggggagcagccagttttcaaagggcaaactgaaaattaaagtttgagacagagctaacgtggactgagacgggatggacaagggactgatgagaagagcagaaccaaatggggacacgaccaaggaagaaaccagaaggtgataacagaccaccagtattctgccctgagcatgtgccaggcactgtgcatggcatgtgtggagtcattatatcatgtgatactcacaaccactcatgagataattactattgtccctctcttagagattagcccaaggtcacatatataggatgtagcggcattaggtaaacatagaattccaagatcttaaacactgtttctctccagtggtggttggatgttatagaccaggacccaaaggtgggacatgggggtgggggacagttaggaaaggaacctagtgactgggactgattccccttgtttagccaggtgccattgcaggctggcttctattgatccatctaaccctttgttgatactgctcccaggacttctaaaaggcacctgtacttttaaggcaaaacataaagggactttaagttatctttggcacaggatgaaaaatatgtccattgcttgagatcaatattgtaactggcacaatattaacaaatggcagaaaacagattctttcagtatttatgtcccttccataattcctatcaaggaaagcaacttcatgttggaaaaggttcccacagatattggtgacagataatggaagcccaagagagaaggttctaaatgaatgcttggtgcccagcggcctggccagacaagttatattgcaggagacttgctgtctgccttgaagcactgagactttgaggaaaggtgctggaagcccagtcatgggaaaaggtggaaatttttgacctttcaaataaaggtcaggcagtttggatgatctttttctggtgagctggatgctgttcccaggtgagaggcaaggagtcagtgaattgtcacagacctgccatgtttctttctgcgagacttgctagactggttttccaggtattgtgtggatgaagtgcatttggattgcagcatgcatttgacagataaagtctctatctttgaaaatgggatacacccatggacaagggctgatggcaaccaagtcaggtagatgagtaactgattggactcagagtactaatgaatgagttgatgtggatctacagaaaggatcttgcacaccacagttttctggcttctgtcttgccttgttaggcatttttattaatgtcttggatgaagacattgacggcccagtgataaaatttgtgggtgacacaaagctggaagggatagctaatacattggacagtagaattgcaatgcaaaaaagatttgacaggctgaaacaatggaccagatctaacaagattatgtttaatggggataaatgtaaagtcttaacatttggttaaaataaacaggcaaataagatggaataagcagcagatgggaaagatgtggtttgataggagcctgtgtgaaaataatagagatgtttcagctgattataagcccagaatgaatcactagtgcactgtaagctcaggctataatagaaatgtggagtatactataaggaaggcagcaatcctttcatagtctaaaataacggctcatatttacagagtgagttctgtatggcaaatatatttatatggattctctcagttattctcacttctggcctttgagtaggaaactggagctcagagagattaagttacctgtccaaagtcacattactagagccaggatatggacacaggtgttctgactgcacacagatgctccgtcctggagggcagagccattgccaatgaggtgaagagacaaagaggtacatttgggttccaacaagactgaactttctaataatgagagtgctctgacaatggactggtgtcttacaagggaatgaggccctgtcaagagatggccttaagcacaggcagattgatcacgtgtcagcaacaaacactggaccaggtagctgttgagttctcatcctactaagggttgttgagcttctagacagatcctaacatctggagtgcagagtctgggcatttttaggtataagggaaattcccaggaggttttccatttattgcatttaaacaatgagctttaataacctgctctcttcatagaattgtttatttggtttttaatttttattccttagggatttttgagttatgtgctagcctttacccatataacaaaagcccctagaaagctgcctcagacccactgtggaaggattaaaggaacaaagaagaaaaagaaacaaacacatataatgttttctacttcattgtagtatctgtgtcctctcactgtcaacagatatcatattttgatactgtcaggattttatatatatgtaacagtctttcactccatcctccttatcccaaggctggcctttctaaattagtttttctattctgcagtggtctagtgaaagagagacctataacattaatagttggaattataaggagaagatagtagagtaaattggttaaaagcaaggagctgagaacatattcaatcaggagttactttacgtgatccataatacatggacttcggttcatccactttgattgctgagagacctccgtcttctcgctttcaaaattctagagtattttaatctttgttttggataattaggatttgtggacttgtggccccatatataagatgtttataaattacagcttcccacgttaagggaagaaacaatgacccagcagtgaggctgacattctgttatgcacctagccagctaatccatctgaacagctcctatcactcacccagtggttgagaaagccggcactgcccagtataatgagacaatgtcaggcattgtaagtaaatatgcttgggcctgcactcaacagtctcatgctgcagtctcattttcaaggaagcccacaccatcttaatcatgcctgccagggaagaaattctcttctctctgtgttttcttttccccaagacatatttcccctgtatcatttaaacatattaaatcactgttagtacgcagagtgggcatcatgttagcataagatctaatcagagcgagtctgctggtctccaaaggctttattctttttgtctctttcctctgttttcttgttagactgaagagccttttttgacattctcatttgttctgctgtgtaatagcatgggatctttcagagctgtcgacatctgctccactctagagagctgcagaaccaagccagcagagcaataataattatgcccaaatgggctgaaaagaatgcaagagatgagaaggaagacatggaaaaatacacccagtgcgatgatgttctaacctgtaagtgggtgtgtgtgtgagagtgcacgtgctgaagccatacgcttatgtgtgcattgaggacacaaatcattttcctgagaacagactagaattcaatcaggctcagacttttccaaagtccccagtctttgtgcattcccccagacggccatgctcaatatgggtgcagttttctgcatgtacaatggtagtttgcagaacactggggagaaggaactttctcctctttcccttactcttatatctggtggggtaacaaaggctgcagatgggtcttcctccctagatactactctctggggataaatgaggctccttgggaagatgctgtaagtcttcctgattgtcaagatactagttattaaataactggtatgctggccttacgctaatattaaaaataacaactggcatctattgggtgcttagtatttgccaggaattgtgtaggcccttcacatgcactatcattcatccttaaagaactttatgaatgggcacagtggctcgcccctgtaatcccaactttggaaggctgaggtgggaggagggaacccaggagtttgagaccagtctgggcaaaatagggagaccctatctctacaaaaaaattaaaaattagtcggatgggctggacgtggaggctcacgactgtaatcccaggactttgggaggccgaggccagtggatcacctgaggttaggtgttcaagaccagcctggccaacatggtgaaacccccgtctctactaaagatacaaaaaattagttgggcatggtggtgggtacctgtaatcccagctccttgggaagctgaggcaggagaattgcttgaacctaggaggcagatgtttcagtgagctgagatcacaccactgcactcaagcctgggctacaagagtgaaactctggttcaaaaaaaaaaaaaaaattagtcggatgtggtggcgcatgcctgtggtcccagttactcaggaggctgagctgggaggattgattgagcatgggaggttgaagctgcatttagccatgtttatgccactgtgctccagctgggatgacagggtgataccctgtctcaacaacaaaaaaagaactttacaaggtaggagttactatgatcttcatttgcagatgaaaaaattaggactaggccatattcccagaggccctgctggtgcattaagagagcctggtttttcaaggctgtggttacacacgaacaaaagaactggtcatgtcattcatctgcgattcttcagcaaagcagccagactgctcagtgacatacttagctagttccaagaaataattgtcagttcaacaaagaactaaaatttaaaaaataaaataaaatccccaaagcagagagcccagtattttttcattgagttaactgattactttgcagaatccaagaatcctactgaggtcttgaggtcatcaggacccagggtgagtcctgcccctgctgtgagtctcagggccctgcttgttcttggaagccaatgtatcaagggtggactctcggcaaaggtgtgaggcagatgagacttatcaacagagaacacgtccttccctcctgtgccatccacttcccccagcctcatccccactcttgcctcactccagaacttattcaaaatgtgctctcctgacatcctttacctcttcagagctttctcctcaaggggcccagatgactaacttacactaaagtgacccgtcttttaaaaattcattttaaccagataaacaccttatttaggccaaaggaatccttctcaagtggtggcattttaaggctttctcaaggtaacaagatggctcggggttggagagaaagtctccatggcacttttataatcataccccatggaaagagaaaggagcctttttccatcagtttatatagctggatcatgcttggaatggagtagaaagagaaggatacagaattttacctgggggtcagactgctccagacttgggagtcatgaggttttctgtgggaaagcactttttctccctttcctccctaaaatttcactgagtgttactatacacattacaatgttaactttgcaaagagagaagacttacctgaacaattcaaagcttgggcagaagaaaaagcaagcagggttgactcttgggagggagaataaaacctagagctaaagagaagaaaaaaaaaagcatgtgacacaatgtctgtcagcagctgtgctgccaaaagtcacccaacaggaagagcaggcagccagcgagatggaaactgccagtgcaataaagcatcagtgagagtcagggctgactggggctgtggataaaactggagcacacctgggaccaaggaatagcatagtccctcccagtgtgactcgagcatcagcatacaaattgtcaggcccaacttggagcaaaattagcatcagtcacctgataatagtaatggttaccctacccttacagatggtagctcatatgaccataagatgttgaccagtgaaatgcactcagccagccaagacttgggctgccgcatgccacataatctttgtggctcttggtttttcattccaataaaacttttttgacctctgtagaaagctgtaacccatacaaaagctcttatgaccatttaggaattcataagatttttggaaaattctacattgtcttcctaagtcccccatgttcctcaagtgccacctgtggttgatcttcccaggtgaattggaacaatgtacccagagcacccctcctctggccccaccctgaaggatggaggtctcggaaatctgtaatgggtgagcggacttgtagtccttactcgggggtgtacagatgtgcacagagagctggcctctgagagcatcccttgcagctaaaggccactgcctggctcaagtccatccacatcagcaaatctgcatgttgtagttctacagagactgctgctcttgatctaattaatagtttctttgtttgcataattttccacaggaaggactattagcacatcaaaaggatgttaaaagtatcctccgtaatgatagagtaaatacaaacctagtttatcacgttgtcagttttaacaaacaccactttgatgtgctaaccttttcccaggaggtgcccctcttaagtcaatagccagcaacaggcccagcctgtgaactagttgatggtgaaaaaccaaaacaatctctgtaacgatatatattttttaaattccaaaatatctgaaaaatgctggaggcatgtgtttactttcccttcctccctcctccgatttaaaagcttttgtagaaaacctgtgggactgatagcacttttcttcacacctcaagggagcagtttgaaaaatgttttcagaacacttactttcataacactccagggaaagaaagaaaggtgggtcatttacataaagttaaggatttctgtataccccgtttctgtccttcctctcaaagaaaagagagggggaacaccaaatctccttgaaactttaagagccctctgaggtttaactcaagaaagaaaatgcctctgaaggcagacagcagagaatgagagtatgaccaagcgcctcagctgtccaaaacacctcaaggtgcaggttaaacccaataacggtgatcctatcatgggacgggattggcaaaggctccttctgtatggaaagtatactcagtaaaatcactcaggcctttcagtgggaagtttggcagctaagtcctgtggaatgttttcagtaactaaaatttaactcccttagcttaaacaaattatttatttagtcacctacatactacattcaggctcattttcttaggcagaagatactgaacataattttaacttcttttttatggttattgattggcatgagacttgtcttattacctgcaggctggagaaataagttcagaaactaacaaaatatcactgaggcaactagaatgacatgactactgaagtaaaaggatacataggatctgtttccattactccttcttatgaggagtctgattatgtctgtcattttcctcccccaggaagcccatgtgcctcaggagaatctgtcccgagcccttcttcccacctagactgtattccaggggaggcctgatttggtcatctcagtgctttgtcagtggttggttgagaaatgatcatgtgaataaaaaaaaaaaagaacagaaatgatcatgtgatatgtgatactttgggccaatgaggcaaaaggaaaggtattctaggagcctctggggaaaatttccttgttcatcagggacagccatgggaacagtctctgaacattgctatccacagatgtgaggccatctactacagctgcctggctgaggatgaagctgtgagttgggaaatggatgagctaagagaactaccgggaaatggggccgcagtacgtgactccatcaacctgaaagcctgaaatacctctggacttcagctttgtgagccatctattatcttattttagaagccagtttgaattttctgttgcatacacataaagaaatcgtaactcatacaagttgtcaacaacgaagaacttctacatagtgctaataatgaaaattttaaacactgcctttataaaaaaagaatgtaatattgacaaatgggtgaaaagatgatcaactgtattgtaatagaagtaagaggacttcctctaaagtgtgagtgactatattatgaaactgttgagcactaagcctaagagactgtcatcatatggggtagtttgaataagaccaagaaaaatgatctaaattattagaaacagagatctaccatggtcatacttaaacttagcatgtgaccttttgaagagaataagtagatacgacatggggtacagtttaaaacagtcctcaagatgccctggtcaagagaccagagactgttctagaggttctaacaataagaatacagtttcaaatggagcggcatgggctggaggatggtcagcctaatttgtgtacaccaagaccagttttgtacataaataaaaatggaaagctccaaggaattgggaaaatgtcctttccccatctgaaatacttccccaaatgcctgctgactgaaattatgttaactctggaataaagacactcctttaacaagaggtaaatgacctcaaatgcaaatttccacaggagcactaatatggtactaaaaacttggccatgctaatgtgaacgtttgtttactttctgtctcaatatctccagactataacctttgtgaggcagagatatttttgtccttttcactgctttatccctagtaaaggactaagtgcctaaaatggtgcctagtcttttgtatatgcaaaataaacatttgtgaatgaatgaatggcaaatatctgagcctttaccaagagcaaacttttataggaaggaaggaaaatctccacagagcactatatgactgaaagagataaaaggaaaagtgaaccctaaagaagtgaaaggggcaagaaaatgaacaaaagatgggaaagattatattttttcttacttcatttagtctaagacaggccctgattgagttcccacactagatcccgtgtcaaggagttggaagactctgacattctaaggatagagaatcacagtatttgagccatgcagcagaaccagattgcatcttcactctccattggcccacctgtctcttgttctccaaatagtaattccctccccaaactccagaggtgaatttatcataaagctcaagcttcactgcacctcaaattgataggaggaaccctagcagtgtatttacttgccatatgttttggcaaaacttgtacaagtgggattttgtagtcacaataggtgagactgttgtctctttgtactccaacttctccttatatcaggtggcatccaaggggctgcagacattctggggagggggggcagctaaggcaagtagaattggagatacgttcttttgggctgaatgctgttacaggaatggctttcaggaagataccaacagcccactgtggaaactcacctggtgtcataacataaaggggcatatctaaaggttaaatcacaatatgaatacatccgagaccctagtagaggaaatgcaaggtttgaaatggattggaaccagaagctggtctgtggaaaattctttccaatcaattgtagcagaggatttagtttctattgacacctaattgaaaggaagttctctcctattgggaatgcacatgcagatgcagtgtacatgattgtgtttttgtactatacaataaaactatttttcatagatttacatataaagtcaatagaaataattctgatatctagcagtaaactgtaacaaaaaacagttgggtgtggtggctcatgcctgtaattcttacactttgggaggccgaggccaggagtttgagaccagcctgcacaacatagtgagaccctatctctaccaaaaatttcaaaattagcctggcacggtggtgtgtgcctgtagtctcagctactcaggaggctgagacaggaggatcacttgaacctgtgaatttgaagatggagtgagctatgattttgccactgctctccagcctgggcaacagaatgagaccctgtctctaaaaaatatttttttaaaaaagtatcatttccagccgggcacagtggttcacgcctctaatcccagcactttgggaggctgagggggatggatcacgaggccaggagtttgagaccagcctgaccaacatggtgaaacctcatctctactaaaaatacaaaagttagctgagcgtggtgccgtgcctgtaattccagctactcaggaggatcgcttgaacttgggaggcagaggttgcagtgagccgagattgcgccattgcactccagcctgggcgacagagtgagactccgtctcaaaaaaaaaaattcaaaattagtaaatcattaagaggaagagataaattgccaatagaaataataaataggcttttatattatttaatgatctaatcaataaaaaagaatgagttatacgaatatatttgtaaaatatttaaatttataattagacaggaatgtttatattgacaaagataatataaaccataatacaccattagaaggaggacatagatcacaaattagttaatagtgaatgccatcaattcatagcatatttaagattagtcattgagagactgaaatgccacctcatcgcaggaggcgcctggcagggatggagctggtgcgggcctggaagtagatgtcctggttctactaccaacacctgctggtcacaatgctctacatgctggagcccgaggagcggaaggtgctcaattccacgctggtttccattgatacgcaggatacatcttcatgacccagcacatcatggcgatattgcactactttgaaattgtacaataaccaagattagaggttccttggggaagacccaccctacgaagttggaatgacaccatcagatgtgataagaaactcttctaaatgtcaacctaaccaacctaaaattcatgagtagaacaggaaaatcaccgactcatgtgttgtgttctatatttttcattttaaaagaagctcttgcatagtagcttttgtctattttaacattgcagccatttgtactttgatatcactattttcttttcttttttttttttttttttttttttttttttttgagatggagtttcactcttgttacgcaggctggagtgcaatggtgcaatctcggctcactgcaacctctgcctcccaggttcaagcaattctcctgcctcagcctccctagtagctgggattacaggcatgtgccaccacgcccaactaattttgtatttttagtaaagatggggtttctccatgttggtcaggctggtatcaaactcccgaactcaggtgatctgccggcctcagcctcccgaagtgctgggattacaggcgtgagccacggtgcccaggtgacatcactattttcttaacctttgtgactgtttcaatattacccccatgaaagcttttttttatgtacctttgagtacattataattgtcttatattttaaagtcattagttgggctttactgttcttgctattgtatgacatatacatctgcctggatatatttttactcttgaccaaagttttataagaacaatataagatttagggtaggggcatggggaggaaggatattttattaagaactacttaaaagaactacttgctgggcacggtggctcacacctgtaatcccagcactttggaaggctgaggcaggcggatcacaaggttaggagatcgaggccatcctggctaacacagtgaaaccctgtctctcctaaaaatacaaaaaaattaactgggtgtggtggcgggcgcccgtagtcccagctacttgggaggctgaggcgggagaatgggtgtgaacccaggaggcggagcttgcagtgagccgagatcatgtcactgcactccagcctgggtgacagggcgagactgtctcaaaaaaaaaaaaaaaaaaaaaaaaagaactacatatatcaaaatatattttattaagagctacttatctgtaagcttgaactcacaagtatagttttagctatctagactctaacagcttttgctttaaaactattaaagcatttgtggtttttttgttttgtttttgtttttttcttttttgagaccagagtcttgctctgttgcccaggctggatctcggctgcaacctccacctcccgggttcaagtgattctcctgcctcaacctcccaagtagctgggattacaggcacccgcaaccacacttggctaatttttgtatttttagtagagacggggtttcaccatgttggtcaggctggtctcgaactcctgacctcgtgatctgcccgcctcagcctcccaaagtgctgggattacaggcatgagccaccgcacctcgccgggtaatgattcttgagacaagaggtggttaagtagcattattatgtaatgtttatataccatggagtttttacaagaagataaatctatttcctctgagggccactattaacaatgtacttccttaaatttagttaagtgatcgtaatacgtgctgcatttgcacattgcattaagttatgatgagctgaattgttacaaattatagcaaaaagaagtgtaaacttggctaaaatccttccattctttgtatttttttaaagatttttattccttaaatgcaaaatgactacctaatttttttatgtaaattcattaaattcaaagagaaaaaaagattagtcattgaacagtaacaacaacgaaaacaaattagagatactctgaaatcttagagttcacatatgacaaaaatttgatggaaatttcctaaaactgtgatcccaagcatttatgtgatagtacaaataatgagttatgaagctcacagaaacttttccaaattcttaatgaaaaacaaatttgatcaaccatgctactggaaagactaatctatctttatatgtaccctcttgatagaaaatactacaaaaatctttgttatatgaagtcgtgacccaagaatatatagagccaaaaaatgaaggcataattatataggggtgtcagggcaattaagtaccatgtatatatatatatttttaattttgtgattcttgtggcagttaaatatttttaaaatgtgtaattgatagcaatttcttttctcactttaaatcaacactcaaacctaattttgtataaatattcttgtcatctttttcttttaaaaagcctctaaaattatgtaagcttcagaccccaaaaggagtaacttatcaagaggaaaagatcctagattcacttctgcttctacttattctacttctggatttattaaaccattactcagattttaaaacacaccacacacaaagaaaagtttctaaaataaatgagctaacatggatttttttcatattctccatcttcttgatagcccagagatcctgatactctttggactttggtagtggaatggtagatgtgtgttgagaatggaagggagttaaggatggggttctagaattcagatgccctcttagggtttgaaatgtgggggaaaaaaaaagagaatcactgcttatcttagtctgttcgggtagctgtaacaaaataccatacctgagtgacttacaagtaatagaaatgttatttctcacatttctggagtctgggaagcccaagatcaaggtgctagcagatttggtgtctggtaagggctaacttccttgttcaaaaatggtgccttcttgctgtgtcctcacatagtggaagaggtgagggaaatttggggggcagctctcataaggacactgatcattcatgatggcctgccttcacgagactcagtcacctcccaagggcccccagttcctaacagcatcacctatggcggtgaggatttcaacatatacattttaggaggatacaaacattcagatgataggccagagcactgacctaggcaatggcatctacagaaaagagaaaaataatttacttttgacttgaggtgtcttgggtttaaatcccagtcccaccacttaatcatttgtgaccctgagccccgtgagctttgatttctgcacttgtaaaaataggcagaatattaaatacctttagagtttttcatgaaaactaaatgctacctctgaagttaaatgaaattgtaagaatgaaataaatagggctgttttaaagagtaaatgtgctcagtaattggtgttctgtaaatgttaacttcgttctgaaatatatagagcaggatgtcaacttatggaaagaatgtaaatattttttggttataaataccaatgaatttttcttacaatgccaatggatctatacatactatatggattatatttaagctttttgccttatcttaaagctaatagcaaatagggcaatgatgtatatgggcaatttacaaaagaagaaacaagaatatctggtaacatagcaagaattttttaacattttcttggtcatcaaacacaatataaacaatgagataccattttgtttctcacactggcaaagattaagaagaatgaaaatgcccactagctggtggtaaggcgggaaggggaagggtacactcatgacattggatagttggagttcaaattggtacagctgttttggagatcaatttaaaagtaggccccctctccaaaagcaaaataaaactttaaaaatgtttactctgcatttaaagctgaaagtatgccttactctatgatttagttatgcctctcctagtttatattttttgaagtataaatatgtcatccaaaagacatgtataagaatatacataacagctttattcagaatagcctaaatgtctatcagaaaaaaataaatcaataaattgtagttttttttttaaaggatactatgaagcaataaaaagaatgaattactgctatactccacagcatggatgaatctcacagacattatgttgagtgaaggaagccagaaaccaaagaatacacactctatgattccatttatatgaagttcaagaacaggggatagctattgactgggaagaggcatgaaaagcattctggaaaatgtttaatccattgatctgggtggtggttgtacccattgtctatacacttgtagaattcaaatcgcagtacacttgagatttattcactttgttgtatatatgctatacctcaatttagaagttttgagaaaacatacactttgacttagcaagtatgttttcattctaaagaaaaaagtcagaggagtacaaaaaaggtttacatacaagaatgatcaccatagcattatttatagtagcaaaaatctggaaatacaatccaataataaggaagtagttaaataaaattatgatacatcagatagtagaatgctataatcattaaatcagataaaatagaagagtcaaaaatatggaaagtttttcataatataatgttccaaaaaaaagtaggttaaccaaacagtatttaagatttaatactatatttgcttaaaatatacatgtctgtctccctctctctctctctatatatatatatgtatattacataatccacatgcttatcacacgtatctctgactaatgggattgtagataattttccctttctttctcttgttttaagcagttttctatattggacatgtcctgttttgtaatctgcaaaaatctgaaataaaatgtaaaagggaaaaatgctaggtgtggtagtgcatgcctatagtcccagctactagggaggctgaggcagaggctcacttgagcccaggagtttgagaccagcctgactgatgcagcaagacaccatctcaaaaaataaaaaatgaaaataaataaataaaaaggaggagaaggccaggcgcggtggctcatgcctgtaatctcagcactttgggaggccaaggtgggtggatcatctgaggttgggagttcgagaccagcctgggcaacatggtgaaaccctgtctctactaaaaatacaaaaattagccagatgtggtggtgcacacctgtaatctcaactactccagaggctgaggcagaagaatcacctgaacccaggaggcgaaggttgcagtaagctgagtttgcactactgcactccaggctgggtgacagagtgaaagtccatctcaaaaaaaaaggtaggggaggggattgaaaaagaaagaacaagagtgagcaaatcaactctctatataagtaagctgttctgaacatttacatattgcattctaggtatgcccttgatgaaggtagttaacctctctaagcctcaggtcctctctgtaaaatgggaataattattgcacctaacttatggtattgttatctggattaaattaaatattctgtatgtagtgcttagcagtgtctgacatatcataaacacttcatcaatattagccattacattactctgggacactggctaagacccctaggttaccagaattgacttaactgctcttgtcttcttttcaccttaggtatctactgacctggttatcgcttcttcctttaaggagtattagaacactgctggggatgggctgacaaacataccaggtattgatgcatacagtcccctgaaaggtctcatctgattagggacatttattctgagaaccaggtctcagaattctcttttggatgcatcaaagtccaaccgattctgagagccaacttggtgcgtatccctcagagaagccttggggcccgggttccacaccattctgtataaaagtggaaagttaggagacagctgattcgctttctctgtagaattatcttcccacaactcactgtagaggtctatcacacaatgggttttagtttctttttttccattgctttccttgttttctattttcattcttttctaaaattttcatttccagagctgcttctgggctctcttctccctgcgccaacccacccccacctcctcccctttctccctccttccttttctttctcgctcttcctcttcgtctctcttgagacaggtctagtggcctggttgccatctgctgcctttttttttataaggttgagatcagatggcatctaatcgatcgtcatggtctccatggttaccagggtgacagagtacttgggagagacacattctcgagcctggggctgtcagaccattcctgagaggggaaaggaaataaaaccccttccatcatatttacacctttacatctttctcaaatgcagcaaaacacagaccctgtttatgttttacatagtgacctagtggcttgaggccagggaatgcagagtggcttttttctatttaaaaaaatgcacaaggacagaagtaaagggttttttgtttttttgttttttagcctcagaaccatcccttcccctccctgctccatacagaccatcccttttatcatttttttttcttttccctttaaatgtttgggaattaattcagtaattctactgagttgttattcttccaataaatcatggtagttctaaaagtgacaattgacagctatttgctttagggaaagaaataaccttcataaaattaccaacactttcacttttgattagaatcagtgttaatgttaatgttagttgttctttggccaagcatttgtaatataggaagccatttttcccacaaagagcagcttcatatgataaaatgtaaacaaaatgacccttattcttaatgcaaaaagtgcttaggcatgactgtggtctgtaatgctttaatgcctaggggctggccagtctggcagaaatacatccaggccttactctaatagaatatgatggcgttgacagcccagatctggtggaaagagacgtgaggaagatcttggtaataaggatatatagctaatgggaaaagggctagatttctggagtaactcagaaataagaaaacaaccaattatcataccattaaataatgttaaaattacataaggaataccatccttggcatattaaaacgcctttaatattaggcacagatgacttgggctataagctgctttacttccttttctggtaatatgttatgcttcataacacttactagaaattctcccctttttttgtgtttgtcagagaaaaccgaacttaaaattatagcacaggtacaaggcctatctataggtgatttttttttcatttaaagaaaaaatataatgccaaaccatgagcagtgcttgcttgcttccttccttcttttgtctctgacttcccttcagacctcctgcatcttcttctgtacagttcctagtaagattcagatatattcatttgcagtgcctttggctgttaagcaaatagcacagtgatatttgaaatagaaatgatgccatcaattggaggagagactttaatataaagggaaaataatgtatcatgaacaaaaaccttcttattcattttggacctttgcatcttagctaatgcttgcctctctttccctctctgcaattcctcctattctctccctctttactggtgagttcaatcattgaatggctgggggaactgcttttatttaattctcacctccccagaaaagctttccccaaattccccatcacagacttctgaactcctagtgttcttttggtctgtgcttctcattcaggacttagctgtgttgcctttcaccccggcttatgtatttgtcatgtttatctgttgcctcttatttacattgtaagctccagaaaagagagaccatttcctctgcttctgggcttctcccttactttgtacctagttagctcttactaaatgtttgataaagataatagcagcctgttgtgcctacagggcaagcgatagctgttttttctttaaagaccaggaaccaaatttgatttttagcatttcttcaactgcagggattttactttgtgtcagccaagaggctttccttacctccttgtcttcagtactcttgtgcacaagcatgcttctcagagaaggtggattctaccttggaaggaaatgagtcgtttcctcccatcaggacaactgccacagcatggtgtcaactcactcttgcctttcgtaaattgagtttgtcagtgctcagcgacacagctgagtgaaatgttgtgtgatgcgggctgtctcctgggagagagaaactggcataaaccacatcctaatgggatccagaaacaaagaagcgtgaatgaagtgttaattgcattcataaagacattaacaaaggaattaaaatggcagaagcttcagtcccccactcaagattcacagaaaaatatgttatccaaagaatgtttcaacaataatcatcaaagtttattgcttgcccattggggaaataactcttgatacatattaacttttcaaagaacattttgggtccattattttgagtatattaactaacagacagtttattccaccctacctccagttctttgcttgcttttgtatgatttaagtttcaaaaaaatccagaggcattttcagtgctgcttcattaaccataaggatgtctgttaacagtttgaacctaatcaatcctacagttcttattagagcaaaatgctcattatctgggagaatttttgctttttgaaataaaattacaagactgggggtttattttacagtccctcttgaatattcctgagatgatctgcaatgtgggcaacccggggctccctccccagccctgtggcagggccccccagctgctgacagcggggctaagctggcaaaaggtcaggaggctgcatttcactgaagatggatcgcacagatgaatattgcgcttgcttaatgaagtcaaggccacggatttggggccttttatggttcttcttgtttcactcaatttcaccttcatagaccacgccactaatcccagccaatcattttgtagatatgtgcaactggtgactaagggactagataaaagtaaatgaatctaaaaaacagtgaccagaaattcagaaatctctgtgcctataacaaactcagaattaaaaaaaaaaagcatgcagagtgagtgtttcgtgatccttgcagaaactctgtgagatatatggagccgacattcctaccttcattctgcaggtaagaaagctaaaactcaaagacattaagtaaagtctcaggattaaaattcagatttttttaatcatctgactgctctttctgctgtagtcatctaaccctcccaggatctcatttaattttcacaagaatcctatgaagtaagacaggctgtataaacaagtgggttgatttttccgggaatcattttttttttttttttttttgagatggagtctcgctctgtcgcccaggctggagtgcactggtgcaatctcggcccactgcaacctctgcctcccaggttcaagcgattctcctgcctcagcctcccgagtagctgggactacaggcacatgccactatgcccagctaatttttgtatttttagtagagatggggtttcaccatgttggccaggatagtcttgatctcttgacctcacgatctgcccaccttggcctcccaaagtgctaggattacaggcgtgagccaccatgcccagcctccaggagccatattaatgccactagaggagcaggtgctctcaagcctctccttagaatttggctgaacccccggttatctaaaacgctatgtttttcagtcttgtctaaatcaatcatattcatggatgtggcatcaactcaatggtgcgggtttaaaagtgacgaaattctagttagttgtatgtatctgggctgatcaacacagatcggtgagtggaagggggttcagaagtgcacattcagcatctcagaaaagctcccgcatagttataagaatcagaccaattgagtctctggttgcttctaattctggtgcaaacattgggaacatttcctcccagacgtgaactatacataaaattcaggttatatgctgttttgtattacttgtgcttagtatcacacatgttaccatactcttaagaggtgattatttcttattagaacacatcatttagagtacttgatttcagaattttcaaataatagcaaatttagctccagtgtagccatgccaccaagttgttcagaagtctgattcaaacagcattttgaattacctagagagtttattcatattatttgcatttactttatttatgtttttataattttgtgtcctaattagaaggtcctattatgtgctcttaagatggaagactaatttaatctttttttttttttttttttttgagatggagtcttgccctgttggccaggctggagtgcagtggcatgatctcggctcactgcaagctccgcctcctgggttcacaccattctcctgcctcagcctcctgagtagctgggactacaggcacctgccaccatgcccggctaatttttttgtatttttagtagaaacggggtttcattgtgttagccaggatggtctcgatctcctgacctagtgatccgcctgcctcggcctcccaaagtgctgggattacaggcttgagccaccgcgcccggccttcaactaatttaatcttacctatctatggctaggtgtgggatgcaagatgtataataaacggaaaaaaaatcaaagtgagcagttggccagttatatattcaatctagacaattaaggttaaagccttactttttcatcaatagcagaagtgttgaaatttcattcattatatttatgtaaaaattaagagaattagttcatgcgcctaagtcagaattgtgtcattatcatagggtggttatattccatttccacttataaaatcaaaatggatgaagttattttctagggctgcactgtccattatggtaagctcctagacatatgtggctatttaaattaaaattatgtaatcaaaattaaataaaattaaaaatccagttccagattttaaatccttaatagccatgtggttagcggctattgtattggaccatggagatttatagaatatttttgtcactgcaaaatgttctattgaacagtgctgttctagagcaaacaactggaattcacacataccacagaaatacattctatatccaatcatatagttgtttgtaaaacaccatatacagtttagtgacagtgacttggagcgccatcctgctggggcttgggcatcaaggaaggatggtctgcagacttccctctgagtgtggactggccctgtgtgtcatgggagaggatgatgagccaaatctctggagaaagggcaggtgcagatgagccatttccattttccactcctgcagctcccacaacctcgagtccagacctgccgccaagacgtgcttgtacagaagcccaaaccaaagcacattttggattaattttctggctgtaatttctttgcaaaatctatcttgtgcctttgattaaggactttctttcatttttgccatgaatttcaatgaatctgaacctaacagtattttccaccaaccaggacatttagcacaggtattgaccaaaagaaataaggcttcagacaagcaagaatcataacagaaaaagaaaaatatagtccagagctccccgctgaacactttttttttttttttttttttttttgagacgaagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccccgctgaacactttaagtgaatgtcattgtctcattctcattgacagtcagcaagtaaacatatccacagactaaagtaaggtctctccctactctgggaaaggtgggaccattcttcgatatttgtcatataagccactttaaacttgtaaaaactgaaaagtaataaatcaccaatcatcttctgttctctgatgttatctcactaggactctgctatattaagaaagagattgaggcagaatgttttcacaagattgctcaaagtcatgtgcagcaagcacatgagatatacaactctcattgcttttatcacataattcttcaaagcggccttattgggcacgtgttttattttcttggtagactgtaaatcccttgaaactgctaattatacatatttgcatcccaaagtatcttatacagcgggaggtgctctgtaccttggttcaaccttatcaatattcactgaacaagtgaatgaatgaatgcataaaggagaaccctggtaacaaatttgtctagcctaattgtggtaagttttggctgataggtatagaagagtggcgggggggagaggtgcaaaatttgagaagaaacatagattgtgagctcattgaaaaggtatcatttcaaagtttcctttgaatctccatagggatatgatgaaagagaaaatatttttaagggcaactgtgaatttcaattactggagcagaggatcagagaagagttgcatccaatctattgtctttcaaaagaatttctttgctgacattctgcctggaagtaggaaacgtaaaaatattgtattaatttgtagtgtataattttgtattaatagccaagtggcacgataatggaatcaattgacattgcaaataggatgaaaatagaatgaacataattgaactgaagcctatatactttttcacaaatttgaatgaaaatgaatcccaaaacaaaagtgaccactttgtaatctgtcctcatactcagatcacccctgataagtcagcactcaacccaatcttcaatatttccaagtaaagagaaccacaggggtatgttaaaggccataaaagggagtttaagcaaatatttctaacctcttttgtgctttaacaatgccagtcaccaacttaagcaagttttttgatgtaactttctaggtcatgtatctttaaatcaccatgactcatatttgtctctgttccaactgttttctggtgtctctcttgctgaaatggtttcaattagagcctggaaagggttgatacagaactcttgcacagtgcttgccaacatgggaattggttttaaacattgctgtttttcgtccagaaaaaaattcccgcttcccgcccttgagttagaagagattattctcagacaggcgtttagctgatttttaatgtcaaagaaacttaatttgcaaactctttagtaaaagccgcctagtaaaacagatgattaatattggtaagctcctcatttgcatattaattagtctccgtactcaactaattaaaactgcactgcctatttgcggactttcttctatactgcagccttgtttctatgtataagcttgtattttaactaaaataagggttagtgattatgactgtacttttcttaacataccgatttttccatctgtgatactgaggactcctcaaggtcctagaaccatcttgaaactacctttgcacaaattataacagtgagaaaactgtgacataggaaaattatgacagcaaaagaaatctgtctcaacctactccatcttgtttttaacctccaagctgtccttgttcattccagggcgtaggccgggctaactataaaaggaatttcgtttatagtttaactttgaaacaaagatgataatagtcccttcccaaaccaaaccccctttttgcctgggaaccagaccacctttgtaaaactaacaaattagccacaagattagaaattatggctcaggagtcatgcagccagaggccacaagattctaaacttcctgatatggtttgtatctgtgttcctaccgaaatctcctgtcaaattgtaatccccagtgttggaggtgaagcttggtggaaggtgattggatcatgggggtggacatctcatgaatgatttagcacgatctccttggtgctgttcttatgatggtgagtctcatgagatgcggttgtttaaaagtgtgtgttacatccccctacccctacccgccactctctcttcctcctgcttctgccatattagatgcctggtccccttttgccttcagccatgattgtgagctttctgatgcctccccaaaagcagaagccacaatgcttcctgtacagcctgcagaaccatgagccaattaaacctcttttctttataaattacccattctcagatatttctttagagcaatgcaagaacgactaatatactccccaattgctcctataaataacatcgctattgtaaaacctaagattggtgtttgagatatttttcagaccctgcatcctgatgaaccaactggcaccacccagactggtaaactggcccaacttgttctgccatcccacccagaaactgaagacagcaagaagaacctgcttcaaccccctatgatttcagccccaacccaaccaaagcattcccccactccctagccccatgaccaccaaattacgcttaaaaaaccctagtcttcaaatttttggggagaccaatttaagtaataaaattctggtcttctgtttagccagctctgcatttattaaactatttctctattgtaataatgctatctcagtaaattggctctgtctgtgcaagtgcaacaggcaagaacaactgtaagggcagttataatctcaaagcagccattttattgggccaaatcacttttgtcccagtatagccatatgttgcttaatgacgtggatatgttttgtgaaatgcatcattaggtgattttgtcattgtgtgacaccatacagtgtgcttatacaaacctagatggcacagcctactacacacctaggctatatggtttagctccttcctcctgggctacaaacctgtacagtatgttacagcactgactactgtaggcgattgtaatacaatggtaagcatttgtgtatctaaaagtatctaaatatagaaaaagtacagtaaaaatacagcattatactcttatgggaccaccatgagagctgtggtctgttggtgactgaaaccatattgtgcagcacatgactgtgtttgtgagcttcttcagattttgatgggaagaaaacagttggatgacacagtgactggcaataattaaagtggaaaaggtaccaaattgtatctcaatatttggtgtttttaagtctggctctaggccggacgcagtggctcacacctgtaacaccagcactttgggaggtcgaggggggcggattacctgaggtcgggagcttgagaccagcctgaccaacatggagaaaccccgtctctactaataatacaaaaattagtcgggcgtggtggcgcatgcctgtaatcccagctactcaggaggctgaggcatgagaatcacttgaacctgggaggtagaggttgcgatgagccgagatcacgccatcacactccagcctgggcaacaagagcgaaactccatctcaaaaaaaaaaggtaagtcttgctctgtaaatgaatatatctttccagtataattttttatatttaaacttagctactttaaaattatttaatcattattttacgatttaatttttagtaaacaattattgggtgggaaagcaggctaatttgttgttaaaaattatgcttgcagaaaagctagtggtttggatcacaagaacccagcttttattgatgagaatggatttccactgtagacaaaacaaaaccaactaaataaacaaaaataaaaaatacctatgaaaggccgggcatggtggatcatgcctgtaatcccagcactttgggaggctgaggcaggtggatcacgaggtcaggagttcgagaccagcctggccaacatggcgaaatcccatctctactaaaaccacaaaaattagccatgtgtggtggcaggcatctgtagtcccagctatttgggaggctgaggcaggagaatcgcttgaacctgggagacgaaggttgcagtgagtcaagatcgcaccactgcactctagcctgggcgacagagcaagactctgtctcaaaaaaaaaaaaaaaaaaaaccagctatggaaagaaacaacctttaagtacagagccatcaaatgagattcaggagaaattatatcggtccaataaccgagtgacattgaacaaattgctgaatttctctttcctctattacaacagaaaataagtatgcacagaatatccacatcaggcattttcttatgacaccctctccccaaattgagtaagatgtcactattagattctttcatagctccctgtgtttactcttctcatagcctgtacttcatggtatatagtcatatctttttttgttcatactccttattggatgcttcttcacagcacagtctctgtcttgtctatcattatatctcccagtgcttagcattattacaggcattatatatcccagtgcctgtgatatttaaataattgccaaataaataaatgaataaacaaatatattaatacatggataaaaaataaataaggcatgcgttttaattatttatgactgtatgacaaaaagctccaaaacttagagactaataacaataatttactatttctcatgattctgtgggttgcctggaaagctcttctgctgtttcacctgagttcactcatggcgctgcattcagttgggggatttccagggggttgagctcagctgagaaagctgaggatctggacatttctctctgtaggtctttcatcttcaagttggctccttggacttcttaacgtggtgagagcaatgtgccaatgtgcaaacacttactgaactcacatcatgtttgctgacatctcttaggccaaagcaaatcatttagccaagcctagaataaatgtgggaagaaattacacatgggcatgaatactgtatttgggagaccctgagtgtaataatgaaccacaaatgtctctaccttaagggatttcttaatccaggggtgttcaatcgtttggcttcccttggccacattagaagaatggtcttgggtcacacataaaaaacactaatatgatagctgatgtgctttaaaaaaaatcacaaaaaaggctgggcactgtggctcatgtctgtaatcccagctctttgggagacggaggtgggaggatcatgaggtcaagagattgagaccatcctgcccaacatggtggaaatccacctctactaaaaatacaaaaattagctgggcgtggtggcacgcgcttgtagtcctagctactcatgaggctgaggctggagaatcacttgaacccaggaggtggaggttgcagtgagccaagattgcgccactgcactccagcctggtgacagagtgagactccatctcaaaaaaaaaaaaattgcaaaaaaacctcacaatgtttgaagaaagtttactgatttgtgttgggctgcattcaaagccatcctaggccacatgtggctcacaggctgagggttggacaagtttgtcttaatcaaagcagatgagtgaatatacagcaaacctaatgaaataaatgttatgccagagataacaacaaactgcttaggatataggtacagacagcattagagccaggaggtcttattttgaacctctctccttttattaactgctgtgtgaccttaggtaagttatttaacctgtcaaaatagtggctttatgattctaaaaatgggtataagacctacttgatatttattgcaacttccttctaatatgacatactgttatacagaggcttgaaaagctaaaacctgtatttatcagactcctttgcagctaaagctcttgatgtgacttagatcaaccgattaaatatgtactatgagaactgactttgaaactgaatcaattgggaaaatatgaagtggcttgaagggcattgaagggcatcaacttttgctggaaggatatagcagctgtagcacaactctggggccaacggtgctggtggtggagtcacgttccagttacatggctttgacatcagaatctacgagtctgcagtaggcatggcaccttctggacacctagtgttccacctatagtagagagagaagttccctgggcaggctaattctgttttttttgagatggagttttgctcttgttgcccaggctggagtgcaatggcgccatctcggctcaccacaacctctgcctcccgggttcaagcgattcttctgcctcagcctcccaagtagctgggattacaggtgcccgacaccacacctggataattttgtatttttagtagagacagggttttgccatgttggtcaggctggtctcaaactcccgacctcaggtgatccgcccgcctccgcctcccaaagtgctgggattacaggtgtgagccacctcgcctggtccctgggcaggctagttctatggtagtgaactgggagccattcctggaggtcttgtctaaagatgcttcatttagacctttcagagcttttgtaggcatcaaattccctttctccttaaggtgttgagagtagtttctgctttctggactgagccctgatggataggttgctttccaagattattgtgaagtttactagagacactttatgtaaacttgattcatgcttgggaagtgcttacttagtaaatactaatgttccttctcttataatttttatatacaaaataacagatgaaacctccagatgtttttaaagattctgactctctcttaatgtttagttggcatgtaaacacaatctttaaacaaaaacttccagtcacactaatatacaaacatggaaatagattcagaaatgcaaaatgcatcctattcttaatcaccttttaacaaagactatgatcatgttttaagaataagtgcctaatcctaaccttgggcaaagcattttactgcctcagtttcttcattaagggccttagtgtcctcatttataaagtgaaggagttggatttacgtaatttctaagacttcttccttccttgcttcaaaactgtgtgttctttaaaccactaagcaattacctcccaatgctggcctatacatatgcagtcaaagtttatcactggtttctgggcttcgctagtggtctgaaattgtgtaaaaagagttgaccctgtgtctttatgtacttgttagttctcaaataagctaggataaccactccctctcataaagcatgttttagctcttttatcgataataatatattttcctgaccaaatgaatatggatccaacactcctaaacacaattcacaattcctctccccctttaacacttaagcaagcactgtcatcattatcattgataacctttattacacaattattatctattgagcccttatattttcttatttgcatgatttattgccaatttgatttccacaacacccgatacacttttttgatatgatgagactaaggctgaaagaagttaagcaagttatcgaaggtcacagaattaccaagtggcagagttagatgttgactaggtttatttgaactgaaagtttcttaacaagtacattagatgacttcttaataataataataagtagtagtagtattgaaaatagtattatcttagctgagtgcttattatatgcctttaagtactctgctgtcttattcatatctgaattctcataatttacagcttaaaccctattataaccatcattttataaatgaaaaaaattgaagcttgttaattttaagtgtctttttttttttttttgtcttttttttgagacagggtctcaccctgttatccaggctggagtgcagtggcatggtcccggctcactgcaatctctgccctctgcctcccaggctcaagcatcctcccacttcagcctcccaactagctaggactacaggcgtgcaccatcatgtctagctaatttttgtatattatttggtataagcaaggtttcaccatgttgcccaggctggtctcaaactaacaggctgaagccatacacccgcctcagtctcccaaagtgctgggattacaggcgtgagccactgagcctggcctaagtgtgtcttgaccaaagttattcagctccactagcggaggtggactgtgaacctcagcagtatgaaatcagagtgttttcacctgccatgccttattgcctcctgtctcctgatagtgatgatattgaaggaaaaaccttgactctgctttaatttatggacaaagtaatttgtttgcacatttaaaagctgtataagtaacaaagtacttatggcactcccccacaattgattctgcccatcagtgtgccaccacaccactcctgagaaccactcacacagagactaacgagtacaaatagagggaaagaatgtgtaggtaagaaaagctatggtatgaagctggttatggtggctcacacctgtaatcccagcactttgggaggctgaggtgggcaaatcacttgaggccaggagttcgagaccagcccagccaacatggtgaaaccccttctctactaaaaataaaaccaggtgtggtggcgtgcacctatagtcccagctattctgaaggttgaggtatgagaatcacttaagcccaggaagtggaggttgtagtgagccaagatcgtgccactgcactccagcctgggggacagagcgaaactctgtctcaaaaagaaaaagaaaaaaagaaaagctttggtatggacacacactcccctttttctcattttttttttgtgtgtgtgtgtgaagaccgtaacaaccttttaattaatttgtttatttttaagctacttctgaataacataacaacctttattattttcctgccaaagccacagaatttctgatcctatttctattaggctggcagtgattatgggaaaccactttatatttcccttttaaacataactttcgatgttatatagacattagtttataatttatggatttttttggaaaaaaaagtatagcccttttaaaatctgagtcaatcttataagtgagctagaatgcctattggatttaataagaaaaaaattataaatctaagcaattaattattaagcacctaacagccaaatgcagcacctgtgggcagagaggccctctcctttgaggagatgaaaactaattgcaaaagcagagatgctgagaagtcacactgggaggcatggagtgcccgtagcagttgtcattttccattttctgagccacattaaaaggaaaggtagagatctaaggaaaaagtatttaaaacaccttgggaaatttatttaataaccaagcatgaaaaaaaaaatgggtaataatgaaagccagtaagaaaagtggtaaggggatgtttaatctgggtttcaggaactctgtgagccttgaggtttttaatctctgaaaggtcacaggtgtagcacacagtaggtgctcaaacatcattaaaataaccagctaattgatgaatggatggatggatttttcccctaagtttgagaaaagaggaagtttgatatttgtaaatattattgaacatagtacctgttatagactaaatgtttatgttaccccaaaactcagatgttgaatccctagccctcagtgtgatggtctttgaagatggggcctgtggaaggtatgtaggattagatgaggttatgagggtgaggccctgctccgatggaatagggccattattagaagagacacaagagtgtttgttctgtctcttactctacacatacaaattgaggaagagccatgtgaggacacagcaagtcagatggaatgcccatgccaggaactgaatgggccagcaccttgatcttgtacttcccagactccagaactgttagaaattaatttctcagcctggccaacatggcaaaaccccatctccactaaaagtacaaaaattagcccaccatggtggtgggcacctgtaatcccagctactcagggggctgatgcaggagaattgcttgaacctgggaggtggaggttgcagtgagctgagattgcaccactgcactccagcctgggcaacaagagtgagactccatctcaaaagaaaaaaaaattaatttctgttgtttaaaccactcagtctgtggtattttgttatggcagcccacacaggctgagatcacacctatacctaagtcctcatatatctttaaagtttgtgctacttgggtacacatataattatagaactgtacatagattatacattgtaaatatatgtacatacaaatattagtcattttaatttctaaaaataagttacttttgaatgtaaaataacttcccaattgaatgaaaattgtactatttcctatgactcagaagactacatccaagaagaagttggtattcaaatcatgcgaccatacctagggcccctcagttaatgtggtgctataatattcaacctgtaagcagcatatcaagggaggaatttaggtctcttgagtataggcgaggcacaaacccatacttcatagttcactttcatttgtctctctctttatttctcccttgggacacataatgatagaaaactaatcgaggctagtggccacgacctggggtgtgctggatgcaatacgggggagccgttagggctttcagtggagattcaaagccctcggggactgtatctggggacagggccttgctggcaacttcagagctggatatctctctcatagtaaatacaaatcaaccctaagcattggatagacagagtgctaattaagtccctagttatgagagctcttgctttatgtgtgggagcagttctttccttgggtttacatagtcaagagctgatagctttttagaaatttgtcataaaggtgagtatctccctgcaagcatggtataagagtaccaaaatcctggagacaatggttagagctcatctccatttcttattaactatgatctttagagtgttgttatagtttactgagactttttgcttctctgcaaaatggggctaataatggggctaataatttctgccctacctgcctcagaaggttaatctcagaaacaagtgaggaacatttgggcatgagaaaacctttcaggaataaaattataattttttacaccagcagttggcaaactctggcccacaggtcaaatctatctcactgaatgtttctgtatggtccacaagctaagaatagtttttacatttttaaatggttgagaagaagcatatattatgatgtgaaaattgtatgaaattcaaatttcagtgtccaaatgaatgagtataaatgttcacttgtttacctattatctatagcttatcttatgtcttaacactaccatgttaaagttgagtatggcccataaaatattttcagtctggccctttacagaaaatatttgtcaacccctgctctacacaagtgtgtaagtcaaggttttccagagaaatagaaccagcaggagatataggttaggctgttcttgcattgctacaaaaaatacctaaggctgggtaatttataaagaaaataggtttaattgggtcacagttctgcaggctttacaggaagcatggtgctgatgtctgctcagcttcttgtgaagcctcagggagctttcaatcatggaagaaggcgaagggggaacaggcacaccacatggcaaaggcaggagcaagtgagagggtgggaggaggtgccacacatttttaaatgaccaggtcttgtgagaactcactatctcgaaggcagcaccaaactacgagggatccaccctgatgacccaaacacctcccaccaggccccacctccagcactggggaatcacagttcaacatgagatttgagtggggacaaatgcccaaactatatcaaggtatatctctatatatcctagtataggataaatacatacatatatatatatatataaatatatatataatatatatattatataatacacacacacacacgaggagagacagagattatgggaactggttcatgctattatggaggccaagaagtcccctgatctgccatttataagctggtagtataatttagtccagggctgaaggcccaagaaccaagagtgcagatgtccaagggcagaagatagatgtaccagtttagaaagagagagaatcaatccttcctccacctttttgtggtatttgggccctcagtgaattgggtgatgcctactcatattggcgaggacagatcttctttactcagtcatctgagtaaatgtttctctctcccaaggcttgttcaataggctcatgaataaccatcacgggccccagtgatacagcaagtatattcataggcttaccatcatggattttgcttctgtccttgggaaagaggtgctattgtcactggctatcaccacttctgagcgaccaacttgttctcattgttaactaatcctggtgtttgaatatgcaaccatattccttaggcacccagctagtcctcagtaacactggactcctactgcaagtgggaaggcagcagtccatcctctctggaacaaatctatgccctgggctcagagttgctgtccctgcccaccatgcttcatggttctgccctcatgatctgtagaagcaatgcatgccgaggacaccaacaggcgtcccaccagcctggttctgaccaaagaactgactgctctctgaaagaagtaaggcaataaatggaatttacaggacttgttcctcctcacttgaagccactggccttacagaacagtaatgacaactcacatttacatgctaggcactcctctaagaacctcccatatgacaacttatttaacccttaaaacagccttttgagataattaccataattatattaatttctaagaagaggacactaaagcaagtatggttaatagactgactcttgtcactcagtaagtggggtctgagacttgaacccagacagtccagctccagagcttgtgcttgtaactgctgctactcataaccgctactacccataaccacactgcctacaacagaggaatggaactgcccttcaaaggccccattatggtgtcttattagaaagaaaggcaggtgagtttacagtgtgggggtgaagtttattttttgaacaagtggtcaatctctggtgccatttctgccacagcaagaatatactcatatgtgaatcaagaggatggaagctggagttatgcccacttccacgtgggaaattttgcttacgttctccataactcagggctccactgatatagaggatttagaatcaaaggaggaatcatcaaggggaataaggtaatggctccactgaattagcagctgaattattggcctattttaggcttctcatgacagtggtgaaaaaggggagctctggaatagatcaggctgcttgagctcaactatttcaagggaatatatcagttaggttgcaaccggctttgagtaacaatgacagcaatacatttaaaaataacccaatcataccaacctaaatcatagaggtctggaggaaggcagtccacaggtggattcatggctcaaagatatcatccaggctgggtgcagtggcttatgcgtgtagtcccagtactttaggaggccgaggcaggtggatcacaaggtcaggagttcaagacaagcctggccaatatggtgaaaccccatctctactaaagaatacaaaaattagccaggcatggtggcatgcacctgtagtcttagctacttgggaggctgaggcaggagaatcgcttgaacccgggaggcggaggttgtggtgagctgagatcgcgctactgtactccagcctcagtgacagagtgagactccatctcaaaaaaaaaaaaaatcatccaagaaccaggttcttcccagcaccctcctcccttggctgctttgtggtgccacccctaacagtgccgagatggctgcaacagaacctgaaatgagtgagtgtgtgagtgaagcaaaggactagggacagtggggaatctatttctgtgactggctcctgcagtttccaggccaacagttccctgtggcagcatcaaccatccagtgctggtggtggtgccgccaggatatccacgactcagctgtgcagcagtcttctcaccaggtagtcccattggtgtgattatggttgtggctctcacttccttgcctccatttgttcctagtcattttctgaccctgattctctaagccctcccagtgagtcagtgagctacctgatatctctttggttctcttttccctgtttatatcagcaagaatcaatttctgatgttgtagctaagaaatctgattgataacatggctgtttaattgatttgttgaaagtgaagttttctttctttttcgtgttttaaaaattttttaaaattatttattcatgtattttgtttaatagatgggggtcttgctatgttggccaggttggtcttgaactcctggcctcaagtgatcctcccactttggcctcccaaaatgctgggattacaggcatgaaccaccttactctgcctctttttggtgttttcagtgggtttcaaatattgccagagggcaaatacacctttactagaatgtaggctttaccaagtctctagtttattttaacggcttcctgtcagtgaaattcaggccacacaagtcctgaaaaatattctgggaaagaggcatagctgttcacaaataccatttattgaggacttactatgagctaggtatacaaaaagtaatttaatatggatttaattctcattgtgttatctacgttttacagataaggaagtcggtatgtagatcagtcacacagggtacaatagcaaatgaccccgtgctacccaactgcaaaggcctgggatatttccagtgtactagatcattattttcttttacttatgttgtcagaaattaaagcaatagattgtgcccttccaaagtctccataatactgctcagccaactgaagttgaagttgatatcaaaggcatctattttggaatctatccgcaggattttgtctagccaaaggaccataaagacattgatagctttttaatgtacagtaaggtcagtggcacaaaccctgaggttacctttaaagtgtggcttggcgttacctaagctggacctgccttgcactggacttgtttatcatgctggatcacccatatactcctctaagagaaacttcacacctccatccagtccctgtagctgaagcaggcatgttttatagtaatttccataattaatgagcaaggaactacttgcctgaaggtcatcaatttatagactggcctgtggcttatgcagcctgttttagaaagatgggtcattcagataggtcttatctaagttaggaattgggaaactgagaaagagagggtgtttgcagcagaggtgaaggtaaaagcatgttttgatgtaaaattgattcaaaagttacatgaaagctaatgttaggaggaggtaaagtttatgctctctgaaacagaagatgaggaagccatttggtggagagaagagggtgcaaaaaatgagcagagataaatagtgatattctgagagaggaaggaaaaacaggaagaggagggagagaagggcctggggcttcctggattttctgaattttccaggaaactttcgtggatccctgttccttaaactcactatactttttgaaactctctttctcatcaacctttaaaaaggaaacttgtgaactaatttgtctttcatctttttagttttcccccattcttcctcctgtggcctaactaatccaatagctagaaccaagagaaaagtgaaatagaaagcaagcctggataatccacaaacataaaaatcagacactgaagggtagaacttgatattttgtgctaaaccctaggcttttataacccctctgctcccctctgtggataaaggcagaaatgagaggatttttcattctataaaatccaaaagcagaagcaaaatgaaattcttttctatgacttttttttcatgactatgaaatgaaaacatcagtgtacttccttataaaaaatgtgtttttttttcctgattcaacaacctcccccacttaagtctaaggtgttctaaacacatacctggatcttacctccaaaatgccaggcagatggtttgagtgggaaaagccagagggggcagtcatttttgctataggttagctaaaagactaacacccctcatccacatgaatctacttcacaccaaagcaaagaaagggagggcctctcttcctttgtgacccaatgataataatcccctatagcagctgaagagttgatggaggctctgagaatagtttcatctcaggccatttggctttcaaagctccttccaccaacctgcagagaagggtctcctgggctcctctgtttttatctcctcctatttgctattgtttttccttgctcagcattgcacagaatataggttagcaatgaagaaactgtggtgcaaagcttaagcctctgggctctagagacaaacctctagtgttcaaaccttgcctgtgccacttacaaatagattgatctctctgagcttcagtttcctcatctgtaaaaacgcagatgatattattactttctacctgtaggactaaaaggtactatttgtaggggtccaggataatgtctagcacatagtgcaccataataagtgcttgctaaatcaacgaacttgctccaaggaaaggagactcctccacaaaagaaagacaggctggtggaaatagagctttctttgaaaagaaatgaactgtgcttcttgctatagtgatttgttttctttgcaggaaatttccatttcataattaatctctactatgccactgaatattctaaagtaagagggtatttcaaataataggtaatgtgcttttggaaaaaagaaacattaaaaacagaaatgtactgtttaaatatagtttaatttactgccaattttgggcatggaaatcagcaaaaattaaaaaagaatgaaagagtttgaggtagttgtgccaaaagacctgggctgaattccagctctgcagccttttaactattttacttctggcaaggcccttaccccgccccgccagcttcagtatctgcaaaatggggacacttgtacctgtctcccaaggaggtcctgaggatgaagtaagataatgtggcacagtggaggctacacgctatgcacttaatgactcaacaagtgttagaatttacatttgaaaacagtttccagcaagctcatacacagagtccttcagagtttggctgaggacccaacaacctcttaaggcacacttcttctaccaagctgggtcatctggtttcccacaactggctgagatgatgggcagttcaagaacactgcaaggaaaaacacactgactagcaagtgataaaggggacaggactaaaagagacaataattacgtaaagaaagaaaaggtagaacattttgtaaaaataagacaaaacaggctgggcacagtggctcatgcctgtaatcccagcactttgggaggctgaggcaggcagatcacctgaggtcagtagttcgagaccagcctcaacatggagaaaccctgtctctattaaaaatacaaaattagccaggcgtggtggtgcatgcctgtaatcccagctactcgggaggctgaggcaggagaattgcttgaacctgggaggtggaggttgcggtgagccgagatcatgccattgcactccagcctgggcaacaagagcgaaactccatctcaaaaaaaaaaaacaaatccaaagtttaatagtttggggtcttttagtgtagaccatgctctcctctgaaggattactacatcacagcccagtgcaatgattggcattcacatgatcccaagcctgttgggcaccaagagatcattcagactcaagtctgaaagatcctggtagggtggaatgtgcctgcaccccaggagaaagggacttggaggaggaaagcaccagattatctcaggttatttggaaatgaacttcaggaagactaggagagaaagagaggctgcttgaggtcccagcttcttacaagatcttcagagatttgaagggcctggaaggataaccttatactgactatacagaggaagaaacatttggaacctagttcaggtgtgcttctagctactggaggaaaaattgaaactgtttccctttgaagaggaaaagaaggtaagtaatagaaagggctaggtagaaacatttttattaataatgtttagattttatttgttgaacagatgcactgtggtgcactgaaggtactaaactcagctcaactcctgaacagatcagaccaccttcttgcagggacatgcagtacagaaggtaggcagccattcagcatggaggattcagagcttgcctgtggaagccaagtgcctgggttcaaactcaactctgactcttactgtttgcatgacccccagcttaatctaacttaatctcttctgtctaaaagaaacaccttatagcattggtgtgagcataattgtgttaatacacgtgaggcacttagaagactgcctggcaaactgcagtatttccaccaatgttagctattgtcaaatacattcctcacatctgttttatcttcttgtgcttctagtaatagacgattgggttgcctcaagtccactcactacaaacaatgctgtgattaatattttcatgcatttgtttaatatgcattttatacaggctgggcacagtagctcacacctgtaatcccagcactttgggaggctgaggagggtggattacttgaggtcaggagtttgagactagcctggccaacatggtgaaaccctgcctctactaaaaagacaaaaattagctgggtatggtggtgggtgcctgtaatcccagctacttgggaggctgaggcagaagaattgcttgaacctgggaggcagaggttgcagtgagctgagatggcgccattgcactccagcctgagcaacagagtgagactctgtctcaacaaaaaaaaaagcatttcattcagtgcttaatatttgctgggcaatgtttctttcagtcctgtgcaagagtttacccaaggcttatgcccaggaacgggttacttactcaccataggctggctatctgctcacaaatttacatgtgtgctagcagctcttgtttccccaaatgtttaacaacactcagtgttatcagacataaaatttttgccaatctaggctgggcatggtagctcatgcctataatcctagcactttggaaggctgaggaagatttgatttcaggagtttgagaccagcctcaccaacatggagaaacaccatctctactaaaaatacaaaaattagctgggcgtggtggtgtagaaggctgaggcacaagaatcgcttgagcccgggaggtggagattgcagggagccaagattgcaccaccgtactccagcctgggtgacagagcaagactctatctcaaaaaaaaaaaaaaaaaaaattgcaaatctgatttgtgaaaagtggtatcttattctcaagtctattgaaagattgagtatgtcttcatatcattagttattccaatatcctcatctaggaattgccaatatgtctattttattgcctatatgttatttttctatggaatttcctgacttcgttttgttgatttaaagttgttttgtatatatcttagatatgtagcacttgctagtgttagatattgggatattgggagtatcttctcccaatttaccaccttttaattttattttaattaatttattttctgtttgtgactttggagatgccacaagagcctttctgttttgttttgttttttggtagagatagagtcttgccatattgcccaggctcgtctcaaactcctggcctcaagcaatcctcccaccttggcctcccaaagcactgggtacaggcatgagccaccatgtccagcccactttatcactttttattaccaatgttcagattttctttattgaacagaaatcccgtggtgcactgaaggtaccaaactcagctaaacacctgatcagattgacttaactgtccttaatgataaaaagaagcatacctatttttggacataaatgttatttatctcagtctccactgctcttctacatacaacatctagcattctttcaaaaatcataagacagaaaaatcaaggggaagacataaaacaatcaaagatctgattcagatatgactcagccgtttaaactatcaggcaggaactttaaataactatgagtagcatgctaaaagatctgcttggaaggagagcaagaggcattgagcgatttcagcagagagatggaaaccataattaagagtcaaaaattggcctgacataggggctcacacctgtaatcccagcactgtgggaggctgaggtgggtggatcacctgaggtcaggagttcaagaccagcctggccaacatggtgaaaacccgtctctactaaaaatacaaaaaattagcccggcgtggtggcacacgtctgtaatcccagctactcaggaggctgaggcaggagagtcgcttgaacctgggaggcagaggttgtagtgagctgagattgcgttgttgcaatccagcctgggcaacaagaatgaggctccatctcaaaacaaacaaacaaaaaagttacacactctattttcattcttctggttattttcccaaatccttaagacctttgcttatgtttgtttttttctgtcttgatttttgttgttgttgcctgtttggtttgatagtttgggcaattcatcactctctttccctttttggcatctccggggctgagattgaggggaagaaacaaagtttaccacctcatcagatataggaaaatttgcctcccatgtctcacctgtaatcttcgggtaaggaatgctttgaagaaaacagtcttcagtgaaaacctcaggaaattaccacaaggcttaattaaatggagaatctacatggttttaggaaaaggattatttgggtttttgttcaagtagaatacttcattctctgttagtgctagaaagtgaaatattgcctaaatttataataatattatcaggcagcagattagggaaaaaaaaaacaagaaaagtttatcttctaatgattgttatttgtcctacaattagacatattttttcttagtagtatcaaagtcgtatattatttattatgtcaacagccacatatcctaaaacatccaggttcagatcagatatttttgtgtttactaagctttggttccactgcaatttttatacaacacatatatccctttgctcattcactcatggttttgatatcgtaggttagttatctttatattctagctgtaagataggaattacttaaagaagagttgcaaaaagtagctgagaacagtggctcatacctgtaatcccagcaccttgggaggctgaggcaggaggatcgcttaagccaggagttggagaccagtctgggcaacatagggatacctcgtctctacaaaaaatttaaaaattagctggagatggtggcaagtgctggtagttccagcttctagggaggatgaggcaggaggattgcttgagcccaggagtcgaggctgcaatgagccatgatggagccactgcactgtattctgggtgatagagtgagaccctgtctcaaaaaaaagtgacagaaaggaaactgaggattttgcacattagcccatgggttttttaaggacttatacaaatacttgagacctaaaaaaaaaagtctctaaaacaacaaaagaaaataatgtatttaatatgctgtggggtagggtagtgggactccaaagaaaatgtgcttagaacctatgcaagtcacctggggaaatgatctcctatctactttgttcttagtctacaacttgagctaatcgggagtattggctgatacagcccaatggagaatggcagagaataagaatgcttaatgctgaaagctacagtggagagcatctatccacattttcaaactgtgcctcagatgcaaaaggaagacagaggcagtagatcgctggtccaacctatataacttcctgtcattactggtatcagagccgctctacttggatctattcgaagtattgggattctctgtagttttgtttgaaaaatgagttcacagcttaatgttagaaaactactgatctattttaacttcatcattttagtaaagagtgctctgaggttcaaataatttaaataaataaattacccaaggtctcccaactagctagtaaagccagatttccagaatcccatcccagttcaagactatttcttcatacagagattgagctctcccgatctcatgttgacaggtgttgttcctatcttgggaggcatttgggttttgctagagcagttgaagtatagtttcatcacctgttcccatgtgctgtttttcaggccaaggccacattctggaacttggaggatatctttttgaagggctcagagggcatctgtgaagctaactaggggaataaaaatcattttatctcatttttagtacatggattaccctccaacttccaccccttaacagaaaggggtgttctcttctcttaaggggtggaacttcctgtttcaacttcctgtttcccaatgaggaaaataaaaacagctaaaaagaaacctaataagcaaaaaatacaacaaaaccagaaagtacataaaggagtaaaagagtttatgatggcagaagaataactaatgaccaaatctagttttattaatcaaccataaaggctataactgtactgtctgatatggtagccactatccacttggggctactgcacacatgaaagatggctggtccaaatcgagaggtactagaagtataaaatacacaccagaattatgacttaatatgaaaaaataaaataatataaactctctcaataattattcttttttgtttgttttttgagacggagtcttgctcttgttgcccaggctcaagtgcaaggacaccaactcggcgctctgcaacctccgcctcctgggttcaagtgattctcctgcctcagctcttgaatagctgggattacaggcacctgccaccacgcccggctaattttttgtatttttagtagatatggggtttcaccatgctggccaggctggtctcaaactcctgacctcaggtgatccacccacctcagcctcaaagtgctagcattataggcgtgagccactgcacccagcctcaatagttattcattttattgattcatgttgaaatgacagtattttgaacatattgaattaaataagccatattactaaaattaatttcacttgcttttttgcttttactagaaaaaatttcaattacatgcttaaatataatgttcacattgtatttttattggacagcactggtctgagagtaactaatacatgtccataacaactgagctgagaaggccaggactcattacagaaatagcttcctacctgcatggccacagactaaggtcttcttcaaagagcagctccagactctgcactcaggctttcaatgaaggccagacgcttatgtatcttcagggagtggtcattacagttctttccttaagtgtaacttgacttttacctggggttatgtaccttggctggctttcagggttattaaataacagcttaatgaacaaacaccattcaaattgattttcaagttccagttctgtggagtggaagcagaaaaacacaacagtccctgcagtgaatttctactgcctccagataaataggactagatctgataagaccccaaacaaattaaagggtgttgctcagaactttgccaaatagaaatctctggaagttttatgttctgacatctctaaaacagatctttaatcaggtaaagacttatttacttttagtttcactggagcccccttttgaaagagatgctgatacggtttgttctgtgtccccgctcaaatctcatgttgaattgtgatctctacatgttgaaggtggggcctagtgggaggtgactggatcatgggggtggtttttaacagttcagtaccatacccctagtgctgtctcaggatagaattctcatgagatctggtggcatttaaaagtgtgtggcccctccccatttgctctttctctctctcctgctccaccatgggaaaatgtgcctcattcccctctgccttccaccacaattgttcgtttcctgaggcctcctagttatatttcctgttaagcctgcagaactgtgagtcaattaaacctgttttctttataaattacccagtctcaggtagttctttacaggtgcctgagaggaaacaaagttgaagttgttttgttggcttacagtatactttctctcccttctaaaaaccaagttttgggtctaggagaaatatgaggcattaaacctagagttgaagtttgattagcatggaaaattgctagagctctgaaggaaaaaaaaataaagaagttgttagaattctaaaaaacaaacaaacaaacaaagccaataccccaaacaaacaaagcacatgttggtttgaggaggcagtgagatagaaattcacatttgaaatagacctgcagtaggctcagtaatgggccttgaagctatacatatcctaatccctggaacctatgagtacacagccacaaaaggggccttgcagatgtgttaaattaaggatcctgatagaaggagatgagcatggcttatccaggtgggccctaaatgtaactgtgtaatcaaaggaagcagaaagagatttgaccacacaagtggagaaggcacacacagagaaggtaatgggactgcagaagcagcgagtggagtgaagtaacataagccaagaaatgctggcagccccagaagctggaagaggccgggaagaattctcccctggagcttccaggaggaaccagccctgcagaccccttgatttttgccctgtaagactaattttgaacttctgacttctagaactgtaggaagagtaaatttccattgtttttagccacaacatttgtggtgacttgttacatatagcagcaataggaaatgaatacaggaccccagtgacttacttggcaaaattaatctataggctgaatatttttttccttcacattaattcatataggcttaaagcatagaagaaagaaatctctaagacaaagttcttgggagaacacatcagagtaaatgttcgaatctgtatttgctcccttacttttccttatcttttatcccattctctaaacttcccattcctttctttcctctttccttccctttcccaacaccctccaccttcagctaagtaacctttcagatgcaactttagatttacttttatgtctggcttgccaaacctccataatgttaacaaaaacattccagtttcccttcaagatacgtatggtgtgacagtcaataaatttatcagctctgctttattgtaaatattcatttattcaatatatagttagtatttaccaactatgtcctaggccctgtgctagattctgggcaaacaacagtgaacaaagtagatgttgtccctgcctttatttacaaataaattcatgaaattaccaactgtggttaaatgctctgacaggcacaaagagagtgcaacaacagggaacaacagagctggcctctcttgggcggtggcatttgtgttgtaaagatgctcaccttgtaaagagcaagatgggggtggagagagcatcccacacagagggaccggtagggaaagaacttaccagtcaaggaactgaaacaaatcccatctgggcagagcacaggagaggggaagagcagtgggacaagatgaagtgagagaggcaggcaggggacagatgacatagggatttaaggtacatctctgttcccttccttcctagtgaacagactgaaatgtcagtaactaggaagcctctagcaagaaatatgctaataattgaatctttgccagtagagatgcactccttaaagtttgcaaagtttatctggatatcctctaccctctaagaagtactttaaaccactatcatttaacattttggtgagaattagttttctggactccttttattcattcaacatttattgcatgcccaatttgtgccagacaaccctgtttggggtgctgtatgtgttctgggtgttgaggattggcacgccccatctctcctctcatggagcccaggtatggtaaagtgctatgaggtaaaatgacagggagccaatgagagtgtgtcacaggttctggcctgacctgagcaaaggaagaaggcttcaagccagaagtagcacttaagcagggaagcaaatgatgccaggttgattaacaggttggtgtgggtatagagggagagggaagaggggtattccaggaagaaagggtcctataggttcagcataccagagaagcttcaagaagtccagtgcactacccctggagtggggagagtgaaggagagaatggaggaaagggaatcagagaggtaactgcagtggagtgcagggttttggaggtgctggtaaatgcatttggactctaggaacagagaaagtgttaacaggttataagcaaaggagtgataggatcaagttcgcgttaaaaaaaaaaatcataggccgggcgcggtggctcatgcctgtaatcccagcactttgggaggccgaggcgggcggatcatgcggtcaggagatcgagaccatcctggctaacacggtgaaactccatctccactaaaaatacaaaaaattagccaggtgtggtggcatgtgcctgtagtcccagctacttgggaggctgaaacaggagaattgcttgaacctgggatgtggaggttgcagtgagccgagaccatgccactgcactccagactgggcgacagagtgagtctccatctcaaaaaaaaaaaaaaaaaaaaaaaaaaatcattacatgttggtgtggagaaggggactggaggtaaagaagagtgaactcgagagaacattcaggagatgattactggcatctaggcaggagatgatggtggcttagaagagaatgatggcagtggagattactaattgcagaacctacttgatctttgcatctatgcttattcacaattcaggttaaatataaagtctttaacaatggtatttggtattgttcatatattgggtgtgatttttattccttttcaagaagcagtattttattttttatataagtgaagctaatttcaacttcaagcccccattcttctggaagctgaacatttgattttagtcaatttgaggtctctccattccttcctcagtattacagcttaatttgaagagggaggtctgtttggttcttgtacaaggtgggtgggggtggatactctggtctccttgctcatgcatctactctggaatccactgacacacccttggtcccatggagcctatggcttacccagacttctgctgtaccctttttgtcccatcttgatactttctcaggcccactgatccctacaccatgtctaaactattctctaactgcttagaaaatgtcctacttcttctaaaacaatctggctgtggataacatctgaggctgtctcagccctgctacatcaacatgccaagtatacctcttcttctctagaacccagctggtgtgcaggaccaatagtttcttactggatctcgggaacagattcaagagatatttagaaggaaaaatgattatctttgatgattcatatatatcagagatgaagtttcaggaatgagtccccccccaccccaccttttttttttatggggaacaggatgatgccttttaatgagacaggaaccttggaagaggagcagatgtagtgcatgggctggaatcatgaggtcacttttgaacatagtatgtgtgagatatccaaaaagagagactgaggaagcagttgggattgaaggcagggatctgaagcttagatgagaggtctgggattgagaatacacagggttgtttgtttttttttttttttttcagtgtaaaatagggggtaatggaagccatgggacagacatcgtgggattccctggagaaagggaatatagaacaaaatgagaaaagggattgaggaaatagctgagtaatgtttaaggattggctaggagatggaaaacctgcaaaataatcatggaggtaagaggaaaacaaggagaatgtcatgaaacaaaagctacagaagcgagtgcttccagagcataggagtggttaacaatgttaaatgccaccgccaagaggtcaagtaagatgaaaactgaaaagtatcctttggatttagaagttattggttatctcaaaaaaagcagttccaaggtatgaaagaggcaaaagccaggttaaagagtctactttgagcatgtggggcattcacagaaacttcagaaatcaagcctttctaggagaagtaaactggccctgtagtaaaggttactctaaattcactccaacaaagcttaagaacaagtttcaaaagactcaagctaatgcacaagtaaattagctgcctgctagaacaaagtctaccaccccttaagaaaacaaattccaatgctcaatagaaaattttcagtatcttgtaagaaacttatagtatccaataaaaaattactatatatgagaagaagtaggaaattgagacctataaccaggagaaaaatgagtcaatagaaacaaacccagaaatgaagagatgatagaacagcagattaggggacaaggacttaaagttagttattgtaaatatgttcatgtatttaaaggaaaatgaatataatgagcagcggaagatatttaaaaaatactacaagcaatcatatcaaagttcttttttcataagactcccctccaaccaatgcaataaccagccccatagcttcttatctgtaaagtattttgtttcatgtaactttgtacttttggttctctgtatgcatgtattttaaaattttcttggggaacatatcatacatattcctaaagaaagaatatatattctcttgaaaggtgccagagaagtagggaggtgggtatgattgtgatagaactctagatacccctctgccctaaacagccattgtttgtaggaagtttgagacttcctggtctcccacagagcagctggctagggctcaaaggatacaccttggtgtttcaggtccatctgtctgattggcgcatctgaccctgaggtgtaataatcctgagtctcactgaagcaggttctcataactctttttttcctcttttaaacccttccttgggagctttaagggcaccttttaaggtatccttaaaattaaaggagaaatgttaatgaaaaggaaaacattaaagttcaagaactcatatgaaatatttgtgaaaatctttgtcacagataagttgggcttaagtcaaatcaaacaatttaagattaaaggagaagggctgagtcttctctccttgctgtgtatccccatcaaggaggtataagttttacctaaagatattcatcccattaacattgatctcaaagatgaatttgcaaatttgaaatctctcatattatcagcttttctaaatatgttcatatggtagagaactcatgaggctcacattacttaagtccatggatcactttgtaaacactactaagcttaaactttaaaattataaattattggacacatttttacttagaatcattaactggaaattcatttatttcttccctgttccatgccagtaagggaattagagatcatgtttttagctactccctggatgaaggaaaatagaaacgtgtgtctcagttgagcgcaccaagctgtcatgctcatatttggtgccagctggtcacctgttggcagtgccagtagagagccatgggactaaattcatcctgccttctacatccaacatcagtagaccatctctgtcagaatgtctattccccatgcaaaccacttcattaaatagaaaacctctctgtttaagtgatgtctagttatcagcttgcattttaatatctaacaaattaaaaactacgttaactttgaggcaatatttttccattctatgttattttaagagacacccatcttcttgcaacagagcacaattttgtctctcaaacacacagctaaaaaggtcagcgacaaaaataagaatacaaaaatgaaacaactcacttcaaatatctttattagttattacttctattagtgcattttatgccatagatattttgttcctaaaatctcatcttctttatttttccttcacctaccttagttctttattttatcctcaatgggcatgtctccaccatggaagatgaagaaatagaaaactggtcaccaggacactgtagaaagcaaatgacatatcattaggaacacaatcatttaacagatcaggctgagaatatatcattaacaacccagacagaagaccatcatcttccatcatcatttgaaattaaaaagtacctccaaaggaattgtttactgctttgcctgcaaaaagtgctacaaacagtaaaccaaagagacaaaacagtctttagtggattgttagagcacttaaggaggtgtaaattgtaattagccatatgctagacttacacagcccaataagaaatatgcctgatggtacagaatctccctggcccagtttttcaggtcaaaagcagaatggctgttgagtaaggaataagccacaaaggagagctacaaaactattccattctctggcttccaacacaacaggtcagaactctttctgcacatgtttgtgatggcagttatgttgctgagttactctggatgcccaaccagagtttctgcattggaagatgggagggaaggccctgttcagctcaagtggcaaccctaaaatcactgtgggtcagaggacacattaactctgttcacaaaggaatcggagtgcaaatgtgttacaaagataatgttgttctatattaatattgacaaagtgtttcagagctggggacctatatatctgagagtggtctcaggtactggcagaacaaaacaaacttttgagaacttggtttcatgtacttctctgttgactgtttgactttcagtatgtctcttaaccatctttagcatactttttaacttcccatagccttaatttatcattttgatcacataggggttggacttgattttttaaaaagcggcattcaaaatatgtttgtgtatgagtgcacattttcctgtaccctcatatttctgagaaatcctataactttcattagctttgcaaaaggttcagggactaaaaaagggtgaaggaataatcttggctctggcagattaactgtaggagtagaaaaggaaacagaatattcaaagtcttgtgctggaacaaataactttcaggatttgatttgctctgtttgactgagaataagatgcttcttatgcaaatgaagactgataaaggatgagtttatattgtttaaaatgcaatatgatcttttggctcaaatagctgtatgccagtaattagggattaatttggttctgaaaatcatgcaaattctctttgtgaatttgtgcattaatgtaactttctatcaagtgattttcactagacggagataagatttggctacattcttaaggcaaataaacacagggacaagagccatgagaatgaagaagacttaatggatatcatcctcctttataatctatttggttcacattgctatggattttttttgtttattatttcattattttgtttattattttattattttgttcattattatttattatttttgctttgtggctcaggctggagtgcagtggtgtggtcagggctcactgcaatgttgacctccctggctctagagatcctcccacctcagcctcccaagtagctgggattacaggtgcatgccaccgtgccagctaatttttaaaaatattttgtacagatgaggtctcattatgttgcccaggctagtcttgaatgcctggactcaaataatccttccatcttggcctcccaaagtgttgagattacaggcatgagtcataaggcctggacatcacattgcttatgtttttatttcatgatcacaaaatagagcaagggtgcaatttccacaatctacaacttcattctctttctccttgccatcaccccacccatcccatctggaactgctgccaagaaggaaaagtcttcactggaatgcaagctccacaagctagaatttttgtctggtttaaacactgtattatctctacaacagtgctcagtacaaagcaggtcctcagcaaccatgtgttgaatgcattctaatactgatgattttcagaatggtttaggatttgtgacctctcctttctgagcctgagtagattaagtgtatcaaatttgattccctgtaatctactttggtttcctattttctaaaagcaatggagagggagagagatcattatggcagaccagacgggaggcagaactagatgattcagatggacagacagtgtgcggaggcttgcattgtgaattttagctccagattgactgcaagaacaagccagcaatcccaagaggacccacagaccctctgaaggaatctgactgctcctgtaggacccaggagacaccccaaatactcagccacagcaagaccccctcaaggagagtctgaactcagacaggcctagccctgacccaacctgatggtcctcccctacccaccctggtagctgaagacaaagggcatataatcttgggagatctagggccccacccaccatcggttcctctccgtactaccatagctgatgctctctggaaagcaccatctcttggcaggaggccaaccagcacaaaaatagagcattaaaccagcaaagctaagaaccctcacggagtccattgcactcccctgccacctccactggaacaggtgctggtatccacggctgagagacgcagagacagtttacatcacaggactctgtgcagacaacccccagtaccagcccggagccaggtggactcgctgagtggctagacccagaagagagacaactatcactgcagtttggctcacaggaagctacatccacaggaaaaaggggagagtactacatcaagggaacatattgtgggacaaaagaatctgaacaacagccttcagccctagaccttccctctgacagagcctacccaaatgagaaggaaccagaaaaccacctctggttacaaggctctttaacaccccccaaaaatcatactagttcaccagcaatgaatcgaaaccaagaagaaatccttgatttacctgaaaaagaattcaggaggttagttattaagctaattagggaggcaccagggaaagacaaagcccaatgcaaggaaatccgaaaaatgatacaagaagtgaagggaaaaatattcaaggaaagaaatagcttaaagaaaaaacaataagaaattcaggaaacattggagacacttatagaaatgcaaaatgctctggaaagtctcagcaatagaattaacaagtagaagaaggaaattcagaactcgaagacaaggtcttcgaattaacctaacccaacaaagagaaataaaaaagactaagaaaatatgaacaaagcttccaagaagtctgggattatgttaaataaccaaacctaagaataattggtgttcctgaggaagaagagaattctagaagcttggaaaacattttgggggaataatcgaggaaaacttccctcaccttgctagagacctagacatccaaatacaagaagcacaaagaacatctgggaaattcgtcacaaacagctcattgcctaagcacattgtcatcaggttatctaaagttaagacaaagtaaagaatcttaagagcggtgaaagagaagcaccaggtaacttacaaaggaaaatctatcagattaacagcagatttctcagcagaaaccctataagatagaagggactggggacctatcttcagcctcctcaaacaaaacaattatcagccaagaattttgtatccagcgaaactaagcatcatatatgaaggaaagatacagtctttctcagacaaacaattggtgagagacgtcgatataccaagccaccactacaagaactgctaaaagaagctctaaatcttgaaacaaatcctggaaacacatcaaaacagaaactctttaaagcataaatcacacaggacctataaaaccaaaaaacaagttaaaaggcaaaaacataaaacaaaaaatccaaggtgcacaggcaaaaaaatagcacaatgaatgcaacagtacctcacatctcaatactaacattgaatgtaaatggcctaaatgctccacgtaaaagatacagaacctcagaacggataagaactcaccagccaactacctgctgccttcaggagactaacctaacacataaggactcatattagcttaaagtaaagagcagggggaaaggcatttcatgcaaatagacaccaaatgtgagcagggtagctattcttatatctgacaaaacaaactttaaagcaacagcagttaaaagagacaaagagggacattatataacagtaaaaggccttgtgcaagaggaaaatatcacaatccaaaacatatatgtgcctatcactggagctcccaaatttataaaacaattactaatagacctaagaaatgagatagacagcaacaaaataatagtgggggacttcaatactccactgacagcacttgacaggtcatcaagaaagacagtcaacaaagaaacaatggatttaaacgataccttggaacaaatggacttaatagatatatacagaacatttcatccaacaaccacagaatacacattctattcaataactcatggaactttctccaagatagaccatatgataggccataagagtctcaatacatttaagaaaattgaaattatatcaaacactctctcagaccacagtggaataaaactggaaatcaactccaaaaggaaccttcgaaaccatacaaatacatggaaattaaataacctgtttctgaatgagcattgggtcaaaaacaaaatcaagatggaaattaaaaaattattcaaactgaacgacagtaatgacacaacctatcaaaacctctgggatatagcaaaggtggtgctaagagggaagatcataacaccaaatgcctgtatcaaaaagactgaaagagactaactgacattctaaggtcacacctcaaggaactaaagaaacaagaacaaaccatacccaaacccagcagaagaaaacaaaaataaccaagatcagagcagaactaaatgaaactgaaacacacaaaaaaatacaaaaggtaaatgaaacaaaaagctggttctttgaaaagataaataaaattaatagaccattagcaagattaaccaagaaaagaagaaagaaaatccaaacaacctcattaagaaacgatacaggagatattataactgataccactgaaatacaaaagatcattcaaggctactatgaacacctttacgtacataaactaaaaaacctagaagagatggataaattcctggaaaaatacaaccctcctagcttaaatcaggaaaaattagatgctctgaacagaccaataacaagcagtgagactgatatggtaattaaaaaattactgttcgtgactaccctgaccaacatggtgaaaccccatctctactaaaaatacaaatttagctgggtgtggtggtgcatgcctgtaatcccagctacttgggaggctgaggcaggagaatcgcttgaacccaggagatggaggttgcagtgagctgagttcgtaccattgcactctagcctgggcaacaagagcgaaactctgtctcaaaaaaaaaaaaaaaatttaccaacaaaaagtgcctgggaccagatggattcacagcagaattctaccagacattcaaggaagaatcggtaccaatccttttgacactattccacaagatagagaaagaaggaaccctccctaattcattctatgaagctagcgttaccctaataccaaaaccagaaaggacaaaaccaaaaaagaaaactacagaccaatatccttgatgaacatagatgctaaaatccttaacaaaatactagctaaccaaatccagcaacatatcaaaaagataatccaccacgattgagtgggtttcataccagggatgcagtgatgcaagtcagtaaatgtggtacaccacataaacagaattaaaacaaaaatcacactatcatctcaatagatgcagaaaaagcatttgacaaaatccagcatccctttatgattaaaactctcggcaaaactggcatatgaggtacatacctcaatgtaataaaagccatctacgacaagcccacagccaacataataccaaatgaggaaaagttgaaagcattttctctgagaactggaacaaggtaacaatgcccactctcaccactcctctacaacatagtactggaagtcctagccagagcagtcagacaagagaaagaaataaggggcatccaaatcagtaaagaggaagtcagactgtcactgtttgctgaccatatgctcatttacctcgaaaaccctaaaggttcctccagaaagctcctagaactagtaaaataactcagcaatgtttccggatacaagattaatgtacacaaatcagtagctcttctatacaacagcgaccaagcagagaatcaaatcaagaactcagcccctttttcaagggctgccaaaaaaataaaatacctaggaatatacctaaccaaggagtcaaaaaacctctacaaggaaaactacaaaacactgctgaaagagatcatagatgatacaaacaaatgtaaacacatcccatgctcatggataggtagaatcaatattgtgaaaatgaccacactgccaaaagcaatctacaaattcattgcaatccccatcaaaataccaccatcattcttcacaaaattagaaaaaacaattctaaaattcatatggagccaaacaagagcccacatacccaaagcaagtctaagcaaaaagaacaaatctggaggcatcacaccacctgattacaaactatactgtagggccatagtcaacaagccagcatggtactggtataaaaatggtacatagatcaatggaacaggatagagaacccagaaataaacccaaatacttacagcaaactggtcttcaagaaagcaaacaaaatcataaagtggggaaaggacacccttttcaacaaatggtgctgggataattggctagccacatgtaggggaatgaaactggatcctcatctctcaccttacataaaaatcaactcaagatggattaaggacttaaatctaatgcctgaaactataaaaattctagaagacaacattggaaaaaccattctagacattcttaggcaaggatttcatgaccaagaatccaaaagcaaatgcaataaaaacaaagataaatagttgagacttaattaaactaaagagcttttgcacagcaaaaggaacagtcagcagagtagacagacaatccacagagtgggacaaaatcttcacaatctgtacatctgacaaaggactaatatccagaatctacaatgaactcaaacaaatcagtaagaaaacacaatcgcatcaaaaagtgggctaaggacatgaatagacaattctcaaaataaggacaaacaaatggcccaacaaacaagaaaaaatgctccccagcactttgggaggccaaggtgggcggatcatgaggtcaggagatcgagaccatcctggctaacatggtgaaaccccgtctctactaaaaatgcaaaaaaattagctgggcgtcgtggtgggcacctgtagttccagctactcgggaggctgaggcaggagaatggcgtgaacctgggaggcggagcttgcagtgagcggagatcgcgccactgcactccagcctgggcaacagagcagcagatcaagaccccgtctcaaaaaaaataaaaaaaaaataaaaaataaatgctcaatatcactaatgatcagggaaatgcaaatcaaaaccgcaatgtgataccaccttactcctgcaagaatggccataataaaaaaatcaaaaaacagtagatgttggcgtgggtgcagtgatcagggaacacttctacactgctagtggggatgtaaactagtacatccccacctacatgtggaaaacagtgtggagattccttaaagaactaaaagtagaactaccatttgatccagcaatcccactactgggtatctacccagtggaaacggagtcattatacgacaaagatacttgcacaggcaggtttatagcagcacaattcacaattgcaaaatcgtggaaccaatgcaaatgcccatcaatcaatgagtgaataaagaaattgtggtgtatatatttgatgtaatactactcagccataaaaagaaatgaattaacggcatttgtagtgacctggatgagattggagactactattctaagtgaagcaactcagaaatggaaaaccaaacatcatatgttttcactgacatgtgggagctaagctatgaggatgcaaaggcataagaatgatacaatggactttagggacttggggtgaaagagtgggagggggtcgagggatagaagactacaaatggggtgcagtgtatactgcctgggtgatgggtgaaccaaaatctcacaaatcaccactgaagaacttactcacgtaaccaaatatcacttgtaccccaataccttatggaaaaataaaaaacagaaataaaaataaataaaaatggaaaaaaataaaagcaatgcaaattgctggttttaatttaaaaagcccagttggctttgagactcttgatatacgtcattgtcatccttatgcaatactcaaccaatagaagtggttctggaagttccaataagcatctatattttaatcctgagaaactgtgaggcatttgtgcctgcataggccaagtttttcatccattctactgaatcactctatttattgactccatgaatacagcaaattcatcatgtcactcagtattccctagttatataactcttccatgtaagaaatagcatcagcaacagcaacaaaaacagtaacatcactgacattttcattaaatatgagcactcaggaatgaacctgttgaattaaatgaatgcactattatctaagcttagtgcctcttggacaacatgtaaaattggactcttagcaagcaatacactctactatctaaattcaaatataattaacggttagttttcctcatatttcatatctctctaccttaacttcctgaattttacacctaactctatttatactcttttgttttattgctaaggtttgagacatggaaatggccaatttctccatattaaatgtagatctttttaaatatgtttttcacccacttaacaatctttttgaatgaccgttgttggtttggaagaccagatgatgtccacctcactgctaactccattttctttttacttctcttccctttgtcttttgctccttcttcccaggcatctacccacaaaatctcctgactcccttgttatttgtttcttcccgtcatatttgctatgtttatatcaacttaatgttgacagaggtatatgtactttagatatctttattaaggtatggtgctgtgacattctaactataaagtgttatctcagcatgaatgaaggcttatgaagagggagaaatgttcttcagatttttctttaaaaggcagtgcatttaggctgggatagaacactgatttccaaggatttctaacaatatgtgacatccagaaagtctattatcttacacaccaaatttcagtagccatctgggacgccaaattaccaatgaaacaaaagacacgacacagtagtaaggtgcacaggttttgtaattaaaaaaaaggaacatgatcatgattgattatatttgctcccaagatttatgtaactgaccaaataatttttttttctttcatggatcaaacagtatctttgatagacgctgtattgaaaacattattttaattttttattattaaaagaaaaaacctagatgttaattattcttcagtgattaaaaagatacagataatataaagttatggaggaaaaagatttaaaaagaaaaatgagaaaaaatggtaagctggagaaaatatgctctcaaaaatggaactctttgctaagagccacagatgcaataccttgaacctcaggagagctttaattagtccagctcttccttgagcgcatgctcagaagctttggtgctgactgtaaattagggcaaggaaatccagcaggggcctgggtgggttaagggggaagggcagaatcttaaaggggcaatgaccatttaaaggagcaatgcctgtcagccccaccgttcttgttgtaggctcctcaacctgccaccacaaacctaattcaacttctgtgttccctgtctcagttaatagcacctccactccccaagtctggctacaatgactaaacatgggagttgttcatgatttctcccttttttgcacctgcaaaatgtcaattttgctgatttttaccttaaatttgacttcatttttccattcctgttatcattgttctgttttaagccctcattgggtcctgtttgggccattacaataatgtctaactggtgttatatgcattttccgctgctgccaaatcatcttttaaaactcacatcactccgacttaaaacacttcagtggttcccatcacctgtaggaaaaagttccagccccttcctggtctctgtcaattcatcagacgtcatttcagattgcattttctgttctcacaatcatcaattacttctggcatatagatcccaatacaaggtaaataaacactgaatatgtagaagagtttttgacccacttaaaaacatatatttttagggagtaagacgaactaatctaatatctaattaacacttaatttgttaattgtatgtcatataaaatattaatttatatattttttcactcaaatgcatcatgatgtcaaagaaaaatcctcaaaagttaaaaacatgactctcttaccaatatagaattaatctatgtcaaagcttttattgccttcaataattgatgagggaaccagcaggatgataaactggttctaagagcatttgaagaaattattatttacacacaaaaaagaatgctagaacaggattgttagattagatacaaaacccgttaatgtcccacagggtaatgaaatcatagattatccttctaactgaagataatcacttacatctctaccacatactaaaaaaatctgtaagttgacaactcactgcacagtgcctgagctcttattaatagagtaaatagtaaagtcaaatgcaggagcattctcctacagcattaaataatcctgggggcagatctgttaaacaatgctccattactgcattaaaaaacacacccacggctgggcacagtggctcacgcctgtaatcccagcactttgggaggccgaggcaggcgcatcacctgaggtcaggagtttgagaccagcctggtcaacatggtctctactaaaaataaaaaattagccaggcatggtggcatgtgcctgtaatcccagctacttgggaggttgaggcatgagaatcgcttgaacctgggaggcggaggttgcagtgagccaagatggcaccactgcactccagcctgggtgacagaccgagactccatctcaagaaaacaaacaaacaaacaaacaaaaaaccacacccacctcttcttgctgtcttattatttccaagtttaggataattttgcttaacaatgaaagtaaaacttcacatgaatcttctacatcagtgtttttggcatcatgatcgtctcttcttgggtcaactaacaaagttttccagaacacaacatctttaggtccttctaagttttctcagatacagtacccttgggatcttgtgtacgtttttatccactttgaaaaggagatatatatcttatataatataaacactgtggaaaagtgcatagttctgtggatgttaaaaatgtaggaatagctatcaaaataataataatctgtagctcttcaaaaaagcaaaagagagaaaggcggtataaaaatagctttaacaatctaacagttggccataaaggaaaaagaagatgataaacagaaaacaaaataagttggtagaaataatttctgatataccgctcccaataaatacaaacggatttaactcatctattacaagacaaagatggccgggcgtggtggctcacgcctctaatcctagcactttgggaggccaaggcaggtggatcatgaggtcaggagattgagaccatcctggccaacatggtgaaaccccgtctctattaaaaatacaaacgttagctgagcgtggtggcgtgtgccagtaattccagctactcaggaggctgaggcaggagaatcacttgaaccagggagttggaggttgcagtaagccgagatcgtgccactgcactccagcctggtgacagagtgagactcggtctcaaaaaataaataaataaataaataaataaataaataaattaaataaataaataaataaaataaaaataaataaataaaataaataaaagatagacactatcaacctggatggaaaaaagaagtcctcctttcataaacatgctgctatggtctgaatgttagtgtctgtcttagtctatctgtgctactctgaccgaatatcactgacttggtcatttataaagaaaataaatttgtttattacagttctagaggctgggaagcctaagattaaggtgctagcaggtttgttgtctggtgagggctgcactgtccaaagaggaggaacattatatcctcacatggcagaaggtggaagggcaaacgggacaaattcccttgtcatgccattttataagggcacctaatcccatttatgagggcagaaccctcatgagtaatttacttcccaaaggccacacttcccaatactgttgcattggaaatgtctgaattctggagggaaacatattcaaaccatagcattctgcccctgccccctcacccaaattcatgtccttctcacacaaaaatacatttatttcatgtcaatagcccctaaaatcttagctcattccagcatcaactttataaagtctaaagtccagagatatgggaaccaatgcatggttcatcctgaggcaaattcctccccagctgtaaacttgtgaaatcaaacaagttatgtgctatcaaaacaatagtgtacaggcataggatagacactgctattccaaaagggagaaataggaaagaagaaaggggtaacaggtcctaagtaagtctaaaacccaacagggaaaccctgtctggttgctttgctagcagcagtccccacttcacttctcactggctagggtcactgcacacctcccaatactcttgcattgagaacatctgaattttggaggggaaacattcaaatgacagcagtgtccccctaaattagtgttggaacctaataccaaatgtgatagtattaaaaagtagggcccttgagaagtgattaaatcatgagggctccatcctcatgaatgggattaatgctcccataaaagactctggagagctctcttgtcctcctactgtaaagatgcgacaagaaggtgacatctttgaagcagaaagcagtccttcatcagacaccaaatctaccggtgccttgattttagactgcccagcctccagaactgtgagcaataaatttctgttgtttatgaattacccagtctaaggtattttgttataggagccaaaatagactaagacatatgccttaagcagaaagaaacttacaggatgaacataaaaagactatataagaataaaaagattacaaggaaaatacaaacaacagaaaaggtgatgcaacaatattgatatgagacaaagtaaaaaagaccaaaagcactaaaaagagctatttcatcacgataaaaaagattcaactagtacctttatgagcacacagagacaaaaagagaacttgataaactcaaaaatgatattaattttggaaaattttgatatattaaaaactgatacattcagcacagaaaaattaagtaataatatagactacttaaataaaattagatcaacaagtttgattaatagttagagaatcttgcacacaacaagtggagaatatatgttatttcaatacacgtggaacattgaaaaaaaaaaaaggctacgggctgggcatggtgacttacacctgtaatcccagcactctgagaggctgaggcgggtggatcacttgaggtcaggagtttgagatcaacttgtgcaacatggcaaaaccccatttctacaaaaaataaaaatgagccatggtggtgtctgcctatagttctacctacctgggaggctgaggtggaaggatcacctgagctggggagattaaggctgcagtgagatgtgatcaagccactgcactgcagcctgggtgacagagaaagatactgtcaaaaaaaaaaaaaaaagaataaaaagagaaaaatcacatattaggtcacaaaaaattaaaacaatttccaagatttaatataatctctgtctacaaagcatataaattataaacaacactaaaaagatggtaaaaaaaatagcaacctttaattggaaacaaaaaatgcactaaaaatagctcattggttaaagaagaaatgacaatgtcatgaaatatttaaaagtaaagacaacaaaagtaccacatgacaaaacttgtcggatggagcaaagtcctatagaaaggtaagtacaaccttaaatataattattttatttatttatttatttctgagacagagtcttgctctgttgcccaggttggagtgtaatggcacaatctcagctcactgcaacctccttctcccaggttcaagtgattctcctgcctcagcctcctgagtagctgggactataggcctgtgccaccacgtccggctaatttttgtatttttagtagagacggagtttcaccatgtttgccaggctggacttgaactcctaacctcaggtgatccaccagctttggcctcccaaagtgctgggattacaggcgtgagccactgagcccagccacacataattattcttcaaaaagaaatattaaaagcaaagaagctaaacttcaagtcatgtggctagtaaaagaattacaaagtaacaaaagtaaaaaaaaaaaaaggaaagaattcatataatcaatgaaataaaaaaattcacaaaactttttaaaaaataataaagtagacaaacctctggcaagactgataagattggaacaataaagatgaacactattcagaatgaaaaatgggacataaacagttagacccttatttttaaaaatcccaagaaaacaatatgaactagtttattccaaaaacaatttctaaactagataaaatagaaacatttctagaaaaaaagtggttcaagaagaaatgcaaagacatacgaatatatctagttatacacacctatttatctttacccattatctataaatctgtaataaagaggctccccctgcaaaacaagctaagtctagatggttgcaggagagttttaccaaacactcacactcatgttatgaaagcactataaaatcttactgccaaatctagacataagcatcaggaagaaaagaaaattataggcctagttcgctagtcacagatgtaaagtccctagacaaaacactagcaaattaaatttggcaataaatagcaatatcgtgagcaagtattaataggatttattccagtaaagttcaatatcaaaaaaactattaccataatgtacccgattatcagattcaagaagaaaaacaataggatcatgtcaataaatgcaaaaagcacttattaaacttcagcatttattaataatgaggattcgtaggaaacagccaaagaaggaaactttttaaactattaatagtacttatacagaaaacgtttccttaagtaagagagagaaaaaaatcttaagagtttatagagtttacagtttccaacccactgataaattcaattacagtgagcattcatttaattgctaaaaaaagaaagcagctgaccagtaaagcctagctaccaatacgctgcaacagacatcacaattaacggaaaattttggaagcataagaaggatactggcaggtcaaggacactagctggtcgccatttctattcaatgttaaactagaagtcatggtctagacaatggaatactatgcagctgttaaaaagacaacacataataaacaaaaaggcaaatgaggttaggaggtggaggcatgaggggactaacgcaggtgtccagcgtcccttggccctgccacgctttttttttttaatttccacctgacaaactgccgtttatcctttaaataccttggcagccatcacatcctgccccttcgtcttttgcacttcctttgtacctcgtgcatacttctataagcaaatgtatccgacggttttacaagaatttgcttgcctaccagtgtacttaacccatggctagcacagaataggactggaaagaaatgctgcacagacagcacttttctctgaaggctctagggctccccaagcccccgcattaaactggtttgggcaaaacgacaggcattgctgagagccgccaggccgcccgccagctgcgggtcccctgtaggcagagccctgggtcacacgcggacgcggtcccgatgtttcttctcaggccctcagcccggcccacttcctctttcctcactttaaggcgcagacagcggtccctctcaaaacaaaacgtacaccaaaacaccattttttttttaaacaggaagtccagaggcccgggtccagggcatccagccccggatctcgaacgccctcctcgcccctcgccccgcgtagcccggctgcgctccccgctccccgcccggcgtccacctctcgagcctgacagccccgccgcccgcgcaggcgccccgccccggcccggcccgccccggccccgccgccagcgcttccatccccgccccggcgggtccaagccggtgccgggcgcccaggggttgccgcgctgggcgggagggcagcgcctgagagggcggtggggtggcggggttcctgcgcgcggcccgccatggaggtggaggaggcgttccaggcggtgggggagatgggcatctaccagatgtacttgtgcttcctgctggccgtgctgctgcaggtaagtccccgcggccccgcagccgcatttccctcttcagggccgcccggcgcagggctaggcgtccgctcccagaccgccggggccggggccgaggccgaggctctgcaaacaccgaggtgtggcgagcgtcggggtggggcaggggcgaggcgccgcgcggtggcctgggcccggccggcagcgtcaaggtcgccggccggcctcagagcctcttgggttctgctgggccctccaccccgccaccttgagtggtggaaggagcgtgttgggggaggtttctcagccgctatgctggttaaggagggatgcaaaattgtgttacctgccctacgctgttgcctataacacgctgcaaatatgaagggaattgttaccctacctgtggcactgtcaccttggaatctaggacacagtcttgataatctgcagacaaaaggttgtgtctaggatcgcctccctctgcgccgggtgtcctctgcctcttttcctgggcttgagggggcttactcttctaggggctttcaaagcataggatttatttccctctggtttaagttctgctggctcattcggccctgcgccagccttgggctgagactcccgtgagccgaatagtgccatctaccatgtgtggttatcaaatggaatcacttcttcattataaagaattctcagaacctacttgtacaccccagcctcaaaatatcgattccatatgcgaaaggtcactacagattaactgcgccaggcaaggattagtccttcaccaacttaaatggctcatttgacattagtcgcttctctcaatatgccagaggcatttcattcacaaatcctttcttagtatttgctgtgagccagccattttactctttccttcagtcatcaggtttaatacgggctaggatgtgctgaacatagggatgccatggtggacaaatcattgactgccctcaggagcttgcattccagtggctgcgggtggggcaggcagacagttaagtaatttagttagcatgtgatgatagttattctgcaggaagtacagagtggtcatggatatagccaccagtccacaagttgcttaaagcttgcataagacagtggctcaacaggaagatgggggaaggtaggggttgacttattgattaaaatgtttggaagttcagttgatttcatcatcagccagaaacggttcaaatgatggagtcagttctttttctagccgaacagttctcagctcacgaatatgtggtattctgaagttcttttaagctcgttgttttagctttaaacaagctttccccagggagaaaaaacgttcaagctaaatgataagagtatttaataccgagaaagaagaattgcaaccatgatgcctgatctttatttataacagtttctttgagaaaaccctttttttctgttccagccatgaattccaggaacatacatcctttcttgaacaatcccagctccccatccctctatccctacccttcacttcctgttatcattttcttatttgcctagccaagtatccactaacttggagtaagtttgtcttcagtagagtgaggttctaaaaaggccagtgttctcggtttaggacctgttaagtttctctaacttacttttatttatggttgacccagttagttagagtttgctatcaaaaagttccaagcccatgcctatgaccgttcactaaaccttggatgatttatggtcagtatttgcggtacaaggaccaggtcttagagtgttggggatgagtgactgattgtttatcttatagatgtgggtgggaagatgccctgtagctgtgcttataccagtggaggagatgccagcctaggcaaaagtgaatccttcacatgctacgtgtttttaaggactcagttaccccattgagatacatgatccagggggttgtagagccacccagagctaccctgggtatgagagtggatatccccaaagacctctctaccaagtctgttgttggagatgttttgtattacggcagctggtctgtggagtgggagtactgtggagtcccattgctcagttgtatcacaggtgatttcatcattcttggggatgaggttttgcttcccccagcagagtaagaagccctttttacacagttgccttaaatgaaagggggtttttctgcttttaaaatcaaaggagttttcgtaccattgcccaaggaaggggcagaccaacaacacagcaacaaggccagagagagggagcctctgcttcagtgggagccttctccccatctgcgatttgataatgattaaccccagctgagaggcacaaaaccagaaggacagaggtggaaattttacaggccttttaacattttccttcttctgggaccattattattatttttaaaaatgattttccctttaccccaaacacatctatgttcaaactaagaggacaaaaccacatagcaaagccaattctaaagggtttttggttaactgttttcttgaattattggtaccatcatgtagatcatcaaaagttacttcactatccagtttcctttggctaggagacttgccctcatactccttgcaaacacaatttttggaatctcaatagcattcaactttgagataactaaagaacagatgcagattttgcagatttttcctcagcgtaagatgcaaatgccctgaaaatggtgatatgtggtattaatgtacataaacaaaaagtgaagggaaaaagattgcctatgtaaaaatggttgacttatgaataaacaataagctttacagttagaaacattcttaccatcaaaatgtacttgctctccctaggatcagagctatctgcgatatttaaataggaataattctatttagcatattactgtttctcttctgatggtgattccgagttgctgccatcgtcactattttgtgtttgtgtatgtgtttgcttgttgtctaggctctctggaggaggagggttggaatacaattcattgtttcttgattcctttagacatgcaatgaaaatggacgttacttctttgttctaagccagaggctcctgctttgtcattttcctcaaaatcatgaatcgtacattatattataatttgcacagaatttaaagcccccatttactatcaggaacatgtaatctataacaagcattcaccagcaaaattgtgatgctgtgctatgaatctcatcttagattctggtgttcaggaatgcattatttttatatatatattaagtatatatatatacttaataaccttattttttagatcctggaatgaccagtgcattaatattatccatgcaataaatagcttttctcagcattttagaaagtagaatgattgcagaagaggaaactgtaatagtcaacacacgaaaagatgttttaacttcagtggtcatctgggacaggcatattaaaatggatatgaaataccatttcacacttgctatattagcaaacattaaacaatctaacagtacaagtgtgatgaaatgataaatagaaactataccccatttagagaacaatttggcaccatctagtagaattaaaacctagcattgaactcctaggtacacatcccacattgtcccttgagcacgtgcatagggagatatgtgtaagatgtttactgcaacactgtctattataacaaaagttagaaccacctgactttcaaaacaagactggataagatgtggtataaatttaatagaatacaacgtctgaaataaatgaactagatctatatatgactatatggaggaatttctaaaacacaatgttaagtgaaaaaaaagcagaacagtgtatactatgtgacacatattcttaatacaaattttaaaaacacacaaaccaatgctatatttgtttcataaatatatataaacagtatagaaatataagaacatggagtagaaagatccacacccaattcatgagattggttgcctcttgggaaggaagggaaggggtgggcttaggggagggtacaaaggagattgcatctgttatcatttgttaattgtgatagtagtttcatgaatcttattttttgcttttccatattaaatatttttaagtgaaaagatggtaaagggaagaagatatgcatatctaagagagaatactatagtttgctgtatgagaataatggttcattcttttttaaaaatcaatattcctttgatcaattatggctgtgaattgtggtcctttaaacacaggagggtggggtagagtgagttttattcagcctgttttgttaaacttcatgtagaatgctatcacagcttaccttccctatctgcttatacgtggcaccatgtccctccacaggaaattcttaggtctgatgagatatggctgagatcatagctggttcttctaacctccctggcataagcaagtgatgaagttcacaccataagcattagtgaagctcttgttcagttataaaagactaactgtcatccccaggatgttctcaccatcactgaggcttcagccatgatgagaacctatggtcttactaagaccctttcatgagtccaaaacatgtggccatttaccagggctctctgtcagtttgagcaagttttatgcagctcctactgtcaaattttatttcaattagccctcacacagtggcctggaggttgggtctcctgagggtttatggtgatctgggaacttttgcctttcaccagtttaggtgggtggggcaaagagacaaacacagtggtttggtcaaagaaaccaaacccacactggcccccacaccctcaggaaaactgttgttgtccatagacagacactgccccctagtgtaaagcagataaagttgttgatctattagacagattttcctccagggaggctgtagagatacaggaggcctccagaagggttaaggagctcctttgagcctggatgtctcaagaattaggacattccatggaaagcaactagactgatacctctgcagcacccaaacccccagccgaatgccttccaaggccatccctggctgtttgacttgtgccttgacagtgaaggtattatcttccaagatagcacaaaaatagtcattaaagtcacgaggacaggcaatgtgaatatggcagaaagaacactaggcttgaatgttgtgctactctgctgcaagatggcattattaggcaattgttattaggcaaatgacccatcagtctctactgtgcacttggaaatggctggatcacgaaagtttaatttgttttgcaagtttaggatttctcagagtttcccaatgcccaacaattaattggccttggggcagtgttgaccctaggtttcagaataccagcttggttcataaccacaattagaggttgccttagaagaaaaagactctcaaatccaaagatgcacacagctcgggactctcctctctgacttctttgaccaaacactcatgcaaattgatatctgccttcatgggacatcatatagtactcaacaaatggcatatggtgattgtagaaaaaagagaaaatatagaaattaatacaaatcactagtgattctaccaccctaaagtaaagcatgctcacattttggtgtatagccttccagactctttattatataaatattgtatatccatcttttttgcagaaatgtgtatcataactgcattttgtctctcagcaatgttgtgaatgcgttgctatgcatgtaaaggaacaactacatattttttagtggctgtagcatggtatttcaatatatggccatagtataatttgctattcagttctcttgtgttgcatatgttatgcttcctctttttcaagttcacaaacccacgcagcccatggtattggttctttcttctgttctgacctttacttcttgccagttgattgtttatcagtcttctcaagcccagacttctcctgattccattcatatagttctacctagatgctttttgtcccaacttcatggataaaatagaggttagctggtgtaaattttctaaacatcgtttccttttacttcaaaagtttttttcatcctcacctatcttaaataccttctctgttagggaacatgtccaagaggaagacatgtttctgccctcttgctagggatatcttttcacttttgtttttgattctatgtaatccatcagttatttctaatcctatctctttctgcattctctgcagaatagcctgcatggtagatatatggaaattgtattaaatagcattaactcttaataagtgatagagttatgcccttctggagccttctttagttgtgtttatctaaggagaaagtctcatttggtgttagcacttctaaaaacatttccaaatatttctgttttaacaaagggaatgagctagcatgaaagaattagaggagcttcagtagaaaacattatctagttggaacttaatattattctgttttattgtatttattcattttcttttaaaacttcttttaaaattatgagacatttctgatggaaaaatacagagagtaatatgacaaacgcacatgtacttgcttccagatttaataaatgcagatattttgccttatttgtttaatgttgtgtcagtcatagttctactggagaagcaggacccctaggatggagatgtgtgtgtgtgtgtgcacgcgcacatgtgtgtgtatgtgtgtttatgtaagattatatatgtataatcgatgcatcattcattatggagatttgactgtatactgttgcgggagctcgttcagcaggccctgtaaggctgttgtcttcgtgtgtgatgttggagcttgaagtctgcaggacaggcagtcgagaagggaagatatgatctggagcccatcagaagtgactggaatctgtgtcattctccctgcctccaaccttgatgaagtggctgcctttcatcatagaattaaacatgtacctgggcaaggagtcagagcagctgaaggaggatccatgggaaggtggagtggttgcagcctcgtgactgtgccacgccaatgaggtggaccagcacataagtggtaagctatgtgaggcactaaggcacctgccccaacctgggcataaaatgcaaaaacagctgctctttcactttcacccctctcccaaatctagcctgaaaatgtctcctgtggcccaccttaaataaaaacatactagctaacacttggcattctaacattgtgcatatttttgtagttccacctgccaagtgatgtctgaattgatataaaattctattttatgttaatttactaaaattaaaacatttgaattgattttaaagaagactattgagtaaatactagcagacagaaaatgggcatgtgaaaactagcaaggggtactcagatgactgaagttagggaaaagctgagctagccatataattcttcccagttatgtaaagatatattctttactttcctgactctgattgggctattgctttaccaaataatttcttttcctgagttttgttttcattaactccttagcagcctttactacctgctcaagtatcatattaacaaccttttcctgattctcctaggtggaattcacatctccattctttgtgctctcatgaacttcattcccagtatggctaatatagcattcatcacaatccaccttgtatttacagctttggatatacagtcatgccccacataacaatgtttctgtcaataatcacatatgcgacactgggcccataagatcataatggagctgaaaaattcctattgcctagtatttcctgtgctatatttttaattgttattttagagtgtactccttctacttgcaaaaaaaagttaactgtaaaccagcctcaggcagattcttcgggagacagtccagaagaaggcatggtgtgataggagatgagggttccatgtcttcaggatgttgttttcctgaagaccttccattgggacaagatgtggaggcagagacagtggtattgatcctgactctgtgtaggtctaggctaatgtgtgtgtgtcttaggttttaacaaataagttcaaaaaatttttaaaaatagaaaaaagcttatagaataaggatataaagaaagaaaatatttttgtacagctatataatgtgtttgtgtttttagctctgttactacaaaagagtcaaagagttaaaacattttaagtttaaaaagtagaaaagctacagtaagtttaattattattggagaaataattaaaaaaataaatttagcctaactgtacattgtttacaaagtctactgtagtgtcctaggccttcacatccattcactcctcattcagtgactcacgcagggcaacttccagtcccgcaggctccgttcatggtaagtgtcctttacaggtgtaccatttaaaaaatcttttattgtatattttctatgttaggtatgtttagaaatacagatactcaccattgtgttgtagttaccaacaatattcagtatagtaacatgccttacagatttgtagcctaggaggaataggctatgccatatagcctaggtgtatgggaggttatagatctaggtttgtgtaagtgcactctgacgtttgcacaatgatggactcgcctaaggacacatttctcagaacgtttcccagttgttgagtgatgcatgacatatgactgtttgttgtcctcatttgaatgcatgtgccttgaaggaaaagactactttttatccattttatcatctgaggtgcataatataatgtgttgcaaagttttggtgcttgttacaattttgttttttttttaaaattaaaccattgaagaagaagggatggtcagctggtggtgttaccattttacttgaaaaagagagagaaggccgggcgcggtggctcatgcctgtaatcccagcactttggcaggccgagacaggtggatcacaatgtcaggagttcaagaccagcctggccaagatggtgaaaccctgtctctactaaaaatacaaaaattagctgggtgtggtggcgggtgcctgtaatcccagctactcgggaggctgaggcagagaattgcttgaacccgggaggcagaggttacagtgagctgagatcgcgccactgtactccagcctgcgtgacagagcgagactccatctcaaaaaaaaaaaaaaaaaagagagagaaacagatgcgattaaatactttgttcagaattttttttaaatttatttttaaatcgaggtggagtctcactatgttgcccaggctggtcttgaactcctggactcaagtgatcctcctgccttggctccctaaaatgctgggattataggcatgagccaccacacctggcctagtcttaattagtgattggagcaaaaattagctaacagagttactagtttttttttcatctttttttttggttataccattatgcaaggagttagttaaaaaatgtatttgatagactatacatatttgatatatatatgagatagacttttatgtatatagcagtgtgttgggttctttagagggaaatagcagtataaattagggtttctttccttcaggaggtgacaaatcattgaaaattagagttgaactattatctacacattatataatgatacaaagcaatatttcccccgtaaataatacagccaactaatgctttggaaattaagaagggagacggtgtggtctagagtgatttgttgaagccgtcagagagatatctgagcttgagctgaactttgaagcttggatttagggagaaatgggaaggtcatttcaggtagaaaaacataaaactggaataagtgtggaagagggaataacttatgcccttgctacacagagtatggttgttggttgttgcagcttattggaaatgcagactcttacccccaccccagacttagggagtcacattaaatttgggaagcactaatatatgctatttgtacagtgctatgcaattcactgttgactatggaggaatcccacttgacactgaagatgggttaatatgatattaatgacttggataaagatgtaccattagcgtctggtcttaactggaagaaaacgaaacagagaggtttggatttgctcaaggtttaattagagctgaggttcagacttggataacagattccactgctttcacaccacacagtgaataagtcatgttaggggaattgaataggctggtagaggaagcttgaatgcagattagttagcacctggaccatgtggtggaggatctggaatgctagaaaacttatcatttatccattaatacgttttgactggaagagtttcatgaggagtttcagggagattgatctggtgtcataatgtagatagatttttttttttttttttttgagacggagtcttgctctgtcacccaggctggagtgcagtggcgcaatctcggctcactgcaagctccgcctcccgggttcacgccattctcctgcctcagcctccccagcagctgggactacaggcgcctgccaccacgcccagctaatttttgtatttttattagagatggggtttctctgtgttagccaggatggtctcgatctcctgaccttgtgatctgcctgcctcggcctcccaaagtgctgggattactggcatgagtccagccaatgtagatagattaaaatgaggaagaaacagtatttagaggcaccagttactccgggtgtgttagtgtgtctcaaattttacacaaaaaaaaatagctagtattagtaagtcaaccaacaaatatttattgaatacccactttgtgctggacactgggcatataatcctgtcttcatgattatggtcttgcttatgtaatgcttttgattgagtcaattaggtaactgagtactaaatgcataaaaaaactaaaggtaatggcaacaataaaataatctttgattcctcccctccctttattttctccgaaaaaagctctggccccaaagttaagtggttctcgttctcatcctggttttgcaattagtgttttatataacattgaacaatttacttaatcgttctgtatctcatttttcctacttaaaaaaataaacattgtactgaaccatgacttcacagcacaaggtattgtgatgagataatttataggagacttttttggtttcctgagaagtattataagagctcttaatggtgttaatatgaaattactttaaaaaccttcacttcttgaaactttaaaaatttcaatcccctagtgcattttagtcatttttctaattataattacattgaaagggggaaaaaaatccagccatctgtggcacttgttctccttccctagaggtagagctagagaagataatgatttatttgagatgttgttattcccactctggtagacaatggatagtggttgctgtttgtggctttaaggcccatctgctgatgggtgcaattttattaggcaaaaatatgtgggtgaatgtgtgcatggtagttgtagataacagtggagagaagaacgagcgaatatttttgttttttgggggggaaaggaatactatgtgagctgtgtgaatttgtcacagccaaagatagcaaaccaaagagaaccacccccatattctatgtgtaggtgattcttccccatggctagttaatgctaagccatctttgactttctatgaccatatgacccttgtgtaagtgactgcagaatagaggatctattttttggggggggactctctctgtcacccaggctggagtgcagtggtgcaatctcagctcgttgcaacctccgtctcctgggttcaagcagttcttctgcctcagcctcccaagtagctgggattacaggcatgtgccaccatgcccagctaatttttttttttttttttgtatttttagtagagacagggtttcaccatgttggtcaggctggtcttgaactcctgacctcaaatgatccacccaccttggcctcccaaagtcctgggattacaggtgtgagccactgcaccgggctgaggacctagtattaatctgaatgcagtgtttaagcattgcctctctgagctaatttctcatagtacccctttcatagcatttatgaaacagtatcattactgcttgcctcttctggctcccttatggttagcaaaagtaagcatgactatgggtattggaggagacaaaaaggctaacaccgttttattgaggctggcactgcatagaagagttgcaagtttctgactcttctggtggcataaagctgtggacctgtgtgttctgtgagggccttggatgtgtgtgtgtgtgtgtgtttgtgtgggtgtgtgtgcatgtgcaggaggtgggtgaggaagacattgtgaagagtgggaggagaacagagaagatgagaaaagtggaaagtgcttattctgcctgcaggttgctagaaagaaaactggttaatactgattaatacagataatactgattaggtagatttcactattccctacattatgaataagggtatatagcaacatcactttatttttgagttgttttctccaaactggctttattgagaatggtgtccttcataatggaccatgcctcagattagaggaccctttggagcatttcttcttttatctgtaaggttgcttatcctagaacaatccagataaaaatatgatatgttggccaggcacagtggctcatgcctgtaatcccagcattttgggaggccgaggcaggtggatcactggagatcaggagttcaagaccagcctggccaacatggtgaaacctcgtctctactaaaaatacaaaaattagctggatgcattggcaggtacctgtaatcccagctactcgggaggccgaggcatgagaattgcttgaatccgggaggcagaggttgcagtgagccaagatcgcaccattgtactccagcctgggtgacaagagtgaaactcagtctcaaaaaaaaaaaaatgatatgttaacatatattcaaaagaaactttgaatagtgcctcgcacatagttagcattataaaggcatgtgctattattggtattccatcctggtcatttattcattcacatgttgagtgtgtaggccctgggttatttgctttggaagctcaaaggtgaatcagacttagatcctgcctttaaggagagtatatttcaatagaacaaaataaaataagcaaatacataaatataatacagtgaaggaaatggttcatgctctcaaaagtctagatggagctttaggagtgagcagcaagaaacaggagaggacttctggagggcttggagacacaagcaagacagtaaggaagtcttcatggaggaggtgatatctgtgttgcgtcttggaggatggggaaagctcaaacatttgcagcaggagaaagtgccttccaggcgaagcgaatggtatgaataaaggtaggaaagggtacatttagaaaacatgacgagtttgctttgcctaattgaaggctgtgcattcactagaacgtgtgtttcgagtcctctcctcccgagttcccttgccccatgtttttcattgctttatacccatcaattaaatttcagcagagtataataatcaggggcagttactaaatgggtgtaagtggctttgtaattatagctgctgctaaatgtgtaatctatctgttcttataattagtaaggtttttatttttataagctgattacctcctattcgaaaacttctgtaacagtatgcaaataggagccaggaaacatataagtctaggagcttactttcccttgccctgtataataaatcacccagcatcctgacccatggcagctttgtacctctccagagaggcccaccattgatggactcaaagtagattgagaatgccttagatcctctcagccttacccagaatggaaacatcacatctgtttttttgttttttgttttttgatacggagtcttgctctgtcacccaggctggagtgcagtggcgtgatctcagctcaccgcaacttccacctgctgggttcaagcgattctcctgtctgagcctcccgagtagctggaattacaggtgcccaccaccacacccggaaaatttgtgtatttttggtagagatggggtttcaccatgttggccaggctggtctcaaactcctgacctcaagtgatccacctgcctcggcctcccaaagtgctgggactgcaggagcgatgattaaaggtattttaagacatcaagttctaagttaatagggatagtttatttagattgtcttactctggagcagactaattatgtgttttcttaataaatgttaaacttgaaataatcgtccaacaatgggagttaatactaaaaatccatagcacaaaaagattgcaatagggcttgacttataaacccaatttcaagtagctgtaaagcccagaacaatcagtgacaaatggcatatatgtttaataaatatttcttgaatgaatgtgtgaagtatatttcttgaatgaatgcgtgaagtatattttctttgcagggggacaactatggttagatcaaaccaagactaggtacaactcagggttacaaaatgaatatctatagctgggactttgaatttcttaaaatcttattatgaactgtatatcatattttaaaatagtgcctactctagtacatattatgcttacctgctttagtaaaacaatacaatatatattgttttctgagacaattatactacagaaagtctcttgtttagatcatgaatccaaggtcaagatgctcctagccccctagtgaatgcttatctgacctgaagatatagtgttgaagagataatagctggaatgttactcttttaaatcagagcaaataatgttttccctgcccttctacttttgaaccatataagcatataagcatataagcagtgtctttagcatcagaaatatctcaaagaaagaaaaacctctgaaaaagtataaagtgttttacaagtgggattgccaatgattctgttcgtggtagatcacaaaggttctttttcatgtttttttcctttgtttctgatgtggcttatatctgtagctcataaaaatacaaaagcaagacactgatctttcaaggtttgcaagcctgctaagtgtcttcaacattgatggcaaatatctgcagtgtttggttctgtgtgtttgctctttcagctctacgtggccacggaggccatcctcattgcactggttggggccacgccatcctaccactgggacctggcagagctcctgccaaatcagagccacggtaaccagtcagctggtgaagaccaggcctttggggactggctcctgacagccaacggcagtgagatccataagcacgtgcatttcagcagcagcttcacctccatcgcctcggaggtaacaacaggctgtttcaatcactaaataaatgtctctctttgtccacatagagctactctttttgtcttgctgatttaaatatcagccacattttcaaataactttctagtaaatttaaaagttaaaggttttaatgtatcaaaggagaacattctatgagaacacattccttttcctcttactacacgtgggagaagcttgaatctttccaaactagttagatgaaaagatacaaactccaaaagaacagtatgttgattatgatgtccttttaaaaagtgaattaaaactttaatctctctttattaaatatgcaaaaattaacacagggaaatgtaacgattcatatataacacccatagttctttttttcttttctttttttttttttttgagacggagtcttgctttgttgcccaagctggagtgcagtggcgcaatctcggctcactgcaacctctgcctcccgggttcaagcaattttcctgcctcagcctcccgagtagctgagattacaggcacccaccaccatgcctggctaatttttttttgtagttttaatagagacgggatttcaccatgttgaccaggctgctcttggactcctgactcaggtgatccacccacctcggcctcccaaagtgctgggattacaggcatgagccaccgcgcctggcctatagttcatttttaagtcaagtcctgtgtgtagaccatatggggcaccttgactatacaatgtaaaagacagtaccacttagtatggtcaggaagccttactttcaagggggctttgctggccagagagaagtttctggtccttctgagccagccagaggtaaagaatctgagggtagatggtctggtgaagagaaaccctggatgggggcagatctcatggtcagctggaaggcactggtgttggttgttaaaatgtagaaatactctcctttcctttgcctgctcctctgaagctacccatgtgtctgttgacactgttgacaccctggccccatccttggaccctgtgatccagttaatggggtaaatgggtggtacaacagggggcctctgggacccttgccagctctcacttctggttgccatgctagttagctctcccaaaattccttaaccactccttcctggaagccactctcctgtgtgtgtgagtgtgtgagagtgtgtgtgtgtgtgtgtgtgtgtgtgtgtctgtctgtctgtctgtctgtatatatgtctgcaccatggcctagccagccttacctgttgctgactattttgataatcctgctttggatgaggcatactaaaaaaaggggagacatgccaaggatgatgttttcttggccttttcttaggagtcctccgtggagtgccccactcctaaaagttactatactaactttttgagggaccaccaaagcagcatttctgattgcaattcctgacgttactcttcacttagaaacctccaatgattctcccacagcacacagaacacagtagagaccctatgagttacattcaggacctctcacacttcgtagcttggtccaggtgtacttttccagccccactctgcactttaccctgctctcacccctatggaaatatttactatttcccacacatgacccaagctctcagcataacctattattgtcaggaaagccctcaccgcttgccctggcttccacctggtgaaatccttatctaccctctaaggctcactttcagtgtcaccttccccgtgagtcttcccagccaactccccaggagaaaatacgcttttgttcctgttccagtactaatttatttgcacgtatgttacagactgttgtttgtggttcagctctaaaagttctttgaggtcagaaaccatgttttggtcatctttgtatttccgtggcctatagcaaccaccagccccaccaccaccaccaccaccactaccaccaccattgctaccactcctaacctatgaaaataacaaacagctttgtttaatgattatgatatgccagggattgtgatatatgtaaaatttaattatcaaagtaattctatgaggtaggaatcatttcccccattttacagatttaaaaaatggagaccccttgaggtcagtgttagctaataatggcagagctgagatttgaagctaaatttgtcttaactcagaagcctgtgctcttaattattgtgctttttaggaatatatccaatccaaattggcatatatatctcttaggttctttttggtgagtaattatagccaaatactttttaaaaccttttttatttggaaataatttcaaatgaaagaaattgcgagaatagtacaaagaatccccttatctcttttagtttcatctattgttactagtttgcctcattagcattattattgtctctctgttttttcctaagccatttgaaagttgcatatattagtgctcttttatgcccagatacttcagcgtgtatttactaaaaacaaggatgttctcttcataaccacaccacagttatcaatgtcaagaaattcaacattgatactatagttttatttaaactatacctagttgtatgccatccatacctaattttgtcacttaacccaataacatccttgatagcattgtattttcctctcatgtattgaatccaattcaggatcacacatgacatttagttgtcatagttctttagtatcttttgaccttcagcctttttttttcttttataacattgatatttttaagcatctataccttttctctttttcaaaataagaatgttcttcattttggatctgtctgatgattcctcattcggtttggttttgcatcccaagtcagaatagtacataaataatgtatccctctcagggtatcatatcaaaagacacactatatccatctgcccttagtggtgatgttaattttgattagccattccaggtattgtctgatattctcccctgtccctgtcagttactatctttctttcatttcgaggaatagaaaactatggggaatccctttcaggttatataaatttgctatttcttatcactgcaacctttgcctcctatgttcaagcaattcttctgcctcaccctcccaagtagctgggattacaggcacctgcaaccaatgcccactaatttttgtattttaatagagacagggtttcaccatgttggccaggctggtctcgaactcctgaccgcaggtgatctcccctccttagcctcccaaagtgctgggattataggtgtgagctactgtgcccagcccaaaatggttatttcttaactccagcacttccatcacatttactagcttgcatactttctactgtaaacaagagccctttctctcccttgtctgtctgtctgtctctgtctgcctatttgcctatatatttatcaaccatatgtacataatcttggattcctattcttttcaatgatttgtaatttattacagctctgaattattttggaactcaaatttttcctaatttaccagtgggaacctcttcaagctgcctcttgtgtccttttatttttaattaaaatttttattttgaaataattgtggatttgcatgcagttgcaagaaataatacagagaaattttgtgtactctttacctagtttcttccaatggggaaaaccatagtataatatcataactgagatattaacactgacactgctaagacacaaaacatttccatcaccacaaggatccttcatgttggccttttagagccacacccactttcctcccatcccttacccttttcttaatcgctagtaaccactgatctgccttcttatactatgagtctttcattttaaggatgttgtaaaaatggaatcatattgtagaagccttttgagattggctttttttattcagcataattatctgcagattcatctaggcttagttttattactgtagttatataagcagatttggaatgggatagattgccgctttattctttttcaaaagtattttagctatttcagttcctttgcctttccatataagttttagaataattttgtatatatctaccgaaaaatatttatgagattttgatagaagttgtgttaaacctgcatatcaatttggggagaatcaacgtctttactatgctgagtcttccaatacatcaacactatgtgttattttgagtgtctttgatttctttcatcaatgtttcatatctttactatgcaaaccctgaacatgtttttagattcattaggttttagattcattcattagattcacatctaaatatttctttttcttttttttttttgagggattataaatggtactgtattttaaatttctgtttctacatgtttattgctagtatagataaatattgtacaattcatttttatatgttaatcttgtatcctttgatcttaatcttgtattatttcttttgggaaattttaaaattatgaatttaatttctttaatagttatagcgtgattcaaatgatatattttgtattgtatgagttgtgtagcttgtgcttttcaaggagttagtccatttcatctaagttgtcgcttattaattctaggtgctttttgacgattctttgggattttcttgacagtcatataaaaagtaaggacagtttttttttttccatttccaatctgtatgccttttgttttaccttattcctctggctagcatgtctagcactgtgctgaataaaatggtaagagtggacatccttgccttgattctgatcttagaagggatacactccgtctttcaccattaagtgcagttttagctataggtttttatagatactctttatcaaatcgaggaagcctcccataattccaacattttttatgccaataccatgctgctttggttactatagctctgtagcataatttgaagtcaaataatgtgattgctccagttttgttgttgttgttgttgttgttgctcaggatggctttggctattctgggtctttggtggttccatataaattttagaatgatttttttctgtttctgtgaaggtgtcatcagtattttgatagagatagcattgaatctgtagattgctttgggtagaatggacattttaacaatattgattcttccaatccattaacatgaaatatcttgccatttttttgtgtccttttcaatttcttgcatcaatattttatagctttcactttggagatctttcacttctttagcgaggtttattttttagtattttattttatttgtagcttttgtaaatgggattactttcttgatttctctttcagattgttcactattagcatatagaaatgcccctgattttatatgttcattttgtatcctgcaagtttactgaatttgtttctattctaataattttttgatggagtctttagttttttttcagatcatatcatctgcaaacaagggtaatttgacttcttcctttccaatttggatactctttatttctttctcttgtctgattgctgtagctaggactaacagtactaagttgaaaaatggggtgaaaatagacatccttgtcttgttctagatcttagaggaaagactttgttttctgtgtccagtgtgatactagctgtgagtctgtcatatatggcttttattatgttgaggcatgttccttctatacccagtttttttgcagatttttatgaaggatgttgaattttatcaaatgctttttcagcatgaattgaaatgattgtatggtttttgttcttcattctgttgatatgatgtatcacatcaatttacatatgttgaaccatccttgcattcctgggatgaatcccacttgctcatgatggatgaccttttaatgtattgttgaatttggtttgctagtattttgttgagaatttttgcatcaatattcatcagatgtattggcctctaggttttcttttttttggtgtgtctttgtctggttttggtgtcagggtaatactggcctcgaaggatcattttggaagtagaatcagctctcttcctctattttttggagtactttgagtaggattggtattagttcttctttaaatgtttggtagaattcagcagtaaagccaatgggtctctggcatttcttttctgggagactttttattatgtctttgatctggttacttgttattgatctatttaggctttggagttcttcatggctcaatcttggaaagttgtatgtgtctaggaatttatgcatttcttctaggttttccaacttattggcatatagttgctcatagtagcctgtaatgatcctttgaatttctgttgtgtcagttttaatgtcccctttttcatctctgattttatttatttgggtcttctctctttttttcttagtttagctaaaggtttattggttttatcttttcaaaaaaacaacttttcattttgttgatcttgtgtacttttttaaaatttcaatttcatttatttcttctctcatctttattatttcttttcttctactaattttgggtttggtttgctcttgctttctaattctttaatctgcatcattaggttatttatttgaagtttttctactgttttgatgtagatgcttattgcagtaaactctcctcttattactgctgtattccatggattttggtatattgtatttctattttcatttgtttcaaggaatttttaaattttcttcttaatttcttctttgacccactggtcattcagaagcatattgtttcatttccttgtgtttgtatcgttttcaaagttccactagttactgatttctagttttgttccattgtgattggagaagatatttgaaatgattttaatatttttgaaatttttaagacttgttttgtggctaacatgtggtctatctttcagcatgatccatttgctgaggagaagaatggaagaatgcatattctgcagctattggatgaaatgttttgtaaatatttatttgatctataatgcaggtccatttggtctatagtgaagattaagtctaatgtttgttgatttttctccctggatgacctatctagtgctgaaagtgatgtgctgaagtctccagcaactattgtattggggtttatctctctttttagtcctaataatatttacttcatatatttgggtgctccagtgttgggtgcatatatatttttgttcttttttttttttttttctggagacagagtcttgctctgtcacccaggctggagtgcagtggcatgatctcagcttactgcaacctccacctcctgggttcaattcattctcatgcctcagcctcccgagtagctgggactaaaggtgtgtgctaccatgcccagctaattttctgtattttagtagtgatggtgtttcatggggttgcccaggctggtcttgaactcttgagctcaggcagtctgcctgcctccaccccgcaaagtgctaggattacaggcatgtaccatcacatctggcctatattcttaattcttatatccacttgctgaattgacccctttattattatataattatcttgtctctttttaaaatttttgtcttgaaatctattttgtctgatatacatatagctattcctgcccttttttggtttccgttggcatggaatatctttttccatccctttattttcagtctatgtgtatctttataggtgaagtgtgtttcttataggcaacagatcattgggtcttggtttttttatccattcagccattctgtatctttcgattggagtttagtccatttacattcaatgttattgttgataattaaggacttactactgcccttttgttatttgttttctggttgttttgtggttttctcttccttttttcttttttgtgaaaatgattttctctggtggtatattttaatttcttgctgaaatttttcgtgtatctgttgtaggttttgttattttatgttaccatgaagcttacaaatgacatcttataacccattattctaaactgatgacaatttaactctgcaaaaacaagcaaacaaagagaaaactaataaaaagtctacactttagcttcatccccttgctttttaactttttgttgtttctatttataacttcttatactgtctatttcttacaaagttgttctaattattatttttgattggttcgtctcttagtcttcctattcaagatatgcatagtttatacacgacaattacaatgttataatattctgtatttgtctgtgtacttaactataactagtgagttttgtatcttcatgtaatttcttttttttcctttttttttttttttttttttttgagatggagtctcactctgtcgcccaggctggagtgcagtggcttgatcccggctcactgcaaactctgccttccaggttccttcgattctcctgcctcaggctcccgagtagctgggactgcaggcacccgccaccatgcccagctaattttttgtatttttttagtagagacggggtttcactgtgttagccaggatggtcttgatctcctgacctcatgatctgcctgccttggcctcccaaagtgctgggattacaggcgtgagccaccatgcccggccgaccttcctgtaatttcttattgctcattaatgtccttttttttcagattgaagaactctctttagcatttcttgtaggacaggtctggtgttgacaaaatccctcagcttttgtctgagaatgtctttatttctcttttatgtttcaaggatacttttactggatatactagtctaggataaaagtctttttccttcagtagtttaaatatatcatatctttctctcctgatctgttaggtttccactgagaaatttgctatcagacatattggagctcctttatatgtaatttttttttcttttctcttgctgcttttagaaccatttctttatccttgacctttgagagtttgattattaaatgtcttgaagtagtcttatttgagttaaatgtgcttggtgttctataaccttcttgtactttactattgatatctttctctctaggtatggaaagttctgttattatctctttgaataaactttctgtcctgatgtctttctcttcttcctctttaagggaaataactctgtatttgctcttttgaaactgttttctagatcctgtaggcatgctttattattttttattcttttttcttttgattcctctgtgtattttcaatagcctgtctttaagcgctcattaattctttcttctgcttgatcagttctgctcttgagagattctggtgcgttcttcattttgtcagtcaaatttttcagctccagaatttctgcttgattccttttatttcaatctccttgttaaatttatctgacaggattctgaattccttctctgagttatcttggatttcactgagctttctcaaaacatctattttgaattctctctgaaaggtcacatatctctgtcactccagaattggtcactggtgccttatttagtttgtttgatgagatcatgtcttcctgaatggtctcgatgcctgtggatgttcgtcaatgcctgaacattgaagagttaggtacttattctaatctttgcagtctgggcttgtttgtacttgtctttcttgagaaggctttcaaaatattcaaaactaattgagtgttatgatctaagtttttggtcactgcagccataagtgcatgagatagcacctcaagcctagtagcactgtgactcttacaaactcgtagagatacaatggtggtcttggttaagatctgggagaatttcctggattaccaggcagagcctcttgttctcttcccttactgttttccaaacaaacagcatctctctccatgctgagctccctggagttaggggaaggatgacataagcactcttttggtcactaccactgggactgtactgggtcacacatgaagttggcatagtaccaggtcctgcccaaggcctgtgacaactatttcctggctattgctgatgtttattcaaggcccaaaggctctttagtcagtgggtgattactcctactaggacttgatcttttcccataagagcagcaggttcccttctggaccagggtgggtctggaaatgccatccaggcagtagggcctgagatcaggggctttaaaaatctgcttcatgctttattttactggggctgagctggtaccgagattgcaagacaaagtcccctttacttttccctctcctttcctcaagcagaaggagcctttgcccatggccaacactgccccaggcctgtggtaactattgcctggctaccactgatgtttattcaaggcccaggagctctttacttagcaagtggtgagctgacaggcatgggtcttttctttcaggggaatgggttcccttctgtcccaggatgggtttagaaattccatgtaggagccaaggcctgtaatcagggactttaagagttggcttggttctttattttactgtggctgagctggtacccaagttataaagtcctttttactcttccctctcctttcttctagcgaaggagtctctccccatggcaaccacagctgggaatgtgctggatcacacctgaagccaacataaaactgggtcttgtccaaggcttatggtgactgctgcctggctaccactggtatttattctattcaaggtctaagggctgtttaaccagcaggtggtaaattctggcaggattgggtccttcctttcagggcagcaggttcccttctggcccagggttggtctagaaatgtcatccaggagttatggcctagaatgggtgcattaggactctgcttggtgctttattttactgtggctgagctggtatgcaaattgcaagacaaagccctctttattcactcttccctcttttcctggagctgtgagctgtgctgcctgggattgcagaaggggcagtacaagcactcccttggctacccaagctggtgtcccactggatcatgtgcatcccaagtccactgactctgagcccagcccagcaccaggacttgcccagtaattgcagtctaggccacaagaactagtttattgaagaccctagagctctttagcttgcagtggtgggactagccagaactcaggttctgaccactgggatgggcgattcctctctggctagggctcatctaaatgctccttctgtgggcaccagctgaattctgccctgtgttgcttgtggtgtgaagggactcactgagttccaatgcaaagttccattatcactgtgctctctgcttcccaagcacacagattctctcttcctgtgccgtgtggtatttctgtgggttgggggaagggtagtgtcagcaattcaagactgtctttcctaccctcttaggtgcctctttccttgatgtgatgttaaaactaggtactgtgatcagtcctgatttgtggttcttaagaaggtccttttgaaactcacccaattgtcccaaagagctgatgtttatggtttcttttgaataaacatagaaattgacccttctattcttaaaactagagaaagttatatttgtcttattggagttccttcctcaggaaactgaaccttaggcctcccagatattatcaaggaactgaaactcagcagatcactgcatccagacagtgaaaggccagacccctcatttatcatgactgcttccttacctctccttaattcctgttttcctgcatgtagcttattacttccttgttatataagtcctcagttttagttggtcagagagacagatttgagactgatctcccatctctttggctgcagcacccaataaagccttcttccctggcaatacgtgttgtctcagtgattggttttctgtgtggcaagcagcaggacctagagcaagcccctggtgttttggtaatactttcttttgtggatagttgttcaatttggtgttcctgtggggaggatgactgctggagtgttctagtcggccatcttgctctttctcctccccattccaatatttttgagaatttttattatgaatgtatattgaattttgtcaaatactttttctacatcaattgcaatgactgtgtaatttttcttctttatcttgtaatatgatggattacagagattgtttttcaaatattgaaccagccttgcatctttgggtacatgcttctttttatatattactgatttctatttgctaacattttgataaggattaatgcctctatatttgtgaggagtattgctctgtagttttcttttttgatactatctttggttttggtatcgaagtagtactagctttataaaatgaattggaaagtgttcccttcttttatattttatggaagagattgtgtagagttggtattaattccttaagcctttgatagaattctccagtgaaattatctgtacctgtagatttccttttggggagttttaaaattatgaattcaattttctggggctattttgtcaaatgatctattttgtattggatgagttgtggttgtttgtacttttccaggaattggtccattttatctaagttgtcaaatctatgtgtgtagaattgttcatagtattaccttatcattgttttgatattttcagggtctgaaatgatttcccttcttttattacctggtattgggcatttgtgtctttttttcttatttaattacttctcagtcattatagagatttgtcaatattactgatctttttaaagaatgagcattttgtttgattgatttttctctatcgtttttctgttttgaattttattggtttctgttctttagtggaaggaataaggaaaagcatgcctacttagtcttcttggaagtgggatccctcttgtgtccttttgacatgcctatcatttctgatatgcctatcagaaatttttggcataacaagatattccaagttcatcttgtacctctcacccctgaagcatgaaattagtcatttctccaaaaagccctggttttacttaggattgatctccataggattttgaaatgggtgagaactataggtctgctctccaataaatctattactacattataatgaaagcaaatcccagaccaaattctgccacatatacagtatatacatttattaactaaattcttgtaatcaaagtagcacataaaaaactgtcttgcaggcttgagaagtcctagctctttagtctcctagatgttttgaacactgattccatggtaggtcactataggtaaactccaattttccataggcagggtactgataccaccactcctactcccaacctccactcctcagccagcatcagggagaaagaagcttccagagtccatgttggctcaggaccaaggaggagttttagctgagagcataaccctgtaggtagagtacctacacattggattatctcacaaattcctgcaagggtggggagtacccctaatatattgacataatccatgtatcttgaatgccttcaatttcacagtgttagaccacttttggtattcattattactagtcaataggctgctattttaatcaagaataagcaaagcactcatttctgacaaccccttatagtagctcctgctggcgaatgggctctctgaagagaaggacagctgaccaccactggacaatgcaatcttgattagaatgcttgtggtaccagggtgacagcttgacctaagcaacatttatgtagaatatcccactgtatgtatcctaatctataattaggagcccttttagatatttccagagggataccattattaacaagtgttcactgagcaattgttacctgccttatgttagagaaggcttgctataaagagagagctcttagatcctgcactccaggacaacagggatgaggcaccctggtccccactgtatctcctatgctgacttctaggatctcacaataaacagtgcccgactgaaggtggaagacagaaggaagggtgaattagttaaagggaacccagggaactactactctcaagataaagagtgttagaaacaggagaaattgaatgaaatggcttccttggcaagtgctgaagatctttaaagcagctctgagaggaaaagaattaagggctgagacagccttcaccttgccacctgtgatagtagctacgtcttttccttcctgttacctaaatcttagcccactggggtgcatctaagaatcgctgtctcccttgccacctgtctttgtcaatctgtatctctgtgtcccctccctccctcctttccttctcttctccccaccttctgtccttattgctctttcttgtctctgtcattttgtttgtgtctgtttctgcttgttcccatgtctcttcatctcagtctgtctgtatttacctctctgtttctgtttctctttctctttctgtatccattgcattcactctctgtcttgcctttccctctgtctgtctttatcatttctgcctctgtgtgcctttctgtttctgtttctcaccctcgcttcctcaccctgtctccctccctcttcctgtgttattcatctgtcctctttctcattcccatcatgtgtagccactgagatgcgtagactgggatgtatatgttattatccaccttgattatagttattgataattatacgtttctaaatacttggtactttcttcccatgatatagaggtacacattatattcctcatcccaccagggtgtcaaaaaattatccaccctcagaggtttatttcaaggtacaaattacctgtgcaaatagtgaccctcagtctccagcaggtgctccaagatgtatccagaacaacatggggagcagggcatggactgtccctgctgcacagttagatgagatcctcatactgccaccccgtggcacctccaccctccctcagggctctttgggaactctggggtcatgatttgggatcaattatcttttaagcattccagatgctgaactggctgcttcagcctgagtgggttcatgatgctttgcaagggtggctgtggcctgcctacttgttggaggagtacagttggcatcactgacccacacaacaggacagaactccacaacctccatgggatcctcagctgtgacaagatcattccatactttgcactgagtttgtgggtaagaagataagtttatataaggtctggtaggtataggagagagggaagaggcagctaaccactttttaaaaatgcactctgggatgggagtctctctgccagaggccttccatagatgctatgtatttagtcctaccaacaaccccactctattagtgaaataacagatgaagagaatttaaagaattttccctaaatcatacacctaataagctgctagtctgggattcaatgagctcatattctttccacttcactagtgattttcaagcttttttaaaaaacaaaaaagaatagaagcctttagttttaaatggtatcttagttggcatttcagtatttagaagagctagatactttgctgttgtcattgcagaggagtagggtccagggcctcagcacctctgccaccgccagccatttgtggcagccccagaaacatgtccatgagaacagggtgaagatcgactctgcctgggccccttggctcactggcagtgaagggacaggaagagccaatgggagtatgccttggcggatttgagaacagttagcacagtgaccgtggggagatagtgtatggggcatgaaatatcaacctaaaggaagaaactgaggcacaaaatataattttaaagagtttctttgagccagggtgagcacagctgcccaggaaacacttcccggttactgtaggaagcgctcttttcaatctttgtggcaagtaatcttttaaaggcaaaaagaggaacaaggagtgggtggatacaagattgtttgttaggagttttcattagtttacataaataacattgatcagtaattggctttatattgttgaactatagagtaggggttatggtgtccagtgtgtagcattgttaggttaatgtatagctaccagtggcatcaatctagagtccacatagcaagcagcttcaagagatgatacttggctcaaggggagatggggacatgactgctgcttcattccagtgcctctctgggcccaataatttaggcagagctcacattcctcatataaaaagtttcatttcttccccaacacattaggctgaaagctaaataagatgctcgcagtcacctgcttgagagtgctttgggcagagtgaattctaggggagaagggaaagcaataatactagtctgctaattaaaaagggaagaagacatgggctcagagtagctgggtgacctcctcagtgccccacagttagtaaacaagcctggccactgtggcatgggcccagcagaaagaaggaggccaggcaggcagcccatctgtgagtggtgtcagcgtctgccttctacaaggtgatgtgacctggggcatgtgtgtcagactcatgaggagcctggccagtgttccacccccacaaaacccactcaagtacggtggaagtagtaatgattacattaagctttattgctggtcaagctcaaataaatgtacatgtttcctaacagaacaaaaaataacaaaggagaattaaatagaatgaacaatagttaagtctcatactctcagcagttcactgtattctcagagccccgcaaccacctgccccagtgacaacattcactatgtctctcctctctgaatagattcagggagacctaacaaaggcctcctctgtttcacatgtttaacacagaatctcttgtttttcctgaagtcctttatattgaggtaccaatgaagtgtctgtgctgtgtgctcccgtcccaccgttcagagtgtgaattatatgttagttcacgcactgtacttctgctttgtgctttagaggcctgtctgggtgctgttccaagtgctggtgtggtataggtagcttgaaagtttcctgctgctgctaacaaaatgataagaatcaaggagagacagcagcagaatggagaataatgtgaatggtgatcaaggggcagccaaggccagcagcaccaggcagcatgttggcatcagttacactttagccggtgttcttgaggaaccactagtctctgcactgtgttgagttcatccttattacaatgaagtgcagtgccaaactaaaacctccacttaatttcttagcattaagtcaatttcaatgacttcactagactctcacttgctcctgcaaatctctaaaggagtattgaaattggtacctaaacatgtcactaagttggtgaatatccttaatatataatctgtggtatataggtaatgtttggttcatattgaaataatcttgtttgaaatcaaagttaaaaaacaaatatgaagccctgttgacccgtcacataaaattttggaagataaatattaagagagattctacgaaactctatagtttaaagatactgtgttaaaaacacacatttttaacgtctaccctgcaccttattacacttgggtcaggccttgcagaagtttctttagaagagtttttgggaagggcaaataaaaggttaggtggatgtgattaacttggtatttaatgcaaaactctaatctaggagtcttgactattctaaaatgagctaatagctattggagcgaatttatgtagcaaattgctgtctgctgtattcagattattccctgagctctgactcattcagaaagcaccaaatatcacggagacacacaattatcatgcttaattaatgtttgcaaccaaaaagtgtaaggttggaattcttaatatcactgtggatattgaagagctgaaattgactgactgttatcttgagattaatatattttccccaagccataccctggggtcaaaagacagagtattaaaactatttgaaaaattcactgcaattaattgctttaggggctaattttttttaatgtcttgcttccttacgcctgtactactgactgttatagcctgcagacttcacccattaagtggtaattcagagtgacaactacattgaaatgaagcaagttagttaatcaccatgaaactgttcctgaaataccctgtccaagtactccctagtcacaggaggcctctgattacctgattttctcctgaagttagattttcatgtacaaagttgtaattatttttattttaaatacaggccaggggagggctgaagtttggttggaattgttatcagagccattcagaatttttcacaggagaccatagcgactctctgattgcgtagagccctcatggatgtgctgcagggatcctaggaagctgctattggcttcatccccgcagccttgaaatactgacaagctaggagtctgggtagggctgtggcagttataatatgacttggttttcatcaaagcatgacctccagcaacaagaggctcgatcaataggcacgggcccagtcttgtttgcccattttggttgacctgcttggacaaccagggtgacctgccctttgtcttcctttcctttatgattaggtgggctatgccctgaacagtcatgtggtgcgtcctcctttcagagaaggctgtgttgggactagtgaactatgtgggtccctgaaaaagtctgccttttagaagggatacagcagccagctgaggggctaggtactactgtctaaactgccacagcccctgcctggcttgcaggttccttgatatactgtgaatcatccatggcacatttcttatccctgcatgattgtatatccttctctcagtggggatatttgtggaccagctaaagtgctttcaggggctaaagataaaatcaagtattctagctgtcagattggctataggaagaaggaaaccccctcaaattctaaatctgtctacactccttttcaagagaatggcattcggtggctccaaggaaatggtgaccaattaggtagttccctgtatgcccgtaaacccacaacctgatgcttgaagtcatgacctggagatattgtgtgtgaagatgcctataagacgatggcacttgctcttcttacataaataattcagcaaataattaattagtgctgacagacactgtaagtttagcatgggggatacaaatatgcccttaagaatctcacagcatcataggggagagacaaatggacacacttcaccatgcatcattgtaaagcaaaaatagggtgatgtggcagaaaggagagagtggtaagctctgctggggtaagtcagacgagacttaaggtgtgtcatggagaatgaatagttcacgggggaggaggtggggatgcaagtggggagtggggagaggagggcacagtgcatactgagagtggtctttttggcaggtgtcatgcttcatggcaaaagtggaatgagaaatctgtttgcctttctttgggtaaccatacccttacctagacttctgcacgacagtggtcctacattattcatctgtgggagatgcagagtcagtcacctgccctgagccaaaacagggagggcaagaaagggcaaagcccacttgtgggagggaaatgacccactgcttgtaaaagcttggagtaaatgatttttttctttaccattcacttctcccttcattagagtggtttgtgattatagcatgtttttcaactattattccatgaaatgtcactataaattagaagaagaaataaaaaacctacaatgggttgtttaggtcacaggaaaaaacggaagcagacaaatttatcacatttgcagagccaaggagaagttgctcagagtagaggctggatatgtgtctcagttctcggagtcagtatgacagaggtccttcttgctctttggtcttcctaatattcatgatcaacttaagaaatatctcctagttcatggattagcctgggcaacaaaataagaccctgtcccttaaaaagaaaaaaaagaaatatctcctgatccctgtgctctaatacagtagggaaggataataataacagcacagggctattcggtggaggaaggaaaagaaagaaacctggagatggcttgtttgtgtcatatgggtacactaggatgtcagatagacagtaagtgtaaatgatacaagtcaattaaaaaatggaaatttattaggtatttgtatttaaaacacacactgtggagtaagatacacgctgaaacaaaagatcagccaaatatgaaaataaccactttggaagttgattttaaaacacattataggtggtcctcaacttaggatggcttgacatatgatttgttgactttatgatggtgcaaaagtgaaaagtattcagtggaaactgtacttccaattttgaattttgatcatttcctgggctagtagtaagtgtggaaggatcctctttcatgatgctgggcagctccccatcagcagcagctcccagtcagccatgtgaccttgagggcaaacaagtgatattattctctacagtgctctcctgtattcagtaaattacatgaggtagtccgcactttattataaagtcagctttgtgttagatgacttggtccaactgtaggataatgtgtttggagcacatttaatgtaggctatgaggtatgatgttcggtaggttaggtgcattaaatgcattttcaacttaccatattttcagcttaccatgggttgggggcagcccagtcgtaagtcgaggggcatctatattctcttctccctcatccccagccttctccctgttgttccccaagcacacaggccataaccctcacttcatgcttgacatgcaaccttccttttcttccttcccgctcctttttagtgacatctgattctgttaccctgtctaagtcaaaaggaccccttatttctagtattccctctagtactcagttgactttttccatagcttcctgaatggaacacatgctgagggtgaaaaaatagaaagtcttagccaatatattgtaatttacataccaaaggctggctcttggggatgaggggagagtattacgtgaaagttcgttggttattatctggttataagatatggcagcgttcctctttgacatatctttgatatacattgtttcattactcagatgttaattttgttttggggattacataagcatgtggtccattttaaagcaatattttgttttttcagattatatttgtatttcaggaaaatgatttatttgatttgtgacatgtccataaagcttaaggttttatgattttaagagagatgctaaagatacatttggttgcttcctttaaaatttatcttcaagctccactcagtctgtggttggcctaatccatcctggtggcttcaaataatacctgttcatggatgactcgccccagatctcacctctgaactccaggcatctatatccagcatgaatcctttctcttctggaagtctccagttctggcctgcacggttgtaatggcctttgatggatcttcccgctcacatgcttgctacctccattctgttctctgtattgcagctaaagcagcttttcttgatgtacgccagtactttatcccttatcaggacatgccatttattctcagcatctaagcagtaagaatataaatatcaaaaaaagaaacctccaaatgtttcattagtacccagccaagagtgtctctgtctcaacccccttcacttctgttcacctagcttttttcctctttaggaactggaaggcactgcatagccctggctctgtgctcacacctgtatttgccatatttatgttcctttcatcttttatgttagaggcacctgctattggttctgcccccagttgtgcctgattttctctcaggtccactttctttagatcagtgaatgattatacgagtgcttttagtgctgtgcccctcaaatcctttttgaaaatagagtatattgaatgctcaactcaatttagtgtataagaacaaaaatacagatgctggttataaaacagatgtaagtcagcctgagagactgaaaatattttgtctttatagtcctccttttctattaatatatgggaaaagaaaagtagatttcctgctttttcaatttgcaaatgatttttcaatttgaagtaccttaacataaaaagaacattcattctgtggctttagaatttggcctattattaacaaaagataatacgaaattcatcaccttaataatctctactcaacagcatttgaatgacttataaattagtgatttttaaaatctaaagactcataaaaaacacatttcttgagagccacacttatcatatttaggtttattatagtttaacttaaaatgacctggtaatatcctggtttgggttttatcctagtactaagtattgaccaaagggggaagaaaatgagctagcaattgagtctagtctgctgagtgagctccttccaaaactttaagtatagattacgccagtacattttctcaaatactatagggatcaatatcctagtgtatcttctctgggctttgacaaaataaaactccttagatcacatagtaggtatgtgatacgtatatcaacaatacttgaaaagtttttaaaattgggcaaaacaaaacatttaaaccaatatctcacatgttgggagatgaaggatgcagagggctggttgtcaacccattgttctgaatctgtgagttggcatccctgtgtcaaccatccccagttcactaggatctgtcagggagatctgggttccagcttcacattctctaatttgcttttgaaaaatctgtctttccatttttctgtcagttcctgcatgtattccaagagtaatagagagacacatgagctcaactagcattgacatgaagaaaaattactagcagttactttgacacttggaaatggcaacctgagaatcagaatttggaatttgctgctcaaacatcccttgggctacttcttcctaaaattgccacaaaagttgacagctatccacttaaaaggatagtattgtagccttttccatggatctgagaagttcagcaaatgaggcaacagaatagttgattatggagttttcaaattagccattttttaatgattaagcacaaaacagatcagtttcgtgtttaatcaataaaacaggccaagatcagtatcttggccgtgtaaacagactagcaaaacttgaggtgcaggttaatgaagactaaagttgcaggccagattttgaaagcatgaagagactaaaacaaacactaagaacataaattttaaaaaaagcaagtgtttgaatttcaaggtattaagaacaagtacaattaagctgtgtacattggccactgtaaaagaagggatctccctgtgacagatacagtcctgtcttttctaggacaacctgatatctcatattgatttatttttagacctggtaaaatgttaccgtaagcattcctcatgagtcaaaaatcctaccacagaactatccatgtttcaaaataaattaattttttacaaaacaaaattttttcttcaaatgctggagctcttttaatctcttttatatgaaactttctttctctttctttttcttttcttttctttctctctttctctccttctttctctcttttcttctctccttctctcctcttctcttctatccctctcttctctctgttcccctcccctcctttcccctcccctcccctcttctcacctctcttttgacagggtctcactctgttgtccaggctggagtgcaatggcactctgtagccccaacctcccaggctcactgtaatggctcactgtagccccaacctcccaggctcaatcagttctgccacctcagcctccagagtagctgggactacaggtgtgcaccaccacacccagctaatttttgtgtgttttgtatagacatgttttcgccatgttgcccaggctgctcttgaactcctgggctcaagcaatccaccggcctcagcttcccaaagtgctgggatacaggcgtagccactgcacccagcctgtatctgtagtttcataaaccttcataacctctcccatgagcttgactcccagccaaatgcctgcttgacttctctacttagatgttttatatgcgtgctctgtctgagcttcttcacacagaactcttgaattcccaccatgtacctaacaccccttgcagccttctctgtcttgataaatgtcacaaccacccagagagtggctaaaatgaacaatttaggtgactcttccattcgttcctactcctactgcatctccatcacaacatctgacagtcctgccttcaaaatacatcccaagtccattcagttctctccatcaccactgtttccaccttcatccaagccatcattatctcctaaatgattactgtaactcccctgcttccactctttgctatcatattgcattctcataaagtggccagagtgatctttagaaacataaacctagtaattcaatattcgttctttgcactagaataaaatctctcagctccttactgtggcctaaccttgcatgatctgatgcccacctgcttcactggcctaatttcataccacctccactagagatacactggtgtgttttcacctggggccattgcaattattttccccgaagagtttttttgtggttggttacttgtcatcatccaggtcacaaatgtcacctccgcccagaatcctcccctgaaccacgtatttaaagtggctccctccagtcccagctacttgggaggctgaggcaagaagattgtttgaggctggggagtcaaggctacaatgagctgtgatggcaccacagcactccagcctgagcaacagagtgaaaccctgccaaaaaaaaaaaaaaaagaaaagaaaaaaaaggaaagaaagaaatagtaaatccaagaatggctaggaaaaccagctaatttaccttgttaagaattgcatgtgaagaatggaattcagaagtaaagcatacattagtaaggggacattattctcatctgtttttcccaattcctgagccttttggtgggtggttttgcatagagatgtccagaagctgtcttgtcaagacctttatcaatccagtcttacaagactaggagggaaggagagaagttagatgtactttgagccatgatgactggttgtggaagcatcagaagggagtgatctgaaaagtggagagagcaactgaagattctttattgcaagttctcgaggaggaggagcccttcacacacctgtcagcactgattctagcgaaggggaccaggaagaggaaggatgagtggtctcttggttctctgaggttattctgtgacatgggttcacttttattcttataaccaaatatcatctttaacacatcactagacaagacttgagatagtggtgttttaaccagagaatggttgctttctctttaagttcctaagtttccctaaagtagaagatactaaaggagtttcttttgtcataaatatacgtgatataaaatttaccattttattcacatttaagtgtgtagtttcagatgcattgcatacattcaaattgctgtgttaccattgccactattcatctccaggacgctttcaacattccaaactgaaactctgttccattatgcaataattccctgttcccccctccttctggcgcctggtaaccacccattctattttctgcctctatgaagttgactattccaggtacctcatataaatagaatcatgctatatttgtgtttctgtgtctggcttatttcatacagtataatgtcttcagagtttaggttgtagcatgaatcagaatttttttcctttttattttattttattttattttttatttttgagacggagtctcgctctgtctcccaggctggagtgcagtggcgcgatctcagctcagtgcaagctccgcctcccgggttcacaccattctcctgcctcagcctcccaagtagctgggactacaggcgtccaccaccacgcccggctaattttttgtatttttcagtagatacagggtttcaccatgttagccaggatggtcttgatctcctaaccttgtgatctgcccccctcagcctcttcctttttatttttttaattttattgacataattatatttatgggctacatggtgatgttttaatacatacaatgtatagtgatcaaataagggtaattagcatttctgtcatctcaaatatttatcatttgtattgggaacatttgatatcctccttctagctatttgaagctgtatattattgttagctatagtcatcctacagtgatatggatactagaacttattcttcctatctagctgtaattttgtatcctttaacaaatctctggctattctctcattccttcttaaagctgagtaatattccactgtatgtgcatacaacattttgtttattccttcatccatcgatagacacaggttgtttccacctttagctattgcaaatacaggtgctatgaacatgggtgtacaaatatcttttcgtgtccctgcttttagttcttttgggtatatgcctggaaatggaattgccagatcatatggtaattctgtgtttaatctttttgagggaaatactcaagagattttaaacccataagccaattggacaaaaagttcatgtatttattgcttcatatatgtcatatagtgtattaggcatcagagaatggaaataaatgggacaaggctcctctcaagaaacacagagccttaggatgtgggacatagtcaatagatgcataagtaattagctattatacattgtgttcaattctgtaataagatatgtatagagtactgtgggagtgcatcataataatagtgatttctagtgtttctgaagataaaatctgattggacgttgtctgagatagacaaattctactgaattctggttaatagtggatcatgcagtatagaaattctggtgtacaagtttttgttgcacatttggttttttaatagctaactgaatcctacatgtctctcttttgttttatcttcctctagtggtttttaattgccaacagatcctacaaagtcagtgcagcaagctcttttttcttcagtggtgtatttgttggagttatctcttttggtcagctttcagatcgcttcggaaggaaaaaagtctatctcacaggtaatctattagagtattcataaactggatgagagggcttatttctctaagattcttagggaaataataaggggactatttccttaaggttctccgggaattggcatatggacacagaactgatctttattatcctggcaagaggccaaactgcagcttgagtgcttctggccaggcacctttaagttactagcccacctagttaaagtcagatatttgtgttctaaaccgttcataggtgatggtgctttctgcaacccccaaattttagtttatgccatgttgctaaggagagaagtaaaagactgtgacagtgtactaggcccatttccttatatctctctgtgttgattcatttcaaatgagctctacaggacttggcatagtgctcttgacaagctgagtatgagcaagggtttttcattttccagcattattgtgaataattgaaaactgtctgtgattgacagaaatcatgtaataaagtaaaccttatggttttttaaaaaaatagtttccaagagaagctgttaaaaaaaaaaaaaaacacacagctggctgggcgcggtggctcacgcctgtaatcccagcactttgggaggccgaggtgggtggatcacgaggtcaggagattgagaccatcctggctaacacggtgaaaccccgtctctactaaaaaatacaaaaaaaatttaaccaggcatggtggcgggcgcctgtagtcccagctacccgggaggctgaggcaggagattggtgtgaacccgggaggcggagcttgcagcgagccgagattgtgccactgcactccagcctgggtgacagagcgagactccatctcaaaaaaaaaacaaaaaaacaaaaaaaaacaaaaagaaacccacaaaaacagctcagaaaatttaagtttacaaacatttattttataagctaatgaatataatttattactttcatcaaatgctattttgcctctggattattgaatattgttttctctttctaggttttgctcttgacatcttatttgcaattgcaaatggattttccccctcatatgagttctttgcagtaactcgcttcctggtgggcatgatgaatggagggatgtcgctggtggcctttgtcttgcttaatgaatgtgtgggcaccgcctactgggcacttgcaggtactacttaaatcatgcagctctggactgggtgagcagctccagaaaattttatagggacccagtttaatcctagagtctggaaatgcatttggacttgaggtactttatccaactattagatttgcttttctgatttggttctgtatgaccctgaacaagtcattttattaatattcctctgtagacagtcttcctgggggcctgcctcacatgtgagcttgccatccgcctcatggactgcctacagattactgtggagactattgatttcctcggaaggacactagcaaatttttacaacttaaactgaaaaatagtgcagacataggaaatattagaaactcctttcttacagcctttttattctagtttattaaatttttgtttcacagcccttttttgtttttactgctctcaagtcaacatagtactattgtagcatttctttattgatatttaatttccaaaattgagactgtattctgaattatttttgactatcccattattttctcaagaactacatagatagtaaaataaatgattttaaaaggttatttaatttcaaatattgtcataagagaagtaactgtgtctaagactttatagacttaggtttgcaatgataactttttgtttcttttactttcattcacttgacaatggttgaatgtttcccatggatgttcttatatggatatgggaaacaggttgaccgtgtgactgatggaaatgtgtctttgggaggatctatatgagaaggccatttcttagaacctgatacacagtgccagccatctcttatgtaccagctaccatgctaggcatttgacatccatctgtaatattcccggagcttacaagttaaggattcctaccttcattttatggatgatgaaattgagcctttgagagatgaggtgacatgcctgttttcagcagctgataactgacagggccagaactgcaacctgggtcttgatgacacccaggtcatcttccactgttccccaaagactctcctcttggaacttcagcatgtcacctcatgtgagtgctggcctggtcaacctgttatttctaactggtgttgtttttgaagtgtatgggctattgtatcgagctggaagacacaaggctaaataaagtagacttgtggtctgtttgcatctccactaaacagctgtcgagtggaaggatccatagggttggaccagttagaactaggctggagaggaagagacaccagctccatcctctccagacaggcttcctgctggtctcaaacagtgttgccttaggattcaccttgtctgtagcaacttcgaaagcctttttggaactggtcctaagctgggatgagtgaaaaagcttcctctgagtcttcaatttgcattgagactttagggtcatttttctgaatagtatggccaatttcctgggactttctaagaagttggtaatgatggtgatcatgcctgctccctgtatccagggaagggaaaaaggcactctctcctttgatttcagttttcctgaggtccaaaattgtgctcatgtagagcaccatgaatacatatttttcttgtacctcttaacatttctccattatagtatttatatttgattttagtcgttgcatgaagatgctgttttataaaaaacgtataccactcccaccctgccagattatctaagtatttttcctgtcatattgcatgtgttaggggaaaggaccaaccctggtctcttgctctcttgctagttgcctaaagccagtgaaaagagtccccttggagtgttttgacctctcattcttatccttgatgctgggttaagatgagactatcaaaatttctgtagcaaagtgaaaagggagagaggaagaaaaactgtaacagtgaaaccacatggttgccaaattcaatgtgaaattgagagcatgtatgagagttccctgaagaccagtacacagccctgcacccaggacaaagtaaggctctgatagcacctggaactttttttgagtagcttccttccctctctcatgaaccgaggtcttccccagggttttgtccttggtctttcttttcaagctgatttctttccagaatgattttatctacacctgtggcttcaaatatgcttatgaattgcaagaagtcagagaaaaccctaaatgttcagcaataggggatttgctggaaatagcctgattatttggcaatgaaaattagtttgaaaaattatgcttattacaaaataatatttgcaatatgtaaaaaacaatatgtaaacatataccaaaaaacacaagtacgaactgcaagcatccatttttgaccagtttgcattgtagtacttaacaaaaaggatttctggctaattgactgaaaattattaagaagtgaaaaacaaaaaatactgaagctgtgaaaaattccatattaatatatttattatttgttttcttatattaatgtcttcatataacaattcatgttcattgtagaaaataattaagaaatatatgcacacgtcatcaaactaaagaatacatgtagtcctattcccctagagacgaccatggttaacatattgctatgtatgcttccagagcttttcctttgcatgtctattccacagcattcatttattaaacggattctgccatgtaccagacactgctttttttagataaaaaggtggaaaagacagggatgatttgggggaggttcttgctctcatggaactgatgctttacttaggaaaagtggaacaaattgataatttctgaaaattagaagtacaatgaagaaaatgaagcagggtaatgggctagatagtaattgtggggagtaactatattaaataggatagttagagaaaacctcgatgtgggtgtttgatctaagacatgaatgattaggaagacccaggcctgtgaaattctgggagaagtatattctagctagatggaatggcaaagacccaggccttgaagcaggaaggaacttctttgaaaagttttgaaaacgttctcatgactacagggtagagagttaaggaaagagtgaagtaactgagagggaccagatgatacagggcctgtgatgggccaaatgaggaatttgttttttacttgaagtacagtgggaagccagtggggcatattaaatacaggagtgatagggtctcatatacagaaagattactctggtaggtacagaaattgagggatcatttagtaggctgctatagttggccacatgaaaccagtggtgggttagacaggatggaagcagtggagaagaaagaggatgtgtctgagctggattttggtgggaaagtgacttgctaaaggaccagtagagatggggagagcaaaataactcaaggagacttcatggtctgtatttgaagatggattactggtaccgtttacaaaaatgaagtcataactatatactcttttctaacctgctgaagtttagcttttactagtgcaaactgagcaggaatagcgaagttgaaattaattaaaaataagcagagaataaattttaaaataggcatagtacttaaaggcatatacatggttataaagccacctatgatactccagaaaagatgacttgaaatgtttattttttattaattttttaaaccaagtaacatagagccttattatattcatctctacgccttctccctgttgtcattctaatgagctcatatataagggaaaatcatttggttaggataactagaccatgaagaaccaggcgttgaagatgcccagaaccagaagtcagatgcttctcatttcagctccccatcctctctgagaagcttcctctgcatagtcacagacagggcccagcagctccaagtctagtatttaaagtcttgggtaaggcctctgatcggctcagctgattggggtcaccctgcagttagaggaactatacttggcaggccccatttgaaccacagagatgaagtcagggaagtcggttctccaacagtgggtgggacattcttggaattaggaaggagaaccaggtagcaaatattctgtgatagattcaacaggaggctttcagatggcttttttttttgaggttaataaatagaagggctaaatccagattacattaggacaatatcgaacatttgtataacatgaggtaggcactgttatttctgtttcaccaataagaaaactgaggctcggggatatttagtgatttgcctaaggtcagagtagtatgtaacagaactaggatctgaacttggttcctctgaaaccatccctcctctgggctttcttggttttgcctacattgttgtcaagggatactgagtgctcaggactattctgagcaatgatagacaagaagtcttattcttggaagccaggtgctgtttgatctacagcagtgaaccagtagtagctattgactgtcttaaatttccaggaaactcacactgtcctcatcccactactcattggaccacatattctgaacatgctgtcacatcagctttcctttctagctctccctttcctcactaggtcaaacagtatacaagccatcacttatttgttataaagtaataagcaatggataggaatcaaagaaaacacatgtgttacaagattattatttttgtaacaagatcaacaaagttttgtcactgtggaatgcccacagaaattgcctttccatagaggggagatagaagagaggaatggtacagaacctgggcacaagtcctggccctgctacttacagctctgtgtccttaggcagcttcatttaaccgctctgagctattttccacttcagtatatggttgataatggtacttacttcataggacaatgtatgtgaaaccattatgcttaataaataatagctattactaccactaatagcagtagtggcacttatagaaagtgtgtcagaggtatagaatttgcaagaatattgggcaagcctgtgggtttaatacccatctcaatatttatttcaaaaagcgtaaggttctttacaattccatggttgatatttttccatcattgtgctgacaaaaatccatgcttaagggagcttattttctacttgggaaagacaggaaacaaataaatacaaaatgtcatgtatcctatagtaatacattaagtagagaaggcagtagggagaattgggagagtgagttgtgatttaagaaacttcggctgggcaaggtggctcacgcctgtaatcccagcactttgggaggctgaggcaggtgggtcacaaggtcaggagttaaaggctagcctggccaagatggcgaaaccccatctctaataaaaatacaaaaaaaaaaaattagccaggcatggtggcgggcgcctgtaatcccagctacttgggaggctgaggcagagaattgcttgaacccgggagcctgggaggtggaggttgtaatgagccaagatcttgccactgcactccagcctgggcgacagagcgagattctgtctcaaaaaaaaaagggaaggaaggaaagaaaagaaaagaaagaaacttcaagggcagcctgtgtgataaagattaagtttctggtattgcaataacctcatgacctgaaaagcgtattacccatatggcaaaaatatttccaagcctcagccagaggttcaggcaaatgtcagtacaacaggcaatgcagaaagcatttagacaaattcttaaaatttatatatccccatatagtttgtattttttgtctatcttccctttatttccactaattttctggcctctatgatactttcattctctgatgttcaacttagtgtagatttttttttcttttctggtgtgcctcttatagttgccagcatagggctgacatctcaccaggaagaaattggctctgtaacttggggttggaaatggtgctgcagatggtgctttctccagtgacagttctcttttccctgaattaggatcgattggcggcctgttctttgcagttggcattgcccaatatgccctgttaggatacttcatccgctcctggaggaccctagccattctggttaacctgcagggaacggtggtctttctcttatctttgtaagtagtttttcctcttagagttttaatttaaaaagccaaagcaatgtcttaagaggatgtgggtcaatgagcagcattattccctttcaggagcttgcctgcactgactttggtgaagaactaaattctgcaagtgctccaattcttggcagctcctgggaagagagatgcttaattaattcagaatgcaggtatcccttgtttaaagtaacctctcaatacactgcattgtaaccttcacattgttggcataggcaaccaattgcttttttaacctaatacctcaaccttaaaggtcttcagactggatcacattatgtgctaggtgtgtgactgaggtatgattttgtagaacagtgtattcatattggatatgtagtgacaactgttcatcctacagattagtgtcatttcagggcctctaaacattgactctggaagagtcttagatataggagaaatccttagggtgcacggcctcatagcagtggcaggatgattccctggtcagggaaggactctataaatgactgcccaagggtgtcataccatggccctctaagacacatagatgttacaaggcaggccaccatttccccagaagtttttttttttttgagacggagtttcgcccttgttgcccaggctggagtgcaatggtgtgatctcggctcaccgcaacctctgcctcctgggttcaagtgattctcctgcctcagcctcccaagtagctgggatcacaggcatgcgccaccacgcccgactgattttgtatttttagtagagacagggtttctccatgttggtcaggctggtctcgaacttctgacctcaggtgatctgcccacctcagcctcccaaagtgctgggattacaggcgtgagccaccgcgcctggcagaattttttaagtggtatatgaaaggcttttcttccctgagatatcagatctctgatggtaatcatcaaaatctttgacataaacaaaattttcagccagtatttcctgccttcatctatgccataaagtgaaggagacctgtagtagtgttttaattctgacagctctttaatttatttactctttatccggggtctaaattgagatttggtggggactaaactgaaatttttcatacatttttgaaagcaagagaatgttaagtgcaaaaatgaatagagtagaagtggcctatattttaaaaataaaatttattaaatgtatttttagttatatgaatttgagtgagataattttattagaagaggaaactaatatgattttattaacttgtatattgtcaatttttgaaagtaataaatgggtgcctactatagtacttagaattaataaacatttatgtaaatattgatgaataaataaattttcttttaaaatgtttcgtaaatttcctacttctccatcttatctggctttcatctccccgttaatagtataatagtagcaccacttcactggatgatctgagctgttctgctttttttttttttttttttttttttaaaatatatagtctgaactagttactgtttagtgctaggtggaaacatctcctcactgggaggtgagttcaggtcgtgaaaaatagaaagcagagagaaaagaactcatgagatttaaatatttacttattccactaagcctggaatgtaaggcttcccacagtcagcctccatttatctttcctaatttcccatcctatgttcaggcacactgcactacttgttccttatgcttttctgctccatgctgctactcagtgctgtgtctgctttttcaacaatcttctgcccagatcttcttatttgataagtacaccactgtcctgattttctcaaatgccgtccaccccatcttttcctgatcatagcttcagctacaagtcattgtctttcttttttgaattccacggcattcacccataccctttgagtggcccttatgtttctgcctcataatggagccatgttctctctttctaaactgagagctctccaacagtagcaggctctttgctccatgataacattttccccagtaccaaagccaggggtttccacacagtagatccttggacattgcacaaatgttggcacaaaaacatttggaatcacctttagaatttgtaatcagcaacataagaagccacattatataccttatttgtttaccagaaacatttttacctagcttaaaaattccttattttcacaatacttcaatttcagtagatttactttttttctgaaaaccagggtccccttaatttacaaagatttgccacctttaatgatattcatggagcggttttgagttgggcaacattgttaaattagcattttagctttcaaaggagcccacggcacagatgaccctgctgctatgtagaggacggcatgttcaaaggcctgctctttcttttaaaaacgtgtcttactgttttgtacgtataatctgcgtgtgttggaactctgtttccaaatctgtccactggcaactaggtgaccctctttagaagcaagcttattggcctctcaaaatgcaaagaaatataagaccgtaagttttcatgatcaagataaaccctttgccaggtagaaatagttttattaactcagagccgaatttctaaagccttcgtgtctctcaaataccagctttaaaatgatttataaagttttaaaagtaatttttattgcttataaacaattttgaaaacacagagaggctaagggtaggagaaaatgacatataacccaaagataatgactgtgaatattttggcgtattttctgttgtttcttttttattcctcccaatcctccccaaaataatttttattatcatatattttctctcaatatttatcacagtagtcctctttcatttagacataatcaagtggttttacgtaatagctcctatatgcccctatggatagggccaataaatcctactcataacctgcagacctaacttcaacagaacaatgttttacttgattatttatttgtttgtccgtaataataatcaaatggcaatgaagaagtaaatggaaggatttttcaggatgttatagatggcctttgttcctgcttttgctgacagtcaaatattgtgcgtgaatattcctttcctcagtagcaaagctcctgggaaaactcctgccttttggtttccagcatctttcctttcagcaccattacattactctgtacaaaattgaaatgctcaataaatggctgttgacagactggctgtccattaagtttccaaatcctgtagtgtttgttcctaattcactatccttattagaaggcacagtgaattctataaagcaccgtaaatagccagttttattcatctaagtttcattttaggcagataatgtcaaattagatttaaaaaaaaaacaaccttgatttgtgtcttgtaaacaaggcttccatattcctgccttggttttgtctttggaaagtcctctgaaagtgtaggtaaaatggggaagaggcaaaaagatacataatatttaagttttgaaactctttgaatatatcaatggcaatataattatccaacactttgtagttacattagaaaataactgttgttttgtaactagaagttggtcaggaaataacttctattctttaaggtcttgggggatcaggaaatatcctcaggacatattaaagccagtgtgtcaggtgatttgagtattttgaagcagtaaacactcaaaagtagctttggtaaacttggtttcatctttatgtgtagtcttaagataatctctacctcctacatgtcactatgttaaaaatatttcagtttaaatttttttttcctgatgagataataaagatttctatcttgtcaggcttttttagaacttaaaaaaacccattgtctctacagtattttcaaacaacacttggctaggatttagagccatatctttgacctgtgctttatgaagaattttcattattcagtcctatagactgaataatatgttaatatttaacatattaaaattcacatattaaaatttatttaaaaataaatgcatactgtttgctttttaaactgcaattgtaaagcatgttcttggttttcagtgataaagtagactaccatttaatgttagcatgctgttgaaagtagccctttcatatgttattgggagagtcaaactttaagtctaacatggaatcccatttgtggtgcaggaatccacgtactgagtaggtgatttgtctccttcctgtgcacgtgtacctatatgaatatacaggctttaatgacatctctttcagattcattcctgaatcacctcgttggttatactcccagggtcgactgagtgaggctgaagaggcgctgtacctcattgccaagaggaaccgcaaactcaagtgcacgttctcactaacacacccagccaacaggagctgcagggagactggaagtttcctggatctctttcgttaccgggtcctgttaggacacactttgatcctgatgttcatctggtaattatactaaggcgtgttctgttgctctttaactaaggttgctcgagcttctcttgatatcctgctccttcttcagggtacagggaattttacctcttttgttagcttgaggttgttttctcaacagcaagtctcctgatccttagcgcctggttttctgcttgcgcagccccgtctttctcaagtagcagatgatagtgcctgatgggcaggtccactgagcttgagtaagtagacatcagaagcacatctttgcttttgaggtatttatcataaatatttaagccttcctgccccttcccctgcaaaaaaggaaagaaagcaaataagcatggtagaaatagatgagtttttaaataggactttaaaaatacttacctttggcactggcatcaagcagtttgctagcacattctgattgcggtgctccatgctgcattttctgtggcactcccactcactaactcactgaggtgggctaaatatgatcccttgtacagatgggaccccaggagtttgaagtgatgaaccctaagccacatatgtaaatcagtgattgaactgatgagcactttctgaacctgatttttctggttgtttagcttattcccacctacctttcaaaatgctctcagcgtgagtgtaagttgcattcagcggttcaagatggtttcatttaaagaatgaagttgtagaaagaggagaaatggatgggtgcatacaatttgtggattgcacatgtgttttgatattgtacatactgctaatgtgccataagtgttatctgggcaaaatcatacctactagcctaaaggacagttgtgctgtggcttatatgtatttgccatgaagcctgcatggagccctacatttcatgcagggataaaggaaagtgattttatatgaaagtgatcttatgtataaagctacaaagaatagtagctttagaataagaagctgcaaagatatttttctatatcatatactctttttctacccaagcagtggctgccacctgtatggttgggggccatgttaaccaactgctgctttcccccacagaaccatcacagcactaggaatatcacagatgcataataaatgttgaggcttggaggcatggagattaagaaaaccgttgaaagccaaacctgacaacacaacataggagctgctaatttgaggttctacccattcaaaagcaaatacttacaaagtatgttcaggtacttagggctccataaaactttacatttgtgtatcacatagacagtcagtcaacctctgccttggaggaaccacctacttgttgcagattattcactatttttattttttcccccatgtatattaacttctgggttctggccttcaatggataaacaaacaaacaaaccctagacttagggccagggaaactgtccctgttcattttatttcttacacagccaaataaacttcttccctgaggctgagaatgttaaaacatgtgataatagagacagtcactccacatattgccgttctttttgaagatgctataaaattctaaaatcttctctgtggatctgtcattcaagaaagccttaactggggattcaaattatacctctgtgttaaacatctgttcctttagttattttccacaatagtgcctttttaaataattatttgatgctctaaatatactgttaaatattatgcaagcattttagattttgtttgggggacataaagaggattgaaatgattttaatagctgtaattatggatcccaatgaccaactctatgacgaaggcaacttgcagagcagaggcccagccctggggacaatgggccttccatgcttcatgctctccccgttctctctcaccaccagctgggaactaaattccactattgtcctgaactggcttgtctattcttgccctgacttgatactgtcacagcttgatttaaataggggtgtctctgtgtgtgtgtgtgtgtgtgtgtgtgtgtgtatgtgtgtgtgtgtggctggaatttctattgtaaatgcagaacagacacagaaaaccaactgggaaacagcattatgtaaatgctgtttctgcaggtgtaagggattttaaaaacgttttagaaaactgcatggatttaaatttattttgccttctgctttcatgcaagatacctgggagacagtgagaacagacaatgcagtgtcaccttgcatccttacatgtgatgtcctggctacaatcctgcccgttgtccttggtatatgaataacacttcatctcagtaagaaatcatgcataatacttctggctcatttgctagggagggctggactactaaccactccagcttgagggtcccttctctttacatctctctcttcttacattactacagcctggggtacttggcccacttctgagattaagcagagatggaaataaaactttccctttcctgactgatctcattatagccacagctcattagagtttctctaaggaaaactaaagggaagcaaatgagaatgtccccttaataaacactgatcaaactgtgttgcaaaagcataaaacctgatgaacttaacaaagcttcggtgttttactgcttgtatagaaatttgtggtttaccaaacatattcatatttttgtaaagcccagtttcagggttttatttttgttcattctattctattttgttttgttttattttaataatgcagtttcctaggcatagaagttcctactaccaccattactgtgtttgaggaagccctgatttggatctttaggttggcacttggcttcctcagctctttagttcttggattgtaggagagaggcttggtgcctagcactatgcctgccacccaagaggagctccctgtttgtttcaggaacggtgtacataaataaattaatggctttttaagtgacccttcctcggttgttcctcctagaagatcctgcctttgctgtgacctttaatttttctttcctgttctgggagtctgtatcatgtgcacctgctgaatgcaggatggggttaaaacctgcaatgggaagtgtctggatcattggggattggagtgccagtcattttgggcctgcaggtgacccactgaagatccagtcacttctcagctcatgttcttaaggccatcttctgttggctttctccatgggagttcttttctagaatcatttcaataatattacaactatctataacaagtgttccataaattgttgccttaaataaagaatagggtcattgtgttctattaattgcagaaatgcttgctgaaagcacatgcaatgtctttcctctttaaggggctggccatccatttgatttatataacatatagacatagctcaaattatttccaaacccccataatttttttgttttttcctagtgttgaaatttagattaaaatagaaaaattagtaggagagacaagcttattgcttacagcagatcaagcaattatattgaaccaatatttgaatctcctctggcaaattcttatgtacttttctgttgtccttcttgtcttttacctcctggtcctttgactcccaattgcaggtttgtgtgcagcttggtgtattatggcctaactctgagtgcgggtgatctaggtggaagtatttatgccaacctggccctgtctggcctcatagagattccatcttaccctctctgtatctacttgattaaccaaaaatggtgagtaagtgtggatgaatatgaagtgcaccgtagagaatgcacacatacacatatgccctctgatacacatgcatatctatatggtgttgtctttgtatgcagtatcagctgattgctctgtggtgattagagtttctttccatctaaaaacagttagaattcatttcttagtgcaggatttcttgagtttcatgtttacgagtttttatatagatttcaattcaatattgaatatcgaaatccaagatagtattgaatattaccatcagagggtttatgagtagtctgtatgtaatttgttagtctccagagatgagattattagttctgtgtagatgaaactctataaacccaattagcaataaatatttagaagttcttacaagaagacaaataattgaaggaactagaaagacttttcttatcttctgtggcccatcttactttgttgaggaggcagaagataaaaccttcttttgctactcattgtcagtgggcacagttttgagatagattttaaacgttattttatagagcaccctttcctcagtttttgagattgcttctgttacttagtgcctgaccaggccacttaaaaatcccattctgtatgagctgggaatcagttggattatgccatttctttttctccaaaaatcatcattccagccaaactcagaatttctttggtgttgtgcttaatgcccttgtcatgaggttttagtctagagtgttttgaagggcaggtttggattctgttaaattgaaggcttgtctcccagggagtgttcccagttgcctctgctgatccctgtgatagaggctacagcttactctcatcatgatccaagagctggatcaggtattgtattcagaaatctttcccagcacccccagttgtgccagatgcctttcctctgtgctgctctagcaccctgtgcatacctctggggccacttaaaagtgttataaggaagccgtccatgggggtatcttatgtgtctttgtatccctggtgcttgcctagcatggtgtgtgttacttgaaaggccttccatattgactgttaaattaagcaaaatgacctggaaaagaacactcaagaccttcttagcgccccccagagttaggattgaaatctgaagcagagggaaggaatgctacctttgtgaccaggcagacctgaattcagatctagtctttgccatgtgttcgttttatgactttgacaagtttcttcactaagcctcccttcgtacttatccccaaaccagggattgtaaaattcactggcaaaattatcaaaattattgaggttcctagtaaaagtacctagcatgttgtaagcccctagaaaagggagactttctaatgttaatatctttcttccaagtctaaggcttttatttgaaaattgcttctttcaacaaagtatgaaatagcatttcacttatttctaacccactgacaaatttttttctgtgtgtatttttaagagagagagacttaagaaaaatgccaaaactttaaactgcataaaaccagaaaaggtaaccagaaaataaagggagctgttagaatattctccttgtttcagtttcattctctaaaagatggagaatataatagtacatgcctacaggaattttattaggattaaataagataatagatggtaaacatttaaaacagtgtctgaaacttaggatttatggaaatagatagaatgatactatgcccttttctcacacaaatcacttaatcctgccatccagcaactttccctttgttttatagtggttatttattttgagtcctagtcagtttcctatcagtcacatttgccacttagccttaagaggagatgaacatatataatgaaactgaagatttttaaataagaaggttgggaagaaacagatgaatttataaggttcttaagagaactgtgtaatttctttctattgtttaggtttggtcggaagcgaacattatcagcatttctgtgcctaggaggactggcttgtcttattgtaatgtttcttccagaaaagaaaggtatgcctttcaaatttctacaagggttttgaacagtactttcattacaatgaatcataatatagtggagagatgaccatatggcatgcttcatttctgtgattgcatattgtttagcaattgtgtgggatataatgggccagattctttcctttgcttcagctattctctgggtgaataatgtgtgtagaggtgcactattaattctttcaggctattaagctaccatctggggtgactgagatgtagtattggtgatgttagagttgtttatttgatgatgaggaggactgattagttcttcacagaaagaaacttcatccaaggttgcaaattgcactcgtcattacagccaaccacaagattgcagagcagagccactggttctcaaaggtggctttggtacccctcaaatctccaccatgactctcaaggaactccgacaacaagaataatggggatggtattcactgttggtgacaatggatagtctcttagtcttatataaatgtgaaaacacctagttaggaaactgatatttttatatatgtgtagcttttctatgcaaacacagcttcaagaaggatccctttagcattctaatataacctgattactgcccctgtgtagacattctgtagctattgctggttttcaatctcttttttcactagcacacctgaggtatgacagtgattgccttgggaactgtgtttttggccgtgattttctagaaggaggagtgagtcacaacaactctctcatgctggagcatgtgatataacaagagccctgtcttaggggcttttggattttgatagggttctgttatggagcttgcactccagtaggcaatcattgtgagacgatttgacgtaaagttttgataactactggaaatgcatgaagaattcattttttgtcagagtatatcaggtattaaatactccttttgtaaattgcttcttgtggttcatttctgcgtgtctcattaaagaccccaaggccatgtgttctccctgttttataaccctccagtatatctactctgctgttgattgccccctgagttctataccttgagcctcgagtgtaatttgctcactacttagagtttacccaatacttagaacagctttaaaatgattttcatagaatcatggaaactagagaattgaataaatttgcccattttttattctctgagcaaatgggtgctcctgctaatgctaagtagaggaggaactccccagctattgccctgacatagacttgtagaactaggtgctcagttttgtttgtcttctggtaagactgtgatggacttcaaatcgttgtagttttatattcagcagattttgttttgcacaggtaccttgagaattcagtttcattttttttttaagctgcaataatagtccagctttctgtttattgcctcatagagaaaaacttgtcactagtcctatatacacacgtgtaacctatcacaccttcataagccaggccaattaatatctttccttccctcccacttatttgcacactccaggtaacctatcccctaggactctacatgtggccctttcttgaaatgatctctccttataaataacaagacaaaaatccatggtgaaggcagatgtatggtctcccctccagaccagcaagtaccactctatttaattacaatctgttttaagagagcagcttggacctttgttgattgtgcccctttatggacactgaataagaaacagcgtagcagagtatctttggcactccacaaatgtgcctcaggagcatgttgcctctgttatacttagaaaacgtggatgtattgtctatttttaacgatttcttagctgggcatggtggctcacacctgtaatcccagcactttggaggctgaggtgggtggatcacctaaggtcaggagttcgagaccagcctggccaacatggtgaaaccccatctctactaaaaatacaaaaattagttgggcatggtggcgggtgcctgtaatcctagctactagggaggctgaggcaggagaattgcttgaacccaggagctggaggttgcagtgagcctagatggtgccattgtattccagtctgggtgacaagagcaaaattctgtctcaatttaaaaaaaaagatttccagggaaattatttctatttttaatatttctactatttaattttaataaataatttctataattaataaccattactattaaaattatcctcttccactaccactgagccattgtctttcatttaattcatcactagagagagaatatatggtcaccttttttgtataatcctttctatgcttgcaaagtcttccagctatgcctgaattttctcttctttcagataaatagtaattgttctttaaactttctttaaaccttttgtatttactctttaaaatattttgttgacttttttttatctcaagtttttcaaagctttaggctacatttataaaagttctaataagtacatataaagaaaatgacctagctgtttgaaaaattctgtagcatcttgtgttagtttggagattactcattttctgtttgcattttgtgttcctttgccctcacttttccttaccaaacatgccttcagtcttgcctttctgccaactcaggtgaccctctacccaccattattttttagcacctgtatttgattgtggttctctgtgtcagaagcattcgtggagactgtgacaatgtatctctagaagagatagccagtaagccagaaaatagattgtttggcattcctcagcctttggtttataattgttagacagaagtgtcctgcccagtatatatttgcatgctggttggcattgaagtaaatgttctcctctgggagtaatattagcaggtggccactaatgtttttcccagattagtaatcagacattttacctgaactctgtgcttgcctggaggattctaattaaccttagaacacttgctaccatttattaagtgttaatcaagtgctggattctctttatatgcagaaggtattatatattatccccattttataaggaagcaaaatctcagattggtcaagcaacacgtccaaggttgcatagcaagtaagtagcacatccgggattcagattctttccaactctaaagtcagtcctcttttgggtatgctgttttctcaaactcttagagagatttttttgtatggtttgttttgagacagggtctcactctgtttcccaggctggactgcaatggtgtggtcatagctcactgcagccttgacctcttgggctcaagcagtcttaccacctcagtctcctgagtagctgggactacaggcatgtgccagccatgccaggctaatttttaaattaaaaagaaaattatttttgtagggtggtcgggagctcctggtctcaagtgattctcctgccttggcctcccaaagtgctgggattataggcatgaccatcatgcctggccagataagagttttagaaccaaagtattcgttgtaaataatgaagctgaagtcagaggattaatgctgcctgattaaacccagttcttaactctttagtgtgcaggcctgataggacttggccagtgttgaagaacctgggttatcagagtggcattgggctctcattgatgaggattatggcagttgtggtcctgccagagaatctgaacagtaggagatcatggcatgataaacacggttcttagtgaaggagtgtccttagactcagccctagtggaaccttcatatctcatttcttttcctaatgttggtctgcacatttctttatttgacttctctagtgtctatgatacaaaagatactattcataaacaaaatctagttcctggtctcaaagaatttacaatctaatgagagtaattagggattcaaaaataataataaaaatcagtactatatgagaattgacaacaaaatgctatgggaactttaagctcaggccatgatagtgatgaagaccagctgacttgctttaaacaacaatagaaccagacaaaatatatacatataagaaatattgattttcagacattggacaacagactgcataggacaggcaatgatccctgagaggagaaaataaacaaagtaggctctgaaaatgccctagcacatggttgccaaaccacagtgcagggaagggaagcccaacaaatcatagcattcttactaaattgaagaaacagaaattgaagcttggggaagccaagatgtctggaatttgttgagcaaaatactggagagtagtaagatacacagagggagaactccagaggtctgcagaagaaacctcctagtctttgatttgagcatgcatttgaagaaactactgaggccagggggagaccaccagaaagtggcaggcagaacaatccttggattgttgaatccatgaatggtttgtgttctcttcagccagttgcagagcattggatagagacatcctaggtcaaagtcattttaggaaaaccctggtttgtttgtttgtttgtttgtttgttttgccataaaagtgcttaaaaacaaaactcagaaagatcagttgattccaagtaacttaactgcatcacggaacaaagaccaacaagacttaaaggaacaataaagtccagcaccccaaaaaataacattaacaaaaaaaaaaaacattgagtgtgtagcctccactcaaaatcaccaggcatgcaaataagcaggaaaatacctcccacaagtagaagaaaaatcaatagaaacaaaaccaaaaatgcacagatgatagaattaagagacaagaatattaaaacagctattataaatgtactccatgtgcttaagaatacaagcagaatacaagcagagaggccaaaagaaagaaaaagacactttcatctagagatgaaacatataatatatgaaaaaaatacagtagatgagattagcaacaggttaaacactaaacagaagaaaagatcagttaaagacataaaaaaactatacaacatgaaacaaaaaaattgaataaaaaactaacaaaacatcagtgaattgtgggacaatattaagtgacctacataagtgtaatattagtcttagaaggaggggataaagaaaaagtatttgcagaaatgctcaaatgctttgcaaatttgataaaaactataaacacataataagaaagtggtcagttcatcaagaggatagagcagtcctaactgtgtttgtgtatacttgtaataaatttatagtacacaaagcaaaaacatacagaattgaaaggcgaaatagacaaatccaagaaacacaatacttcactatcactttctcaatgattgataaaaaggtaaacagaaaatatagacttgaacaaccaataggacctgatttataggtcactttaccctaaaccaatagaatatgtattccatttgaagtgcacacagaacatttgccaagagagaccatattctaggccataaaacaagtttcaataagtttagaagaattgaaaatttacaaaaacaagttagttgaccagactagaattaaactaaaaatcaccaacagaaagatatatggaagatcctcaaatatatggatatggaacaacatccttctaaaaacatgtggattgaagaaaaaaatcacaaggaaaactggaaaatattttcaattgaacagtaaaatatactgtatcagcccggcacagtggttcatgcctgtaatcccagcactttgggaggccaaggtgggtggatcacttgaggtcaggagttcaagatcagcctggccaacatggtgaaaccctgtctctaataaaaatacaaaaatattagccagtcatggtggtgtgcacctgtaatcccagctatttgggaggctgaggcaggagaatcccttgaacccgggaggtggaggttgcagtgagccgagattgcaccactgcactctagcctgggtgaaagagtgagactgtgtctcaaaaaaatataaagtatactgtatcatagtttatgggaggcaaataaagtaatgcttagagggaaatttatataattcttttaagtatcagaaaaaaagaaagttttcaaattaatgatctaagcttccaacttaagaaagtagataacaaattttaaaaaagaagagctaattaagcacaatgcaagcacaggaagaaaataataaatataaaagcaaaaaaatcaatggaatgaaaacaaacaatggagaaaaatccttaagaccaatacaattattaaacctctaaccaagataataaagagaaaaggaagaagacacacattaccaatatgtggaatgaaagaggggacatcactatagaacctataggcatttaataagggaatattatgaacatttttatgtcaataaattcaacttaggtaaaatgggcaaatttcttgaaagattataaactaccaaagcttacttaaaaacatatagataacctgaatagcaccatatctactaaaaaaattgaatttgtagttaaaaacattcccacaaaaagaattctaggcccagatggctttactggtaaattctatgaaacgcaaaagaaatagcatcaattgtacacacttttccagaaaataaagaggagagaataactctcccggcttagcctctaagggcctgcaattactttggtacctaaaccaaacaaaataaaggcattataagaagagaaaactacagatcaatctctcttattaatatggatgtaaaaatcttaaacaaaatattagcaaattgagtccagcactgcataaaaaaggcaatacataatgactaagcaagttttatcccacaaatgcaaggttggtttaacatttaaaagccaattagtggccaggtgctttggcttacgcctgtaatcctagcactttgggaggccgaggcaggcggtcaggaattttcttaacttgataaagagtattaagggaaaacctacagtaaacatcacatttactggtgaaagactgaatacttatattctaaggtcaggagaaaggccaggatgtccattcttaccatttctatggaacattgtacaaaaagtactagtgaatataataaagcaataaaaagaaattaaagggatttaaattggaacagaagtaaaactgtctttattcaccagactacattatgatcaccttcatagaaagtcctaaggaatatacaaaaaagaaatctgtaagaattaatagatgagcttagcagagtcatgtataaacaattttctttctacatattagcaacaaacagttaaaactgaaataaaccaatgccatttataataaaataaaaaatatgaaaaatttagggataaattttatgaaatatgtatatgactacaaaaaactttaaaatgctgatgagaaaaattaaagaagatgaactaagtgaattggtaatagcaataataataaataaatagattaccatgcttatggaccagaagatattaagatatcagcactccccaaactgatttatcttcattcagtgtgatatcagtaaaatttccatcagtcttcttttggtgatagaaattgacaagttaatactaaaactttttttcttttgagatggaatcttgctctgtcatgcccaggctggagtgcagtggcgtgatctcggctcactgcaacctctgcctccaggattcaagggattctcctgcctcagcctcccaagtagctgggattacaggcgcccaccatcatgcccagctaattttttgtattgttttagtagagacggagtttcaccatgttggtcaggctggtctcgaactcctgatctcaggtgatctgcccacctcggcctcccaaagtgctgggattacaggtgtgagccaccacgcctggccaatactaaaatttttatggaaattcaaaggatctggactatccaaaataattttatcaaggaaaaacaaagttgaagaacttaacttacctgattataagacttacaataggctgggcatggtggctcatgcatgtaatcccagcactttgggaggctgaggtgggtgggtctcctgaggtcaggagtttgagaccagcttggccaacatggtgaaaccccgtctctactaaaaatacaaaaattagctgggcgtggtggtgcacctctgtaatcccagctactccggaggctgaggcaggagaattgcttgaacccggggggtagaggttgcagtgagccaagatcgtgctactgcactccagcctgggctacagagtgagactccatctcaaaaaaaaaaaaaaaaaaagacttataatgaagttacattaatcaagacagtacagtattggcataggaatgtctctatagataatggaacagaattgagtatgaaatagaaccacatatatggtcaattgattttttttttgacagagctgaggtttcattcaccttttaaaaatattttactcagtcataatatacatacagaaaaatgctcatggtcaattaatttttgatgaaaatgacatgttaattcaatgaggaaaacataacctttttaaaaaacggtgctgaaataactggatctccatatacaaaaaatataacttcaacctgtaaatcacattatatgcagtaataaacttgaaatggttgtttaactgaaatgtaaatgctaaaactgtgttgtacaactactagaagagaacataggagaaaaatcttagtgactttgagttaggcaaatatttcttaactaggacaccaaaagcacaaaaagaaaaaaaattcatgacctagacttcataaagttaaaaacttttgctttttaaaagactctattacagaaatgaaaagtaagacacaaactgggagaaaatatctgtaaaacatgtatctgataaaagacttgtatccagaatatagaaaggactctaataataaggaaaaaataggcaaaagatttgaatggatgcttctccaaaaagatataaaaatggcaaataaatatggggaaagttgttcaacatcatcagacattagggaaatggaaattgaaaccacaatatcaggatcatcatggcggacagaaagcaggagtagattgctgctctgactcagatgaacagagcgctgtgtggaggctcgcatcatgaactttagctccagattgacagcaagaacaaaccagcaatcccgagaggacccacagtccctctgaaggaagctgactgctcctgcaggacccggagacattccaaatactgagtgccccaatttcggaagtgggaaagggagatcctcctctcctgaacacatacccccactggagaaactgcaggagaagtttcccaccttacctggagctgagtcaattaagacagccagcaaaatacaggggtggaggaagcagcagggaaggccctgggagctcgctggttccctaaggaagccattcctgcctggcaccacagggatcccttgggagggtggcctagacctgacccgacctgacagccttccctccccaccctggtagctgaaggcaaaagacataaaatcctgggagttctagggccccacccactgctggttcctctccatactaccatagctggtgctctctggataggtgccacctcccagcaggaagccaactagcacaacaatagagcattaaatcacaaaaactggccgcgcacagtggcttacacctgtaatcccagcactatgggaggctgaggcgggcagatcacaaggtcaggagttcgagaccagcctggccaagatggtgaaacaccgtctctcctaaaaatataaaaattagccaggcatggtggcacgcagctgtagtcccagctactcgggaggctgaggcagaagaatcgcttgaacccgggaggcggagattgtcatgaaccaagatcgtgccactgcactccagcctgggcgacagagcgagactccgtctcaaaaaacaaacaaaaatccccacaaaagctaagaaccctcacggagtccattgcaccctcctggcacctccaccagaacaggcactgttatccacggctgagagacccatagacagttcacatcacaggactctatagagacaacccccagttccagcccagagccaggtagactcactgggtggctagacccagaagagagacaacaatcactgcagtttggttcacaggaagccacatccataggaaaagggggagagtactacatcaaaggaataccccgtgagacaaaagaatctgaacagcagccttcagcctagaccttccctctgacagataaaaggttagttattaaattgaggcaccaggaaaaggcaaagcccaatgcaaggaactccaaaaaatgatacaagaagtgaagggagaaatattcaaggaaatagatagcttaaataaaaaacagtgaaaacttcaggaaacattggacacacttatagaaatgcaaaatgctcgggaaagtctcagctatagaattgaacaagcagaagaaagaaattcaaagctctaagacaaggtttttgaattaacccaatccaacaaagacaaagaaaaaagaataagaaaatatgaacaaagcctccaagaagtctggggttatgttaaatgaccaaaccaaagaataattggtgttcctgaggaagaagagaaatctgaaagtttggaaaacatatttgggggattaatcaaggaaaacttccctggccttgctagagacctagacatccaaatacaagaagtacaaagaacacctgggaagttcatcacaaaaagatcatcacctaggcccattgtcatcaggttatctaaagttaagacaaaggaaacaatcttaagaaactgtgagacagaagcagcaggtaacccataaaggaaaacttctcagattaacggcagatttctcagcagaaacgctacaagctagaagggattggggccctgtcttcagcctcctcaaaccgaacaattatcagccaagaattttgtatccagtgaaattaagcatcatatatgaaggaaagatagtctttttcagacaaataaatgctgagagaattcgccactaccaaactaccactacaagaactgctaaaaggagctctaaatcttgaaacaaatcctggaaacacatcaaaacagaaactctttaaagcataaatcacacaggacctataaaacaaaatacgagttaaaaagcaaaaacaacaaaaaacccaaggtagacaggcaaaaaatagcacaatgaatgcaagggtacctcatgtctcaatactaacattgaatgtaaatggcctaactgctccacttaaaagatacagaactgcaaaatggataagaactcaccaagcaactatctgctgccttaggagactcacctaacacattaaggactcacataaacttaaggtaaaggggtggaaaaaggcatttcatgcaaatggacacaaaaagtgagcagggtagctattcttatatcagacaaaacaaactaaagcaacagtggttaaaagagacaaagagggacattatataacggcaaaagcccttgtccaacaggaaaatatcacaatcctaaacacatatgcacctaacactagagctctcaaatttataaaacaattactaatagatctaggaaatgagatagacagcaacataataataatgggggactttcagtactccactgacagcactagacaggtcatcaagacaaaatcaacaaagaaataatggatttaaactataccttggaacaaatggacttaacagatatatacagaacatttcatgcaacaaccacagaatacacattctattcaacagcacatggaactttctccaagatagactatatgataagccctaaaatgagcctcaataaatttaagaaatttgaaattatatcaagcactctctcagaccacagtggaataaaactggaaatcaactccaaaaggaaccttcaaacccacgcaaatacatggaaattaaataacctgctcctgaatgagcatcaggtcaaaaacaaaatcaagatggaaattaaaaaattcttcgaactgaatgacagtaatggcacaacctatcaaaacctctgtgatacagcaaaggcagtgctaagaggaaagttcatacccctaaacacctacatcaaaaagactgaaagagtacaaagtggcattctaaggtcacacctcaaggaactagagaaacaagaacaaaccaaacccaaacccagcagaagaaaggaaataaccaagatcagagcagaactaaatgaaacaaacaaacaaacaaatatgaaagataaatgaaacaaaaagccagttctttgaaaagataaatataattgatagatcattagcaagattaaccaagaaaagagagaaaatccaaataacctcattaagaaatgatacaggagacattacaactgacaccactgaaatacaaaagatcattcaaggctactatgaacaccttcacacacataaactagaaaacctaggaagagatggataagttcatggaaaaatacaaccctcctagtttaaataaggaataattagataccctgaacagaccaataacaagcaacgagattgaaatggtaatttaaaaattaccaacaaaaaaaagtccaggaccagacagatttacagcagaattctaccagacatttaacaaactgataccaatccttttgacactattccatgagacagagaaagaaggaaccttccctaactcattctatgaagccagcatcaccctaataccaaaaccaggaaaggacataaccaaaaaagaaaactacagactgatatccttgatgaacatagttgctaaaatccttaacaaaatactagctaaccaaatccaacaacatatcaaaaagataatccaccatgatcaagtgggtttcataccagggaagcagggatggtttaacacatgcaagtcaatgtgatacaccatataaacagaattaaaaacaaaaatcacatgatcatctcaatagatgcagaaaaagcattagacaaaacccagcatccctttatgattataactcggcatacgagggacatacctcaatgtaacaaaagccatctatgacaaacccacagccaacataatactgaaaagttgaaagcattccctctgagaactggaacaagacaagaatgcccactctcaccactcctcttcgacatagtactggaagtcctaaccagagcaatcagacaagagaaagaaataaagggcatccaaatcagtaaagaggaagtcaaactgtcaccgtttgctgatgatatgattgtttacctcagaaatcctaaagactcctccagaaagctcctagaactgataaaagaattcagcaaagtttctggatacaagattaatgtacagaaatcagtagctcttctatacaccaatggcagccaagcagaaaatcaaatcaagaactcaacccctttatggtagctgccaaaaaataaaatacttagaaatatacctaaccaaggagtcaaaaaacctctacaaggaaaactacaaaacactgctgaaagaaatcatagattacacaaataaatagaaaaacattccatgttcatggatgggtagaatcaatattgtgaaaattgccaaaaacaatctacaaattcaatgcaatcctcattaaaataccaccatcattcctcacagaattagaaaaaacaattctaaaattcatatggaaccaaaaaagggcccacatagccaaagcaagactaagcaaaaagaacaaatctggaggcatctcactacctgatttctaactatactatagggccatagtcaccaaaacagcatgatagtggtataaaaataggcatatagaccagtggaacagaatagagaactcagaaataaatccaaatacttacagccaactgatcttcaagaaagcaaacaaaaacataaagtggggaaaggacacccttttcaacatatggtgctgggataattggctagccacatgtaggagaatgaaattgcatactcatttctcacctatacaaaaatcagctcaagatggattaaggacttaaatctaagaccggaaactataaaaatactagaagataaccttggaaaaacccttctagatattggcttaggcaaggatttcatgaccaagaactcaaaaacaaatgcaataaaaacaaagataaatagttgggactgactgtacaactgtatcagctgctcgtaggacatgtccagcagctgctcgaggtccacaccgcggtgatacatcctcttcacagactgcagaaaaacagcagatttgtgatttaactgggagttttctgggatcaaacagtagctttgtttacagtcctgggtatgtctttatcagcggcatgaaaacagactaagaaggaggagccaagatggccgaataggaacagctctggtctacagctcccagcgtgagcgacgcagaagatgggtgatttctgcatttccatctgaggtactgggtttatctcactagggagtgccagacagtgggcgcaggacagtgggtgcagtgcaccatgcgcgagccgaagcatggctaggcattgcctcactcgggaagtgcaaggggtcagggagttccctttcctggtcaaggaaaggggtgacagatggcacctggaaaatcgggtcactcccacccgaatactgtgcttttctgacgggcttaggaaaccaggagattatatcccgcacctggctcggagggtcctacgcccacggagtctcactgattgctagcacagcagtctgagatccaactgcaaggtggcagcgaggctgggggaggggcgcccgccattgcccaggcttgcttaggtaaacaaagcagccgggaagctcgaactgggtggagcccaccacagctcaaggaggcctgcctccttctgtaggctccacctctgggggcagggcacagacaaacaaaaagacagcagcaacctctgcaaacttaaatgtccctgtcattttgaagagagctttgaggagagcagtggttctcccagcacgcagctggagatctgagaacaggcagactgcctcttcaagtgggtccctgacccctgacccccgagcagcctaactgggaggcacctcccagtgggggcagactgacacctcacacggcgggctactcctctgagacaaaacttccagaggaatgatcagacagcagcattcgcggttcacgaaaatctactgttctgcagacaccactgctgatacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagtgcctctcctcctccaaaggaacgcagttcctcaccagcaacagaacaaagctggacggagaatgactttgatgagttgagagaaggctttagacgatcaaactactctgagctacaggaggaaattcaaaccaaaggcaaagaagttgaaaactttgaaaaaaatttagacgaatttataactagaataaccaatacagagaagtgcttaaaggagctgatggagctgaaggccaaggctcgagaaccacatgaagaatgcagaagcctcaggagctgatgtgatcaactggaagaaagggtatcagtgatggaagatgaaatgaatgaaatgaagtgagaagggaagtttagagaaaaaagaataaaaagaaacgaacaaagcctccaagaaatatgggactatgtgaaaaaaccaaatctatgtccgattggtgtacctgaaagtgacggggagaatggaaccaagttggaaaacactctgcaggatattatccaggagaacttccccaatctagcaaggcaggccaacattcagattcaggaaatacagagaacgccactaaaatactcctcgagaagagcaactccaagacacgtaattgtcagattcaccaaagttgaaatgaaggaaaaaatgttaagggcagccagagagaaaggttgggttacccacaaagggaagcccatcagactaacagcggatctcttggcagaaactctacaagccagaagagagtgggggcgaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagccgctgcaaaatcatgccaaaatgtaaagaccatcgagactaggaagaaactgaatcaactaatgagcaaaataaccagctaacatcataatgacaggatcaaatttacacataacaatattaactttaaatgtaaatggactaaatgctccaattaaaagacacagactggcaaattggataaagagtcaagacccatcagtgtgctatattcaggaagcccatctcacatgcagagacacacataggctcaaaataaaaggatggaggaagatctaccaagcaaatggaaaacaaaaaaaggcatgggttgcaatcctagtctctgataaaacagactataaagcaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagttaaacaaggatacccaggaattgaactcagctctgcaccaagctgacctaatagacatctacagaactctccaccccaaatcaacagaatatacatttttttgagcaccacaccacacctattccaaaattgaccacatagttggaaataaagctctcctcagcaaatgtaagagaacagaaattataacaaactgcctcagaccacagtgcaatcaaactagaactcaggattaagaaactcactcaaaactgctcaactacatggaaactgagcaacctgctcccgaatgactactgggtacataacgaaatgaaggcagaaataaagatgttctttgaaaccaacgagaacaaagacacaacataccagaatctctgggacacattcaaaatagtgtgtagagggaaatttatagcactaaatgcccacgagagaaagcaggaaagatccaaaattgacaccctaacatcacaattaaaagaactagaaaagaaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccacctatcccacagaaatacaaactaccatcagaggatactacaaacacctctacgcaaataaactagaaaatctagaagaaatggataaattcctctacacatacaccctcccaagactaaaccaggaagaagttgaatctctgaatagaccaataacaggatctgaaattgtggcaataatcaatagcttaccaaccaaaaagagtccaggaccagatggattcacagccaaattctaccagaggtacaaggaggaactggtaccattccttctgaaactattccaatcaatagaaaaagagggaatcctccttaagtcattttatgaggccagcatcatcctgataccaaagccgggcagagacacaaccaaaaaagagaattttagaccaatatccttgatgaacattgatgcaaaaatcctcagtaaaatactggcaaactgaatccagcagcacagcaaaaagcttatccaccatgatcaagtgggtttcatccctgggatgcaaggctggttcaatataggcaaatcaataaatgtaatccagcatataaacagaaccaaagacaaaaaccacatgattatctcaatagatgcagaaaaggcctttgacaaaattcaacaacacttcatgctaaaaactctcaataaattaggtattgatgggacgtatctcaaaataataagagctatctatgacaaacccacaggcaatatcatactgaatgggcaaaaactggaagcattccctttgaaaactggcacaagacagcgatgccctctctcaccactcctattcaacatagtgttggaagttctggccagggcaattatgcaggagaaggaaataaaggatattcaattaggaaaagaggaagtcaaattgtccctgtttgcagatgacatgattgtatatctagaaaatcccattgtctcagcccaaaatctccttaagctgataaacaacttcagcaaagtctcaggataccaaatcaaagtacaaaaatcacaagcattcttatacaccaataacagacaatcagagagccaaatcatgagtgaactcccattcacaattgcttaaagagaataaaatacttaggaatccaacttacaagggacgtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgactttcttcacacaattggaaaaaactactttaaagttcatatggaaccaaaaaagagcccacatcgccaagtcaatcctaagccaaaagaacaaagctggaggcatcacgctacctgacttcaaactatactacaaggctacagtaaccaaaacagcatggtactggtaccaaaacagagatatagatcaatggaacagaacaaagccctcagatgtaacgccgcatatctacaactatcggatctttgacaaagctgagaaaaacaagacatggggaaaggattccctatttaataaatggtgctgggaaaactggctagccataggtacaaagctgaaactggatcccttccttacaccttatacaaaaattaattcaagatggattaaagacttaaacgttagacctaaaaccataaaaacgctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaggaaactaccatcagagtgaagaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgtagccaacagacacatgaaaaaatgctcatcatcactcgccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaaccagaaataccatttgatccagccatcccattactgggtatatacccaaaggactataaatcatgctgctataaagacacatgcacacgtatgtttattgcggcactattcacaatagcaaagacttggaaccaacccaaatatccaacaacgatagagtggattaagaaaatgtggcacatatacaccatggaatactatacagccataaaaaatgatgagttcatgtcctttgtagggacatgggtgaaattggaaatcatcattctcagtaaactatcgcaaggacaaaaaaccaaacaccacatgtcctcactcatagatgggaattgaacaatgagaacacatggacacaggaaggggaacatcacactctggggactgttgttgggtggggagaggggagaaggatagcattaggagatatacctaatgctaaatgacgagttaatgggtgcagcacaccaacatggcacatgtatacatatgtaactaacctgcacattgtgcacatgtaccctaaaacttaaagtataataataataataataatactgaaaaaaaaagaaaacagactaatacataaaaaaaatagttgggacttaattaaactaaagagcttctacatagcaaaaggcacagtcagcagagtaaacagacaacccacagagtgggagaaaatcttcacaatctgtacatctgacaaaggactaatattcagaatctacaacaaactcaaacaaatcagtaaggaaaaacaaacaatcccatcaaaaagtgggcgaagaacatgaatagacaattctcaaaagaagatatacagatgtccaaaaaacatgaaaaaatgctcaacatcactaatgatcagggaaatgcaaatgaaagccacagtgcgataccatcttactcctgcaagactggccataatcaaaaaatcaaaaaacagtagatgttggcatggatgcgggtgatcagggaacacttccacactgctggtgggaatataaactagtacagccactatggaaaaccgtgtgaagattccttaaagaattaaaagtaaaactaccatttgatccagcaatcccactactgggtatctacccagaggaaaagaaatcattattcaaaaaagatacttgcacatgcatgtttatagcagcacaaatcccaattacaaaatcgtggaaccaactcaaatgcttatcagttaacgagtggataaagacaccatggtatatatacaatggaatactactcagccataaaaaggaattaattaatggcatttgcagtgacctggatgagattggagactattattctaagtgaagtaactcggaatggaaaaccaaacatcgtatgttctcactgatatgtgggagctaagctatgaggacgcaaaagcataagaatgatacagtggactttggggacttggagggaagcggggcaaggaataaaagactacaaatagggtgcactgtatactgctcgggtgatgggtgcaacaaaatctcataaatcaccactaaagaacttactcatgtaaccaaataccacctgtacctcaataaattatggaaactaaaataaaaataaaaatgaaaccacagtgggatgccacaggacactgattaaaatgacaaaaattacagagaccgcaagtgttggtgataaagaggaactgtaactcatatacattgctagtaaaaatacaaaatggtatagacacttcagaaaatgtttagcagcttattttaaagtgaaatatacacttactatatgacccagctttactcatgagaagtggaaacctagatccacacaaagactttgatgcaaatgttcatagtggatttattaataatagccccaaactggatggaactcaaatgcccttcagctgatgaatggataaacaaattgtggtatatcaatataatggaatattagtcaacaacaaaaaaggaaagaactatgtcctactgtgctgagtgaaagaaaccacacacaaaagtctacaaacagtattatattattgtgaaatccttgaaaaggtgaaactatggtgacagaagtttgtgtgtatatgctttttataaaaagccagagggaagcaaaatgcattgtgattcttaccccatttatgtatcatagcagaggacctgtacctgtcttaaagatttttaacatgtgaacaatcaaaatgaacaattttcttgtaatcacacagtgaatgagtggatgtgaaagttgaattttttgccattttgggtcagtgaaatgtgactatatcatactaagacattttttgctggtgatcccaaatggtatctggaaaaccttccagaaaaatagttctgaaaatgatgtctgtagtagtcgcatcattggaataaatgtataacctccttgagttagtatttgaagtatacaagtgttttttgagatttccttttttaaaaagatagtttagttttgcttatgtcttttaaatcgctcttttttctcgaccatcactttggacattcattggtaacagccaataatatctgattttcagataaagaatccagggaaccagtctaacggctgcaaagccttcctgagtatttgccaggacaaacagcccagcagccccacaggcaggagtcccagaaagaaaaagaaataattttctcataaccaaaactgtctgaaatggacatgggctattttgaggaaaaagtgaattaccctggtttaaatggcaactgcagaccccattggcaggcacatacgagagaagttttaagcatcagatggggtattggactaatgcacgcattctgtggacatgtagctggagccaggcttcccaaatgggctacagctggagctatcctgaccctatcatggaaaacttcatctagctttggatcttgtgggtattaagaagatacactttctgtgacacacccttggaatccagatttcaaggatggcagttctttagcctgttgttaaagatgtatagtgcctccatacagttctgaaagataccattctgtatgggttgaaaacagtcccagagatcatttgcaatcaagcatatgtgcgtatttctgtttggttcaatgcctcccaataccttttcccaactcattctgtttcctggaaaataattgatgaatttaatttgccctcattattggtttaagtgaaaatgttgttagatctcaaaagttgagaaacatatctcagggtaaatgctgaaagacatgattctttatcagaagcaccttgtggcttaaaaatatatatccaggacttagaagagctaacatcgtcttccaaatagcctggcagaagagtttgagaaagcagctccagaaggtggagtctggcagagtctggactactctgttcaagacacactctttaaagaagatttattttatagttaagcagggaaggtgaaacttattttttggactggggcatgtctatgcctccctcctttcaagttgagagagcatgaacacaggttctattcactaaattaatccctcttgtagtccttccacttattagttcagcagatatttaatgagcaccagtgtacatagtgctatgggaggtgccttgaggaacacgaatacaaggaagttaccaacctgggtctgagagaactcgaaatcccaatttggacaggcaagatggaaaagtaagcagccacaaggcagtgtctgaggcacgccagttgaatggattggaaagtaggggcagtggaggttgaaggaaagagagcatatttcatttgagctgcttaggggaagagtggtttctgtgagccatacattccaaaggaaggaacgagagtgttctctttggcagaaatgtcaaggagaatgagaggcaattacatttggtgatgaggacattgctgctgaccttcaagagtaggaatttcaggagaggatggtatggaagccagattgtagtaagttgccaggacaggtgcattggagaaaatggagtggtggtcattcactgggacgtttgatagggaatggcaggaagtacaacagagtcagtgagaacttttttgcctcataagaagtaaattgttattttgaaggtagaggcaaatgattattgaaggggagaggttaaacttttctaaaaaaaaaaaatcattaaattgtagaatcccagaaagtataatgttaataaaggaaaaaaaataagataattgttagcatttttggtaaagaaatgaactgacataaaatatattttttgcattttaaataaaagcattacattaagaaactaaaatattactattgattagtaattcaagtgagaagttgaggagtaaaagtaatttcatatttagattcttgttatttaaagaacatcggctgggcgtggtggctcacacctgtaatctcagcactttggaaggctgaggcaggtggatcacctgaggtcaggaggtcaagaccagcctggccaacatggggaaacactgtctctaccaaaaatacaaaaattagctgggcgtaatggtgggtgcctgtaattccagctactcgggagactgaggcaggagaatcgcttgagcccaggaggcggaggttgcagtgaggtgagatcgcgctgtggcactccagcctgggagacaagagcaagactctgtctcaaaaaacagaaagaaagaacattaatgtctttgatcttctgatagtaattgaatggcattgttccttaccttctcaatgaaacaccagagaatgcaaactgcatataagagcttttctggagcttacctctgtctcatgtacttatcagggcttgttgtgcagaccactgttttacgtcattgattatgtgagtaagagggaagaaaggagagtcaagttacacccttggaagatgaaacttataatttccatgaagcttactttatgacagtacagaagttttcagggtactctgtcattcaggagtgagtgaaagtttatcacacttaatgacaccactatgtaagtttccaagggtagagccaaaacactgagaaaatagatgcatgtgttgtgtgattactaaaccttctgaatgtgtatttggttacactatctctttgctctttgagatcaacatgaatgccacctgctccatcaaaatgaaatgtgccatttagaggaattgtttcaactgtgggtctcacaggcattgcccttgtcctcctcagacacaggtgtgtttgcagtggtgaacagccattccttgtccttgctggggaagctgaccatcagtgctgcctttaacattgtttatatctacacctctgagctttaccctacagtcatcaggtacgtgtctcacacagcctcattcttcacacattctacactttgtcatccattcttgcaccaacagaggtgtggtactcatttcatctgcttctggagttagtttggggcagcagtaattcagcaagcagtttagggtgagagcttgccttggcagactgctctctgcctgctctgctaggaaaatgtcactttatggtggactgaattccttagtgtaagttgtaagagaagtactctatgctaggcatattctgtcacccaaacagtgcacagatgctattattattttggtgaattttatttattcagtcacccatcctgcatcacacatcacagacatggggacaagctccctattctcacagagcctacattttaacacaaaatacacacatttttagaagataatttcatatagtaataagtgaatatcagagttaaacagcaattgttaaaactgggttcttaatgaataggatatgtttatattgaaaagaataaatatccagcctaaatttcccttcataaaataagtctgaaagcaagaaacacacccaaatttgaaggatgggggtgcagctgaggctttgcagaactgcttctgtggcctgggcaggtattcgctcagccagctctttctcagtcttttagaggatcattccaaacaatccttctccttcccttatccatgcaagaagcttcatggttctttctgcctgttaatttaaaattatttttcctagtaagagagcagagtgtctgcaattggctagtaatttcctagctggtcctataacctactttacctggctactggctataaaactaggatgatgattttgtccactctgggacaattttgagagcaaatgtgggtatgaacttttcagctgggattacagagtgctgtatccctctacccaaaaccattaattatcattctctctccctccctccctctctccttcctatcttttttatgcctgcactccccataaaggtgttcttggtttcctgacagtacacgcttagtcaatttctatttatatgattgacctgttaattgttaattagttagttgagtttaaataaatgagcagccttttcagatcataaaaccctggcagtctgtaggagatctaaggcatgaaaatccatgagaacttttaacttaaaaatattcaaatgctcatttctatatcatcctttgtggatccactgtccaatatggtagttactggcttcatgtagctatttaagtgtaaattaattaaaattaaataaattaaacattcagttcttcatccttcctggctgcatttcaagcactcagtagtgcttgtgtctagtggcttccacattggactgggtaattatagaacattcctagcatctcaggaacatctagtaggcagctctagaacccactgttctctaggatcctgtgcttccacttcaggacatgttattcaaggcccgctgctgccccccaagggtctcttaattcctccgctagaacttactgatgtatttttacttatgcttttcaggaatgttgggcttggaacttgttccatgttctcccgagttggtgggattattgctcccttcatcccctcactggttggtttgtaccttctagttttgtttttcttgattctctgctttggaaatgcttatgctttttagtagaaagaggtgatgaacagatgtcatttaagatcagctgacacaaatgtgaaccttggcccttttagatagtattccgtcagggcagatggactcttatcgaggattcatttgcctccagtgggtctgattttttgttcatctggatttgttggagggtctgctaatgccagtgtgccccattcctgtccccatgaaaaagttagtcaactaataagtatgtatgacacttctgctgtgtgctgggctctatgccaagcactttctacatatcatcacatgcagtcctcatagtaaccataagaggaaggcattgttgttacccctgtattaaatatgagacatgctacagagaggttaaataccttcccccaagaacacacctcctggaaaataacattagaggagaaatatgtctctcactgtgtctgttaatattttttttttgaaactttctaacttgtatagtcaaagaaagggaaccagattaaatgacagccctaaaatccttcatcttaaaatgctcagattctgtgaaagaacccaggggacccctacgcaagtctctccttggtttgatttgtgactttccacagccaagactttttgaaagcaactagatttgatgtgggacttgtggacctgttctgtagacaactgttcattacttaggcaggtctctgaaatgccattataaccttttcattttctgaggtgcagtacatttcccttctcagagtatctctctccatgtctcatgattaattttagttcacaagacccttctcctaaaggagtcatgtaggtctgtgttttattctgcaaaatataggtactgttagagatatctgactttggatagctatcctacaacattataatacccagcactgtgtctctgttgcttcctacaaggttagaagaagggaaagtgtgtgttccccttgtttcaacaacaggcccacagtgctggacatatgtttgagtgtagatggctagagatgagagattctcctcctccctcttcctcctcatccctgtcttctgctcggttctctccatctctcccttctcctcccccttctcccttttccacctccttctccatcatctcttcactttgaaaaatcaggaaaaaattgtctgaggggaaatcctaattagtagtggacctacccacgaaatttggaagcctaaaccagaagatcataaagcttagcaggaattctaaaatgttgatcagctcagaaaagccccagagaaacaccctggaagcaactgtttttcatgttttctttgaatctctttgtgatgaaatgtttccgttttcctgagaatatgttttggatctctgaaacaattgcttgtatcaccagcccttaaccatgttcagtttagaagtttataagccatatgtatgtcgtagggttggttttttaaaagagtttttacacctttaatccctggaactctcagttacggtcttaaggtatataggatggtttggccaattccaggattaagaactttaaagttcatcatcagcaagtattttgggatgcctctgtgcaaagtgtgctcacctggaatggaagctgaactacaagatgtcctgtcagctctggccatataggcctgcctgctcagaggcagcctggcctcttctcctacagtacccaccccggacatgaaattgctgcttctaatgtacagactagtgctgtccttttatttactcactcccatctctacatgcctgaggaatcattctctgatttcccaggataattctttatgtggaaagaagtggcttatagtgttgtctagtgcgaggtcatgaactaggtggtaaacatgacagtttttcagtcatgagactgcttgtattacatgctaaggaaactaattctctggtttattttcattccactccccgcctctgcagaaatatgtgcaatggtctttaccattcattgtcttcggagccacgggtctgacctccggcctcctgagtttgttattgccggagacccttaacagtccgctgctagaaacattctccgaccttcaggtgtattcgtatcgcaggctgggagaagaagcattatctttacaggctttggacccccaacaggtgtgatatttttcttaattattataccgcttggatagtggcagttaatgaaaaaaagaaggtttgcgttaaattaaatagaactgagtaaaactgctggaaaacaaaagtgggatctaacagcagctgattttcagagaaataaggatgatcgatgattcattagctttcctagaatattttaggggctatttcttgggggaatgaatgtcatataaatacatttgtcagttgaatagctagatggtagtttccatttcagaaatgtcataacatcatttcactgcccttttcttctttcctgtttcagtgtgtggacaaggagagctctttagggagtgagagtgaggaagaggaagaattttatgatgcagatgaagagactcagatgatcaagtgaagagccccagattccccctaagaagcaaaggatcgtcttttatgcctctggctaaggcaggttcttccatgactcctaagagagttgtaaaaatagaggcttggcttgaatgtacatagatggtacctggcatggactgatgtttttaggcacagaagttggagaagagatttcatgaaagacaacatcactgcattgagagaatagttgttaatttgtttagaatttaagttctactcagaatcataacatctggcagaacagcccaaacccacattccaaagtggtaggctcatttgtttctagagatttcatcatgtcgcttttccttcatcatgatctaaataaaggcagatatgtaaaatttctcaccattttggtggggtaagataagctattattaagatttaatccttataccatgttggacatttgcccctatcagttgctcctcaggaatcttctggtacaggttaacatcagcattttcattttgtgtccagggaaaagcacccagaggtcatctgtgtgtcccgagaccctccagctttttcttagctgatgaaatatgagtcctcagcttggttcccagcctgctgattgacttgggctgctggtgccttgagtcccacagatgattcattaggaaaagccagatataccaaagcggtttactcagagtcaggggtgtagctctggctgcctgtcagctcccttggatactatattgtatgatttcttcctttcccactaatatgcacatccagaaaaatttccatctgagattctagtacttcaaaatcatgcatagtaaatgagaaagctttaagtagagggcagttaaacagtgacatgttgagcacctggaggaaaaaaaaggtgcagtttttaataagagagaaaatgaaattatctttgataaatttttgtttgttttgctttcagcattgtgccatgagggatttggacaatatttaagaacttcttgtcctagatcagccccaatctgtttaatcaaaatggaaggttcagtaatttcatgggaaaccttggtttttcattaagtgctaccaactttcaagtgaatcttgtatttgatttcctaaaatcatgtcttgaaaacatgttttctcatgaaacttgaatactatctcaaataggaatataaacctggagtcaacaagcttaggcagcattgatttaggtcactttcccagtgaggaaaatttctgtgttttcagaatttccatttctactaacctcttggagaaaaagaaattgaattagaggtaaatagaagacgtcactgtggctgcttctggaagtgctggaagcatcaccccaattggctccaaatactgtcatgttttcttgcacactgacttctggtttccactgtatcagtatgtacctttgtaattgttatttttatgtcttttatgcccttgattattagttgggctcttcataaacagaggccatctctactactgtttatttttccctgctgtgcccagaacattggcgtagacacagtaagaacctagtaaatattactgtttctagccatcagggagattgtggaactcctcccagtataatttttacaaactccaagcaaatctgacccaaactcccaaattgtcaagtcctgcttaactttctctggaaaatagaccccttctcaacatcagaataggaagagaggaagaacttacaaagacacttaaaagttattcttaaatggtggttgggcatttaaaacagtgaactaacatatatataatttttgattagttggagctttctttgtattataagagtaatatatctcattacagaaaatttggaaactataaatttagaaacgtatcacccatacgtccaacatcgaaagaaaaccagtgttatgactttgttccatttgaagactaattgggagtccatctctctattggcactgggttcgattgcctctggctaatagagttcaattagttctatccctgggtttcctttcttagctatggggtggaagataggagggggagatctacaatttgaatatgtgttacttaataaggctaggctggccatcagttgcttatttcagatgtgtcactaaattttccttctagatggtccttgagcaaaacttaataattactgttttttatttccactgcctttataaaatcaaaattttctccttttgataaaaactgttgaatactattgatgtagagaatgtgtatatgtgtatatttgcattgattaaattattggaaaacttttcattgacaggtaatgtattttggttgtgcggatggtttgtaaaaagtatcctgtttttttaattctattcaaaattaaaaattttttttcctaaaataaagcaagaaaaataaatgtaagatatataagaaaccccagagtttccagggtgaaagttcacattagcagcttgtccaaaatatttacacctcacaaatattttgaaagaaaccatgttgaaattttctgattttgtgagttacaaccacagcccagtaaaaccaatacttgttatttggctactttcaagcaatgcagatattctttagtatttaaaaatgagcaaataaacaaaatgaggcaaataaatgaagaaaatgagtttctgagacactgtttaggtaaccataaatcagacagatatttttatggtgggcaaattgatgaagatacttttagtaggtgatttatattcataacaaatacatattgaaataattgtcactactgtatcagaattaaaaaccagcttcacattaggacttctccatacaaatgctttatcattggttcttaaattggaaaaatatctataaatgattacatttttaagctaaataaaatgcagatattttggcttcttgtgaatgtaataaagaatcataaaacatagaccttttttttgttctcccagaatgtctcaaaatctacagtagtagctttgacaagttgggcaaatgcagaacctgctagtaaagttaagtaatatgtgggacaggggttgtaggaaagttgtagactgatggacacaaaagttaactatcaaaatacttttagaatgaggaatatgcaaagacaatgcattgtggaaaatccatcaatgtagtacatcaaaggagaaagagcttatgattacctcaatagaaaaataaacattatttgatgaaattcaacatccattcaaaataaaagctattagcagagtaggaataaaaggatgcttccttaataaaataagagatactatagtagatatggtaaactggcacacagcatctcttcaccttcctggtaccttggccttcagcctttttttttttatcataacccacagtaagaaatgcattttacatattcatcgtgtcatacttccccacctacaaatatatatgtatatataaaatatctatgaatcataaaaatgtatatattttatgcaataatacttaatcttgctaggcatactgataacttatgttctatttcacttttcaaaatgccatttataactcaataaatggatatcatgactcgctaataggttgcaacccatagtttgaaatccactgctctactctatcttcttatactacagaagctttaaagctaaaatgtacattttctgaatttcttgcagataagtttaccccttgcagccaggtgcagtttggtttccttcaatcagatacaaatggagcttggaaggtagaagcaaggtggaggccatacttttgatgagtatgcttttttctgctcagattcacagtgctggagccgtttggtttctctgaggcagtatcagccagagatgttgtcagttgggcaatactgattaaaatcttaacaagattttttaataaacctggaataatacttctggtattcaaatggaaaagcaaagatccaaaaatattcaagacaattctgataaagaagaacaaacagaagggacttgactttctagatataaaaacttatgaagctgtattattggtcagcagtagacaaatagatcaatagaacataacagatttgttaaagatagcatgacacattagaggaaaaagtgaacaattattgatactaaatcttctccccataataaaaataaattccaaatagattgaaggcctcaatgaaaaacagcaaaactttaaaactatttgaaaattatagaatattcttatgaccttggaggatggatagatttatcagacaagaactgaaaattataaattattttttaattgatatatttgacttgatctaaatttaaaacttgtttctgtatgactgaacatgctacaaagttaaaaggaaagcagcctgggcgcagtggctcatgcctgtaatcccagcactttgggagaccaacatgggcaaatcacctgaggtcaggagtttgagaccagcctggccaacgtggtgaaaccccatctctactaaaaatacaaaaaaaaagttagccaggtgtggtggcatgtacctgtaatcccagctactcaagaggctgtggccagagaatcgcttcaacccgggaggcggaggttgcagtgagccaagatcacactgctgcactatagcctgggcaacaaagcaagactccatcttaaaaaaaaaaaagaaagcaatagattagggcaacatttataagcaataaggattaatatccagactatataaagatttactgcaaatcagagataaaagtaataaagtttacaaaaactgtgattaggcaattcacgattcacagatgaaaagatgctcaacctcactacaggatcagggaaatgcaaactgaaaccacatgaagatatctttaaaaatccattagattgggaaaataagagaatatcaaatgttaaagctatgaagaaaaaggaatttagtgacatcctgatagaagcataaatttattcatcaactaggttgtcattagcaagtaaggctgaaaatgtacatagtctaggattcagaaattctgcttctatgtatgtatcatgaaagagtattttcagaaaattttactataacccactgtaaagaaaatgttttatactgtgacacacagtacacacacctacatacatacccacgtgtgtgtgtgcatatatataattgaaatggtgttataaaacaataccttcacttaatatatgcactgcattatattttctgttttatttcatttcataaggaatactagtgaagacacacaaaaatgatttcacagttttgaatggatcaaaacatgcagttggaaaaagtgaaacatactacccttaatatttgccttggtacttgcctgatatacatgtgtacaagagatttttacagaatgttcattgcagcattgttagttgtaataaaacaatggaggtaaataccttcagtagggaaatgtatgtatataatttcatatgcataggatgaagtaaaaacatagttctatgatttaggtggttggatctcaataatgttgaacaaaatgttggcaaatttttattggatcaaagtcctttcatgtttaaattttccagtaaatgattggagtacttgctaattaaagggatttaaatgcttttcatgtcatactttaaagtcaagactattgatattctgttacaaaaatatagaaatctcactcttattcctcccagatgaagaattatccctcttccctatggagaaagtctataaacttgcccacctgcaagtctcaatttctcttgaaaaagagctttgcatttgtggaaacatttagacaacttttcagccaagactctagagctgtcttataaagcttagaaaagattacatatttattgaaaaatgtgaagggcagatgtagctaaattagtattaaaagaacttcagtctagactctgcagaacaattgattttgaatagaattgattgatagagttgctttgcttcaaaatataactttaagaaatggaataaaatgattgtgcatgaatgtaaaagcacacagtcaacttggaggactttaattaatgagtgatttaccagtatgtgtgcagagcttctagaaaccatggaagataaagcattatacaaaaggaagccattaatagagtctgtaaaggtcagccttgtggagcacggcaccacaggaggagtggatccagagaggcagaggcaaacagaagatattcactcaccactgggaaacccttaaaaattggtgaatatctgtcacatcagatgattacagctttagaagcgttcaagctaagcagttcttggtgatgataatacaacagattaatttgcttcctggagtcacttttatagatgcatgtcaccatatcagtgtaaaagaagaaggactacaacatgccttacactgtctacaactagggtgtggtttgccaaacaactccctttgccctctgatgctttcagtgggtactgaatgacctgaggactacatcaaatactacatctcaccacactcgtgattctttttgaggaaaacaaagatcaactatgatcagcagatgccttaaggcctcacacttacacacacacccccccccatttccttgataatataaaatagtaaaacagtgacctgaaataaattgtaatagctataatatgcctgtctctgatgcaacatagttagattggaaaacttaattccgaagttgacagggaagaatattggcaaagagcagcaatttactttcaaataatattctttccaaattatttgttgtaattaatttttccatgatagtttcctctgagtgggtactataacaaaggaagagcaagaagatgaagagtattttgcttttagaggaagaatggcagccaaaaagaccagtggttaggaaatgccaatcaaaccaacttttctttaaagaatactcccaaaggccttctcagttttcgtaagtaatggggtcttgcattggttttctattgatgctataacaaattaccacaaacttagtggtaatttggacaagatgaatttattttatgacagctctgaaagtcagactacgaaatgagtcctaaggggcttgaatgaagatgtcagcagagctggtttctggattctttttttgcaataaaaggtaacatccacaggttctggggatttaaatatggatagctttggggaggaacattattcagcctgtcacaggtgtcttaaagtgtgtgtcaaaagatcataggtagacaagacctagtggagtcatcggtgtatgttattaatttaatgaataattcagtcatcacctggagaagctagacagaaatcatgggtaacagccccaaatctgcatttattgttgatcttttctaactatttaagcctgaggtctcccactgagacattttgtcacttgttgtttgaaagaatacactgcttacaaaataatttaaaactcataagtgtttttgagtttcatttgttgctgtatcttaacagtgttttagcagttatcaaaatcagttaatcagttctgttattacttatacttttgttatgttctctgtaatcaacctatacttttccattaaactctttgtttggtttgttttgagacagggtctcgctctgttgcccaggctggagtacagtggcacgatcctggctcactgcaacctccgcctcccaggctcaagtgatcctcctgcctcaacctcccaagcagctgggactaaaggcatgcgccaccatgcagggctaatttttttgtagagatgaggttttgccatgttgcccaggctggtcttgaactcctgagctcaagtgatgtgacagcctcagcctcccaaagtactgagattaccggtatgagccattgccctcagccttccattaaagtcttattgtgtcatttaataaatgatgatgtcttccctactaggccataagctctacaaaaacagggtacatgtctttcttttttccaacccatagctctgggcccaatgtatcatgggcattcagatattcaccactctttcatatgagctctattgttacattgaactcaaaggcaagcaaggaccttatcttattcatcttagtaaccctaaaaactagcatggtatctgggacacagtagtcactacatttctgaatgagtgggtgcccagacacaaggcaatcacgattagtttaactagtctattcagcaatgtactcaaaagggatactcttccccaaaatcaatttgagaaaaggacttttgattatttatgtctgagaaagctgcttatagatactagaaaaaccttcatttcaccttaaccttctcattatctaatctcacaattttgtttaaagttgtagttaggatgagaatacattcaagagagaactgatcccttttttatagggttaatgatgtctaccttgagaaaggaggtaggcaaagaaagattaattattaaataataatcttgtccgtgtacctatagacttattaccatagtaccattcagcctactgatttgtagaatgaatgaatttggtgatttttaaaaattgagatatctccctgtctcaacagagaggcagtctatcctatgatggtattctttggatgaatttttgacatagtcatcaatattgtaatagtcaggtcttttaaaataattcatctaatggaaacaccatataaaaggttgagaaatgatatctatttggttctgggcatttgaggatcatcaaacacattaagaaaaaaatcattaggtgtttgatcaatgtttaggtttttctgtttgctagataactcagaagatggctctcatatgttgactaaatataggtcacctttgtcagaggaatgctttgctagaggaacgaataaatagctgaaaacaacagagagtaaagcctaaggggaaagtttgacaggctggttgtatttatgtattcatcctgccacatcctcgaaaaaggtatttattgttaagtaggttcaaaaacatcttcaagaccagaaaatgccttcggacgccactgggctgttgaattccttagttattgattcactaatgtcatcatgaaagaatttatgattttcccaatccagtccaccaggagagggaaggccttgataaggatttagatgataaggagaagaattgccaagattgaagacccagagcaacagcaaagaattttggaaaagaaatttcaccaaagagtaaagttagtgttattttggttatgtggaatattagagtgaattaagtagaggaataaaatcactaataaaattggttagcaaaggcgtcataaaatcacaccaatgagaaacagagtgctaacctagactttgtatatcttcagtttcctttcaagcatttcaaacctccccaattagcttcaagtttatccttaggtagatgtgtacaaaagatttcttcaactactttctagtattcaagatattatttaagggaaaaatcacatttatttattcattagatattttggtaagtattctaggtgctggattaaaagagagaaatggctcacgcctgtaatcctagcactttgggaggccgagatgggcggatcacttgagatcagaagtttgagaccagcctggccaatgtgttgaaaccctgtctctactaaaaatacaaaaattagccggaaatcacctgaacccgggaggtggaggttgcagtgagccgagattgtgtcactgcactctagcttgggcgacagagtgagactctttcttaaaaaaaaaagttaaaaaaataaaatagataacatgtcttatttttcctcaggctctgtttaatggtggtgatgatgacatgatggtcatcactaccatccattgagtacatgcaccaagtcatcatgttaaatgcattccatggttattatgtcatttaattctcacagctctattaggtggttttataatccctactttattgatgagaacaatgaagctaagagacattacataactttctcaaggtcacagtaagtggcagtgctaggtctagaccctatctttcatgtgttaaagcctagcacttatctgccccttctgccctgcttcctgtgaaagagttaattcaagagaaatagtgtcacttatttttcaaagataattagaaattgttccaacccctccctagttttcaggacaagaatgcaagttgagaacagacactggtggaatcctcatgaagccaaggcttggacattttgattaggctccttctggacgaaggccttttaaagaaggattctaattagttaaggattctccctgtattttataaacatttgagtttttttctccagaattagtggaggaatatatttgccagtcaataatatgaattgagaagtttgtcaagattcattaatgggctgaatccagttaagatctcatagagaagatggcaaaattcttctccgtatctctagggtgccatttgagatcactttatttgctttggggaaaatattaccctgacattctgccaagtacattcaagaaatattcactgagggcctcctgtgtctcaggcaccatagtaggcttggtgctgtcgaagatcagtgagctgggttcctcaagcctgagcctttccagagtctgacctgaataggatatagggaataggaagtaggagggattgggggaggggtttgaagtatctcaaaggtaaaagccttagtgaaattagagggaacctcagatatccaagttttggaaactagctagtaacagaaaataatttcttttaaggaagaatttcttaagaaatgatatctcaggctgggatttctgctagagtttcatggaaatccaagtcacaacttctaaattattcttcaccccacgctttaattatgtcactagctaaaacctgttacctgagagtaggcttgctgctgtcaggaaagggatgcatatacatatcctcttacctgacacacagtaggcccattatcagatcagccacgtttcaaagcccagagtaaacaaacagggcttcccaatcaccaccaatttttcttttgcattttcctcattaaatttatttgatgcttaataacttttagctttgaaatagttcaaaatattccccaaatatattgtaagtactctctgaagttttcataatatcatgtaaattaattttagaatcagaaacattctcattttcctcatatgtaacatgaaatgttaataataccatctttattataactgctgtgatgattactaagtgacatgtatgtaaaatgccaactgctatgtaatagggcttcaataaattataccccttaggaactgtcaaagattttaaaataagaatttaatgcacatttatgtatttggaagaagcgtagcatttatgtatttgtaaatagcaatgagagaggtcccttttattttaaaaaaacatttttaaagtgttgttttttaaagggacatctcatattgctgtactttttccaaaaaatgaaatcgacatgaaatgtttcaagaaaacattttcacttgatccacttcatttgccaactaataatataactgaagaaatgtgacttttgtaagattatttctcttgttattgtccttgaagatctttcgatctttcatttcctatagaggaatgcctgtaatctgccttctcctcccacttttctgaagaatacctcgagcaaaactggggaggaggccatagcctccttgtgggaggaattggagggactacatgaaaaaacaactttctgaccctaaacgaaagaccttctctcttctgtttttggaatctttttgcaggggtgagtatgggagaaaggtaactggggactcgtgtgtgtgtgtgtgtgtgtgtgtgtgtgtgtctgtctgtctgtctgtctgtctgtgtattccatctagagctctacaagggaacctaggagagaaaccaggagcgctggctgcaccattatctagggagagaaggatcctgaggattctggctaagggtgccttcagggaaagagtgcgatctgtccagagtgacatttgtgtttaaattatggaaacctaaggaaaacttaggtgaatgaacagaaagcaaattgaattgcacattatatacaccaccctttaggtggatgggaaagtctcattgttttaaggacaaataaattttaccagactcagttctacctagttgttcacataaagattctatcctttgccctc

SEQ ID NO: 305 - DNA, 23517 bp, Homo sapiens
tacttgcccccctgtatccagcctcatctgccccacaggctctccactggtagccccattaccctccaccactctacctctggccccccaaatgccttattctctaaccttaggaattctacagtaactcatttccctaaagtcccatctctacccactcagcccctgaaataagaaacagtcatcttagccatccccctgcctccatgccagaggatccctcttccccctaagaaagactcctagagtctacaggcaccatacgcctcaatttcctggccctgggcttcactgtcctcacatcttggaagttcttccttctgtaatctaatctaaatcttttgtgctgccattctgaccattttctctctaaagcagagaagaattgaatagtcaagttaaatataaatcagccctcagtgtctccagaaatgggctttttccagcctgctgaggacctggtgctcacagccccctccttgacatcaaatcccctttcctagaagccaggaattctgggtcctgggaaaaagaaggaaaagatcagggttgtgggcaccagggtcccaggggagcctggctggccagagggaggaggggctaggcaggaatgcaaagagttggctctggcctcagacacctgatcctggcctgtccggagggccgtcctgttggcagccagccccagtgctccccagagccagctgcgtggcagcatcgagggcacagggagggggagggggaccctgtccaggaggccaatgagacaggtagtcaaggcttcctttctttctgggcttactgggctctgctctgaatcacaggtgctcaccccttatcccagagatatcgacagaaaggccataagacacacacgcctcacccatcaacattggcgtctaccatccccacaccagcaatgactggaccgggctggccctggccatcttcagctcttcccaaggactcaagacaagcatccatccccattcagggtctctaaagtggtcctccacctttcagccctatctgccctcccccagtcacttcaaggacaaagagattcctaccctgatgccaaggaacacaggtgtcctgccctccagcctgtagccttgaagccccaaatctccttgttagactcagaagctgctgccccaggcatcagctggccccttcccagagacactcagagctccagcctgactccgaggacccaggcatcaggactcctcttacctgcccagcctggggccgcgctcagccccagcaccagaggtaggaggaggaggaggcgatggcagcggctgcaccgctccatggctgagaagccgaaacgccgggtcccagggacccaggtcggcctgagacgctggatgccctgaggctgacagaagacagggagcagactatgagcctcagacgccggggtcccagggaggtcagaggctgcgggcagcgacagctgtcagcggcccagctccatgcagcaaggcgccgtcggggctcccggcactgctccctcctcggtggctgccgcttctgtgtgtccccggccaccctggcgcccagagcccccacctcgcccccgcccccggcccggcccccgcctccagccgcccgcccacagccaccgaagggaaaccccaccctcagtctccacctggggagggaggcgggaaccctccctctatcgctcgctctctcctgccccttgtaggtctcaacggcctgtaccctaagattctcttttcgggaaccccaatatcttccctagccccttccttttctaggacccaaacgtccagtcacacacactccctcccattccctccctcttgggggcccagagccccctttcagcagaggcctgggcgggatttagggcacagtgggagggggagaggcgggcctgggggtcgcagtccccaccccacccataatcaggtctccataattacttccctcaccccgccccgtgtaattacagagccgggccggggcgggggtatttatagacaaggctatagatagcgacgaactggggcgggggatgtgggggaaggtgttctacggagagcaagaggccagagactgggacccaccgacaaacacaggatagtcaggtccaaggagatgcaaatgggggacgcggttagggagtcccagagccgaggtagagggggagcagtggtaagatgagcgagcagtcgactctggttggaagggtccagggaaatggggtcactcggggacgtgggccgcctccgggcgggcaacgcctgagaagcacgcagcgctcggcgcccagtgcgcccccacgagcgggcacggcgccgggtctgcccggagcccgcagcgcgcccggagggaaggccgcagcgagccgaggcgccgccgcccgctggcgcggagagggcacgagcgaacaaggcgcctttgagaatccaccgcccccccttcctcctccggccggccccgcccccagcctggcacaccctctccccccctccccgacaaagcttgccttgtgtcccccaccctgcgtgcacctcttgggccccacggaacctcggcggcggcgtccagggatcgcgtccggagctcccaaccggataccccccccaagcccgaaacggcgctgcccatcctcatacagtcacctcagtccagaaaacagcgattttaatttgaaagcgattttatgtatgagaggggaaaggagccccaaagagaagggacgcagggcaaaaatcatgcagccccagcaccccacctctgcgggctggccacctcccctcaattctcaggccaggatcctgtgtccccagcctatgctatgtgcccagggctggaggagagctgtaaagggaaggcctccgggactacactcgtgaaaccatcccctgtgggggccctgtcctcacagcccaggccccttccccaagttagacaggaagagatagggggggcggcgggaagctgggaaggctagtgcttggagagccctagggacaggccatttcagggccctgcctttcccaaacacccacctccaccactggcatttcttagtcaacctgggaaagtacagtacttctttgagtctaactgcaagtctctatcctcacaggaaattaaaaatagcagatcggttcctacatctccaccagccccttcaccaccaccaccaccttttttatatttcagtctgactgcagaaggaggtgaagtgtaaaaagagactctggacagtgacagggcccctccctcttccagagaggcccccatctgccaggtttgagaggaggaaggcctgtcagggccctactctcatgtccatcagcttgggaggcctgccccccagtatccacctctgggggagttccccatttccactcttcagatgggaagcaaaatgaggcaagatgagaaggaagcaaggtcctggaggcaaggccagtgctttgtgctgggggaaggacagagggtgagaaatcaccccaaatcatgggagaacccgacaaattcagagactcaaggccaccgaagagagacaaccagtcctcacaggtatctggggtcccttccaacttgggatatcaagcagatcccttggagggtttatgttcttggttctgccctgtacttctcaccccatcaaggttctgggaacatggccccccaccctgccccagggcttggagtccctcttggatgtgtgctcctccagtgtgagaagcaccacgtctgggtctgagctcaggccagttgatggggagcctcaagcatctccatgaggaaggtgtcgatgggggtgtcaccaatgagcttgaagaaaaacagatgctctagacacttaaggccaatggaccggagggcaggaagacgtagcagcagcttggcaaacctggggtggaggtgggagaaggggattgagagctggaagcacacgggccctgaacacatcctcatagcactccccacccccaagggagcctcagtgccccccagccccatctcaccgtccctgctgctcagggtacttctgtttgcagtaggtctccagtgatgcatacactttctcccgcaggacctccacctcactagggttggagaggcccttggcatctgggatggcagggaagagaggaggaagagaaatgaagacaaaccaaatcaggatggccatgcagatgtgagccacaggatgccccttttgggctgcacttgcttgccctttaccagaggcctggcaagggaagcagggcccactgggtttgtgggatggatccgtggatgtgggtttttcctcggccagttgggagatttccaggttgagggtcttactgagggggatagctgggtaacttaggagtctcggagaagaggaggctccaaggttgccttggccttgagagacaaaggtaatcctcctcttacctggattaaacagaatgattgccctcaggcagccaagctctgtcttgtccatcctcatgtcacgcattttggacactagctctgtcagcaccctggagagggacctgcaggtcactcaaaggtcacagctcagccagccttggacacggaccagcctatagccccaccccctctatctacatgccagcctagccgagggccactgaccgatcaaagatggctcctactcctgctgaatgggctgagttgcggtgcacgtgaagacctgtggcaaggaggatgccatctcgaacatcaatggatcggtgtgagaaggaggcaatgaggagttcattccagcctgggtggggcagcaagggtcaggagccagaaatcaggccaagggattcaaagcacatcagtggaagagaaggagaaaagaggtggcgaggtcagcaagtttggctccctgggtacgcaaggtaaggccactggggtcactaaagatcgggaagtcaaagaggggtcaaatgtcaagaagtcaaagggatccaaggtcactgacctgcccgcagcaatatgacctgatcatccagaggcaaggaggaaaagtgtgggatcctcttcgcccactcaacaagcgtgaatagctgtttgtcagctgcctgacagatgttagtcacagggtcatttggctgcaggggacgggggtaagagttatggaagattttgagatatgctgggagcccccttgtaagaggcttttgacaccccctccttacatatagtcttcctgtgagccccatccaaaccaatccctgtaagtgagtcttctcttctggcattagtgcaaacaattatttatttgggacatgcctatggttctgccagtgggttgtttggggagtggagacagaaggagctatcacatccacctcagatgtttgaaagaccttgtttggcagcacctccagtcccaagtagtgttaggaaggttatgaggggaaaggagggggaggggatgtagaacagacctagactgcctcccccaacccccatcacgaaggagagtggattgaccccaacactcacgctgctgccgctacccccggttcccccaggaccctcaacgccctggtcactcttctgttccacagcaagctctgcctccaggatcctgtccacaggcatctcctcgggggctcccccagccccctccccatccccatccttgtcctttccccgctgacgctcctcctgtaccgctgcagggggaagggggagagaaaaaatggaaagtcagcagccagccatgaaggggttccacaaatatccttacggcctcatcaggatctcatggcccttgggagatatttataggaattggggaagtcactagaaagggtggactgggggcagccctgaaggaagggttataaaagggcaggtaagtcagtcgggaagggtgaggtaggtaaaagaattagggaggaatttaaatggagagcctactacatggttaaaaaaaacatgccaagattcaacctgagaaagctgattgaaaaaaaaaatttttttaaataaaatatgccaagaaacatgctaagcacattttaccattcactcaattatcataatgatgctggaagcatttattctcatttttaagatgaagaactcggggttcaaagagattagtttgcttaaattcatataatacatggcaggtcatacaactgactctaagtgtgtctgagtgcaaatcttgtgctcttctgactcaacaaataggcagtgaaaggagcactggcctaggtctttgaagatgtgggttctgatcccaaacctgcctgccactcctttgttgcatgaccttgggaaagccaagcctcaggctcatcttctctaaagtgggtgttttgaccaagatatgctctaaagtgtctctcagaatcctaggaatctgacttaagaagataagatggagacacagaagaaggaagggaagccctgaggtcttcagtaaagtctgtaagcttaagagtgcccagtcccaggagttagaggaaagatcacagataacaggagacagagaccagagaaggtccatggaatcagaggaggaaccactcaggttagaaatggggagacagcccatcatggctaaggaaaagttatcctatcctaggatcagtctagggaggggtcatatgtgcaggccacagaggcctaaccattaagaaggaaactcaagggccagaacagggtaacagggaggagagctgcgaagggagagagaaatcaaatatcgccctctagaggagagagagcagtccacccttccagagaggtacacagtctgagtgggataagggagaagggcatgtggtctaagacgcctgggcagggcgggtccttaccctccctcttcatgccagtggccaggcacttctgatagcggcagtactgacagcggttccgctggcgcttgtccactgtgcagtctttgttgtcccggcaagagtatgtaaggtctttgcggatggtgcgtttgaagaagcccttgcaaccctcacagctgtaaaccccgtagtgtttgcctacagggaaaggggaggagcaataagaaggttgcatggagacaccttcaccatttagtctgtttccaatctccccctagcaaaacttaaagtcctccctgtttgccaaatacagagatagggaaccaggagctgagtgatgatccagtcccagtctcctcactgttcagaaaccctacacgctgcttccttttccctctgaccttccccccaatcgcgtcctacatctcagcttcagcttctttactcccatcaggcctcccccaggtcacttgctctgaccaaactccataagccctgggaatcccacaggtgatgatacatggcccagactctccctctctgttcatcctctgagccacatacctgagcttctgtccccgcagattgcacatagccgtttgccagccccagggccacctggagggggtggacagtgcaggccccggacccctaagactggtggcttcacatcttcaggggggccagacccacccccagggagtgacactgttgagttaatctgggatgggggaaatagggaagtcacaggaagacttattgggaagcagaatgtcacagaagtgatggaaatcattccctaccactaagcaaggccctgcaatgcacattccagaggctgtcatttacactgcagtctatgtgaaaggccatccctggagcacaaccccaaagtgaataaacaggccccccctgaaattgtgcaacacagtgaccctgaagggcaggtgtcttgggaaagcagatgggatcaaaagggcagaaaatcagatagatgaaaaggacatcaagaatatcagaattagccgggcgtggtggtaggcacctgtaatcccagctactcaggaggctgaggcaggagaattgcttgaacccaggaggcagaggttgcagtgagctgagattgtgccactgcactccagcctgggcaacagagcaagactccatctcaaaaaaaaaaaaaaaaaaaaacacacacacacacacaaaaacaaagaatattagagttcttttaggggaggaagcatgcactgaaagatcagtcacctcaggaaaggcaaggggtctcataaagaccacaggcctgacaaggttagaggattggaaggtcaatgggccatggggaagttcacacaaggatctggggttacaaggaaaacaagaaaatgaaagtggccaggcagtaagttggtcacaacctctcacctgggggctgctgacaggcccggagaatcctgggggagctggagggggcagaccaggggaccccatggaagaactgatgactggaaagggagagcccagtgggggtggtggcatcgggggtgggggtggggccccagagcctccaagggatggagctgttgaagggggtaggggtggcccaggaggagaagggggagggactccctggggaaggggatttggggaggagctgtctgggcttcgggagtctgagggaggggtatgtacaggcacacagacacacaagagacagaagagacaaaaaaagaaaatgagtcttcaaacatccaactagagactttaattctctaataccccaccgtgccggacccagcccactccacccatccccaagttcagagacaccctgctgtcaaacaacagtgtaactccggctggtccgatggtagtgggttatcagaacttattaacatttgtgtcactaaaattggtatacaacctcccactgctatatttgactggctaaaaaaacccaaaaacagcgtaactcctcattgtggtgagaggagggagttgacaaggagaggaggatagttcaggtgaggaaaattttccaaccaatccatttgaatgaataccaggtcatcccaaagccacacctgtctcgtgggtggggcagcacgtggggtagaccatcgagcccctctattcccagcgtaaagccaggtagccagagcgtgcaagggaaagagacaggcaggagagacccctcctaagacgcaggatctgcctgtaaacgcccaaagtcctgaggtttaagaggaatcgtgcccttcccaggcccgcgacctccggtgcccaaggcctcaagcggtcacagctaggagggcggaagctccccttccccgccccgccccgggggggagggtgctaaggccctcgggagggaggggacgcgtgtttacaaacaagggggcgggagcgcaaggaaaagagcaccgggggagggtgtgggggaggggtcgcagataaagcggtcactggctcgcctgcccttctgctggggcactcaccccgcccgctgtcgcccatcccgtcccgtccagcctcccctggctccggctccggggtttgttgttctccgcctgccaccgccgccgccgccgccgctgcgggatccagccagggccgtcgccgccgccaccgggacgcgaccccacaatgcatttcttttcgcacccccaccggcccacactgccctgcggcatgccgctgagggaggaagggcgggcgagcggcccaagacatgatccctggctgagagtagggataccgaagaggtcccagggattcccaaggattgatcggaggattagctgagcacgaggaagcccctgagagaaagactctggcctggattgggtcgaattaagcccgtcgctctgctcagtaccaaaatgacagcgccaatgtggcagccatctttgtacagacgggaagtctcggcgcgagttcccgccccctcgtctagttggaaaccgaggaggcggtctcctccggcctgttagcccgcctcgcccaccctcccctcaaatcacctccacactcgcgcatgcgtgtcagtgcaggatggattcgtcgctaccggagtgccgccatattggtaaaggcattagggcgaaggtggaacggaacttcctgttctcgcgggatctaaaggcgggactgccacgtccaagcaaaccgggaaaggagaggatcccggagccggtgagaattctctgttttttctctaccatcctttccaggccttttcctcacctaatgagtcgtagagacgagggcccagagagtctgtaaagtggctggtgaaagattagtgtcccagggccctacatccgggaggtggttcgggataaagagaactagtcttgggaacaatgtaggtgggaacttaagggaatgggagagcggcccatagaggtggacggagggcgcgattggagtaaagcggaccctgtgtaggtatagagttgagtcaagtggagtcactgcctctgtccctctggtcagcgtgatggccagaggcctgggggccccccactgggtggccgtgggactgctgacctgggcgaccttggggcttctggtggctggactcgggggtcatgacgacctgcacgacgatctgcaagaggacttccatggccacagccacaggcactcacatgaagatttccaccatggccacagccatgcccatggccatggccacactcacgagagcatctggcatggacatacccacgatcacgaccatggacattcacatgaggatttacaccatggccatagccatggctactcccatgagagcctctaccacagaggacatggacatgaccatgagcatagccatggaggctatggggagtctggggctccaggcatcaagcaggacctggatgctgtcactctctgggcttatgtgagtctccaggggatgggagagagaagggctggttctggattgttgggaaactccacagtacttgaccttgactctccctcaccaggcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttggtaagtaacctctgacttctacctcaaatctaacctatttcgttctttggaggaaaagggttctttctcctttatgatccctgacctttcgatattcccccaaatacacactcattgtgtcagatattccctcatctggttttccccccttcttccagaacctcattctcaccacactctggagcaacccggacatggacactcccacagtggtgaggaagagacagatggggatgggagttggggtgctggggaaggtccgtctctccctattcctcacctcccgcacttgaggaggaggagtctggaatgcacatctcccttaatgtctcaatgcctccattcccaggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaaggtgagcccaggaacaactttcctgaaagctgacttgcctgcctcagaatctcctcatcttatggccctcaggagggagaggacatgttggaagatctgttctccactctgaccaactcttttcttccctcagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttaggtaagggccagagttggtgataaatttgggcaagggacatcatcacaaatcacatggaatatgtgctgtgggtaatggcaggtatctgagaaacactaaaggactgggtgtaaagtggtctctgaggggaggtgtgagaatagctgaccaagactggaacaagtggtgatggaagcctctgatcattttctcttcttgtcctgtacaagacctgcgtgtgtcggggtacctgaatctggctgctgacttggcacacaacttcactgatggtctggccattggggcttcctttcgagggggccggggactagggatcctgaccacaatgactgtcctgctacatgaagtgccccacgaggtcggagactttgccatcttggtccagtctggctgcagcaaaaagcaggttggtgatgtctgccaaacacagctgcctcaaaccctttatctctcctcactcaccctaaacccaaacagcctcttattagttccaaacaattcatactgtcattgacaagtcctctagaaatgagggggaagaagttctggttactttgtcctttagctcagtatttcttaaactggtctataaaccatctgaatggtttagtggagtcttacacacacacgcctactcaatcagaaagtctgtggaaaggacctctgatctcttaagatttttcagaaattgtctattctagactgctccctcttctctttttattttgatgtttagtttccaaatccatgtcccctatacctataccccaccagccacttctaaaccactgataatctttagctattggtgagtgcctttttctcttttctgcccatcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcctgggagaatggttactttggcattagggccttcaagggctggcagtcttacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgccccacatgcagtctttgtctttttggggggaatggggccccttgtcttctccacacccggggcccctaagcagcagtgtcgggccacgccccctcggtgggaggtcggcctgcgctggtggccgcagatggcctaaggctggcgggcctttgattggccccggctttgcccttgccacgcccctctgcgctgggattggcttagtgctgggattcccacccacccacagcccgccatggcgtctcagctccagaaccgactccgctccgcactggccttggtcacaggttgagggggttctttccccgggcggtttggggtattggagtgaggtcaggggcgtgcccttggagtgcgcggccgctgtgacctctggccccttacccacattttactttctgccctgtgacctctgatccctgccctctcctccccgtgcccggtccggcgtgttctgtcctacctcaggtgcggggagcggcatcggccgagcggtcagtgtacgcctggccggagagggggccaccgtagctgcctgcgacctggaccgggcagcggcacaggagacggtgcggctgctgggcgggccagggagcaaggaggggccgccccgagggaaccatgctgccttccaggctgacgtgtctgaggccagggccgccaggtgcctgctggaacaagtgcaggtgaacgctaggccactttccccctctaaagctctgatattgcctccactgccccggctttttgtggggggtttttgatgcgtaacctccccctcccataggcctgcttttctcgcccaccatctgtcgttgtgtcctgtgcgggcatcacccaggatgagtttctgctgcacatgtctgaggatgactgggacaaagtcatagctgtcaacctcaaggtggcgatctctgaacctgcgacgtttggcccccttagcctggggagggagttggaggagggctgtcaccccagctgatcttttctcccttgttaccctttcccgccagggcaccttcctagtcactcaggctgcagcacaagccctggtgtccaatggttgtcgtggttccatcatcaacatcagtagcatcgtaggaaaggtcaggttgagttggacgaggtcagccagccaagtggtatagagaggagaacccctccttgagactcctgactcattccacatctctgactcacctataggtggggaacgtggggcagacaaactatgcagcatccaaggctggagtgattgggctgacccagaccgcagcccgggagcttggacggttggtcagatgcttgagggtgctggggagcacctggggggtctgagggaggtaccagcattcagccctctccagaatcggcagccactctccttcccacagacatgggatccgctgtaactctgtcctcccagggttcattgcaacacccatgacacagaaagtgccacagaaagtggtggacaaggtaggaggctgtgggtggagggcagaatcattcagagactcaatctctctgggcttcacagagagagagagagagagagagagagaatactgggcacagttcctggcaaacattaaatattcaatgaatgtatgagaaatgaagacaaaaaagggtcacagactcagtcttcaaaaaaatccataaaagaagctttcacccacatgagtatttccttacagattactgaaatgatcccgatgggacacttgggggaccctgagggtgagcactgaatgtagtggggtccctgggaagggggcctgaatgaagagatccccaaagtttggggattttctaggggactggtggttggtgtctgtggagaggtttgtggggagggatgtctttggtgggagattatggctgttttgggtctatgggagtgagcagaattctgccctctccccaccattctcatagatgtggcagatgtggtcgcattcttggcatctgaagatagtggatacatcacagggacctcagtggaagtcactggtatgaggccagcatggggagggagagggcagagaagtagaacccagactatatgagaaagcaagtaaggggagtctggagccactgggaagggcagaggttcccaaggccagggacagaagtgggtaccccctagcccatttgtgtctccacccatgcatctgtccaaatgtttctgcccctcccaggaggtcttttcatgtaactgcctcaaggaccctggactctgctcacccccccaccactctgcctggcctcctgctgatgaggactctaagttcccaggatacaaaaggggtggcagtgtatggttcaggaatgctgaatatgggaagcaggggtgcttgtgaccctaataaattccaagtcctcttccctgccacctccggctcttcttgtgtccaagccctcagacccttccccacctccccctcctttccctttcccgaaggattgttccctttctctgcctggtctcccagggcaacccccgccgccgggtgtgagaggaaagagtatgtgtcactgtgtatgcgtgacactccgggtctttttgaagggaggggttcgtgcgtcacccctttccactggttctgcagcaccagtcccctccccccaactccctgggttcttatggtccccaagggtgatttgttcatggccccatcttggtgtccagtctggccttgaaagggggtcttggaacaggtggccctcccccacccctctcctttctctgagtccccccctcccctttctctccaccttacaatagctgcagccggcctggggtcggatgggggggattaggggagggggccaggattaggggaatgaaccagccgatgaaaggggctggagagagcaggagggagggggctgggaagaggaggaggaaggggaggggggtctgcgctaatcgactctggcgcccacataaggactggccacggactgaaggagaggacagggaagtaggggggaactggggtggggggcgagggcacccactgctgccttgtcccagggacaggccaccccctggcagccgcagcccaagtccgggagcctcagctcgggcggggacaagatgcccatcagggtctctaactgccccccaccccctcgccctgtatccctctcattccctacactcaatggggatcgctctgccccttcctcttctctttcctccccatccccttcgtttactctagagtcctcgaagaggcttctgcccacttcccactccagacattctgcccctgtgtaccccacccacacgcgcacccccccttcccaatgggagctccatcttgtgtatgtccctgtttccgcgtggtgtctccattccccctttcctcccgtgcgcctccctcccttccccgccccgggccgcggctcctgattgtccaaacgcaattctcgagtctatggctccggccgagagttgagtctggacgtcccgagccgccgcccccaaacctcgagcgggagagcgggtcggagggtctagggagagccaaagcagagggtggagggagtccccagggtggtaaggggaatcccgggcacatcgggacctaggtgtgttctcaggactagaaggctaaagcggcagatcttttgcagccttttcccccgggatcctggaatgggggttacggagaagtgaggggggttgatccccagagtcgccagggtacgcagagtgggggaggtagcccttttcacgagccctctgtcccctcctggggtcccagatattccaggccccggccccccggagctgaggccccgcgtgggggcctctggaagggaaccgaggctaaggttgttggccgcgcgacggtgctgggccgggggcggagaccgtggttccctaagtggcgcagaactcccgggacgcaggatcctcacgcgggacgagcccgtcccgtgggcgggagaaccgcggcgtccacgtcccgtcccacccgcgccgcgaatggtgggtgacgtctccgccggcggggggagcgggtgtagcggaggagcaggcggaagtgacgtagggccccagcgcccgggccatggcggcggcggtggcgggagctgctgtctgagcagcggttgcggaccgagcgaacttggcccaggagcccgggcctagggagaggcgcggcggcggcgggagcgcgaacggctggagctgggtgaggggcagtgccggcgcgggggcgggagcgggggcggagaggggcgcttctggaggggcggggtctacgcgaggggcggcccccctgacgccctcctccccttccccccacccccagccttcttcgccttctcctcggctgtggagccctggtggggggtctgcgcccggtcaccatgacgacgccggcgaatgcccagaatgccagcaaaacgtgggaactgagtctgtatgagctgcaccggaccccgcaggtgacaggcattctccctttcaggcttaccccctcccccaaacccttatatccacagaccgcatcacacagcttcttttccgtaatttgctctattctgccttgcctggccctacctttgaatcaccttaatctttccaaagcactttcgcatttagctcatttaatcctcaaaacagccctgccagagaggtggaacaagtattattatcttcatttgaaagatcacaaacacaaaaattaccttccctgttcctcattcagtgtcataagtcagtgcacataagactcactttgggagtttattaaaagcagagcttcatgccccccaacattctgattcagtagtgaattgggttctcagaatctgaatttttaacaggcaccctatggggttctaatacaggtagcaccaggactttaaaaaattttgttgaatagtttttcccaaccacagatttgtgccatcttcactcctaggccacttagccacctcagatcctcctattccaaagctcctactcttagttaatggacactaaagtctgtcttttctccatttgctccaagtcatcagtccttctctttctcagaattcttgtctcctatagagaccaacatgggtcttctcactgtatttctcaaaattcttattttatgggctgctgtttctaaaacccctttccctctaacccacaccacctttctactcactgatgccttcaggaagccataatggatggcacagagattgctgtttcccctcggtcactgcattcagaactcatgtgccctatctgcctggacatgctgaagaatacgatgaccaccaaggagtgcctccacagattctgctctgactgcattgtcacagccctacggagcgggtaataggagagacatgtttgagatgagatgaaggggtacaaagttagggccctctcactggtcttggttcagcctaggcttcagttcccttgactgaccactcagggcttcccttctcctaccccaggaacaaggagtgtcctacctgccgaaagaagctggtgtccaagcgatccctacggccagaccccaactttgatgccctgatctctaagatctatcctagccgggaggaatacgaggcccatcaagaccgagtgcttatccgcctgagccgcctgcacaaccagcaggcattgagctccagcattgaggaggggctacgcatgcaggccatgcacaggtgtgagggtcaggagagaagcagaactgatgggatgggtccgtgggtcagtccttgttgcctgctagcttctaagcctcagcatcctaggagctgaccacagactgatcattagggctggaaatcatgggtgtaaattgcagtttcttagtaaacaactggccctgctcttcttaagaaaaatatagggctgggcacagtgactcacatctgtaatcccagcactttgggaggtgaggatgggaggatcacttgagcccaggagtttgagaccaccttgaataacatagggaaatctcatctctacaacaaattaaacatttagctgggcatggtggcacatgcctgtagtcctaccttcttgggaggctgaggtaataggatcacttgagcctgggaagaaagtggatgttgcagtgaaccatgatcacaccactgcacactgcactccagcctgctgggcgacagaacaaggccctgtcacaaaaaaaaaaaaaggaaaaatgtagtttaccccatgactttctagaagttagaacagtagagcgattttgagaataagccccggattcatactgctggaagttaaatcacctcctaggccagcatctctcagtctttcatgtgtatccagattacctgtagatcttcagatgcaaactgtgattcagtaggtctagagttgggcccgagagtctgcatttcacaagctcacaggggatgtgtatgctgctaccgcactttgagaggtgacagcctatgatcactaacaagttacttaacctctctaagcctcagtttcctcagccataaaatagaggtaatataattacctgtgtcataggattcattgtattaggtaaggggattggtgcaaaacacttagtatactgagtgcttagcacattgtgtttaataaatattaggtatcgtcattaggatttttcttatctcttaattctctgaagtttaaagtctaagccctttatcctggatgccttctaaccttaaccacttgcttctacagggcccagcgtgtgaggcggccgataccagggtcagatcagaccacaacgatgagtgggggggaaggagagcccggggagggagaaggggatggagaagatgtgagctcagactccgcccctgactctgccccaggccctgctcccaagcgaccccgtggagggggcgcaggggggagcagtgtagggacagggggaggcggcactggtggggtgggtgggggtgccggttcggaagactctggtgaccggggagggactctgggagggggaacgctgggccccccaagccctcctggggcccccagccccccagagccaggtggagaaattgagctcgtgttccggccccaccccctgctcgtggagaagggagaatactgccagacgaggtgaggagccctgtctttccccagccactgagaaaccaaagatcacctagatttccatcagaagtgggctttgcccaaacccaaaataccaccccaacccagaatccattttggaaagcccctacctccagtcctcatctgaggcgctctggctctaagcctgtcctccctcccattccaggtatgtgaagacaactgggaatgccacagtggaccacctctccaagtacttggccctgcgcattgccctcgagcggaggcaacagcaggaagcaggggagccaggagggcctggagggggcgcctctgacaccggaggacctgatgggtgtggcggggagggtgggggtgccggaggaggtgacggtcctgaggagcctgctttgcccagcctggagggcgtcagtgaaaagcagtacaccatctacatcgcacctggaggcggggcgttcacggtgagagcttctgagggcagtggtagaagaggggagaggagggagggtggtctgggccacatagaaccatgagcctggtctaactcatcagcactcttcccctatacatcctctatctctttctatgtcccctctcctttcccatcatccatgtccttttttgccttatcgcttttattattccttttttctttcctcctcccttggtcaccttttgcctctcattcatttccttttccatcttctccaactttcctctctcttttcccctctctcccttttaccccctcctcagacgttgaatggctcgctgaccctggagctggtgaatgagaaattctggaaggtgtcccggccactggagctgtgctatgctcccaccaaggatccaaagtgaccccaccaggggacagccagaggaaggggaccatggggtatccctgtgtcctggtctatcaccccagcttctttgtcccccagtacccccagcccagccagccaataagaggacacaaatgaggacacgtggcttttatacaaagtatctatatgagattcttctatattgtacagagtggggcaaaacacgcccccatctgctgccttttctattgccctgcaacgtcccatctatacgaggtgttggagaaggtgaagaaccctcccattcacgcccgcctaccaacaacaaacgtgcttttttcctctttgaaacctgcagttctgtgtgtctgtttatcaggggtgtacaagaaaaagaaaggaaaatagattggggagggaggcctagaaataatgtaaaatcagccttggaaatggggagaaaatgtcgggttattcgagatatgtcgtcggaaactccaaattagcaaatatgtatgaaaataggaaccatctatgaagctggaagagaggataaaaaacagaggtgccaagttagaccccaaactttcccccctaaaacctgagtcgcccaggctgaaatccagggtttcaacaccaaagggaaagcaggaaaatggctcaaaagagaaagggatgtgtgtagatgtgggaatgaccgtgatgtttggaagtcactgcgagcagccggtttctatagctggaaagagggagggaggtggagaggactgcggagaagctccctgttcgacatcccagtccccgggccacctcccaaaaaagggcaggctgggctgcagactcggagtgtgagtgcacagcctttgcccgccgggcagcggggctgagcggagggagggtcgcctgggaacactagttctgtgctcgtccaggcagcggctgagagcagaggagtgggggcatcaaggaaagccgcggctgccttactggcctcgagttccgcgagcggggctgggcaccaagcctgaggctggggggacaggggcgcacgactgcactcccggtccggggcagtgcaggtattcggggaagaggaatcgcctctccagaaccgactgctgttccttccaccacccgtaacctctctgcccctcacttcctgtttcctctgctctgggtacccccagcccctctggccccaaattcctcccccatgctcagttctctgtctcactggcagaggagccggccgtgtttccccctaaagcccgcttggccctcccagttccgcagctgcgcggcccgcccgccgatcccatggctcccttctccacccttgggatttctcgtttgttcgcctcctctccggtaccctcaatcccgtagatgcaggtgggcatcctccagccccagcaagtactgcggaccagttgggctggctggcccctttcctgcagaagcagacaacacccacttctaccctcgtaggagcccctttctacactcacttccctggaacccgtgatcctgactcccctcctcccggaccccaagcatccaggacgtgtacggtataaggggaagttgtagtgggaggcaggtgggcgttgttcctggagtttcagggtagagaagcaggtggggaggagttgggtgagatacagaggtggaagccaaaagtctggagttaacctgacttctcttctggctccaggggctgccgggatcgtctgtcctcaccctccttgtcctccccagccctaaccacccggcagcctcttctctgtctctgctgcccgtcctgccttcactctgaaacagcctgccccctcccgggtccccagtcctcacctttgccccacacgcccccctctctatttatcacatttcctttcgtgtccccctaaccccatcgcttggtgcgagtgctctcttgccctcctctccccatgactgaacctcacagacatggctgtttatttaggtgacaccatgtgggagacacagaggaacccatttccatcctggctccactggggcatttcctttccaagtccttcagtccctccca

SEQ ID NO: 306 - DNA, 23240 bp, Homo sapiens
tgtgcagaaccttgctgattatagttctagggaagatgcgaaaagagaaaagaaaaggtatgtcctccagccacttgtatgctcctcactgatctgaaaggagcactctctgggccctctcaatttttttttttttttttttttttttttttttgagatggagttttgctcttgttgcccaggctggagtgcaatggcgccatctcggctcaccacaacttccgcctcccgggttcaagcacttttcctgcctcagcctccggagtagctgggattacaggcatgcgccaccacgcccggttaatttttttttatatttagtagagacggggtttctccatgttggtcagcctggtctcgaactcccaaactcaggtgatctgcccgccacggcctcccaaagtgttaggattacaggcgtgagccactgcgcccagcccctcaattttgttttttaaaataatttcagtattagcctgcatgcgttgaggtatcagagacattaaaatatcaaacttgcaggtcccctgaggtcaggagttcaagactagcctgaccaacatggagaaaccctgtatctactaaaaatacaaaaattagctgggagtggtggcagccgcctgtaatctcagctacttgggaggctgaggcaggagaatctcttgaatccaggaggtggaggttgcagtgagccaaaatcgcaccactgcactccagcctgggtgacagagtgaggctctgtctcaaaaaaatatgttaacaaaataaaattaaaaaatcaaactctccagcccttataaaggtaatcacttggttacccattcagtttcaaaatggtgagtttcaggcactgctaggatcatcaaatggtgccttgaaggaaaaatgacatcttaactcattctcaagatgccagtcacgttgccgtgatcaggactttagggcaatgagcaaagagaacaaggaactctgctgtctgaaacagctctcctgtcggatcagcctagcgtcactcctgtagctgcacaaaagctcatgggcaccagcctggaattaggcgtcccttgtcctaagcacccctccccagccccagctgtccagcccatcctgtctaatcattacttaaattaccagggttgtgtctggaaagaattgaagggtttgaccttcagaagacaagcctccaggggaggggaatttctattttttggcatgtggataatgaacacaggggagggcaatccctgctccgggctccatgtctttttccagcttgtcaaaataggacgtccacaccctcctttgcccccaagtccccccactaattggcatcaatcgaggaagtctgagcgactgcatgtttaggtaaaagaggaaaggggtggggtggggcgcagtggctcacgcctgtaatcccagcactttgggaggccgaggcgggcagatcacaaggtcaggagttcgagactggcctgaacaacatggagaaacaccgtctctactaaaaatataaaaattagccgggcatggtggtgcatgcctgtaatcccagctactcaggaggctgaggcaggagaatcgcttgaacccaggagacggaggttgcagtgagccaagattgcgccactgcactccagcctgggtgacagagcaagactccatctcaaaaaaaaaaaaaaaaaaaaaatagaggaaaggagtgaacccctgagtggccagctgggtgcctcaacggggtgtctccaaaggcagcttgtgcttgtttgtgaccagggtgacaaaggacttcactgtcctgtagcacagatgaggttccaccctcaggtgggtggaaacagcccaggccattagtgcaaatcccctgcctggcccagggccacgttcagcccactgtctgtttgctttgggacccacccaaggtcacattttagcttttgagaaatgtgaaagtggaaaacattgcaaaacaaaaagcccctggaaaactgtgcacacacccatcccctcagcctgatgctccagcttggctgctaggagatcaatgcagctctgccttcctgctccctgtgcagaggtgccggctcctgcttcctggttcccagctttccttttgggaactgcctgaggtggtttgacacacagctgttgggcttctcttcccttgaggtctctgaaccagggcacccatgcaggtaaacacaaaagcggagtggggtggaatgggggtgctggctgtagcctcggcagaaggggacccgcctctctcctcacgagtatccaggatgtgggactggatattgaccagaccagaacccactttgggcccacatgggagctaatgtcagcaggggcctgtggactgttcccattgaacggctcttcctgctagctgtggttctcagtgtggctggcctggtccagcctggcacaggacaggacctgggagggccacacatttcccacctccattttgtgcccaggggacctgtgccagcagcaagcccttcctgcaaagcagtgtggggaattctgccaggctgcagatggatgggccggtctgcttccaccccttcctcaggtgcaaagttggggttttgcgatcctgtaattactatgtttagcaaagttgccaatttctccctttagggtaattttcaaaaatggaaaccaattttctttgtaggggcttctgctggataaaccaaccaccacaaagtctacagaaacatgtctccaccccagcctcactccacaaatgcttctttggtggaaggctggttcctggtttgtgttcatttgggtagagctggggagggagtaggagtcagaaatgaaggttctggagcccaaaagccactgttcccagactaagtttgcctaatcatctgtggttggcaaaacccctcaaagatgtccacgtcataatcactggaacttgtgagtgcgtgttaccctatatggcaagagggattttgcagatatgattacggattttgagaaggggagattgtcctgggttctctgggtggggtgaatgtcatcacagggtccttatatgagggaggcaggaaggtcagagtcagaagagttgtgtcaatgggagcagaggtcacacagagatagactggaagatgctatgctgccggctctcgaggtaaaggaaggggccctgagccaagggatgcaggtggcttctagaagccagaaaaggcaagggaacacagccctgcaattcatcttatattaggttggtgcacgaggaactgtttttttttttttttttttgagacggagtctcactgtcgcccaggctggagtgcggtggcgcgatctcagctcactgcaacctcccaggctggagtgcagtggcgcaatcttggctcactgcaacctctgcctcctgggttcaagagattctcctgcctcagcttcccgagtagctgggactacaggcacacgccaccacgcctagctaattttttatttttagtagagacggggtttcactatgttggccaggctggtctcaagctcctgacgtcgggtgatccacccgcctcagcctcccaaagtgctgggattacaggagtgagccaccgcacccggcctgtttgttttttgagacagagtctcactctgctgcccaggctggagtgcagtggcacgatctcaggctcactgcaacctccgcctcccaggttcaagcgattttcctgcctcaccctcccgaatagctgggactgcaggtgtgcaccaccacacccagcgaatttttgtagtttttagtagagaggaggtttcactacgttggccaggctgatctcgaactcctgacctcaggtgatccacccgcctggacctctcaaagtgctgggattacaggcatgagccaccgcttctggcctggggaaattgcgttttttggcattaaaagtaatggtattagcaaccattctaatacttctgatcttctgcaagataaaaaatttgtgttgttttaattgtgtgtagcaataggaacctaataccccatccaacacgacactcagctttgctcttccaaagactggggaagaaacccatctgctcaggaagctgaggatgccatacgccaaggtgtaagataacatctgaaagtcaagggagcaggagcacaggaagtctggctgccagcataggcataaacaactcctcccagtagatcacaccttggcaaggctgggaggatggaggcctggcagccaaaaacccctttcctcctgtacccttaggagactacactatcttctatcaagacccctggtattgttacatcttttcattcaaaacttgaaacactggccaggtgcagtggctcatgcctgtaatcccagggctttgggcagctgagacgggatgattacttgagcccaggtgtttgagaccagcctgggcaacatagggagaccacatctctacaaaaaataaaaaaacaaaattggctgggcttggtggcatgcacctgtagtctcagctactaaaggggatggaggtgggaggatcacttgagcccaggaggtcgaggctgcagtgagctgtgactgtgccactgcactccagcttgggtgacgatgtaagaccctgtttcaaaaaaaaaaataaataaaacatgaaacactgattcacactagggccctaataactcactggttttccctccgagtcatctgtagcagaaaaagaacaggcccacgggccctacggaaaaagttccaactctttcccagggagagggccctctgaaggtgaaggcagagacggggacgacgcagcagcaagacacggatgaccaaaggctgtcggcaaaccaccaggacacaggcctgggacagagtcacagcctcagaaggaaccaaccctgccaacaccgtgatcgtagacttcccaacctccaaaactgtgagacagtcaatttctgttgtctacgccaccaggacactaatacaaatgcctatagatgctgggcaggcagctgagacaaatggagtgggtagggctgcagctcgccaccttgagagggctctgaagagaatcaccctgaattgcagccacagtcagcagcctggaggtgagggcatgtgacaggcagagcccagaggcccagaagagacctgggtccccagcctcagcaaggacgacaaggacaaggagaccacccaagggatagagctagggtcaccccaccatacactcatcatagtcaaaccactggggagaatcagaaactcgggcaaagcacacactccctgcaagcagccaagaatctcgcatgaccagtctggtcctctggatctccacatgtggccacgtgtggcgcgtggcatcccctccaccccaatgcctggtatggtcgacctggaaatgacatctaggaaactgagaatggaaagccatgtgggggcagcgctaagcttttttttttctttttctttttttgagacggagtcttgctctgttgcccaggctggagtacagtggtgcaatctcggctcgctcttgggttcaagcagttctcctgtctcagcctcctgagcagctgggactacaggcacctgccaccgcgtccgacgaatttttgtatttttagtagagatggggtttcatcatcttggccaggctggtctcaaattcctgacctcgtgatccacccgcctcagcctcccaaagtgctgggattacgggcgtgagccactgcgcccaaccagccctaagcttttttttttttttttgagacatagtcttgctctgtccccaggcaggagtgcagtggcaccatctcagctcactgcaaccttcgcctcccgggtccaagcgattctcctgcctcagcctcccaagtagctaggattacaggcatgcaccacaacacccagctaatttttgtattttcagtagagacgggggtttcaccatgttggccaggatggtctcaaatctcctgacctcatgatcacccgccttggcctcccaaagtgctgggattacagatgtgagccaccgtgcccggcccctaagctcaaagagcttgtgagatagaacctcccccttccccggtccttgcaaccccctaggcagtaaagtaccataaaaagggaaaaaccggagtggtggctcatgcctataaccccagcactttgggaggccgaggcaggcggatcacttgaggtcaggagtttgagaccagcttggccaacatgtgaaacacaaactctactaaaaatacaaaaattagctaggtgcagtggctcacacttgtaatcacagctattcgggaggctgaggcaagagtattgcttgaaaccgggaggcagaggttgcagtgagccaagatcgcgccactgcactccagcctcagcctgggcaacagagcgagactctgtctcaaaaaaaaaaaaagggaaagaagttgaggtcaaggaagaccttgaggctatgcaattagggagctgaaatctcctagggaaggtagcttcagggaagggtgagatggcaggaatcctctcctcataaaagcaagtaatttgccatctggcagccttgactccaagtttctggagagctgggaccaggccaggtgaatgcctgctttctttctcgggaaaagaaaaaagggggttctcaggtgtgtctccctggggaggctgcccacaaggaaggggaggctggggaagttagaaaaagtctcccacctgtgaagcagattacctgcaagccaagctctgggttggtgatcaaatcagacctctctgccggcccaggcctgttcccaggcccacggtgggccttgctgagcacagcggctgctcagctgtttccagactcaggatgaagcctggggagggcttggagctgcttcctctttctttttttttttgagatggagtttcgccctgtcacccaggctggagtgcaatgggacgatctcagctcaccacaacctctgcctcctgggtgcaagcaattctcctgcctcagcctcccaagtagctgggactacaggtatgcgccaccacacccggtgtagagacggggtttgagacgggtttctccacgttggtcaggctggtctccaacccccgatctcaggtgatccacccacgtcggcctcccaaagtgctaggattacaggagtgagccactgcgcccggcctgctgcttcctcctcctcagggagacgccacagctctgcggcaagcaatccaccaggcaccagatccccagatacctgcccttcagggagaaatagcctgggatacagagaggcccagaggggagctctggctggacttggcttctcagcgtggggtctgggttcacaggtttgcttctctgctttgtggggaactggttggaggcttgtgcaagcctcttcacctctcagggtttcaggcccccccaactccttcccgccttgtccttttttcttttttaaaaaaggaagtaaagtacagtgggaaacgggccaagctggcagcttgagagatccaagtgcccgccccccgacccgcaaccgtgggaaggggaaccatcttgctcttggccaatcctgcctctctgagcagggatgcagctgggggagtttctggagataggatcaaattctttagaaagggagaaggggaaaggggtctggagaaaggcagcctgggttgggggaagtgaatgacaagaatgaggggggcaaaggccttggaggtgaggggggcagggggttaggcgccagggaggacagaggacccattgtgcggcctggaaccggggccagagggctttgcccttcgcctccctcccgcggggccttccagagccaggaggggagctggggcccggaggcgttggataaagagcccgtgccccgcctccccttgccaactcagtttgcagtcaaccccgcccccgcccgctccgcggactcaaggctggtggtagtgggcctggaggcgcaggatccgacctttctggggccccaggaggaaaaaaaaaggggggaccctgaaccaggtgggctttatcaccacgaactcacagtgcttccctgtgcctcagtttcccctcttcagactctatggctaatgacagagcttttcagatttggtggaaatgctctccggggcggggagcagacggggaaggctgccccagctaatctccgcagccagtaccctcgaaggctgagatctcggggagcacagcctccgattcgcgttttctaggcaccaaagtccctcgctggaggaagaggaggggaagaaggcagaggagaggggaggggcggacggatctggtcctgggctcccgcgcggagccccctcctcccacagccgccgctcgcgtccccgcagcgcatgaccgcggcactgcggctgcagggctctctcccccgcccgcgccggattcctggagcaagggggtggggggctcggaggtgcaggacccatcattccgacacgcgccgcgacgccaggagtcggggatgacgcccctgctccctcccctcgttcctgtttctcggagtttttcgacccctgagcgcgtcgctgagtcaccttcccggaacgcgctcgggacgctctggacccagcggggactgcccgggggccgcgcaaggcgaaggcgcacccgccgatacgcgcgcggagctgcggccccagggaccccgcgtcccagccagtgccccccgacccgcccggggactctcgggtcccgcccgtctgaccccccaagtgttgggaaacggggccgagctgcctgggtcctccggaagagaagacaccgcggaggcgtgccggagttcagggcgccgcccggctaattggctgcgtgctcctcctggacctgcctcttctcgactttaagaagcgatgagagaggtgtgtgggggcgggtggggccggcgggggcgcgcgagccccgcagcctcccgcaggggcttggtttctcctaactctggccctacctgggcaggtcaccaatgggccttggcaacttcttcctccgtctccgccgtaaccccccagggatctaactcgaggtgctcgcggacacgttctgtggcttgccgcgataagtgtatcacaaacacactgacaaacgcgtccctactggcctccaaagaagtgacaacttctgagcgcgtttccggcgccccttcttcacgctgagccagagggggcggggggcacgtaccacatgcttggctttccaatcccgacgggggcccccaggcccatctacactgtcaagcctcctctccggctcggagcccccggcctgtcgcctgctctacccgggacagcgcgctaggcggcctcaggctcggtagcccagctgcagcgtcgggaagttaaaaataacctccgtgggagcgcgggggaggaagaaagagggaagctggtgggcggcgggcgagacgccccggcctggagaggcgccccgggtggcgtgcgggcctcgaatttcgggtgggctagggcagagcgcgcaaaaggggcgctgcatcccggcgccgacagcacccgcgggggcgaggtcgtggcgtcgaggtgaaaccaagggtcccccgggagagcggagccgcgcgcgcccggcgctcgctccgacacgagttcgcgcggagcccgcgcctccgtctgcgctgcgcggtcgctttcgcgcgccccagacactgcgctcgcggccgggcccgggactccgcgcctcgcggcctgccgcctcagctcacccggccaggtcgcggcgccgccttctagccagacgcctaggacgagcggcgggggcgcgcttgccgcttcctaggacccgggcgggaaccagctcgtggcccggccgtgggcgcgggccgtgccggaggcggcgcgctgaggccggaggcgggcagaggccgaggccgcgccgggctcaggttccacccccgggagcgcggggcggagccaggccggcgccgaggctcagtgccctccccgctccgcggcgccggctgcgaagttgagcgaaaagtttgaggccggagggagcgaggccggggagtccgctccagcggggcgctccagtccctcagacgtgggctgagcttgggacgagctgcgttccgccccaggccactgtagggaacggcggtggcgcctccccagcaaaccggaccgactgggtagggccgcccaccctgccttcgcgccgctcgtggctcctgtgcggcccgccctcgcggggccccgggaactgggccacttgtcgcttgggcgagagcaggcggcagctggtggcccggttcgggcttggctttggcgcgacccgggagcggctcccacgagcgccgcgcgcgtcgcaacggagcggggccctgagaagcgcgcgccgcggctcccaccgctctggagctccgggcaggggacacggcaacctggatggctggggcagggatcctctcccagaacttcgtgcccagcaatgtccgctcaagttctgggatttttacgcagctggactcccctccccctggcagccccgaggggtgaggagctagtccgtcggagggagccacggggctctgactcatccgtcgggccggaaccgaaccccaagccccagggagaaagccccggagcaggcgcccttctcagggattgtaggcttagtcacacggcgggggcgccctcggaggcaccggacctcagctctctggacttcccgggaacctggctccccgcgcgtggtcccgggatttagtcgggcgctccccacctctggcagctgcggccccggactccgccagcgctgtcttctctccctcaggtccagccgccgcagggaatgacgccggtgctcctgcagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccaggtttgtggggttcctgctgggaagggctgtagggggattcctgttcctcgccaggaatgatggaacgcccagctggacgaaaggggctgtggacgatcgggagaaacattatccctcacgaggccagaagccggccgaatctgagccaaggaagggggtggcaggggcgccgcgtccccaccccaggtctcccagcaaaggccgctcctctggccagggtcaattaccggggtgtttcgggcaccaagttcccacactagtgccccattgttacccgtggccccctagtggtcggttgcggacgtggcctctttggttttgttttctcagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactggtgagtacctctcggagggggtttcgggagcatcccctggcaggggacccccccagtcctgatagctgccggtctccctgcagagcggcggaaccacgcgcgggagctggtgcggtcggaggagctgggccgctgggacgctctggtggtcatgtctggagacgggctgatgcacgaggtgaggaccgcactgcgcggctaggcctggggcttggcgcggtgcgtcccaggctgaggccacgtgtgcttcaacaggtggtgaacgggctcatggagcggcctgactgggagaccgccatccagaagcccctgtgtagcctcccagcaggctctggcaacgcgctggcagcttccttgaaccattatgctgggtgagagcccagggccagagtaggcctgtttcccgtcagtgctcctctaccgcgggggttttcttgtctaagctcccataggctgagatcatttccatttccccttctcccttagtcctggggccctctcctggtgaccccagctgactgcttccatttgctccatctgtcacctaccagtcctgccaactccccagggaccacatggcgctttgccagctcccactccccgggaggaggaagcgggggatacatgggggctcctgtcctgccttatctgactttttccccctgcagctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcccagcctgctcgtcctgtcctggtgactggggagagaatgggttctcgttctggccgggactatagaatttaatggtaatgatggccaatggtgccccctgggatgggcaatggattttactggccccaggcatagtcattctggtgggggactcaggaccagagctggttcagcctaatggtgggggggcctctaccaccctgataattatagcacctccaacctgaagcagcctcagagctcagccagctgcctgaccacacacaggatgcagctcggagctggcatgtctcagccagggccacacaagcagctagtcccagcaaatctcatcagagccccatgtggatttagcaggaaaggggaaatatctgagttaagggcattagaaaactgatgggccaggcgtggtggctcacacctgtaatcccagcactttgggaggctgaggtgggtggatcacttgagcccagaagtttgagaccagcctgggcaacatggtaaaatctcatctctacaaaatgtgcaaacattagcagggtgtggtggcggacacctgtagtcccagctacttgggaggctgaggcaggagaatcgcttgagcccgggaggttgaggctgcagtgagccgagatcgcgccattgcaccccagcctggctgggtgagacagagtgagaatgtctcaaaaacaaaaacaataaaaccactggccaccgcccccgcccccccccaaaaaaattggcaaggagcaggagacctcagaagtaaaaaatggcaatatcttgctttttttttttttttttttttttggctcactgcaacctctacctcccgggttcaagtgattcttgtgctcagcctcctgagtagctgggattacaggtgcatgccaccatgcccagctaatttttgtagttttagtagagatggggtttcaccatgttggccaggctgatcccaaacccctgacctcaagtcatctgcccgcctctgcctcccaaagtgctgggattacagtcatgagccaccacacctggtatcttacctttttaaaaggagtctgtcatccaccacaatggtctagggttctagggttctcccagcctccctcagctgtctcctttccctacctgtccctgtggaggagtgccaggcaggagtggaaagaatgtggcagggaaggatccatccaagtctaaactgggcaaccattttggcttagcgtccaggagttgtggcacctgtccaccgccaggtgctatgacgtcggctctcccagaacctggaaggagctgaactggtcagttgtaggtctctggagactacagctgctgggaggctgctctaagctggctcctgaggggcacaccaccggccaggaggaggccagaggactgctccaggacaagaagtacaaaaggcatgcaagcaggtctggcaggcagagggcagtgtgggcgggtgggggtgctgttcacagtggcccccacctggccaggaaagccaggacccactgccacatgccttccctggcaacaaacaaggtctttccttccccaggaagggtgtgtgtgagggacacaaaggcaacggagcccagatgaatggcagagggaggtttaatggtgtcaccttgtcttgctaatgagccaacacaaaaaaaaaaaaaaaaaaaaatgcaagtaaaaaaaagtttaatcacacagcactttatacagatatcgtaagcagtaggcattcacatctccacatgtacaatgcactgggaagcacagccccaccagtcactccgggtgtttctcaaacaagataccgactcggttccaaatgccacggtgtgtggtccggctccatcctcccgcagctctgctggctgggcggtcacagcacagcacaggtgtggagcccacttaaggctgacaagacgcatcatgctttggctttttttttgtctttttttctaataagagttaatatctttgcttttgagttttttttccaaccttaaatattacatacatacaccaaaaattacatagctgcaatgtgctcaacagcatcctctcggcctggagcttcacattatcaaaagcttagaaaacttgtaaacctctgggcctgtctctgggcactaggagagcccccgccggccgtccccttcggattgagcctgcagtttgtaagcgaagggctgacagtaggccttctagtccaagagagggctggctcgcttggagttcagtgagctgcacgcctgtcccagtgtgaccatgtgatgggggaggggccctagcacttgccctggccttgtgcagctgctcttgcccccagcagcctccgacagaagagcaaggcacctatagctgttgctttccctgcagctccctggtcctcaactccatgtgcatgtgtgaaggccaccacctctcctgggcgtcacccggaacctagcctggtcccaacctctcttagagagcaagttcaacaggcctgagggctataacgtggtcgacaggccatgtatagccgggagtcagtgacagcagctacaactcccaagggatagtgttgacgctggaggactagggaggacctgggtggtggtggcagcaggagggtctgggacacagggaggcttgagttgaactaaacaggttgaaagggaccaggggaattgttggcgcaacccacacttcatgcaaggcacatgtgctctcctgcgggtctgcagggaaccggcccagagagccccgcggcaggccctggaacacccgcctctgacctgagaaggggcagcaagggagcaagtgccggacattctgctggggtgacaaatggaaaatcggcaacagggttccgattttctttgccacaggggacccgcctgttgaaagctcgcttcaaaatagaaacggcagcatctcaacacacttcttgcacttcagcatcaaactcaccttggggagaagagggcagtgggtttgcagtggggacagaggggcatgggaagaggggtgattccgggggggagtgagcaggcggcggctggcctctcccacggtgatgctctttcctctgtgcctggcagctacttgtcctctgtgcactccggcatgcctgcctctagcagggcagcccggaactgcgtcaggacaccccggatgctcttgatgaaacccttggaaagtgggaagagggggaagccgatgtcagggtagccactcttctcaggtaagaagctccggtagctctttctccgcttctttggtttcacactgggtggcaccgatgcgtctggtgcggtctccgaagtctggtctgtgtggtccctgctagctgaggccaggccctgggcaccgccctctgagtctgagccctgggaggcctctcctggggctggccctccatcctcaggttcttgttggccggagtctgacagctcggctacagctgggggctctggcgagctgctggccttgggcaccccgttgggcagtgcctgggccttctccagcagggcatgggtttccagccaggactcgatacggttcaccagccgccagccaccagtgctaaagtgttgcctgatctcctgctcaaagacctcggggggccgccgcaccagctgggtcatggactgcaccacgcggatcagcgccatctcattgtaacagcgactgttttcatagccttcctgcaggcctcggtcactgtcgaagccggcttcgttgtagtatggttcatttaccaggatcagacctgtgtgggcgggacaccttccctcagtgggtgagagaggcccacaatgcaggcctaccctccacctgccagggggactatcagagtcactttcctccaccggccctcccttgtccgcacccccgcttcagcccaactgtaccttggatggagatgagcacctggagaaggctggacttgcttgtccacctctctgtcccctgaaacacacagggcaccatcaattctgttccccaggcccctatccaccagtggctcttcctccttcttggctgggggcctggccctatactcacctttccaatccaggtgcccaggaggctgacacacaccttcccattgtcatacaggttggggttcaggcggccactgcattgggagaggtagcagaagtgggggggcacggctgggtagatgttggggagctggatgtcaaacaagtagaggccatcctcgtagggggttcgagtggggcccttgatgagagctgagaagaggtcctaggtagggagggagggagggaggccaaggttggcaggggtggaagggggtgtcctacatgtggcatctgcatctgcacctgctctttcccaggacactgtgcagatcacgcaggaagagcagcacctgggactccagatgccaccagcagtggagaagctaaggacaaatctctctctgcagaacagcctggaatcttttttttttgagacagggtcttgctgtgtcccccaggctggagtacactagtgcaataatggctcactgcagcctcccaagtagccgggactacagtgtgggccaccgtgcccagatgatttttttattttgtgtacagacagggtttcactatgttgcctaggttggtctcgaactcctgggctcaagtgatccgcctgcctcggcctcccaaagtgctgggtttacagccctgagccgtcactgtgcctggcccttgcctggaatcattgaaccctggctaagagaaatactcgaagtgagtttttatcttatcaggtgtttttcctcataaatcattactttaagactgtattccagctgggcgcggtggttcgtgcctgtaatcccagcactttgggaggccgagacgggtggatcacttaaggtcaggagttcaagagcagtctggccaacgtggtgaaaccccgtctctactaaaaatacaaaaattagccaggcgtggtgatgcatgcctgcagtcccagctactcgggaggctgaggtgggagaattgcttcaacccggaggcggaggttgcagtgagccgagattgtgccattgaactctagcctgggtgacagtgcgacgctatctcaaaaaaaaaaaaagattgtattcctcagccagacgtgatggctcacacctgtaatcccagcacttttgggaggccaaggtgggaggactgcttgaggccaggaggtcaaaaccaacctgggcaacatagtgggaccctatctctacaaaaaataaaaaattagctgggcatggtggtgcatacctacagtcccagctactcaaaaagcttagatgggaggatcacttgactccaggaggctgaggctgcagtgagctatgatcacaccactgcactccagcctgggcgacagagtgagaccctgtcttttattttttggcttatgtgtttttttgagatggagtatagctctgtccccaggctggagtgcagtggtgtgatcttggctcactgcaacctctgcctcccaggttcaagcgattctctgcttcagtctcctcacgcccggctaattttttgtattttaatagagacggggtttcaccatgttggtcaggctggtctcgaactcctgaccttgtgatccgcccaccttggcctcccaaagtgctgggattacaggcgtgagccaccacgcccggccaaccctgtcttttaaaaacaaaacaaaacaattcctctaaacacctgctccaacccttatccccaacaaggcaagtagtacaagcagtttcaagctgaaaggcagttccaggctggtgaggcctggggaaggggggatggtctcacaaccagaagctgacagtgagggtttgaactccatgggggaggttgggagaccaccgctccacagacatctggaatctgtgcatctatttgcgtgcatctgtgcacacacgcgtgtgtgtgggatctcaactgacagggcaatgggcgaggtcagtgatgagctgagaagcagggaaggcagagcgctagctggggcgagggaacctctgcacatgctcttatcggtgccaccctgggagcctccagggaatgcactacttttcttctcctgagtgagatgtggggaaaacagaacaaaacaaaaaatactgtttccatcttccctcagcagagctgagacaggctagaattttcaaaaggaattttcctacaacccaagaaaaaaccaaaagcgttattaagaatctcaagcagcactgggccttaggactctgcctagccctgttccagggttgtggctactccgggcccatctcaacagcatcccgcttggctgctctcaggatcgcttggctgctctcaggatccctgctctttcttttcttactcccttccttccaggacagggccagaactggggcctcagactcagattcagagtctagcatagtgcttggctcgatgcacaggcccagtaagggactgcggagtcaacaaggtggcaggcaaacgggcttgcctgttccggaaggatgcactcagcgctgcctcagtaaacatgactcagagacactaggccccgtccacgaacagaggagtgggaaaatggaatgtggtgtggccacatgctgtcatcctattttgcaggtaaaaaggaagaaactagatcattatgaatcaacacaggttggtcttaagcaaattagagatgatgtgtacgacgacatattctgtgtgtaaacaaatcatacaaaatattatgtacttatggtgatacatgaaaatgtaaaaatatttttttagtgtataaataatgtaaaagtataaaaaaaaggtcatccgtttggaaggagacccactaaacttccaacaatcctctgggtgtgggaagaggcctatgattcggggagaaagggaagtgaggtctggtcaaaggcaactttagctcttccatttccactcaaaggatctgtaatgttctaatttttcaaaaagaaaagtaggcttgaggagtaatcataatataattaatttcaaagtaatttttttttttttgagatgaagtctcgctctgttgcccaggctggagtgcaatggtgcgatcttggctcactacaacctctgcctcccaggttcaagtgattctcctgcctcagtctcccgagtagctgggattactggcacccgccaccacatccggctaatttttgtatttttagtagagacagggtttcaccgggttggtcaggctggtctcaaacttctgacctcaggtgatccacctgcctcggcttcccgaagtgctgggattacagtcgtgagccaccgcacccggcctatttcaaagtaatttttttttttgagacagaatctcgctctgtcacccaggctggagtgcagtggcgtgatctcggctcactgcaagctccacctcccaggttcacgccattctcctgcctcagcctccagagtagctgggactacaggcgcccgcatggtggcgggagagttttttgtaattttttttttttttttagtggagacggggtttcactgtgttagccaggatggtctcgatctcctgacctcgtgatccacccacctcggcctcccaaagtgctgggattacgggtgtgagccactgcgcccggccgagaaagtaattttttaaaggagggaggaaagaaagaaccatctggcctggacacacggctgagtcagccctcacctgactgagcctgtgaccgcccctgtaaaaggtgggtgggtgagtgtcctcgcaggtgccagtcagccccggaggtttggggacccaaggttggtggcctcttgggcactgggtgcccacacagcacatctgcacctgcccatgccaagcctacttgccattctatcttcaaaagtcttgaccatgatgccctcaggcagtgaggtagccagcagcgccatctccttccgcactgtgctgaagaacttcttggcttctggaggctggaactcaattttcttaaaagaatgatttgctagaggggggaagagaatagtcagtccctcatggagaggccctggagctccatctgccaacctggctggacaggtgagcacacccacagacttcccactcgccgctgctggcctcagcactgtgaccacacagggaaatggtttgccctggggcagtagctggggtctggcgaggggactaaccaccctgcacccagatctggtgacacaaacaggagccccgagaaggcgggggaaggcgaagaccaggcaagggctgactcacagggtgcaaactccagtacggagaagacctcgcccttggcgctggtgaaggtgacgccaggcttgccgccacactgctggcacagcaccggggtttcgctgggccactcagccttcacaggtgactgcccctcgggcttgtcctccttgcgctctacgtcgggcactgcttccatcttctcctcctctacaatggccacattgtccagggtcttcttgaggttttcctgtagcttcttgatgtcatccagaaacttcttctcccgagttggcttctcaggctccacagtcggagaggtgggcgagcccgtcagcagctgctccacagtcatgttcttgaggctctccaggatcttgatggcctctttcaactcccggaagctcttgggtggcccgtccttgccagccttctccatcagcccggccatgggggcagccatggccacagccccctggacggcagctgtggctgcctcttcactgatcaccactcccttgtcctcaggggccaccggctgctccaggggtgggatggggggctcctctatcttggggtgctcgtcctccaccagcccattgtccgtctcccagctgtcactatcatcttcccattcatccgaggatgccccgctggtgctgccttctaccgaatcgtagtctgactcctcaatctcagactctatgttgtacaagtgctgggggcagaagggaagtgccagggtaagcagacaggaagtcacctccccaccactaaggaggagctctggggatccctgatccgcacagctgatggcgactgggctcatgaggccttggcaacctcattccaccctttccctgacctctgctctggcttttgcagtccctaggtctctgggagaggcccttcacctgtcccaccctccagctggacccaaagccccagccagtggtctgttccagcctctcctcctgctctgtgcacttcgtcagcatctgtccaaggcgttaggggaccttggcaggcccagtcccacacctgaaaagcgcagggtcagctaatgatgcagccaaggaggcctgtgtggggagctgggaacatatgacaagaggggacatgtagaagggccgacatatcctgctgcgttccctggaatggccgttaaggtgatggggcaagccattcccgcccccactcctgccccctgtgtggaccaggagaggagagctgggctgtgtggctccaaccaggaggcgagggaaggagagcccgtgtagcccttctgctcaggacccagcaggtggggctagaactgggtcggctctctcctttctctccttctctgttagagctttctaaaaagggtggtaggaaagtctccatctccttttaggagggaacttgcattcttcgtagcatagtgagctgacaatccaggaaaatcctggaggtttgtgaaagtctacatgcacccagagatggacgtgaagagattgctgggagaagcgaggctggtgggccaactgcaggcctgcaccaagggctgtgtggaatgcctgcctttcccctcacgctttcgctgagatctcaccaggaagacctgagagcccatcttctggctacacgcctgtggcccccggcccaagttgccatagtcacaagctcagcaggggggtcttgccagagcctcacctggggcaggatgatggtctttgagttgtcagcccacaccacctccaccttgctgctgacgt

SEQ ID NO: 307 - DNA, 23292 bp, Homo sapiens
ctttgtcacccaggctagagtgcagtgatgggatcacagttcactgtggcctcgcctcgacctcccagcctcaggtgatcctcccacctcatcctccagagtagctgggactacaggaatgagccactatgaccggctaattttttgtatttttagtagagacgggatttcacatgttgcccaggctggtctcgaactcctgacctccagtgatccacctgcctcggtctcccaaactgttggcattacttgactgggcacggtggctcacacctgtaatcccatcactttgggaggctgaggcaggtgaatcacctgaggtcaggagttcaagaccaaagtgatcgcattataggtgtgagccactgcacctggcttcaatctttctatcgcacatataattacccaacattatctgtttacttgcgtgttctgtgtctctgttctagaatgcaagctccacattttagttttgttcagggctgtgtgcccagcatgtggcaaccactcaataaacactggttgaatggatgccaccttcatggaaggagcaaggtgctgggagggaataccgggagaaaagagagtgcagtgacctgtcccttcagctgcttaacagagtcactgtgttccagctcctgggcctttagctgcaccatgagggcaaacaccttctcccgccagcggttcagcagggactggcacttcctggtaaactcaggctccagggaatctgaaggttgaacctgagggagaaggagtgggagaaaagtgtgggctcctgggggaggagaggaaggaggtggcatctttgtttctcctctgtcctgcctgggcaacatgagctacagcaagaggagttcacaggaaggagatctaagcaggttctggggcacattgacccctcctgcccacagggagggaggcaggggacagtagatgcaggatgcggctgagggtgaggggtctgggggttgggctgtaccttcctggtcagctcctcctcctgcagggcgaggatgtgtgtgaggctctgcacccgcacctgcagcagctccgcggtggcatgcaggctgtcccggtcctcctgcaagtgctgcgggcagaggaaagcagcccctctgtagggcctccatgccgccttaggtaccaccttctctcccggaggctgtgctctacacgctcctccaagggccacgcttgcctcccaacctgatccctaagtctgcacacagatacattcctgcaccctcacctgcatggtttccagaagcttctgtcgctccagttcccatgtctggctgtggacctcagaaggcacttgttccccaacatattttcttagattctcaaccagggtcacctgagcctccaagtcttcctgggtcttgctagggttggggtgggaatgggacagccatcagtggggcgccctgcagatccaccacatcactaattgctgggctcccgtcggcgtccgcccacctacctcagctgcttccgaagcagctcggcctccctctgagcctcggccagctccttggcttcccctgctcttctggtttccagactactcagagacttctccaagccctcagccttgctggtcaaactggaaagagcctcctcgtgagcctgtgtcaaagaggacagctgcggaaagaagagggggctcagcagaggctcgaccccacatggaggccttccttgttcccttcactcccactttctgtgaccttagagaatgacccaaccaatcagccaactgtgcacagcaaatggagagctggcaactcactctccgcagctgccccacaacccatcaggagttcttgtccgatctcccccaaaacatatcttcacctctctgtctccgtctccactgccaccaaccctcatcttttgcctgggcaacagcgaccatctcctaactagtctttacaaaccctcagtggcttctcacagcattcacaacaaaacccaggtgtctctccacacctgcaggccaggggacccggcctctgcctacctcctgagctcaccctggaggctctcccactgctccccgctccggccacggggagtctgctgagaaccagacagcggcccctccttgctccacagaccccaggcgatagcccctcctcagggtggcttcactgggccctctaataccgtccctccccaccctactctgccccatcagctgttcacgtcctcctgagcacttagcactgaccatatcttgcttatgtgtatgtgttactatctgtcggaccacactggaaggaaagctccaggaaaggaggaattttgtgtcttttgctcatggcacctcaaagggttgcaggggtgtcagagccaccaagagtcatgggatggactggaaaggagggcaaagtgcccaccctgcttcctggtctgcctcctctagccctgtctccatacaacaataaaattaatttgggggacataaatgacaaaattttttagacataaaatacaaatctaatcatgttatttccctgcttaaaacctttcaacaggccgggcgcagtggctcattcctgtaattccagcactttgggaggccgaggtgggtggatcacaaggtcaggagatcgagatcatcctggctaacatggtgaaaccccgtctctattaaaatacaaaaaattagctgggcgtggtggcgggcgcctgtagtcccagctactcggaagaatgacttgaacccgggaggcggagctggcagtgagccaagatcgcgccactgcactccagcctgggcgacagagcgagactccatctcaaaaaaaaaaaaaaaacaacctttcaacggttgcttattacttgaaaaaacaatttttttttgtttgtttttttggagatggagtttcactttgttgcctagactggagtgcaatggcacgatctcagctcactgcaaacgctgcctcccaggttcaagcgattctcctgcctcaccctcctgagtagctgagattacaggcatgagccaccacgcccagctaatttttgtatttttagtagagatgaggttttaccatgttggccaggctggtctcgaactcctgacctcaagtgatccacccgcctcagcttcccaaagtgctaggattacacatgtgagcaaccatgcccagccctaatttcttccataaaatagagatgggggtctcgctttgttgcccaggctggtctcaaactcctgggctcaaatgatccttccaccttggcctcccaaagtgctaggattacaggtatgagccactgtgcccagcctgctcattgctcttatgggaaagtagcaagttctgaagtggccaaagccttgtgccctgggccctgggctctgcagcacactcagtgcccctcatctctgtgccccagccttctggcctcctgtccccgccttcacctgttgtcccaccaagtgtcttccagctaccactggacttcacacgcctcttcactggccaactcctattcagcacaaacggtagcttgttgtttttttagtctcgctctgctgcccaggctggagtgtgatgtcagctcactgtaacctctgtctcccaggttcaagcaattctcctgcctcagcctcccaagaagctgggggattacaggcgcccacgactatacccggctaatttttgtatttttttgtagagttcttcatgttggccaggttggtctttaactcctggcctcaagtgatccgcccacctcggcctcccaaagtgctgggattacaggcatgagccactgtgcctggcctagcttcttgtttctaagtttctttcataaatctcctttgtccattttctgattggattgctggtctttcccttaccaatttctaggcacacattttatattagggatattacccttttcttgtgatctgagctataaatatagcttttttttttctttttggctattcctaatgttcatgttataaagtcaatggatcaattttttcctttatggcttctagattttggattttgactcacaggtagaaaggccttgcccactacaaggttataaaggaattctcccttgttttctcccagttccttttttattttattttttgagacagagtcttgctctgtcgcccaggctggagtgcaatggcacagtctcggctcactgcaacctccactgcccaggttcaagtgattctcctgcctcggcctcccaagtagctgggattacaggtgcgcaccaccacgcctggtgaatttttgtatttttagtagagacagggtttcgccatgttggccaggctggtcttgaactcctgaccttgtgatctgcctgcttcggcctcccaaaatgctgggattacaggcgtgagccactgcgcccagggctatggtttctttccttgacatgtcaactggttacagtggccttccctgaaccccagactaagttagtgctttctagtccttctccttcaaggcattcctcctgattgcaattaattatgattaaattaaatgtggatgtgtatatcccccacgaggctgtcagttccatccacgaaggcaggactcaggctaatttggtcactgagtcttagagatggcaaagagtaagtactgagtttgaggactgaataatctctctctcccagtccaccatagcccccttatacccaccttcctcactgccctccacaatacccctgatgaattggtacctggagtaaagtagggaggcaaactatttcctactagaaagggaagcagggcttcaagtggtgggaggccacctgagtcttgggggaaaagtgcaacctgaattaagataaaagtacccaaattctccatctttctaggccatgtgtgtttattttcaccaaaggtctcatcactctactactcactactcatggagggtcttttctgcaatacctgttctttgcttggaagctactgcccagctctccgttatgaatttgaatcctttctacccctgcattcacctgctcttggtgcagcctctgaacctcttccagctcccgctggctcccctcttccaagttcttccggacaacctcagccccagccaaagcagcacgcaggccctcagcctcagctcggccggccttctccgcccgtgccagagcctctagctccatggcctgggcctctagcctcatcttctgctgcagcgaggtctcccgcaggagccggacctcctcctccagccgccgcagctcttgcagctgccgaacgatcacctcagcctgctggctcagggcctgtgacccctccagcccccaggaccttcaaagacaggttagtgcaggtgagacttgtctccagtgctggaaggatagttgagggcataaacatagccaggagaaggaaaagaggacccctctgcttccgtgtggggaggtgaagggggtgctgaagctggggtatggggatgtctgcattgacatcatcatcattcatcaaagccctattgagcatgttgagtccagtgcctggactcacaggacctaaagtctggctgagatcgtggaacatgatctccctagagagagctacatacaggaggattcaacatcaaatgtgtatatcattaggccacacattctttttgttttttggtggtttttttgtcttatttatttttttatttttaggccacacattttaagtggaaaggttggaagaacacacagggacttctcaattctaatttaagggcaagaagtttgagggaggaatgggcatagagaggtcgtaagcttccagtatcaatatggtgaggccaggtgctagttaaaaggcatttattggctgggcgcggtggctcatgcctgtaatcccagcactttgggaggccgaggcgggcggatcacgaggtcaggagatcgagatcatcctggttaacacggtgaaaccccatctctactaaaaatataaaaaactagctgggcatggtggcaggtgcctgtagtcccagctgcttgggaggctgaggcaggagaatggcgtcaacctgggaggcagagcttgcagtgagccaagatctccccagtgcactccagcctgggcgacagagtgagactccatctcaaaaaaaaggcatttattgagtgttaggtatactttatgaggagtctgagagaacagtacataaataacacagtgccagcctttagagaaatcgtctaccaatgtcacgtgaagtttaatccagcttggaacatggctcctgaggcagctctctgagacccaggactataagagattgttgttgttgtcgtttttagagacagggtatcactgtgtcacccaggcctcaatgcagtggctggatcataggtcactgcagtcttcaacttctgagctcaaggggtcctaccaccttagcctcctgagtagctaggactacaaatgcatgccaccacagccagctaattattttctgtggagacggagtctcgctttgttgcccacgctggtcatgaactcctgggctcaagtgatcctcctgcctcagctcccaaagtgctaggattataggtgtgagccgccatatctggctcgctctttctttctttctttagtagcagcgatctgtaggctagggaaattaagtgacttgccaaatgtcctctagctggtagccaaactagaaatagagtctctgtctcctgacacccagtctagtattccttcttcatcatgctgcttcttctaatgtaatcctattctggagcaaaatggcagaatgatatcccagtacatctgggaaaagacacatgaaacaagaataagaatgtttacagataatacgacagcatggccagctcccacagcatgtcctctgtaaaggctttcttccatcagaatgaacccacactgccacagtgctgggtctctacctctagtttgcacttcttcatcttgcctcataccatgctttaccatcagctggtggtcaatctatctcccctcttaggattttagattccttattaattacaaatttaagtcaggatttgtcttattcactattgttatcctcatccctagcacttagcacactgctttattatttatgcactgtaggaactaattgcttacataaaaatgagtacgttctggaaactagggccgaaatagggtaaggagtttattccagtgaggaagggtcactagcaagcaagcctgagaaaacggcgtggatggatccctacctgcctctccgccctggctcctgcctgtcactggaaacatcccgttcccacatggtcacttgaggtctctgggtgtctagccgcctctctgagacatcttgatggcctgggggttggaccaggggaatgtctgagagccaggtgggagccattcttggcagagttgaaaggggccgagcttgaaagtgggaggggggaatcagcccagtggaacctgaagaattacaaaaacaaagatggtcagtttcccaggcagagacaaccaccactccccttgtctggtcccactgacctgaaggtggaaacatctccacattatttgaaggctctagattctgtctccagccatctatgttcccctggacaagaggagaaacaaagacactccaattcaattttcaggccaccttccaaagagaaagcccctacaataacaaagtcataatccttgaattatagccaggtccacccgatgcttagctcttttcctacttccccaaagtaggagataccccaaattcacttgcttgtctcaacctggttcctcatggaacccaagcaactatcaagtggagagaatttactgaaagagacagactgagaggggctctgaggctttactcatactttcaggattctgggcagtgcctctaccctcctccttaagtttctatggtccctgctgctcctggccagaggtgagaaaggaggtacacagtgcaggggtcttgagcgccatctccagagttctctccatggctcagcaaggcctgagggaagcccatccagacaccagcaggccatgactcttgggtccttccctgttaaagtgctggcccaaggcctggccccagctgaatgtggccacatgcagggctagaccctccccaagaccttgggaatccaggccgcctagatccccaggcagaaaagccagcgtcctgacatcttattcaaatctttcctgcggctgttctctcagcttctctctactatccccttagcttccatgcctgctgcccgcctcctctttctcgagtcctaacacatagtgggcactttaagatcttcctcccaccctcccaccctcattaatctattttttacccgaatctgggatccctactcccgtccctttttacaacctaatctacctttttctgaaggaattattctggtcctgaccctcacccccatctctcaatagcctgccctcgccccctgtacgctagccggctctactctcccaccactgctcccctagatacccgaggcttcacccagttagcccgtgagctctaaggctgttctgatctcttcatctgtcccttcacctggcccctgtacccccttcccctttggaccccttgaaccctcccaggacccccgctcagccccttcccgcccccaaccgactcttcccgaacgtcccttaccaaccgcgagagccccctactgcgctttggccacaccccctacgcctcgctcccggccccgcctctgcccctgaccgcgcctgcgcaaggcgggcgccctaaagtcctatttcactctgttgggaggagggggaaaggtgtacgcaggcgcagtggcgtctaaatttgggcccactaaatgcgtcggagcatctccgcgcccaggcggctcctcctcactgcggcaacccgggaaaacttgtgaactaatcagaaaaagtggaaggcgggagatcttggggcgctgtccaatggcgcggaagagaacacatgagctggccaatcgggaacggcacgggggcgggctcgctcggcgcgaagttcgggcccgggaattccgaaggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcgggtagatccgaaacggggctggggcggagtgggaaaaggccgggtatgccttgcatgatcgcggggagctccttcctgtttttatcccacctagagaagccgggaagtaggggtttaggtccaatttgttggagtacttaaggactcgtttgcactttcttttgggggatgacagtggattcattgccctcggaggttcaaccagttatgagtgagggattggccagaagatcggggcgcaggcaagcaggagtgctctattaggataagcaagtttgacaggaagaagctactcttctccgaattacacagaggtgatgtgttcgtattgcacgtagacgtgtgtataacaggacctccttccccgcgccccgccaccccgacacacacaggagctgcctaaagtatccttgccttgcagattggaggctccccaaatattttgcgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtgagcattaagcagggcagctttgcccctgggtggttgaagcgccaggctggaatgagtaaggtctccacaagaccctgctgcctgcctcccatactcccatcagattggatggatggtcgtggtccagaccttcatcttcccaccagaagtgtgcacagtcagaagctctctgccagactgaccctttttggtcccgtttagctcatacaggacctgggatatcatcagaaagatatcacagtggggatgttctgaggccactagaggccaagtttagacttgattcagtttccagctttgctgaggcactctgttcctgggttagggcagttctatgttgaataatgtttttaataatctgggcatgtctttctccgtgacttgaggcagttagcctcagaaagcctagattcacatttgagttttgccactgcctcttggtaaagtcagctgtaggagtgttatggttattagactatagtagccaacattcatctagtgcttactgttatgagccaggccctattttaagtgtattgaatgtaggtggtactaatattatcctcatttacagtaaaggaaaatgaggcacaaagaggttaaggaacttgtccagggctgggcatggtggtttacacctataatccagcactttgggaggctaaggcagggtggatcacttgagctcaggagttcgagaccagcctgggcaacatggtgaaaacctgtctctaccaaaaaattaattaatttttttaaaaaagcctgggcacggtggctcacgcctgtaatcccagcactttgggaggccgagatgggcagatcacgaggtcaggagttcgagaccatcctgaccaacatgttgaaaccccatctgtgctgaaaaaaaaatacaaaaattagccaggtgtggtggcgtgcacctgtaaccccagctactcaggaggctgaagcagcagaatcacttgaacccgggaggcggaggttgcagtgagctgagatcgcaccactgcactccagcttgggcgacagagcgagactccatctcaaacaaacaaacaaacaaaaagcttgcccagggtcacataactggtaagtggtagagctaggatctgaacgagctggagctgggggagagtgagcatgtttgaaaactggaccttagggcggggcacggtggctcacgcctgtaatcccagcactttgggaggctgaggcgggcagatcaggaggtcaggagtatgagaccagcctggccaacatggtaaaaccctgtctctgctaaaaataaaaaaattagccagacgtggtggcacatgcctgtaatcccagctactcaggaggctgaggcaggagaattgcttgaacctgggaggcggagtgcagtgagctgagattgcactactgcactccagcttgggcaatagagcaaaactccatctcaaaaaaaaaaaaaaagaaagaaagaaaaaaaaagaagaaagaaagaaaattggaccttaggacagtgagggcagggatcctttgtaggaaagcacaagaaacacagacttgttcctagctgacaaggagtgtactgcctggtacctgtcacctgctgaggggcttaggatgtgagggagaatctgactacagtttcatattcttccccagaaatcatacagatttctccactcctgactctggtcatttctgtttttgtcctccatatttgcctggtgccccaccatcaacaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaaatggggaccacgccttctgctccaccacaacgcaatcggaggaaatctgttcaccgagtgttggcggaactggatgatgagagtgagcctcctgagaacccgccaccggtccttatggagcccaggaagaaactccgtgtagacaaagccccactgactcccactgggtaagtggagtcctcacttggccctctcagtgttttactgcttttcgattccttgtatccctaggctgtgaggaggtccccctgcctggggggatgggcacgggaggtggaatagatggaatggcaagacctgggttagctctgataggaaaagaaaaatatgtgcaggagaacatgagaggtggggtggggcagtgcttataaaacaaccggagtgagcatgtcctgctttttacattcatatggctttaaccccattcttctagtgcctaaggatggggaactttcaggctcatactagaggtttttaggcccaccctatgtgtttttaaggacagagtccaggctcaccttagttctcagaccactgtgcctctgtggcctcaccctatgaccagccatagggtggcaaggtctaggccttctcctacaggtttccggtgacccttgtgtctgtgtcacttccttcagaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccactgccaaggcaccatcggacacacctgcccatgagtagacacagcagcgagcaaataggtctgataaataccccccttcccttccctccccaggagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacacccgccctttcctacctagatttaatgagcccaagtttttaaaatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatcccagctctccctctgatgttgtgtgaccttaaggagtgtaaatggcaccttagtttcagggtcacttgggtatgagcattggatattcccatccctacctcagtaactgaaggacaaaccaagataagtgtgtctatctactgtgtcccaggcttctttatttaagaaaaaagtgatacatgatgtgggattaaaatcaagagcatcattgaacttcaccttccctccaaccagttgccccaaactcccctgcccccaccctttgtgttcccaattccttccttagtgaatgaagaacttaatcccaaaaaccctggcacaaactccaggttttctttccctagctcctcccctccccctgtcccccattcctagaagggcaggcacctcagtttgaatgcatgggagagcccagagtggtgacggagacagggggaaaggcttccccctcagggaaagggaccgaggagtacagtgcagtgaagtgagggctcccatagcctggggtaccaaaatggggccctggggccagaggaaaggacactggtccccctgagaaaggagacccagcagcctcaaaatcctctcgttgtgcatagtcgctgcttgatcgcttgcccttctggcgccggttacagaaccacactcggaccacctgcaagtgaatgacagaaaggagaatgacattagacaatgagctgagacgggcctgactctgcttggacattctatccaaagccaacagccctagagcagttagaggaggacattagagaatgagctgagacaggcctgactgcttggacattctgtccaaagccaacagccctagagcagttggaggagccagagctagggaaagcgaggtggtgacaggggaaagagatggagcccgcagagagacatggcactcacatccttctcgagcccaagctgctgggcgatgtggctgatctgctgcagtgtgggtttcgggcactgcaggaacaaattctccaggttgcctctcactcggttctcgatactggttcgctttctctttcgggcctgcacgagggtttctgctttgcatatctgtgcaggtgggaagggggtgacaagggcaagctttggacttgctgagtaacagcatcacaggggtctgtgactagatgtgtcagcagagccaggtggtggtgtgaaaaggcaggatcctggaagggttggctctggaccttatcccagcagaactgaggaatttcactccatcccactgagaaccactgcaccaaagacggagagctacgagccagtgatggaagcaatggaaattaggccaagaaagggaaggtccccgggtatccccctcccacccttacctcctgaagattttcattgttgtcagcttcctccacccacttctgcagcaagggccgcagcttacacatgttcttgaagctaagctgcagagcctcaaagcggcagatggtcgtttggctgaataccttccctgggggaggccagtcaaaagagaagcaaagtgagggagcacgcagggcccttgtgaccctgagatccaagcttaccacctcttcccagagggagctcaaagcatcttctccctctccctactcctcttcatgggtgagggtagtctgcccctgcccctccccactaggttcagggatactccttagaggggagatgcggtcagaatctgcagaggggaacccaccaaatagaacccccagggtgagccccacatcggcctgtgtatatcccagggtgatcctcttctgcttcaggagcttggcaaattgctcgagttctttctgcagagctttgatgtcctgggactggattttaaaaggcagaagacttgtaagaacataaacacaccagttatcaatctcccctttccattcgggattcaagaacctacgtgtggccccaaggaatagtctgtagaagtgcctctgccttccaagctgcccacctaacttctagaaataacctacccacaaatgtcattcacccattccctgttcactgactcatgcatgtaacaaaggactactcttcccccagaaactggcacatccaagggatgcagagcatcgtgaaaggacagaaagagagaccctggcctcgagaacacctgtcaggttatgaaggttagaagttctttgctgggcgcggtggctcacgcctataattccagcactttgggaggccgaggtgggcagatcacgaggtcaggagttcaagaccagcatggccaacatggtgaaaccccgtctctactaaaaacacaaaaattagctgggcacggtggcacgcacctgtaatcccagctactcaggaggctgaggcaggagaatcacttgaacccgggaggcggaggttgcagtgagctgagatcacgccactgcactccagcctgggtgacagagcaagactctgtctcaaagaaaaaaaaaaaagaagatagttcatttaatacctgcaaaattctctcactcaagtatcacccccagtttaaggatgttttgagattagagaaatagataagctgctaagttctgggttaattaaaaaggaagagcatcatgtctcagaagctaaattcagtatatactctccccagcttgctttgagggtcccacaaactataacatggcatgcatacacacaaacacagcaaaaaagtaacaggtgtcataagaatggataaagtgctttgtgtgtacttactcattttttaaattgattatccctcatctttactgtatctttttcactatagaggcatcctaattgatttttaaattcaagagatttatcgagcaccttctataagccagcggctatacaaagtggacaaagagccctgacatccagcatgacagaagtgctatttggcacttgttcttcaagttgcccacttggatctcttccaagtgcactttccttttttccctgccctataactttttaataataaacttccactcctgctctgaaaaataaaaaagtaaataaaataaaaaatggccaggcacagtggctcatgtctgtaaatcctagcactttgggaggccaaggtgggcagactgcttgagcccaagagttagaaagcagcctgggtaacatagtgagacccgtgccgccccttctcccacccctgctgcctctatttaaaatatatatatatattatggaaaaaagtaaagcagtctgggcgcagtggtcatgcctgtaatcccttcactttgggaggccaaggtgggtagatcacttgaggtcaggagttcaagactagcctggtcaacatagtgagactctgtctctactaaaaatacaaaaattagctgggcatcatggcgctcccctataatcccagctactcaggaggctgaggcaggagaattgcttgaacctaggaggtggagtttgcagtgagccaagatcgcaccactgcactccagcctgagggacagagtgagactccatctcaaaaattaaaaaaaaaataaagcagtctataggagtagggtaaaggagggaaggagattatggaggagggtgacacttttaaagacagagaaggtgattgtttgagcaaaggacaagagtctaatgtggcaaggccctgaagtgggccttccagagcccaaagctggtctggtggctaggtagatcctgttgcagacatagtgactttgttttagtccaagcgaaatgatctctcaccctttttctccccaccaagacggaatctcgttctatcgcccaggctggagtgctgtggcgtgatcttggctcactgcaatctccgccttctgggttcaagctattctgcctcagccgcctgagtagctgggactacaggcacccaccaccatgcccggctaatttttgtatttttagtagatatggggtttcaccatgttggccaggctggtcaggagacctcaagtgatctgtccaccttggcctcccaaagtgctgggattacaggtgtgaaccaccgcacctagcctcaccttttttttttttttttttgagagtttcgcttttgttgcctaggctggagtgcactggcgcgatctcggctcaccgcaacctccatctcccaggttcaagcgattctcctgcctcagcttcctgagtagctgagattacaggcatgcgtcaccacgcccagctaattttgtatttttagtagagatggggtttcgccatgttggtcaggctggactcgaactcccgacctcaggtgattcgcctgcctcggcctcccaaagtgcctggccacaccttttaaaacactgactctagttgacgtgttggccacagacagtagggaggaagcagtataatttgagaagctactgcggtaatcccagcagagatgatggtggctgaggccagggttaggttgtgattgattcaggatgtttcttaaggataggatgtaggacatgaaagaaactgaggatgactgggtttggccttgagcaactgggtgatcagggtggagcagttcagggagccatcacaagagacagaaaacgcggtagtcatctggtgtctaaatggcatttaagccttgagggtgggtgagaggaaggaagggtagatagagcagaggttgaaggactgagccctggggcatgccatatgaggctgccggcagacagaggtgcacagctagtgagaaaaaaacaaggcctttttgtagttctgaagcctcaaggaagtgtttcaatggtgcttgatcatatcaatttcaaataggctgttttcatccccaacttctgctcagccaataactcaaactgataaatgccctctgctatcttggattttccaaattctgttttggggttttggaataaacactggtccaaatcctcgcttcatcatttagcagttaaaacccgttaaataggataataatacctccccctaggagattttgtgctggttaatgagataatgatgtataaacggagcacacagccaggcacttaggaagtggaccacaattgccagccattatcattcaaggctcagcagtgacctcctgcgaagaggttggggcttctcggtcactccagaaaccagtcacacctttctgtgaggtctcaaggcttagtatttaatctctaattgcttacacttgtcgccttgaaggactggaagatacatctttaatagtcctcagcagggctggatgccttcaatcccgcagcagctctatatttgcaaatggcctggagaaatctctcaccatttttcttgtttacaactttggaactgaggctgaagtcaatcaaaatccagctttctacaaggggtgccagggtgtgcaccttaacacagtggccagtcattggcctgaggcagagatccggggaagacaagccctatacttgactggaggtaaacccagctcacaacgcgcacacacacagcccaaacaggagatcctatcagaaacgagtcacaccctagactttcaggaacaataatcctggaatgagcactgtttttaccctcaggctatgcttaaccctaaggccaaaatcttgggtctgataagggtcaaattttcaagcaggactaagggtgggaaaaggggctcaaaccaaccccaagctgggtctggtgctgggccagtaatgagtgaccagaccctgggcaggcctaggagatgtgagagaccctgacaagggctgggccagagcaaaggccagcctgggccagcttccgactctcccaggctgctctgccctcaccggcagttgtctcttcgaaatccagcttccacttcccacctggcccctgcctgccagggctgccagcagttgatacacacccctccctggccagggcagctgaccctgcctgctcctctcctgggtgccaggtctgggcagctgcaggtgaccacttccccatcaggctgccctgtcatgaccacctccccacaccccaaccccgtcgaagctcacttgcctcctccgggttttgctccagcttctccttctccagcttcacggcaccaggggtgacggtgcagggctccggggaggccccatcggagttgctctccaccccgactcctgcttcgccctcaggctgagaggtctccaagccgccttggggcactagccccactccaacctggggcccacagtacgccatccccccacagaactcatacggcggggggcatgggggaatcccccacacctcagagcctggcccaacccccggcccgattcctggccctccaggagggccttggaagcttagccaggtccgaggatcaacccagcccggctccggcccccctggcccatcacctccaccacctggagggggcgagaaggcgaaatccgaagccaggtgtcccgccatggggaaggaaggcgccccaagccgggggcctggtgaaatgagggcttgcgaagggactactcaacccctctctccctccccagtcccacccactagccttgacctctggccccgccccctggatgggtggaggagagggaggtggggggagaaactgaggcgaaggatgtttgcctaatggtggtggcaatggtgtctgtggaaggggaaaaccgggagacacaactggcgcccctccaggacctcagtgcaggtcccccacagaaactttttttatttttattttttaagacagggtctcactttgttgcccagactggagtgcagtggagtacaatgatggctcaatgtagcctcgatctactgggccaaagcaatccttctgctccagcctcctaagtggctgggactacaggcttggaccactgtgccctgttagtttttttatttttagtagagatggggccttgctatgttacccaggctggtcttgaattcctgtcctcaagaaatcctcccgcctctgccgcccagtgtcatgattaaaggcgtgagccaccacacccaactttcaactcccaacccgctccctggcactctctcaggctctgcacatcccagctgtctggaatcactcccacacctccatgttcttcaggaacccaggtgcttgaccccctctccacagacctctggcactgtgccttcaggggccagtcaccctctcagctcctcaaatttattgaatgtgtgtgtggcgctatccctcaatgcatcaacagccataagcacaatggccagctgctcccttatgccttcccccgatccatccagaatcctaggcattcccatcccgatactggccaaatccagccaccccgcagcctgggtgcctggcaccatctgcccagcctgccaaatttcaccccatcttcaagagtagactgccagacaaggcctccgtgctatatccccccacccccccatccccccacccctccgtcttccagaatcagactccagactctcctcatctaacagactaaggggttggtccctacttccccttcaagggaccagactttggactgactgggcctcagtttcccaacctttgctgaaacagagtgataagacacccgctttgggccccctccactatggaacctgcacatcaggttccttgctcccctctcaaccaaaactcagacatctaataccacggtaggccccgttctccctcccccacctccctggcccaggcctccagccctaggccctgggtggggaaaaccagggggtggggggtgtggagaaaaaatatctgacttcaggttcaaagaagcctgggagggactgggggaagggggcaggacaatggccttggctggacaatcccggtccccagagggggcagctctaaccctaaacaagtgctcaacccttgaatgggcctggatggctcccctggggactgcttcctgctccccaaccccccagtcccaatcccctcacacagaatccccttcagagacgctaaaaggagctccagcaacccccctctgcaatcccctcaaagactgagcctcagacgggcaccaagggccccccacagggacctaggtatctagttcctccttcctctgggggactcaggcgtccagcttcatcgtgcgtccctccccgagcctggcagattgagggatgtgctttgtttagtggggctggctggcagaaagacgcagaggaggtggagagtgatttgtggaggcgtgcaggaaggctgccctaagctccccttcagggtctgtttttctgggcctggcctgagtatcctgaggctcatgctgctggtctagtgcttgattctgtttgcaagagaatagccaacggaatgcctgtctgtgagggatgatgtttgtctgtctgctcccaaaacttgatctcagtggagggcctggggtaagtctgggggctccagagggggctctgggccagggctccccacagcttcgaaggccagaaggccaggtctggactgggcacgctgacctctgtcgacttaagtaaggcttctcattgcaggctccaggctcagccctgcctgggcttgtctgctggggtcagtggctctatctgcc

SEQ ID NO: 308 - DNA, 167278 bp, Homo sapiens
cccatgaaagccacatgagggaggaaatgctgaactactgctccattttactggtaagaaagcagccattcagagcaattgtcccaatgtcacacagcaatacagtcagaattacaccctcagtgagtctcttttgttttgagacaagagtctggctctgttgcccagactgaaatgcagttgcattatcttgactcagtgcaacttctgccttccaggctcaagcgatcctgtcacctcagcttcccgagtagctgggactacagacgctcaccaccacgcgagcatagagaggggatttcgccatgttacccaagctggtctcaaactcctgggctcaagggatccacctgcctcggcctcccaaagtgctgggattacaggtgtgagccaccgcacctggcccttagtaagtctcttaatgtcttgatacgtatcacaatcccttcccagcctgaatctgcctttcatggccaatgagccttgggccacaacctagttccttaccatcacaggcagaaggcttggcctgactgttgttcttagcatgcttctgcctcccttcctggctggctgcctgcttcctgtgaccacttcccacggctgctcgtggcttcctcatgatggcctgaaacaaaaagacccagccaaagcagtcagtcacaatgaggccaaattttgaggccttccaagggtgatagctatctccctctcatccaccattcacatggggtccagcttctctcaagcactctcaagatgctcacgggtttactcttggctggctgcagcactgagatacaactagtatagctgagcaagtggcctcaagggggccggcgttacagccctggagacatgcaaagactgtgaggccagggctgggatgggtcaaggatgaaagcctcctgtttgggagcatttgtgtatctctgatgcttactgtgactgtgtgtgtggataggggttgtttaggtgtgtctgggagaatgggggtaggcggtttctctgcctcttagagatgtagcatggttacactgaaacagcctgtagtagtcattaagtccaaaaccttcattttatcctagaagaaaccaaggatcagagggacaaaagatctgtctgagaacagatggcaaatcagtgggagaacagagattagctatttttattcctaatctagtaaaccataggtggctgaccatcaacaatgagaaaatgtgcctggttgattttcactgctccctaactgttataatggccgccttttctctaacagctaaaattagttgatattttgtgagtgcctactctatgtcagaccccatgaagagctttaccggatctctcaatctcctggtgactctatgaggtatgtactagtatcacctccaccttagttataaggaaattgaggtttatggagattaagcgacttgttctttcaaatccacgaccagcattcttatactgtgataaaatgcagtccctgctaagcctctgtatcaaactctccccccaaacctttgactttaccacctcattttcatcaaaagagcttgcctcctccttcagaaaaaaaaaaaccaacttcaaatctacctccatttgcactgtcttaccctcctcctcttcagggtcctgctcctccaatcccgtctaactgttggaactcagaaactaataccccaggccaggcacggtggctcatgcctgtaatcccaacactgcgggaggctaaggcaggcagatcacttgaggccaggagttcgagaccagcctggccaacatggcgaaaccccatctctactaaaaatccaaaaaaattagccagacgtgctcgcttgaacccaggaggcagagcttgcagtgagctgagatcatgccactgcacagcctgggcaacaaagacagagcaagactctgtctcaaaaaaaaagaaaagaaaagaaaccaataccccaaaatatggccctctgacatgctgaactcaagaagccgcaaggtctctctgatccttccaccccagactctcccaaagccaggataaagttgttctctggaactctttatctgcctaaagtccaaactcactaaaaagaatacttgttttttcttcccctcccaataagactaacatgtaaccacacctgaacaaaccctttcacaggtattgtgtacctcaggatcactcaaattccaaagagaactattaacaagtcaacctctgtccccattccattctctctagtaatcctttattgcccttcaacagaatctccttctggccaaagttcggtttatttaaaaacaaatagagctggacatgctggctcaggcctgtaatcccagcactttgggaggccaaggcaggaggattacttgagcccaggagttcgagattaggcttgcaacatagcaagaccccgtctctacaaaaacagaaaaacagaatttctcttctaccccttgtcaggcctctgagcccaagctaagccatcatatcctcagtaacctgcacttatacatccagatggcctgaagcaactgaagatctacaaaagaagtgaaaatagccttaactgatcacattccaccactgtgatttgtttctgccccacgctaactgatcaatgtacttggtaatctcccccccacccttaagaaggttctttataatctccccacccttgagaatgtactttgtgagatccaccccctgcccccaaaacattgctcttaactccaatgcctatcccaaaacctataagaactaatgataattccaccaccctttgctgactcctttttttcagactcagcctgtctgcacccaggtgaaataaacagccttgttgctcagacaaagcctgtttggtggtctcttcacatggacacacgtgagacacccctcccataatctgttttgccagatggtatataaactcacgaactctgtagggagatgggtaatcactttatggttctcccaatgtgcatgttaataaatttgtatgccttttctccagttaacctgccttttgtgagctgatttttcagcagatcttcagagggcaaagggaaagattttccccttggctcgtaacacaatcaaatcccaccctccttcccttcatagccaaacttccttcaccaaacctgcttacttccacattcattctacaatctattctccaaagagcaaaggaatcttttccagatcacgtcacttccttccttataaccttcaatggtttcccattcttttttttttttttgggatggggtctcactctgtcacccaggctggagtgcagtggtgtgatcttggctcactgcaacctctgcttcctcggctcaagcaatcctcccaccccaataccccaccccaactccaagcagctgggaccacaggcgcacaccaccaccacatccagctaatttttgtatttttgttagagacagggtttcaccatgttgcccaggctagtctccacctccagagctcaagcaatcaacccgcctcggcctcccaaagtgctgggatacaggcatgagccacggcgcctggtgacaccccattatattcttttattttctttcttttctctttttttctccctccctctttccttccttccttttttcctttttctttcttttttaaatactgtaggcctttactatgggtcattaaattcttgagcaagctggttgtggtggctcaacactgtaatcctgctactctggaggctgaagtgaagaacagcttgagcccagaaggtcgaggctgcagtgagctatgattgtgccactgcactccaccctgggctcagcaagaccttgtctcttaaagaaaaaaaaagattgagcaaatatttatagagccccctaatatgtgccaagcagttttaggcacttggcatacttcagtaaataaaacatcaaaagttcctgccctcagggagcttatattctaatggggacagaaaaggaataatgaacataagtaaattccataagatgttaggtgataaatattagcataaaaagcaaaaattagaccaagaggggaaaaaaaagagtgccaaggtggggtttaatgttgcaattttaaagactgtggtcaaggtagacccaaagcattctaagtgagtgcaaaggccccaaggagggtgcctggtatgtctgtggtacagtaagtaggtcaatgtggttagaatggaatgagatgggactgagtggtagaagaggtcagagaagtaaaccagatgaggtggggagaggagggtcacaaagtaccttataggccattggagggatttggctgccacacccttgctcttagaaggcagtcctcttactacagccttgcaggtccagtgatccgggcaccatccgcctcatcccctcactatgctctagccaaggttgactgaatttagttgcttaaacacctcaagtgtgtctgcccaccttggggcctcacacaatccatttcctctgtttggactcttttatgcttttacctaacaccttatcatttttcaagtcttgactgaaatgtccaaatcaggtcccctcatcttatcctatcacatatttctgccttgtagctcttacctaatgtaattttacattactttgattctttccatcagtgtgtacttcctgaatttgactgtaaaaaacgacttgagtgcaaggactgattctcttgttgattggtgtgtgtccaaagtcagtgccaggtaaactgtacacaatagatacctgttaaatgaattaatgggatgggggatagtcaaaagagtttcccttttttaggataggagaaatccaaagagtttttttatttttgttttttttttgtttgtttgttttgtttttagagacagtgtgtccctcactttgctgctctgccactcaggctggagtgcaataagaacatggctcactgcagcctcgacctcctgggctcaagccatcctctcacctcagcctcctgtagctgggactacaggtgcgcaccaccatgcccaactaatttttaattttctttttgtagagacaaggtttcactatgttgcccaggctagtcttgaactcctagggtcaagcgatcctcccaccttggcctcctaagatgattacaggccataagccactgcgcccggcccaagcagttctgaataatgatgaaatgggctcagttgagagaagctgaagattaactataaacaatgagtaacaaaggagcactggaaggcagaggtggatgggaatcgtagtgtttacggagggactagtctccaataggaattttttttttttttttttttttgagacggagtttcgctcttgttgcctaggctgaagtgcaaaatggcgtgatctcggctcaccgcaacctctgcctcccaggttcaagcgattctcctgcctcagcctcccaagtagtgggattacaggcgcccgcaccatacccagctaattttttttgtacttttagtagagacggggtttcaccatgttggccaggctggttttgaactccggacctcaggtaatccgcccgcctcggcctcccaaagtgctgggattacaggcgtgagccaccgcgcccggcctaggaacctctttcaaattcaatcaccctctaggtcgactataccgcctagctgcttcacaatttgtcccttcctcgccatccatactgccagccttaattcaagttcacattatcacttgattggattattacaaaagcttccctaccaatcggtcgctcttacaccctgggcagcctcctccgatggcccactccccgcctctttcactttctggagatcactgagctctccatcctctctgggaatttaccgatgcccagaacgcccttctttcccccacacgaccctctcctagtctaactcctgggcgtgctttaagctcagctcaggcagcgtcaccttctctggaaagcccaaacccagccaccccactacccgctacccgcggcccacgctgatgaagacagcagaacacggaggccccgcgttcccgccgcgagagcaggagagaaagattacctcccgcgagctctagcgcgcccggctttccggcgcactccagggggcgtggctcgggtccacccgggctgcgagccggcagcacaggccaataggcaattagcgcgcgccaggctgccttccccgcgccggacccgggacgtctgaacggaagttcgacccatcggcgacccgacggcgagaccccgccccatccccgactgcctgaaccgcgccaggagacggaccgcaagtccagcgtacccacagacgactcaggcgggagacgagcggtgtcatggccgccgacagtgacgatggcgcagtttcagctcccgcagcttccgacggtgagcggcttcccagaggtagccttcaaagcctctgcgctctgggagaggggaaggcctcgggctcatagttctagaggctcctcaagcttcagaggactgctccttccgcctgaactagccacgaggagactacaagttccgttgtacaccgcggctccggctgcaaaagcctggagcgttgggagcatggggctgatggaggcatggcgggagatgtagtctggagctcataacggttagtagtaatagttgtgattcagttcagtggagtggattgagcgttgtgatccaaaggaaggtaggacgtattgggagctctggtgtggggcactgccaggctctggggcttactgggagctgttgcttgtggcgctggggcaccatgagaacagtagtatggatccctgtgggatattaagggagctgagatcctcaagccctacaaaatgtttcctgcaggacatgggaaaaaagaatcaaaggtcgtctagtccaactttctcctctacagattgtgaaagcgaggtgggaagtaatttacccaggctcatacaagccagtagaagactcaggcttcctctccccaaattcagggcattctccactccaaggcctgtgtgtagaacacgtgggttacaaaggcttgtgggaaaagctaccaatggaaactaccccccttaccaccatcaccgtggcctagcttggtgtctgttcccctgggctctttccttaagcatgaacatccatcaccctcctaacccccaggtggtgtcagcaaaagcacaacatctggggaggagctagtagtccaggttcccgtagtggatgtgcaaagcaacaacttcaaggagatgtggccatccctcctgctagccataaagacagctaatttcgtggctgtggacacggtgagagttgggaaacaaggagggcaggtggttgtgaaggggctggtgctagaggcctgtcacaactctccctttacctacccacaggagctgagtgggcttggggacaggaagagtttgctgaaccagtaagtataagcccttttctctttagtgccagccctcaactgtggagtgggggggtcacagacctgggtggtttgggtccttcataaggctaactcctagccacagcaacccccatacccaaccccaaggtgcattgaggaacgttacaaggccgtgtgtcatgctgccaggacccgttctatcctttccctgggcctcgcctgcttcaagcggcagccagacaaggtatgagctgatctcaccccaatcctaggtgtggctgtggggtggagggtagagagattctagggaacatcagataggaagcatttctctcccaaatctttttttttgacttgatagtttttttttttttatttgaataggtttatggggaacaggtggtgtttggttaaatgagtaagttctttagtggcaatttctgagattttggtgcacctatcacccagtgtacactgtgcccaatgcgtagtcttttatccctcacctgcctccatcctttcccccctgagtccccagagtccattgtatcattcttaagcttttgcatcctcctagcttggctctctgaaatcttgatatagcagacttctctttctcccagggtgaacattcctatctggctcaagtgttcaatctcactctgctgtgcatggaggagtatgtcatagaaccaaagtctgtgcagttcctgatacagcatggcttcaacttcaaccagcagtatgcccaaggcatcccctaccataagggcaatgacaaggtaggcctctagcctccctagccttgagtctgccctttctgtgactttatttcttcctaccctaggctggatgtctggggagaatctgcttcttagggagtatggggaatcactagtgacagggcttgggaaacaagactggtatgaggagggtgggcagcattgggtaaggtagagagagagcgttccaagtggggaagtctgggataagtgcccagcagaagaggctccctgggggactctgtcctcctcattgacccctttactttcatctagggtgatgagagccagagccagtcagtacggaccctattcctggagctaatccgagcccgccggcccctggtgctacacaatggccttatagacttggtgttcctgtaccagaacttctatgcacacctccctgagagtctgggaaccttcaccgctgacctgtgtgagatgttcccagcaggcatttatgacaccaaatatgctgctgagtttcatgcccgtttcgtggcctcctacttagaatatgccttccggaaatggtgaggaaatggttgagggaaaggggtggggcctgatacgagtttatttcattcacttaagatatttattgagctcctaccatgtgcccaggcagtgttttaggtgctgaggattcagcagtgaacaaaacagaccacaaaaccctgctcttatggagcttatatgctagtggaccattaccctcttgcgctgttgcagtgaacgggaaaatgggaagcagcgggcagctggcagcccacaccttaccctggagttctgcaactatccttccagcatgagggaccatattgattaccgctgctgcctgcccccagcaacccaccgtcctcatcccaccagcatctgtgacaacttctcggtgagagcacccacctgtttcttgggagggaaggttctgatgcctggagcctctttctaagcctctttcccacccctaggcttatggctggtgccccctgggaccacagtgtcctcagtctcacgatattgaccttatcattgacactgatgaggctgcggcagaggacaagcggcgacggcgacgacgtagggaaaaacggaagagggctttattgaacctaccggggacacagacctctggggaagctaaggatggtcctcccaagaagcaggtctgtggggatagcatcaagcctgaagaaaccgagcaggaggtggctgccgatgaaactaggaacctgcctcactccaagcaaggcaacaaaaatgacttagagatggggattaaggcagcaaggcctgaaatagctgatagagctacctcagaagtgccagggagccaagccagtcctaacccagtgcctggggatggattgcaccgggctggttttgatgcctttatgacaggttatgtgatggcctatgtggaagtgagccagggaccgcagccctgcagctctggaccctggctccctgaatgccacaataaggtatatttgagtggcaaagctgtacccctcacagtggccaagagccagttctctcgttcctccaaagcccacaatcagaagatgaagctcacttggggcagtagctgatgcaacttccaccttgctctcaggtggaacagaggtattttgggtctctctagcctgaaatgtcatcctcaactgctactgagtttaggggagggggaatgtcttgacagacatcactgcattgccctggaccgcctcctttatcccagtgtttgaggtacaagtaagaaggctgaccagcacctgtaacactgactttatttttaagtctgaaaatgtcttgggaaagttttacaaaaaaaaaaatcaacagaagcaagttatgaaaatatttgaccagcttcatctttggttatttcttattgcagctctgtaaggacagactgttcccaaagctccagccatggcaggaagggaagcaaatcagtccctgtataaaccatttaaccaattgaatgtatcacatgttgataaatacatagaagcaggccctagggcctacaaaaccagccccactcccaaccacaaggttgaaagtcttatggggcagaacattaagactcctttataaatatgaaaatagattaatcaacaggaaaaggtctttgaataggttagctaagagccatgaccaccacgctgccttgctgtccccttgcatagaaatgtagtgacgtggtctgaccatgcagtaagtgcaaacagcaattactcaaatgtcttagaatactggcaagaagcaccccaatattcaggtctgggaaacagccatgaccattacggcctcttgatcagctccatgttccactcagtagcttatatgccccaagaaaaggcaagagacagacctggggtggggaaagaaccggggtaatagctgcctgccagctcagcctagaactagacatcctctggtcctatctggggaagtacactggagagggtctggtgggaggcagacctccttgctggatttcagaggcttggtatcagctgttggccctaactaggaaggcctctcactgctgcctcccgtcatacacagccaatgggcactgggagcccagaagttgagcctggcttggcctagcctgcctgctctgtaggctccagggaagaatcaaggctgtgcacctagggggccatatggtttcagctgaaggtccatccccaaggtgaggcagggactaaaccccctcacccatcctgctttccctgggtttgcaggcctatgcctgaggtggagaaggtggctggagttgagcctgctggcctttcttctacctccatctcctcagaagcacccgcagggcatggactggtcccctggggcctggacccaaaaccattttcttcctggagaatggagcagtccatagcctcatgggcttgagcagctggtagggcagatgcccggaatggtgggatctctttaactctgtacttgagactacttaggcgtggtgggggcccatcagatagcgattcttcccggcccacaaatggacaagcctcttgatgcaagaactcaggcgaaccaggcaaggaacgccaccggcgaataggtggggccaggggctcctgccagtcagccaggggcatagttccgggccctggtgcatccaggtcaaataccagagagatgacagacttgctgggcaggtcaaaaaacttgatcttgccccccatgaggtcctggcgagcactaaaagggttgactttgggggtgcgggcagcaccatctcgtggccggtagtatgggtccaagacactcactgtacgtgggggcttacgggaaaagatatctgactggcttcgagacagccagatggtacgtcttgggcatggtgacttgtgggggatcttgtcatccagtgagcttagtcgcttcaccccaggtgctttctccaagagtcctgaagaataatcaagtctgggttactctcactagtcataacaaatacaagcagcattttaccacagaatgttttcactcatgaaagcaaagctgataccatggccctgttttaccaatgaagaaacagactcagagaggggaagcagtatgccaagccacagctcttaaaaaggccagtactttctgcatcatctccttcccctcccatttgtttctggacctgggatcctggcaatcacaaccctaagaggagaaggccccacatccgaatttcctcccttagggttaggttgggctccctggtctaatctcttacccctggctgtgggctgcagcttcctatccctctcctgctcttcttcctgtaggcggctcagaatttcctccagggtcttcccaatctccacaaaagatgggcgcagtttgggatccatctgtaggtatccacaacagccatgagctctgccctccatctcccaccccaaagatggcatttgagtctatttctggcatctttgaagattcagatgtgcagctgagagaccttttctaaaggccccagacaatgaaggtgatccctacagttcaggtcagggaaaacactactgtctactaccctccctgtcttagtgtttgtcttatcaccttgtcacagaaccttccaaaagtatgctcatattagtttattctgttcttgagttctgctcctaatgtgtttctgggaggtatctgaacaaagcccacctaccccttgatcctaacaggtaaggtccagccccagagctacatacatgaaggccaagaagagcctttctcatatgcctcaggaccagttggatccacagtccaacaataaaaccggaccagagttccatcaacacctaacgcaaggagtgatgggtctaccctacaggttgaggaccagataatacaaaacaacttctttctttcctttgtccagagctctgaataggttagctgccagagggaggaggaggaggtgtggttgctgtcactacagtgaaaatgaggtccctcatgaagctaattagcagcctctctgtacagtcctaaccaggtgaaaagggttcagccagcccctgatgaaaggcagagggagaaagacactcacgttacagcagttgaaagtaagttgcagaaaatctgggggacagtctcccaccatgtgctggaaagcatcatagtccagcccgaaattctgtggatgggtatggaaagcataggtagacagttcattaatccccccacccatcctagcctgctcagtagaagtggttgggagctgcccctgacaaccagcaacagagagttccagcaagtccatcccagggacagaacagttccattgcttcaaactagccccatcagtggcaatgatccccatgcttgcagctcacctctgtgcggggaagatagtccggatcggcctggatgcgggcgatgatctcgcagaggatgataccataagagaacacatctgcctggtgggtagtcggactttggtttccctcttaatgggttgaggggtagggtatctgcccctgcccctgcctcccctgcaccccaccatctaacagcccaggcctgggccatattgcccatacttcatcccagtcagtcactgggcagctgccaggtaccaccactgctcttggtaggaacatcttggacactctgctaagagtggattctagggagaatcagccgagcgcgatggctcatgcctgtaatcccagcacttcaagaggccgaggtgggcagatcacttcaggtcaggagtctgagaccagcctggccaatatggtgaaaccctgtctctactaaaaataaaaaaattagctgggcgtggtggtgcatgcctgtaattccagctacttgggaagctgaggcaggagaatagcttgaactcgggaggcagtaagccgagatcgtgccactgcattccagcctgagcaacatagtgagaccatctcaaaaaaaagaaaaagaaaaaaggagaatcaggccttgagatcctccaaacttaccttttcattatagggctcatctcggagaacctcaggtgccatccagaatggggaacccaccacggccagcttctcactccccatgctgtggggtgagattatacagaaaatgagcttgccaatggctggtgcaatggaatcttttgaccattcctccacctcaaggatgggtacagacgaggactaaacaaatttagggagctgaggttgagctgtgaccaagtcctggcctctggggaggaggctagaattttcccttagcttcagccccctgtcccttggaccccagcatccagtagggctacacacctgacatcggggatcttctcagccaggccaaagtcagctaccactgcagagtaaccattctcatccctctttatcaggcagttctagggttcccaggaaggaagagaaaataatgtggctcagaagcggggatcagccatagagttaccacccattccccccttcctatcacagggcaccttgtcctctgctccttggtgaaccgcactcaagctgaccccactggtcaggtcaggggctctaagacagccaggtgagatgagttagtcctgggtcttgggtggctgtcctaggatacacttcacattccaaacacaattactcatctttgctttctaagtgctaggcataattttaagtgctagaaatagctagatgaaaacaaccaaaacccttgtcctcttggagcttgcaatataggggagaacaacagactatcaggcccctggcctcccttcctccttcctcagaaacacagacccaaagcccaggcctgaccttgccaacttgatataagcacaagacaagtgtctaagccttcactaaccttcactgtccacaagatcacaaccaacctcttctctggcattaaaagtctatgatctggctttatccaactggcctagccgctgtccccctgttcctggtgcccctatgcacatatcctcatccaaacttgtcacagacaagcttgacttaccaaacctgaacaggtccttcaagcctttgcctttgcttacattgttccctttcatttgaaatattctcccaattatccttttcacctaagaaaattttgtattttaaggcaagctacctttttagccatgacctcatctttctccctctcatctcaactcttagctcctcctctatgccactcctcttacagtctagcagaaaagctatgaacccctcaggagcaagttctggtttgccttccttcctcacagctttcaattcatgagacaggctgagaacatgctcactgaaaaaatgctgtcttcaggtcaacccaagtgacctgtaaataaacaaaaagcggcaaccagctctccccaaatagctgctttcaaaatagccctacactgctctggctcaagaggcacctcaccccacccgcttccttcagaatagcagagagcagggatccttggctcacagaaacacttctggagccagcaaggccccatctgacccaaaccagccctccctcttccttgccagccttggtatctagttgctaagacatgccaagtcacctcctgcttactcctgtcaggtacaaatcaatcccttactctggccttgacatgattacactatttcccttccccaagctggaaggagccgtgatttcatcacttctaccctggatcacaggtagacatgcctcatctctggcttccaggaaggacagttcttgtgcttgtcctggctttggctctctaatcagtcctgctggctcagcactcgcagctccctgactttgactgtctgtgagaagatgggccctaggccagcctgcctattagccaaagccccagctatagggcaccagcctgtgaggcagtggcagctcagatatgtcacctatgtctcttccctcctagaagacttttgagtgaggtagccctgcctacactaagcagtaagagaggaccagtcagatttccctgaggcaagaggtgaccttttcagtttcagaaaacagcccaggcactgttgctgcctggttcccattcttcatttcctcacacctattatatcacactgcaacagtgacttacatgtttgcctcttcactggcaaggaatgatttcatttgcctctgtatctgtaacctagcacaggtacccagaaggagcttggcaaaagtgtgttaaatgaaagtttagtctgatgactgaagcaactgggcttcttttaaaagcatgtgtcaagctgggtgtgatggctcatgcctgtaattccagcactttggaaggccaaggcacgtggatcacctgaggtcaggagttcgagaccagcttggccaacatggtgaaaccctgtctctactaaaaatacaaaaattagccaggtgcagtggcaggcacctgtaatcccagctactcaggaggctgaggcaggagaatcacttgaatccgggaggcagaggttgcagtgagccaagatcacaccactgcactccagcctgggtgacagtgagactctgtctcaaaaattaaaattaaaaaaagcgtgtgtcaaacgtatacaataatcatacattccactctccatagtgaggactgagctgacaagagactcaaaagggtggccatggatgcatttcctggaaacctacacaaattcttcagaactgggccagatcagacacctgaaagtgcctgaggtgtcctggaacagctgcacagtcagtattaacactgaataaagccacctgagtgaagaaatgccaagtctattaactcatgttcactctaaagctgtttctgcaacaaaaacaacaaaacactttctatgtggcttcacctctttcccctcacccgcaacaaactgactccctaaacccagttaggatcaggcaggaaaagactaagattctactgaaagactgaacagttaagaggttcttttcatagcacagggagatcagtgaccgaactgccggactcctaaatgcctcagggactgttatatttcaagtctcttagaggattatctgttttggtgtgatgtgtcccatcccttgccctcaatcctaccatgtgatctcatacctttaccatagctcttgtgtaatggcctgctgacttaaatatctccacaactagagtagagcccatggaaggtagagattggattccccaatattgtgccctctaatagcacagcataaatagttcccagaagctgctgatggttttaattataaaaattaactttagggtacactaacagtcattctctacatccctccagcattcaacgttgttcctaattcatgttctcttcactctgaaaattggcattttctattcctcattgtgtggcatagcctaagaccataactgaataggcttttcattccagtgaaatcacctaagtggcttctatgcagtcaacaataacaacagaaaagaactaagaactaaaggtgcaattcataattcatactcattcccaacagtaatcacagaagatcagttgggcagtaatggtattaagcagaagcaaactactttctcagctgcccccaagagccaaggctcgggtatgtgtgtactggttacttctagagctactgataaaagcctgtgtgtggctattggcacttcttcatagtgctcacaaactgaatatttttaaagccacactgcctcccacttccttccaagtaagttcttggccttgccactgcaaaagtctgtttcaggctgtttcttagaagtaattacaaaattagactgaatggctatatctgacagacattttactcttagagcattattgcagtagctgcggacatgagtcctataaaggtaatactactttcaggaggcacgttgataggaaactagggatctttttgcttctaaccacaggcttaggatcatttggaaaaaggcatcttcttctctctgtcctggtttacccacttggaacatgttacctctactttaaatccctcttgttagctctggtctgagcagtgtggactgatcgctcctgcaaagtcaaggacagcatctgttttacagactgggagcacggaggttccaaggtcactgaagtcgttcagagatggggacaaaactgggcctggaacccagaatctcagctctggagcaggcgttttggcctctttgctatcaagcccttcgcccttccctgaaataggcccaggaagactttatactctcataggctctgtgctaggtggtaagaaaacaaaagtaaataagagaagcacttgagaaactcatgctggtgggagatacagacacaacagaacaatcaagtgatatggagtgtataatattaaaatataagaaagcctgatactgtccttaaagaaataagacacagacccaagatggactatgaagagataatttggaaacctccgagccctctactgtccctttagctttatttctcagagatgataaaagggcaatgaacacagacggtatctcaaattggacagtctggttcataagactcacttgtttgtcttcaacttgagatcccctatagtgtacttcccagccttcctctagagtttgcaaacgtcctttgttctcaccacctggaattatcctcaaaacctccttaaagtccggacccaagaaagtacagcccagaaatatagggagttatttctcctatgttcctagtttcttgtctcaagtcagttgacactgggaatacccattccccataaggaaaagcaaagggtagtggtcttatcctatagtccaaaaaggttatttttataatacagcacaacaagcccagacagaaccacacttggacactagcacaatgggacaaagtgcttttggggcacagaagggaatatgatgaactcttagggagtgggggctttcctcgaggaagcctagctaccctggcctagagtgatctttcctgctcagaaaacttgtcgtctatgtagctaaacaattataaaatgctgtgcactactttttagttatttgccaacaaaactgtacatacctctaggtcagaagttcctcttttctaatattccttcatccttggagccaggtataggagacacttgtgtgtgtgtgtgtgtggggggagtatctgtgtaactgatacatattttgtcacaaactccttctatcttagaaaaaatggcgctttctgagtaggaagcaaagatttgatatctgagttgattcagtcccatccatttgcctggaacaaatgcaattttctttttttttttcttttttttttccaagacggagtctcgctcagtcgccaggctagagtgcagtggcacgatctcggctcaccacagccaccatctcctgggttcaagcgattctcccatctcagcctcccgagtagctgggattacaggcacctgccatcatgcccggctaatttttgtattttagtagaggaagggtttcaccatgttggtcaggctggtcttgaactcctgacctcaggtgatctgcccgcctcggcctcccaaagtgctgggattacaggtgtgagccaccatgcccggcctgcacttttcttagtcttggttttccaaaacattctgggggagaagaaatggctaataaagagataagatatcaccttccaggtcccaactgcctaactgtccagttcttacagacagtaatgtagataaagggctccttacaactaggcctctgctggttcccagtttctacttgccagtcttgtgctccttcaggaacagtgcagctgactacaaatgactctgccacacaccaaaaccattctatgtgaggcatccaggtacttactgctttaggctttattgactcagtactgctgcttttgttccctttcaagctttttcttaagatgggctcccttcccctccccttcatctggggcagaaggagtaggagtatgtgcatgcatatgtgaatatgtgtacatgtaggtattgagggtggggaatgaagtgacagctattcttaggcaggtacaaaactcttatacacctccctagcagactttaattcagttcttgggcagcagtcatattagatatgttagattgccttatagttcccccattaataatcaaacggtactatttatataagccttgtcatgatggtatcttaggccatttggctatgaggtgtctgttttgtggcatggccaacttcctctgaaagcgactcttttctaacctggtcacacagcaatttggacagcaagagagtgctacagagatcagctgatgccaaagaggaactggcagggcagcagaaactcaatcacacaggcagaaaatgggtcagtacatatggccctaaaaacctgcattcaagtgactaaaaatcactgaactcctgctcttagctaagaactacatcctggggccacaggaaagaaaactgataggcccctatactgccttgactgctgtcattcctataaggcaagaatttcttaacccttctcatgtcatttgctcctgtaacacatattcaggagattgaagttaaacatgaaggctctcaagatgtatgagttggctgggcacagtgcatgcctgtaatcccagcaccttaggaggctgaggtgggtgactgcttgagctcacaagtttgagaccagtctgggtaacatggcaagaccccatctctgttaaaaatacaaaagaaaggctgggtatggtggctcatgcctgtaatcccaacactttgggaggccaaggcacgtggatcacctgaggtcaggagtttgagaccagcctgccaacatggtgaaaccccatctctactaaaaatacaaaaaattagcgaggggtgatggcaggcgtctgtaatcccagctactcaggaggctgaggcaggataattgcttgaacccaggaggtggaggttgcagtgagccaagatcactccattgaactccagcctgggcaataagagtggaaaaaaacaaaacaagaccaaaatacagccaggcatggtggtgtacgcctgtggtcccagctattcgggaggctgaggtaggaggattgcttgagccgatggagtggaggctgcagtgagccgagaccatgccactgtactccagcctgagtgacaaggtgagaccgtctcaaaaaaaaaaaaaaaaaaaaaaaaaaaaaatatatatatatatatatatatatatatatatatgttggctcactcagcactgaaaggaacctgctataagaaaatataggcttatggtggggcacagtgactcacgcctgtaatcccagcactttgggaggccaaggcgggtggattgtttgcagccaggagttcaagaccagcctggccaatatggcaaaattctgcctctactaaaaattagctgagtgtggtaatatacacttctagtcccagctactcaggagactgaggcacgagagtcgttgaacccaggaggcagaagcactccagcctgggcaacagagtgagacactgcctcaaaaacagaaggaaaagatgtaggctttctaaggactaactataaaatataatgaattatgtcctctgtgattaaatgttaaatctaacacagctttcttggcaaaagagaagggtggtatctctcaatgagttgtgagagtaaagccttcataccttagatgtgaggtcccgatgaaaaatgcctttgaagtgaaggtagctgaggcccactgctatgtcataggccagttttaccctcacagtccaaggcaaatgcaggttactgtctagcaactgttccaggttcccggagttgatatactgcaaaacagaaggaaaacccagctaccatttatcagaaatatttaggctagtggtgaaaccattagagagtaaacacctggaagagagagactgtattttttttttaagttactgagggcttattctgcctccaagcactatggtaggtgctgcacacaatgacactttcctttaaggagatcacaatctattaagggacatagtcaaacaatatcatataataaatattaaaatatagttatgtgcaggtaggacaacaccatgcagcaacaaggataaagctaaactgtggaggcatgtcagaggaaatgcagagaggaaataaggagtcagaaaggatgacctggagtagcaggaaagtagcacgaaagacacagagggagcagcatatgcaaagttacaggttaagtgcatgatgcattcaggaacttaatttacttcgatatggccagagtgcatttatagatgagtcaggaagtgaggctgacatgttttgctaagatatgtgaactttatcctgtctataggaaacaaaagaagcattttaagcaggagagccacatggttatatttgctttttaaagaaaatattattttagccatggtatgatagatggattagagtgaaaaatacagagaaagggaaataggagattactgcaataatcctggtgagagcagggcatctgaatcatggcaatagtggaggcattggaacaaggcaagattcaaaatgtatttagatggcagaattaaaaaaaaaaaacttgataattgcctggattagagaatgagagcaataggctattggtccctggatgtcatttttaaatacccagagagcaaggagaggagtaggtttttagaagaagaggcaatgttaaaagagagtgagttcaggccaggtgtggtgactcatgcctgtaatcctagaactttgagaggtagaggatcgcttgagctcaggagttcagaccggcctgaacagcatagtgagagacttagtctctacaaaaataaacagaattagctggacgtgatggtgcacacatgtagtcctagctacatgggaagatcgcctgagcctgggaggttgaggctgcagtgagctaagatcatgccaatgcactccagcctgggtgatagacagagcgagaccctgtcttaaaaaaaaaaaaaaaaaagatagtgagttcagctgggagaagttaaattattaaaggtacaggtgcttattggacaaccaaggtggaaatgatctaaatagagtcagtttgaagcttaagaacaaagtctaagtgaaagacaatatttaggaggcaaaaacattgagctgaagcagtcatgcattccaaggtcatgcatgcccagggtttaacatgtaagatgggaaatcaacagaatcccaaggaacaggcaagaatgtcaataggagaacattctaaatgttcagaaggacggccgggcgcaatggctcatgcctgtaatcctagcactttgggaggccgaggcgggtggatcacctgacatcaggagttcaagaccagcctggccaagatggtgaaactctgtctctgttaaaaatacaaaaaaattagctgagcatggtagcaggcgtctgtaatcccagctactcaagaggctaaggcaggagaatcacttgaacccgggaggcagaggtagtagtgagctgagatcgtgccattgcactccagcctgggcaacaagagctaaactccatctcataaataaataaataaataaataaataaataaataaataaataaatgtatgtatgtatgtatgtatgttcagaaggacaatgacattctacatgtcagaaggaaagcattctacaaaggaaatgactgacagtatcaaaagccatgaatgaggaagacgagcttgaaaggtatccactgaatttgcaaccaggaaatcattggcaaccttggacagagcagtttcagtaaagtggttaagacgagtaagactgaagtgaacagaggaaagagtagcagataaggttatggagaaactatttgaagatagtcttgctgttcatcattcctaaatacccatgaagggcagctttgcttttttagtaaaaaaaaaaaaaaagaaaaaaaagtgaataaggctgggcacggtaggaggccaaggtgggaggatcacttgaggtcaggagtttgagaccagcctggggaaagtggcaaaatcccgtccctacaaaaaatacaaaaattggccaggcacggtagctcccaggggtgggatcatagtagctaacacctgtaatcccagcactttgggaggccaaggcaggtggattacctgaggtcgggagttcgagaccagcctgaccaacatggagaaaccctgtctctactaaaaatacaaaattagccaggcatggtggcgcatgcgtgtaatcccagtactcgagaggatgaggcaggagaatcgcttgaacacgggagatggaggttgcagtaagccgagattgcaccattgtactccagcctgggcaagtgacggagtgaaactccgtctaaaaaaaaaaaaaaaaaaaaaaaaagcctgggcacaatggctcacacctgtaatcccagcactttgggaggccaaggtgggcagatcacgaggtcaggagatcgagaccgtcctagctaacatgctgaatccccgtctctactaaaaatacaaaaaattagccgggcgtggttgcaggcgcctgtagtcccagctactcgggaagttgaggcaggagaatggcatgaacccaggaggcggagcttgcagtgagccgagactgtaccactgcactccagcctgggcaacagagcgagactccatctcaaaaaaaaaaaaaaattagctgggtgtggtggtgtgtgcctatagtcacagctactcacaggttgaggttgggatgatcacttgaacctcaggaggtcaaggctgtagtgagccatgattgtgccactagattccagcctaggcaacagagagagacccagtctcaaaaaaaagtgagtaagtatatgtatttataaataataatagcagctgttatttatatagtatctaaattgtttcaggcactgttctgagagttttgcatatattatctcatttaatctgcacaataaccctataaggtaggtacactggtactttttttccttttttttttcatgtcagacaacgtgcagacattaataaggtttgagggtagtacacctcacacatgcacatgaaaatccaatcatcgtgctatggactacaaaatgactacatactattactcattttagagaaggcatttagaaattaagcaacttgcttaaagttatccagttattaagtggcagagactggcagactctgcagtctggctccagagtccatactctttaccactacgttgcactggagacttagagaccacagcatctgagtaagagagcctcatgcagcacaggagctcaaaaatgaatttactcaaaccttatatgatgtattatctccctcctcctcccaagggagaaaaagagggaaattcctctaagcctaaaatttatatcttaatacatatttttgggtaccattgcatttacaaaggactagggaacttaatgggataagaggagaaatatctgaattctagcccaattcagcctcctaatagccatttaacttggacaaatcaactaataaggctatccatctttcacttttctcaactataagtaggtatgataatccctgattcacctaatttgcagtgttgttatgagaatctaataaaatatgtgaaagttggccaggcgccgtggctcacgcctgtaatctcagcactttgggaggccaaggcgggcagatcacctaaggtcaggagttcaagactagcctggccaacatagtgaaaccccatctctactaaaaatacaaaaattagccgggcatggtggtgggtgcctgtaatcccagctactcgggaggctgaggcaggagaatcacttgaacccgggaggcggaggctgcagtgaagtgagattgagccactgcactccagcctaggcaacagagtgagaccctgtcttgaaaaaaaaatatgtaaaagttggccaggcgagatggctcacacctgtattcctagcactttgggaggccaaggcaggtggatcccctgaggctaggagttcgagaccagtctggccaacatggtgaaaccccatctctactaaagatacaaaaataagcagggcatggtggcagacgactgtgatcccagctacttgggaggctgaggcacgagaatcacttgaaccttggaggcagaggttgcggtgggcagagatcatatcactgcactccagcctgggcaacagggtgagactctgtctcaaaaaaataataataaaataaaatatgtgaaagcgcttcgaaaaaaatttaaatgtcatatattttctgatgtggtaataatataagcaccaaaaagaaccagttgggggcagcaccatgcagcacttcagatccttggaagcgtcggaccagttttggcaagacagaaagaatgactaaaaataaatcttccaacttctcaaaagggaaacttgttgatctgcttcatcctgcttgataatccatctttgaaaatcttaaaataaggcataatgacggcataagcacagcgccttgctctcttcattctagttgaatctgcccaagattcacatttgaggtgcccatttgctgaaaagaaactgagcttgtgaacttcagggttataagtgggcagtgaagctgacatctaatcatgcaggcagatttctttagctctgaaagtcaaaaggtaggcagtggttcacttctttagcatgatgacagtgtgatatgtcgggcctgtcttcaggagccactcaggtttcccaactgagtgccaggcagaagacactataatgaaaagactgtatgtgcactctctataggccaggtgacaccaggactcttggttctgggaaacacttgtttactctgttcagcagtgtctctgaaggccctggaaatccatatgcaaagccagagggtggagagcacaggaaaaggtgacaaaagatgaggaatcacacttggctaatagattctggcttctccaggcaaactggaaaaagcgcaaaccaaggaccagagagggaaaacaaatggaatttgcttttacaacccatttctcttgcctgcctttggtgaatacattagttgggctgataagcctgtaggccctcagaaaccgcttctcaatgtttcaagacctctgcatgcataagaaaaggaaatttgagatttgtcaacaaggaagatttctttcttttttttgagacggagtctcactctgtccctcaggctggagtgcagtggcgccatctcggctcactgcaacctccacctcccaggttcaagtgattctccagcctcagcttcccgtgtagctgggattacaggctgtgtcaccacacccagctaatttttgtattttttagtagagacagggttttcccatgttggccaggcttgtctcgaactcctgacctcaggtgatccacccgcctcagcctcccaaagtgctaggattacaggcgtgagctaccgcacccagccagaagattgctacacggtctctgtgcccattagctggaatgttcacttctccataagcaactcccagtgcagactcagctggtgtggcctctaaacaaatccctctgcaggaagcagagacaagagcaactgcattagcatgttcagctttcccggatggggataacagctgctttgctttcattttcagctagactactccctcggtcagccctataaaatgacccaaggcattggtaatacatttaattaatacagaagttttaatatttttaattgttgttattttaacctttcaagttagaaaactataatacagtcaataaaatgtgttatagatacttcaatacctctcagtggctgttacctttttctataccaactttacctataccaaaacttgcctcacttcctcacggtctaataaaataacagagtttcttccatttcatttgtgtttgatacttggtttcattaaatatatacagccttttcctagaaggcactcaataactttctaaagtgtattggtaattcaactatattatgtaaataaacctttattactaaaatgcaagaaatcatatgccaacatcttttttaaaatcaccaaaggcacagagaagtggacactcagttctccactcaggaatatcaattcaggttatttctacaaacatttattgagcactcctccccctactgccacttccatatgagagtaagaacttgtctcttggccaggcacagtggctctcgcctgtaatcccagcactttgagaagctgatgtgggaggatcgcttgaggccaggagctcaagaccagcctgggcaacatagcaagacccccactcaaaaaaaagatggtaaattatatgttatatgtattttaccacgatagagaatgtgtgtacaagtgtccccatagttctttagtcccttccactatgtaaggacacaacaaaaagacaggcatttatgaaccatgaagtaggccctcaccaaacactgaatctgcctgtgcctagatcttagattgcccagcctccagaagtgtgagaaataaatttttgttgtttataagctacccagtctatgatatattcttatagcagcataaatggactaagacaactgcctaggctaaagagtataggttcttcccacatatccctatagggtctggtaggtaccaattcaggcacagacaagcacataaacatatccatacagagaatattctggactggctctagggaatatgtacctctctctgaggtaaatgcacccaggactccagttcccaattcttgctgattctagtcagctacagtagtttcaaccaattataactattcagaacaataagacaaaatggtagttttaaaaaaatttgaattaccagtgtactgatacctgcaaccaaataagcttatctctgaacagtggttcaaaggcattcagagaaggtctggagaaaatatcaactctaagaattattattcctttttgaaaaatctacccaactggccaggagttagggcatttacccaaagaagataactgtgctgtcatctaactagcagagataatttgctaccatctaattagcaacatggtactgagaaagattcatccatccttctgttcacctacccaaacactgaaaacctacaatgtgaaacacaaagataaatggggccagtctctgcccacagagactagtctagcctagatggtctagtagggatgccatacaatcaactaacactttttttttttcacacaggagaataacatgatcagatatgctacatagaaatattctaacagtagtataaaaattgtatgaaaaggtcaggaactgaggctgggagaagagttaggataaccaaggcctgaataagacaatggcagcaagaatggaaaggaggttattatctcagagacattagaggtagaatcagcaagatttggtgtttgttcaaaggcaaggagtaattaaagagataaggtctaaatacaaagtcagtccagtttggtgtttagctcatagtacacaactcattctcccatttaacagtatctttttaaaatttattttcattttttacaacaggtagaacccactatcaataacttatcattctcacgcctcccttaggttattccattagctttctaacctgttttcttgcccccttttgcatcttgaaaagatttagccctcattccaatccattttccacaatatagccaagacaatctttctgaaatgccaacctgaagccactctcctgttaaaattattcagtgatgtgctattacttgtaggataaaacccacaatccttagaaaggcacacaaagcctttcactcctgcttataaaagtctgactcctgctcacctgcacatttgtacacattgctggtccctttacctctaatatccttcccctttccccacctaggcctggctaatattcactcattgttgaggatttaattccatttcatggtaacccataggcagggttggggataagaaagacagtctatgcaaaaggaacacaaagataacaaagcacagagattagtaattattcttttttttttttctgtataagtaggggagaaagtatgaagctaaaaagttaagatgggcagtataatatagtggtgactgcagttaggctggctaggattgaatctcatctcagactataatagttgtagagccctgagttggttactcagtttgtttaatacacatctataaaatgggaataataatagtgcctaacccacagagttgttgtgaagattcagtaagttgatacatgtaaaatgctaagaataatgtcaaggaaagtgctcaatatgtcagttatgactatttctattattattattatatttgttattagtgcagaagttctggaataccaagatgaagcatctacagttaattcagcagaccacaggggccactgaaggtttataggtaaaggtataatatgatctaatgggggttgaattacatccccccaaaagatgcatgcaagtcctaaaccctggtaaggtaactataaatgtgaccttatttggaaatagggtctttgccaatgtaatcaagttaagatgaggtcacattggagtagggcaggcccttaatccaatacgactggaatccttataaaaagagtggcaagagatataggcacacagggaaaatgtcatgttaagatagaggcagaaattggactgagacatctacaagccaaagaacaccaaaaacctaccagaagctaggaaaaggcaagaaggatcttcccgtagagccttcagagagaacaaggccctaccaacactttgattttggacttccagccttcagaactctgagataataagtttctgctatgtcacccacattgtagtgctttgctatggcagctctaagaaactaatacatgacccaaactgcattttagaaagatcattctggtagcaggatagagaaggaattagaggcagttttggagggtactgcaacagccagatgagaggtgaccaaacatctaactaacagtgctatttatgggcaagaaaaagttggctatagtcagaatataaagctttttagcaactgagtgatagatatgagaaataaggaaaaagagtcaaagacatctcagagattccaaattgaaaggttcagacagcaatggaaaaagatttcagaatcttaaatgactcaatgtgccatcagtaagtcagaaacctgtcagaaaccagtatcaatgtcaaacagccaaattagtggcttgttggcactctactctttggaggggctctttgcagaaaagggtttgggccccgacctagttttcactgtagcccaacaatacttttgtgctggccaccgtatgtttgttggtaggctccaaacacaaaggctagccgacatcccatcctgctggcttgggttaaggaagaaaagaaagctttgttactgctctgggtaattccagaacagacatcccaagagtgccctgtgggaggcttgtgctccaaagaagcctcctgttctcagctcgaggatccacagccactacaagcgtacatccgtatatctgccaaggactgaatttgcctaccgctccaggaggttcaccagggcctgcctgactgaaacagtcagtagtaatgagctgactcaaaaagaaaaagggaacactagttctagccacagagtaaaacgttgttaataacccaaaatatatttcagaatatttaagtgtttaactcttggccttcatatatgcttgctgaatacccttcttcatagctttgctaattcttattcatcctccttgtttatttattttcattttttttattattattattttgagataaagtttccctcgttgcccaggctggagcacaatggcatgatctcagctcgttgcaacctcctcctcttgcgttcaagtgattctcctgcctctgcctcctgagtagctgggattacaggcgtgcaccaccacgcccggctttttttttttttttttttgagacagagtctcactctgttgcccaggctgcagtgcagtggcgtaatctcagctcactgcaacctctgcctcccgggttcaagcaattctgcctcagcctcctgagtagctgggattacaggcgtgtgccaccacacctggctaatttttgtatttttagtagagatggggtttcaccatgttggtcaggctggttttgaactcctgaccttgtgatccacctaccttggcctcccaaagtgctgggattacaggcatgagccactgcacccagcctaattttgtatttttagtagagacggggtttcaccatgttggccaggctggtctcaaactcctgacctcaggtgatccgcctgcctcgacctcccaaagtgctgggattacaagcatgaaccaccacactggcccttatttatttatttgtcacccaggctggagtgcagtggcgtgatcccagctcactgcaacctccacctccagggtttaagcaattctcctgcatcagcctcctgagtaactgggattacaggcatggaccaccagacctggctaatttttggtatttttagcagagacggagtttcaacatgttggccagctggtctcaaactcctgacctcaagtgatctgaccgcttaagcctcccaaagtgttgggattacaggtgtgagccaccacggccagccacttattcatccttctgaactcatggaaagcattccttgatactccatcccattcttagtgctaggctgggcacagtagctcacacctgtaatcccagtactttgggaggctgaggcaggagtattgcttgagcccaggagttcgagcccattcttggtgccactttagcatcctgcacatgtttctactattgttcatcacactgtactataacatttatggcaggaactaggtcctgctcaattttgtaagcccctttgtaaaactcagtgaaattgttgaacaaacaaatacataattaagtgcatttaaataaatggaggtgggttttaagttccctcttttattggaagccccacccctcaatttaatcattaaaatgtaatttaagatataaaagagaaatgtgcttttagaggaactttccaataaatatcatgcaaaaacaaatatttaataatgctggctgggcgcagaggctcatgcctgtaatcccagcacttttggaggccaaggtgggcagattgcttgagctcacgagttcgagaccagcctgggtaacatggcaaaaccttgtctctgcaaaaaatacaaaaattagctgggcatagtggtgcatgcctgtagtctcagctactcaggaggctgaggtgggaggatggcttgagctgaggaggcagaggctgcagtgagccaacattgcaacactgcaccccagcctgggcattagagccagacctagtctcaaaaaataaataaaataaaataaaataaaataaaatgtttaataatgcctactcagacaaagaaaggctcaggcaaaagactgagtctgatcttctacattgaggagaccatgttgattagtgttatattcaaaaaaaccaattcccaagtaatgcatacacagctgaaagaaggaagtattccagctgcaccctccaagttttctacatctcagtaaacggcatcgccacccacctagaaactgggcatcatttggttcctcgttctcctttttttttttttttgagatggagtctctgttgactccgggttcaagcaattctcttgcctcagtctcccaagtagctgggattacaggcatgtgccaccatgcctggctaattgttgtatttttagtagagatagggtttcaccatgtttgtcaggttgctatccaaatcctgacctcaggtgatccacctgcctcggcctcccaaagtgtagggattacaggcgtgagccactgcatctggtcacaaagcattttttttttttttttttgagatggagtttctctcttgttgcccaggctgcagtgcaatggagtgatcttggctcactgcaacctctgcctcccaggttcaagcaattctcctgcctcagcctcccgagtagctgggattacaggtgcctcccaccacgcccagctaattttttgtatttttagtagagacggggtttcaccatgttggccaggctggtctcgaactcctgacctcaggtgatctacccacctcagcctctcaaagtgctgggattacaggcgtaagccaccatgcctggcaaagcactttcatagttacctcatttgaccattgaaatttttttttttttttttgagatggagtttcactcttgttgcccaggctggagtgcaatggcgcgatcttggctcactgcaacctccgcctcctgggttcaaatgattctcctgcctcagcctcccgagtagctgggattacaggcgcctgccaccacacccggctaattttttgtatatttaatagagatgggtttcaccatgttggccaggctggtcttgaactcctgacttcaggtgatccacccatcttggcctcccgaagtgctgggattacaggtgtgagccaccacacccggcctgaccattgtaatatcttgaaacattcttgtcatctttttgtttttgtttttttgtgtgtgttttttgttttttttggttttcttttgttttgtttttcagacggagtcccgctccattgcccaggctgggctgcagtggcgcaatctcagctcactgcaacctccgcctctgggttcaagcaattctcctgtctcagcctcccgagtacctgggactacaggcgcctgccaccacgcccggctaatttttgtattttttagtagagacgaggtttcaccttattggtcaggctggtctcgaactcctgacctcaggtgatccacctgcctcggcctcccaaagtgctgagattacaggcatgagccaccgcacccggctggttggttgtttgttttttgagacggagttttgctcttgttgcccaggtgtgagccactgcacctggctggtttttgtttgtttgttttttgagatggagttttgttcttgttgcccaggctggagtgcaatggcgccatcttggctcactgcaacctccacctcctgggttcaagcaattctcctgcctcagcctcccaagaagctggaattacaggtgtgcgccaccatgcctggctaatttttgtgtgtgtgtttttagtggagatggggtttcaccatgttggtcaggctggtcttgaactcctgaccttaagtgatccacctgcctcggcctcccaaagtgctgggattatgggtatgagccaccaggctggcccagagaacttaaataacttgcctatgattattcaactagtaaatagtacagcttggatttgtatccaagccttgtgacctaaaagcctgggtttcttctaccctaggagtgtacatttatgtagggaagctaaagcaaaaaaagctttaataaatgaaagaatggggctgagtgcagtggctcacgcctgtaatctcagcactttgggaggccaaggcaggtggatcacgaggtcaagagttcaagaccagcctggccaacattgtgaaaccccgtctctactaaaaatacaacaaaattagctgggcatggtggtgggcacctgtaatcccaggaggctgaggcaggagaatcacttgaaaccagaaggtggaggttgcagttagccgagattgcaccactgcactccagcctgggcaacaaaagtgaaactccatctctaaataaataaataaataaaaggaaagaaaagaaagaatgtgtaataacaaaggtacaaaaattctatataggagaagatgaatggagggaaacattatgatcaaatgagtggtggcagtggaggcgggcagagaggatgcggccgagaaaaagaatcaggaaaggttttatggggaaataagcggactctgaggccaggtcttgaaggtaagataatttttctttttttttttttgagatggagtcttgctctatcacccaggctggagtgcagcggtacaatctcagctcactgcaacctccacctcctgggttcaagcaattctcctgcctcaacctccccagtagctgggattaaaggtgcgcaccatcacacccagctaatttttgtatttttagtagagatgggggtttcaccatgttggccaggctggtctcgaactcctgacctcatgatccacccaccttgacctcccaaagtgctgggattacaggcgtcagccaccgcgtccagccagggaagatgatttctataggacagagggaaagagcatattctaggttgaagaaaccatatggataaagaggcaggaaaacacagaccatgttcagtaaacaataagaaatccagtttgcctgaattatagagtacttgttaaagaagaggagaactaggagaaaagtagtattatagtagggcataaaggactaggatatcaggctgagtttatcctgaattccatttttaaactctagctgtgaatcaaaataatttgtagaactttatttatttatttttaaatacagatatctgcatctcacctaagactttaatcaatgaggaaatcactgaaggtttctgagccaggaaatgccattgattgttaatttatttattcaatcaacaaatatgataagcagctaccatttgtcaggcactgtgctaggaaccagtggatgtcaatgtaaataaaacaatcgttgccctcaaggaatttataatctacacatacaaacagtcagttgaaatcaatgataaattatattgtattatgagagcacataggaggggtaccaaactactcttggaagatcagaaaaggcttcccagagaaaatgaattctaagctggggcctgaggaattggttgggccaggggggatgaagaggtgtgttctgggcaaagaaaaagtctggtgcagagctctaaaggtggaaagggtcatgttccatttgtggaactgaaagaggttcagtacagctgtagcacacagttgagacaggaatagagaggcaagagaagtgaggagtgaggccatagagataagcagtagcaagatcagttttgactttaccctgaggacaatgaggagccacagaagggttttttcagggagaaacaaaattagatgtgtattcaaaagtggtactggcataaaaacagacatatagaccaatgtaatggaatagagagcccagaaataaacacctatcaactgggaaaggacagtctttgcaacaaatgagaaatgcaaatcaaaccacaatgagatatcacctcacatccattaagatagctactatcaaaaaaaaaaaacacagaaaataacaagtattggtgaggatgtggagaaactggaacccttatgcaccatcaatggattgtaaaatggtgcaactgctacagaaaaaaaatatggcagttcctcaaaaagttaaaaatagaactactatatggtccagcaatcctacttctgggtatgtacccaaaagtctggaaagtaaggtttcaaagagatatttgcatacccatgttcatagcagcataatttacactagccaagaggtgaaagcaacccaaatgttcatcaacccatgaatggatcaacaaagtatggtatatacatacaataaaatatttatgcagccataaaaaggaagaaaatactatcacatgcaacaacatggatgaaccttgtggatattatactaagtgaaataatgtgatccccaaaagacaaataccatatgattccacttatatgaggtatcaaaagtagtcaaattcatagaaactgaaagtacaggctgggtgtggtggctcacgcctgtaatcccagcactttaggaggctgaggtgggcgaattgcctgagctcaggagttcgagaccagcctgggcaacatggtgaaaccccatctctacaaaaaataccaaaaaaaaattagctgggcatggtgatgcacgcctgtagtcccagctacttgggaggctgaggtgggagaatcccttgagcctgggaggtggaggttgcaggcagccgagattacaccattgcactccagcctgggtgacagcgagatcctgtctcaaaagtaaaaagaaaatagaatggttgttaccaggagctgggaagagggagaaatgagtagttgttgtttaatgggtatagagtttgtttcacaagatgaaaaaggccagccatagtggctcacttctatactcccagcactttagaacaaggtgagaggattgcttgagcccaggagtttgagaccagcctgggcaacttagcgagacctcatatttacaaaaaataaaaaattagccagatgtggtggcacacgcctgtagtatcagctactcgaaaggctgagacaggagaatcacttgagcttgggagatcaaggctgcagtaagccatgatcatcccactgcattccagcctgggtgatggagtgagacccatcttatttttgaaaaaataacaattaaaaaaaaaaagatgaaaaagatctggcagccaggcacagtggctcaagcctgtaatcccagcactttgggaggccgaggcaggcagatcacctgagctcaggagttcaagaccagcctgcgcaacatggtgaaactctgtttccactaaaaatacaaaaaattagccgggtgtggtggtgcatgcctgtaatcccagctactcgagaggctgaggcaggagaatcgcttgaacccaggaggcagaggttgcagtgagccaagatcgtgccactgcactccagcctgggtgacagagcgagactgtctcaacaacaacaacaacaaaacaagatctggcctggtacagtagctactgtccctattacgtgggaggctaaggcaggaggactgcttgagcccaagaatttgcggctgtaatgcactatgaactctagtctgggcaacagagcaagactctgcttctttcttaaaaaaaaaaagaaaagaaggccaggcacggtggttcatgcctgtaatcccagcactttgggaggctgagacgggtggatcatctggagttcgagaccagcctcaacatggagaaaccccatctctactaaaaatacaaaattagctgggcgtagtggtgcatgcctgtaatcccagctacttgggaggctgaggcaggagaattgctcgaacctgggaggcggaggttgcggtgagccgagatcacgccattgcactccagcctgggcaacaagagcgaatctccgtctcaaaaaaaaaaaaaaaaaaagaaaagaaaaaggtctggagatctgttgcacaacaacgtgataatacttaatactaactgctgaactatatatttaaaaatggctaagatgattcaaaacaacaaaaaaagatttgtatttcaggaccactccagctggcaatagagactatagatttaaagtgtggaacaagactgacaaagagactagttaaaaggttatggcaagacataatgatggcagaaggaatgatgtaagataaatgattcaagaatagtaaagaggtaagatgaacaggacatggtgattggtaagatttggaaaagggatagattagggataaaggaaaaggaaactatcatttgtagaagagccattcactatattaatacttttgcaagttattaattcatttaacaaacattcattgagcagctacttgtgcctagtattacagaagattttagacaatcattctgccactatgatagaacaacttctcattttttgaagttcactaaactagccattgacacagtacctgcttaataattatttgttaaataggaaacagacacaagcaattgcattgaaatgagctaaaatgagcaagtaaggaaataaatgcctatgactgactctggaaaacactgatctaagaatttattatctaagcaaataatggtgaccaggataacaagaaaagaccacataaagagaaagagaaagtaaatacagaaagtgcagacagtgattatgtatcaggcacagggatgcagaaatgcccctgagtagtagcaatgtgtgagaggtatattgggagaccctccttccatggtcctacttgctacagattccaaagttggaacagctcccaggagccaacatagaaccaactcctgggaatgataccacttatcaagttaggaaaattacacttggcaaatctattagaaacatatctagcctaaactcaaaaagaactctgtgaattcaagtgtcacactagtttaacaatcatgaggggattaggagaaagattagctagaaatcctctgaagaactttctaaatccttctgctgtcctcatactaccaatgctgtaaaaagattcatcaaatggatggctgaaatgaccttgaaagaggcagatatctttgcagctaacagtttaactgttaaaagctcaagtgttgggagcagtacttatttatccattttccatttacccaacaaatatttattgcatgcctttatgctccagttactgacaattcagcagtgaacaatagccaagcccaaggagctcaaagactagtaagtacaggattatagtcagccaaaacttgatttaaatcctagctcagctacaagaccttagctaacttaatctctttctgagcctcagatttgtcatctgtaaaatgggaaaaatattacctatttcataggattgcatgctaattaaataatatattgagagggagaaaaaaaaagcttagcagaccctggcacatagaaaacatttagtatgaaaaatcactgaatgatttttttatttttgttactcaggagataatacagcagttgaaaaatgcctccttccaaatcaatgaaacactctctaatgaaaatgttgataaacaggatatgaacaaggaaggtatcactcagagtactccttcagacaccagtactctatgaagatatctcaactcgaatgtccaataaatatctcaaactgaacctattcaaaaatgacctcttgatcatctcccattgtgtacctcctatagtcttcccatctccattaatggcaactctattttttaggtgttcaggccaaaaacctcagagttatccttgacttctctcatcctctcataccccacagccaatgcatcaggaaagcctatttgtttgtttttcttctgctttcaaaatggatccagaattcccagctccactgctatcattctggtccattaccattaactctcaccttttttgcagtctttatgtattgcacagactttattgtaacagtctcttaactggttttcctgcttccaccctttctcttttttcagtcattcaccaaacagtagccaggatgatcccattaaagaataagtcacaaaaacctccaaagacttcacaatttatcctgagtaaaatctaaagttcttacagcagtatatatgagactctgatctagccagtgtttcctctctgaccccatctactactgttctcttcatgctctccactgcagtcacatcacccaccttggagttattcaaccagaccaggcacacttctgcctccacgcctttgcatatactattccaactacctagaacactttgatatccacacagctagttccttcacccttttttttttttttttgtgagccactgcacccagcccaccttcttaaattttagcctcttttatgaggccttccctgtctacatgttgaaaattgtaaaccacctagcacttaacatcacatatattacaatttgttcccttgtttagtttaactcctctgcccgccccctgctgattaaaatataaattccagctgggtacagtggctcatgcctgtagtcccagtgctttgagaggccaaggtgggaggatcacttgagcccaggaccagcctgggcaacacagcaagacccatgtcactaccaaaaataaaaaatataaaataaagttaaacttaaaaaaaattaaaacgtgggacagggatttttatttgttcattattgtattcccagtacctggaatagtgccagacatggtaggagccaaataaatatcttttggatgaataaatgagccaaaagcaagcaagcaagtcagagaaaaactgttttaaggataaagtaaactaaataaactcttctattatttgtgggctagcttgccaacctcaaattcttgtttctcaaatgtcacagggagttactaaaaataagaacagaaatgtaccacagtttgagagttttttattactaaatgagcaaagcaaaaaaattaaataaaaattactttttccaaaagcaaagtacatgtcaaactgtatttgtagaaatattttttgcacatagaagtttaagtgaaataaacttctaattatgaaaggatttgagatgtgacatttctttctctctcttttttttttttttttttttttgagacagagtctcactctgtcacccaggatagagcatagtggtgtgatttcggctttgtagcctctgcctccagggatgaagcaattctcctgcctcagcctctcaagtagctgggattacaggcccccgccaccacgtctggctaattttttttttttttttagtagagacagggtttcaccatgttggccaggctggtcttgtactcctgacctcaagttatccatctgccttggcctcccaaagtgctaggattacaggcgtgagccactgtgcctggccttcacactatttttgatttctggctctttccgctagggctaattcagctttcttagagttgggtctacactagaccatcaactacaaacacacactaagcatatactatgggcccagccacacagagtattattataagctctatctaggagacttagttccattagagaacctgggatttgacacagcttggagagaagagagataaggacattcctagtactggaagggacacctaaagcaagaatgtatagaagagagcaaaaagacccatgtaactaagggagggattcgtattatcaaacgagattagagagaatttagaataggaaacataattttttagacagaagcatcacattatcaggtgtgcttgatgatgattattcagatagtagtatgtcaaaatgaagaaaacaggtcaggtgtgatagctcacacctgtaatcccagcactctgggaggcccaggtgggaggatcccttaaggtcaggagttcgagaccagcctgggtgatatagtgagactccatctctacaaaaaatgtaaaaattagctgggtgtggtggcatgcacctgtagttccagctaatggggaggctgagacaggaggatcatttgagcccaagggtttgaggctgcagtgagctatgatggtgccactgtattccatcttaggtgacagagcagcaagaccttgtctcttaagaaaaaaaaaaagtatttgtaggaattgaggcatgaaataatattatggctttggaatgaagagaaagaaaaataatcagaaagatatcacaaagaagaaaataggaaaagacggcggaccgattaaattcaagtgatgagaaaaaatcaaaactaaccccaaagaacaaaggattctaataagagaacaaggattttttttttttttttttgagacagtcttgctctgtttgccaggctggagtgcagtggtgcgatcccggctcactgccacctctgcctcccaggctcaagtgattctcctgccttagcctcccgagtagctgggattacaagcatgtgccaccatgcccagctaatttttgtatttttagtagagacagggtttcaccatgttggccaggctggtctcgaactcctgacctcaggtaatctgcccaccttggcctcccaaagtgctgggattacaggtgtgagccactgtgcccggccaagaacaaggattctaataatgataagggccgggcacagtggctcacacctgtaattccaacactttgggaggccgaggtgggcggatcacgaggtcaggagtttgagaccagcatggccaacatggtgaaaacatgtctctattaaaaatacaaaaattagctgggtgtggtggtgtgcgcctgtagtcccagccacttgggaggctaaagcaggagaatctcttgaacctgggaggtggaggttgcagtgagctgagatggtgccactgcactccagcctgggtgacagagcaagactccatctcaaaaaataaagaaatgaaatgataaggttggaatggatggccagtttggggaaggtaaccaagctaagctgtactgcaaacactagcaaaataactgagtggaaaaaaagaaaatgaactataatgagtaacaactattaatatacagagagatctgagagttaacagcatgggataacagatttttaaaaaacagtttctaaggaagggcacagtaagaattttctcactatcccagccattaaccattgagttcatgaaagacactccagtgaactaaagatggtcattgacagatggccttagtgacttgcttgaccaataaaatgcagcttaagggacattctggaacttgcaaggctaggtcataaaaggcttgcagcttccacttgagtggtttgtaccagtctaactatcctgagatcaccatgctgtgggaagcctaagccatatggagatgatctaaagaatgagacaccatgtggaaaaagagaagaaccaaggagtaccatggcaccagatatgcaaatgaagaagccatcttggaaatggatttgccagctcagtcactccagctgacacatatggatcaaagatccaggaaagcccttctgcatacctgacctacaaaatcacaagcaaactaaaattagaaagccactaagttttggggtagcttgttatgtaacaatagatcatgggagcagatgtctttttatcctaaacctaaagcctagcaaagtacctagcccatagtagattcactcaaaatggtgtgtatcaagtgaatctctaccttcccgtgtattttctaatttacatctttgtcgtttccccctcacttgtccttttaggaaaacctgaatcacagatgcaatcactgttagtacctctggtgtgtctctaaactaccatgtggtggttaacagctgccagtcccaaacttgaaagataggtatgcctttgctgccaaagttaacccaaggcagggcaccaagcaacttcacatctttatcatggtaaataaggataggaaaatattctgtactgaaacacacaaaaaaataagaagcaggcacaactaataacaatatcacatatcacagcacaccaaaaaaactggaatcagggtctgccttgctcacttttcctttctttgagatggggtctcactttgttgtgcaggctggggtgcagtggcagaatcctagctcattgaagccttgccctcctgggctcaagtaatccttctgcctcagcaggagtagctgggaccacaggcacaaactatcatgcctggctaatttttaaatttttttgtagagataaggtctcactatgctgcctaggctggtcttgaacgcctggcctcatataatcctcctgcctctcaacctcccaaagtgctggggtcacaggtgtgaagccactggacatggccttggcttgctcatttttataaataacgcatgagtttggtcactgaacccatggagtttcattgtaagctgtctgattatataaggcttcttataagtctgacaaaaccaactcagaagcaatacatatcaacccgcataaacaagaaatttccaaagtcactaatactctttaataaagaaagaagatgtatggttgggtgggaatagggagtgacaggaggatcagagctatgtgaataacaaactctctgcaatagcctttagctaaaagcatttctttcagtaccaaacatctgctcgactgagatggctctgttgtaaaaagaccgaatcacctcgactaggccaaggaatattctgcaactgcagaattggctgagtggttctcatcgccacagaagaaaataagaatagtttatttttttttaaattttttttttaggcagagtctcgctctgttgcctagagctctgttggctagagtgtagtggcatgatctcggctcactgcaacctccacctcccaggttcaagtgattctcctgcctcagcctccggagtaactgggaccatgggcttgtgccacccatgcctggctaatttttgtattttttatagagacggagtttcaccatgttggccaggctggtctcaaactcctggcctcaggtgatccacccgcctcggcctcccaaagtgttgggattacaggcatgagccactgcacctggctggatagttttcttcatggcagaaaaggcaagagagacccccaaaacatcctgctcaccaagcaattcaattgctgactctcctgatcagagagtactgccatttgtgaaccctctccacaaccatataccttacccagttccccaatcttctagccactgagagtttctgcactaacaggttcccaaactgcttgattttgacggtatttccttctctgtgcctttcttaacaatattaaaaggaaaaagcgctttgagatgacatacaatctatccagaggcatctctttctcttctctctttcttcctctcctctccatcccaacctcccactcatcttggctatagaagagaaaacatataccatgtaagtttttggcagctactttttgattatgagtgacagacatctttattttaggatgaaactgacaacataaagacagagcaaagagaaagaataaggtctctggacagcgtcaatttaaccattgaattatatcaatacttaatctaataaactgctaaaattccagttatatgagtccttttgttgtttaaagcccatttaactattttctgttacttgctcccaaacacattctaatacacccaatgaccaggaagaaagtatcttttccaaataacccagaatacataaaaagtgagtcagaattgaattctacaaatactatgcatgctacacacataagatcttgtgcttagcaccgtggggaatataaaaatcaattaagcacagcatgttgtaatagaaatagactttgaagtcagatgaacctggatgcaatcctactttggggaagtaacttaatttctctaagctttagttttctcatctacaaaatggaagaaataagattatagcattgtgagaattatagttaatatacagtatcaaccatagcattctgcccatagtgggagtttaaataactaatagttgttatggtttaagaaatgggagaaattctttactctccaatggggcagaaaacacaaatacttatgatctgctgactgggatatttacagggcatggttgattgtcaaaggttccaattcttcgccttctactgaatctgtgccttttgacacataactttgcggcatattcctgataagggcagagcatacttcctacccctggactcaagcatgtgacttgctttgtccaatgggatgttggccaagcaaatctgaacataaggagagtcatgaaaatcagttgtgcaaatggactgtcatattcttgctattctggtatcatcttaaaaaggacaagtccagtctagcccactggccccagaaggaggatgagccagagcaaagttctcccagcaaatttcagcctagagcagaccaccagctgacctgcagatgcatgagtgagcctgagatcagcacaactgccaaatctagccccactcagttcagctaactctggaaatgtatgagaaataaacgtttattgtatgcttttgaggttttgtggctggagggcaacagctaaccaatacacagaattatattttctgttaaaaaaaaaacaaagatttacacttccctgatacttgtgactaagtgaaagacaaggttaggtcttgtgaatgaaagacatacttatggtacattcctattcttttttttttttttttttttttttaagaggtctctctctgttgctcaggctgaagtgcagtggtacaatcatggctcattgcattctcaaccttcaacctcctgggctcaagcaatcatcctgtctcagcctcccaagtagctgagactgtaggtgtgtatcaccacatctggctgatttttttaattttttgtagagtctgggtctcactatgttgccaaggctggtttcaaaatcatggcctcaggcaatccttctgcctctacctcctaaaagtgttgggattataggcatgagccactgcacccagcctcaatacagattcatatttcaactcattaaatttaaaaggtttcatgtgacttttcaccaaaccgttttcactatatattttttgaaacagggtcttgctctgtcaccaaggctggaatacagtagtgcaagtatggctcactgcagcctcaacctcctgggctcaggtgatcctcctacctcagcctctccaatagctgggactacaggtgcatgctaccacacctgactaatttttgtattttttgtagagacaggcttttgccatgttgcccaggctggtctcaaatttctgagctcaagcaatctgcccaccttggcctctggaagtgttgggattacaggcgtgaactaccatgcccagactatgctttcactttaacaaatactagtttgcttaaaaacttgagtcagctggccgggcgcggtggctcacacctgtaatcccagcactttgggaggccaaggcaggcggatcacctgaggtcaggagttcaagaccagcctgaccaacatggagaaaccccgtctctactaaaaatacaaaattagccggtcatggtggcgcatgcctgtaatcccagctactcaggaggctgaggcaggagaattgcttgaatctgggaggtggattgcagtgagctgagatcgggccattgcactccagcctgggcaacaagagtgaaactccgtccccccaaaaaaaaaatctttagtctatcattactacaggtagtttaaaaataaaaactaagtgtctgactgttccaagttcaattaatgtctacaattacaaagaagactcatggaaatggttcaagcccaggaaagtccagatcactaatgtatatgggaaatattcttcctaataatgtcaatgttttataggtattaatgagtgccatgcttgtctactgtaattattgacaaataaatgtgaagagaaatgaagaatggtactcacattactttggaggacaagcattccaccaactgaaaagtatttggtgaatgtcatctaagtttcaaggactgtgctagatatttttaataatttattttttattatccttaccatatagttgtgctgccaagtcaaattataaggcaattaaacctagaagtctcgaaagacctatgccatcaaggcctttgctgatcccttctaaaaataaccaagagcatttggctatttgggcttcatcactaccagtctattaacatcatattaaaaattactaatatcataagctatgtcaaaatctcattaatgctgctggaaagactggcaataaatactcttccataaagtacacattgtatgttttatatggctataaagaagctaacaagcagcagattaagtacaacatggccaagagaatattgcattatgatcactcattactgtcatttccaccacaacctgctttaaaatatgcaacttaacacagattttaaaggatgttcttctctgtcggcaaaattaacacaccagcccttccaatgaattcacatttcagagaacaatcacacatgcagggaatgcatcaaatacttttatgcttgttagcgtcagaactctggtagacagaaggaaggggagaattttatctctgaagaatttatagactcacttccaagaaaaaaaatacatggcaaatgtttcttgatctggggtgctggttatgggtgtgttcatttgtaaaaattttgtgagtggtacttttcatatgtatactttttctgatatgttatacttcagtaaaaagtctaatttaatgacactaacagcggtataggactaagtacaaaatgaaaaatattaacaattcagagttcagaagagggactagtcactgttattttgttcaaagagttaacatgtattaaataatttatacatgccaggcactgtactaaataagtattttatatttcatcctcccaacatccttgtgaggtcaacattatatcaacagcatttgccacaattaatactccttccttgaaactctttccttttcattacaggccagcacgttcttctggttttctacctacctcactaactgctccttctcagtctgtccttctccccagactttcattcattcattcatctatctatctatcgacagggtctcactctatgtatgtatgtatgtatgtatgtatgtatgtacgtacgtatctatctatctatctatctatctgtctatctatctatctatctatctatctatctatctatctatgtatctagagacagggtctcactctgttgcccaggctggagtgcagtggcacaatcatggctcactatagcctcaaactcctgggctcaagcaatcttgctgccccagactcctgagtaaataggactacaggtacatgccatcacatccagctaattattaatttttttttttttttttttttttttttttttttgtagagacagagccttgctatgttgcccaggctggtctcgaaatcctggtcttaggtaatcctctcacctcagactcccaaatattctagggctcagctcttggtcatcttctctatctaaactccctggggcaggtattattaattattattatccccattatacagatggaaactttgagatacagacagattcaaacgtatgtaatcaagacttcagaggccatgctcttaacctcttcaccattctgtcttctttggctttccatttaagaggcagggcatagctgcacacattccacattctagtgccttcagtaactgagaaaagagagagactgaggcacatgggaccctctttcataagctattaaggactaataccagttaccaagccagtaaaaaaccaacactcttgcaaattctgttaaacaactttccttcctaagtttcttcactttgtactttggtaattgcttctcaaggaggaatgtgaaaagaatctagaacatagattctcaaatccagatgctcatgaaataatctgaggagcttttaaaaatatagatgtaataggccctatacaaacctattaaacctagaagattccaggaatctgtgtttccaaggagcacccaagcaaggtctgaagttgataacttggtacctgaattggctctaaagagagttctctgatcctcggaggatgaataatgactatcacatattccgcctagcagaggctggaaatgaaacgagaatgaagatgtaaactgattccaacaagtaataagaccaaccaggaaaccacagcagggactgtggaattctagatcaggacagcaaacattaccaggtggtctggtaatttgttgccatagagagtttgcagtcaagtgctgtcatcccttggcttaggatggagtcatatctaggcagcaagagctaacttaatactttaatacttgagcactcatattgtcagagtattcaccaagtattatgagggaatagaaggacattaagaaatactgcccattctgcacatgtaccccagaacttaaagtgtatgtgtgtgtgtgtgtatatatatatatatatatatatataaagaaatactgccattgttcccaggcaacagaataaagcattattaacactgccatttttgcataaacataaatgcacatacattttgtttacatatgcaagcaacacttactatggaactataaatgctgaaactaaggcaaatacgttacttcaacacttactgatgtcttacctctgtaagtgcatgcaattgtccttgatgaacacatacacccatgaacctaaagaacaagacagaattatttaacaagtgaaaaggacacaaatataaattcatatagagaaatcaggttagttacccatgcattagaaacaacctgtggggtgcggcatgatggcttacatctgtaatccccgcactttaggaggcagaggtgtgcggatcacctgaggtcaggagttcaagaccatcctggccaacatggtgaaaccacatctctattaaaaatacaaaaattaggcaggtgtggtggcatgcgcctgtagtccgagctgctcaggagactgaggcaggagaatcccttgaacctggaaggcagaggttgcagtgagctgagatcgcaccattgcactccagcctaggggacaagagcgagactttgactcaaaaaaaaaaaaaaaaaaaagagactgcatctaaaaaaaaaaaaaggaaagatagatagaaaagaaaggaagggaaagggaaaggcaaagagaaagggaaagggaaaggaaaggaagaaagaacctgtgaagccccctgctatcttgtacagccctgtagactcttaatctttttgttgtttttaattatttcaagagttttaggggtacaggtggtttttggttatatggattagtttttttactggtgatttctgggattttggaacacctgtcacctgagcattgtacactgtaccccatatgtggttttgttgctttttttttgagacagagtctcaccctgttgccaagctggagtacagtggcatgatcttgtctcactgcaacctccgcctcccgggttcaagcaattctcctgcctcagcctccagagtagctgggactacaggcatgcgccaccacgcccagctaatttttgtatttttagtagagacggggtttcatcatgttggccaggatggtctcaatctcttgaccttgtgatccacccgcctcggcctcccaaagtgatgggattacaggcgtgagccaccgcacccagccccatatgtagttttttatccttcatccccctcccaacctttccccccaggtcctcagggttcattatatcattcttacgcctttgcataagatttggcataagactcttaatcttgattaagatgccaggctgataaatttctaaatttaccatgaagtatctggttgtagcaagacctggtggtaaaaagcaatggtggaagaaggagagtagtcttgaaaacagcatggtataatggaaaaagccccaattggaagtaaataaacttgatgctggtttcagctctgccattacctaactaaatgcttacacacagacacaaagtcactatttctttttagtttacacatttaagtgatatttgaagtttttctcaaccaacaggttatatttatatatatgaatgatttttaaataaaaaccataaatcaatgagtatgactgatgatgatcataaagtaggagaagataaacgtcttaaagccattaacaatacccaagtcccaagtaagttctagtttagaagagcaaaggaatgggaagagactgactacaagcagagtgtaaggcacagcagtgactgtgttagaaaggatcataaaatttccaggaagacagggtccatgtcatattcttccctgtgttcacagaacctaacaccacctagtaaacaaagagtaagcaaattcagtaaatgattgctgagtgagaagaaacaaaggagaatgcctggttggctataatatcacagcagagtttttaaaacatgctgcttccacatttcaactaatgtggaaatatcccagcattttgggaggccaaggcgggtggatcacctgaggtcaggagttcaagaccaccctggccaacatggtgaaaccctgtctctactaaaaatacaaaagttagctgggcatggtagcaggtgcctgtagtcccagctactcaggaggctgaggcaggaaaatcacttgaacccgggaggcggaggctgcagtgagccgagatcgtgccattgcactccagcctgggcaaccagagcaaaactctgcctcaaaaataaataaattgattaattaattaataataaaaataaaataagatgggtcatttttctctaaatgttcatacaactccccaatcactagaattttgagggtatgccattaatttattaaacaattatttattgaatggctgctatgttgaaagtattaaggacagagagtaaataaaaactttcattctagggtcattctgttggagggcaattataataaaaagataaattatgcagaatgtggttaaattgtatacatgaactgctgtttctagtcagcctcttttagaaagactgcttctctgagattaaattatatccctgcctaggaataattctattcccattatcctactataacaaaaacagttaaagtaaaatatgataagctacatttcctgcatgattaaggctttccaaactatgatgggtactagcaggaattggctaactatggccaactacctgtttttataaattaagttttactagaacatagatatggtattatctatggcttctttgatgttataatggcagagttgaatagttgtgacagagactgtgtgacttgtaaagactaaaatatttactatctagccctttatagaaaaagtctgctgactacaatggtttgaatgtttgctccctccaaaactcatagtgaaacttaattcccaacgtggcagtattgagaggtacggctttttttttttttttttttttgagacggagtctcattctgttgcccaggctggagtgcagtggcgcaatctcggctcactgcaagctccgcctccctggttcacgccattctcctgcctcagcctcccaagtagctgggactacaggcgcccgccaccacgcccggctaattttttgtatgtttagtagggacggggtttcaccgtgttagctgagatggtctcgatctcctgaccttgtgatctgcccgtctcagcctcccaaagtgctgggattacaggcgtgagccaccgcgcccggccgagaggtatggcttttaagaggtgattgggtcatgagggctctgcctaatccattcatggattaatggattattgcaggaatgagtctggtagctttctaagaggaggaagagactgggcacagtggttcatgcatataatcccaacactttgagtggtcaaggcagaaggatcgcttgaatccaggagttcaagactagcctgggcaatatagggagacctgagacctcgtcatatacatatgttagctgggtgtggtcacacacttttgtggtctcagttactcaggaggctgaggtgggaggaccacttgagcccaggaagttgaggctgcagtgagctgagatcatgccactgtactcaagcctgggtgacagcgtgagaccctgtctccaacaaaaatacacaggaagagagacctgatctggcatactcagcccctttgccatgtgatgccctgagccacttcgggactctgcagagagtccccaccagcaagaagactctcaccagatgtggcctctcaaccctggacttctcagcctccataactgtaagaaatagtttccttttctttataaattacccagtttctggtattctaagcaatagaaaacactaaggcattgacccttcctctagagcacagggatatctctccatttccacctgggagacattaagaaagttacctaatctttataaatcgcaatttcctcatctataaaaatggacagaaaaataacaccaccttaaaaggttgttatgagaattaaatgggatattttcaagtatactgtgtagcaatgcctagtgtatgctcaaataaaggtcagtggtttttattttatcattattaacaatcctaaattacattatcctttacatggctatgagagttaccttttcaaaacacaaaatatgtcattctctttttcataacccttcaatggttcccttctgcctacagaataacattaaaacttcccatgatccactccaacttatctttgaaacctcacattttcccatgagccttattcttcatccacctgtccttttcctctgggctctatgaccctagcctacaaatatatagttaaatttccctcatcttaaaaaattcttccgccaggcacagtggctcacacctggaatcctggcacttggggaggccaaggcgggcagatctcttgagcccaggagatcaagaccagcctggagaatacggtgaaatatgatctttacaaaaaatacaaaataataattgtattttttatacaaaaaaatacaaaaattagccaggcatggtggcatgcctgtggtcccagctactcagtaggctgaggcaggaggatcactttagccagggaggcagaagttgcagtgagccaagatcacgccactgcactccagcctgggcaacagagcgagactctgtctaaaaaataaaaatagaaatcttcccttgccccctcactaaaatatgaatctaattcactttttatttgttaccaaactttaagaataggttacattctctatctatgtttctaaggttttttttttttctttaaaaagagtcttactttgttgcccaggctggagtgcagtggtgtgatcactgctcattgcaaccttgaacttctgggctcaagcaatcctcccacctcagcctcatgagcagctaggactataggtgtgcaccaccacgcctggctaattttggtattattattattattgttattgttattattattattatcatagcgatagggtctcattatgttgcctaggctggtctggaactcctggcctcaagaaatcctcccacctcagcttcctaaagtgctgagcttacaggcgtgagccattgcacccagcctctagctacatttctttttttttttttttgagatggagtctcactctgcgcccaggctggagtgcagtggcgcgatctcggctcactgtaagctctgcctcccgggttcatgccattctcctgccccagcctcccgagtagctggaactataggcgcatgccaccacacccagctaatttttgtatttttagtagagatggggtttcactgtgttagccaggatggtcttgatctcctgacctcgtgatccgcccccctcagcctcccaaagtgctgggattacaggtgtgagccactgcgcccagccctttttttttttttttttttgagacagggtcttgctttgttgtccaggctggagtacaacagtgtgattatagctcactgcaacctcaacctcattggctcacgtgatcctcccacctcagcctcctgagtagctgggactacaggcacacatcaccacagcgagcaaattttttaattttttaaatagagctggggtcttgctgttgtccaggttggtcttgaactgtttgtgtcaagcaatcctcctgcattggccccatatcactcttgaaacttttctcactatggaagattcagagcttcatttatctctgcatttctactacctagtatagtgtctggaacacagtaagctagttatcagtaaagatttattaaatggcatgaatgatttttatgacttggaaacttggttgaagttccttccttgaattggaatactatatttactgaaaatcatccaagatcagctaaaatttcatcttctatacaaaggatctcctggacgcccttagcattaatctcttctctctctcttttgtctctccctacctcccacagtataactagcacttttcaccctactttgaatgactgctaattagcattaagttaagtggtctggatctagagttagactgctttgatttgaatcctggctctaccatttactgatgacctctctgcaattcagtttcttcacatgcaaaatgtaaatattaatattacctaacccatatggttattgtgaagatgaaataagataacttgggcttctggaacataataaacactagaaaatgttagctattcttgctaatctaacatttctgactccttccccagactggaatataaggtattgattgattgattgattgactgattgagactgtctcgctctgtcacccaggctgaagtgcagtggtgcaatcttgcctcactgcaacctccgcctcccgggttcaagcaattctcctgcctcagcctcctgagtagctgagattacaggcacctgccaccatgcccaggtaatttttgtatttttagtacagacagggcttcaccatgttggccaggctggtcttaaacttcctcaccttaggtgatccacccacctcaggtgatctgcctgccttagcctcccaaagtgctgggattacaggcataagccaccgtgcttggcctatttgaatattttttagcccggcgcggtggctcacgcctgtaatcccagcactttgcgaggcagaagctggcggatcacctcaggtcgggagtttgagaccagcctgaccaacatggaaaaccctgtctctactaaaaatacaaaattagccaggtgtggtggcacatgcctgtaatcccagatactcgggaggctgaggcaggagaattgcttgaacccaggaggtggaggttgtggtgagccgagagcgcaccattgcactccggcctgggcaacaagagtgaaactctgtctcaaaaaaaaaaaaaaaatttattttttagagatagtattgctttgttgcccaggctggtctcaaattcctgggctcaagtgatcctcccacctcggcctcccaaagtgctaggattacaggcatgagccactatgccgggccaaggcttttaagagtacagatcttgtctcatttgtttctatatacaatgtctcacacaaaatgtttcgtacacaagttgctaaacacacatttattgaatgaagaagcaataattaccaaattaacttcacaatgtaaactcgtgttacattaaagaacattagaggcaagtacaaggcagtaaagccaagaggtatttgattttctttaatcaaatatttataaagaagtcaggcaataggattctactagaaaaacaatggctacattttaaaatcatgggtttttctagaagctgaaaagacctggtttggatgtgacacacccttgcttttcttcctcccaggcccactattattttgaccacaccatctacagagatgtcatagcacatccaggcaggcactggcttcataggagagttttctgtctgctttcttcccaccctctactcaaataaccatatcacaatcgtgtcacacaactctacttctacgtgcaactttactgcctaacctctcccaaatcattcctaatggaaaaccaccaccacatccaaagtggtgtcacagagctggcaagctgagacatgcattagctttatattggaaaaagagcggccgggcatagtggctcatgtctgtaatcccagcactttgggaggccaaggtgggaggatcacgaggtcaagagatcaagaccatcctggccaacatggtgaaaccccatctctactaaaaatacaaaaattagccaggcgtggtggtgggcgtctgtagtcccagctactcgggaggctgaggcaggagaatagcttgaacctgggagatggaggttgcagtgagctaagattgtgccactgcacttcagcctgggtgacagtgagactccgtctcaaaaaaaaaaaaaaaaagagcttgaacagagttaatcactctaaatgttgtaaaaaaacaatatactataaagaggaaatattactcatccttgacagggaagtgacatgtgcctagaaaagcacgtaacatcaacaataagttttcactaaagtttttattgctaactatatcaaaaatcgaaatgaagcctcaaatcattgtcatgtcacaagaccttaaaaatttatattctgaatgatttttattcccctatccccataccccaccccaaatcataccagctagaattacttaactcaggaagggggtgctttcttaatgcatgtgctttgagagtaagtgattactcaactttgttatttttagtttcatatgacatacagattcatgttgagaaggagggttgcttttttttttgagacaaggtcttgctctgtcgcccagtctggagtgcggtggcacagtgcaatagtgtgatcataagctcgctgcagcctcaacctcccagtctcaagtgactctcctgtctcactgtctcagcctcctgagcagctgggactacaggcacacaccacagctggctttttttttttttttttttttggtagagacagggtctcactgtgttgcctaggctggtctcaagttcctggcctcaagtgatcttcctgccttggcttcccaaagtaagccaccacactaggccaaggattgcttttgtactttagaccactgtggaaacaaacccatgaaggatcttgtcaaaatgcagactcgcactctgtaggtcagggatggggcctaagaatctgaatttctaaactcccaggtgatgctgatgtcgcttggtctacagactacatgcagtgagtagcaaagcctttaaacaaatgactgtttatcactgctctaaagatagtaagaccaacaggaaactctttttttttttttttttttttttttttttaaagacagagccgcactctgttgcccaggctgcagtacaatggctcagtcttggttcactgcacctctgcctcctgagttcaagcgattctcctgcctcagcctcccgagtagctgggattagaggcggccaccacacctggctaatttttgtatttttagtagagacggggtgtttcaccatgttggctaggctggtctcgaactcctgacctcaagtgatccgcccgtctcagcctcccaaaaggctgggattacaggcattagccactgcacccggccccaacaggaaactcttaactctgatactactggtaaactagactttgtctagagactagagtcttttctatagcatgatttaccattccccataaagtgtcattattaagcttttccacatctttgccttttctcagactgttcccactacctaaaatgcccctctcttcatttccacataccttacttaacgatggggatacattctgagaaatgcattcttaggtgattttgtggttgcataatcatagagtgtacttacataaacctggatggtatagcctacaataccctcaggctatacggtagagtctattgatcctaggctacaagcctgtacagcatattactgtactgaatactgtagacaactgcaacaaaatggtaagttttgtgtatcttaacatatctaaacatagaaaaggtacagtaaaaatatggtattataatctcatggaaccaccatcatgtatgcggtctgttgttgaccaaaacatcttatgcactgcattactgtagttagattctactcatcctcaaataccagttcaaatacttccttctcatgttcttcaactaccaaggcagccatttacactcctttcttttcttttcttttctttttttttttttttgagacaaggtcccactctgtcacccaggctggagtgcagtgttgcaattacagctcactgcaaccttgaactcctgggctcaaacaatctttctgcctcaccctcccaaatatgctaggattacaggtgtgagccaccatgcccagcctatatcaccttcctatagcatcatttccaagctttaactatgttttatcacatgccttataacttttttactagaccacaagcttcttaacagcaagataccattctcttgcctggcatatgacaatatataaacgcttgttagtctttctctgaaggaggttaaaaataaaaaacacttgctgggtaaattatggtttgttttgttttgttttgtttttgaggcaagatctagctctgtcaactacgctggagagcagtggcaccatcatagctcactgcagcctcaaactcctgggctcaagtgattcttcactgggtaaatttatttttatttatttttatttatttttattttgagactgggtcttgctctgtcacccaggctagaatgcagcagcgctatctggcctccatgttcaagtgattctcccacctcagcctcccaagtagctaagattacaggcatgtgcccccatacctggctaatttttttgtatttttagtagagacagggtttcaccatgttggccaggctggtcttgaactcctgacctcaagtgatccacccgcctcagcctcccaaagtactgggattacaggtgtgagctactgcgcccagccttcactgggtaaatttaaaacacaactcaaaattttttgagtacctattatgtgccaggcactggcaacgatgataatgatgatggtatgagataactcttttttttttttgaaacagagtctcactctgttgcccacgctggagtgcagtagtgcaatctcagcttactgcaacctctgcctcccaggttcaagcaattctcctgcctcagcctcccgagtagctgggattacaggcgcctgccaccatgcctggctaatttttatatttttagtagagacagggttttgccacgttggccaggctggtctcgaactcctgacctcaggtgatccacctgcctcggcctcccaaagtgctgggattacaggcatgagccaccacgcccggcctggtatcagctaagttgtttttttttttttttttttttttgagatggagtctcacttcgttgctctgttgcccaggctggagtgcagtggcacaatcttggctcactgcaacctccacctcccaggttcaggggattctcctgcctcagcctcccaagcagctgggattacaagcgtgcaccaccatgcctgactaattttggtatttttattagagacagcattttaccatgttggccaggcgggtctcaaactcctgacctcaagtgatccgccatcctcggcctcctgaagtgctgggattacaggtgtgagccaccacacccagcctggtatcagctaactcttaatgagcacttactatgcaggcattgttctaagcactttaccttatatgaaatcatttaatcctcataataacccaatgaagtagtacttttattatcccaatcataccaataaagaaactgaggcacagagattaagtaacttgccccaaatcatacagctaataaaaggcagagccgggagtcaaacctaaacagttgattatagagtctgtgttcttaatcacaatgctatattacctctctgtatagttatacaaagtatataaagatgagcaagacacaatcacttcccttgagaaactgctactcaaaaagcttttgtggcagcttacagatcccgattaaagtccaaattccttaccatgttattcaaaggtctgaatgatctgatccaaacctctcttgctttatctcctattacatccacctgcattctctctcttttctttttcttttgcattttataaaattcttatttttccaacccggacccagagccagcaccgcctgcaggctctgaggccacaggcaccacctgcattctctatgttgcagttatacaacctgccacttctaaatatgtcctgaatcctcctacttccatattgttgtgagaatgagtctctctgtctggaatccatttttcaaagctctatgaatccttaaaaacttggctcaagaacacctccaaataacaacaacaataatagcaccaaacatttatatagcatttagtgtgccagacatgtccacatattaaatcacctaactctttttgtgttttttagagacaggatctcactctatcactcaggctggagtgcagtggcgtgatcatagctaactgcagccttgaactcatgggctcacacgatcctcccacctcggcctccaaaatagctgagactacaagcatgcaccatctcacctggctaattttttaatttttttgtagagatggggtttccttatgttgtccaggctactctcgaactcctggcctcaagcaattcttctgtttcagcctcccaaagggctgggattacaggtgggagccactgtgcctggcctgtcactgaattcttaaaatagctctttgaagttggttataagaatctctagctcagagatgtaatttcaaatatttccaatcataattaatctttctcgaggcgggagaatcacttgaggtcaagggttcaagaccagcctggccaacatggagaaacccaatctctaccaaaaatacaaaaaaaattagctgggtgtggtggcgtgcacctgtagtcccagttactcaggaggctgaggcagaagaaaattgcttgaacccaggaggcagaggctgcagtgagccgagattgagccactgcactccagcctgggtgacagagcaagcctccgtttcaaaaaaataataataaaaataaaaataaacctctactggagcatttattaggccctgccttctacatcaagttttacctaatgtctacctcttccatgatattaaaaggtttttgagggcagggatcctgtgtgtggaagagaatagctacttgttcaacaaattgcttcccctttcctcctgaagtagattacatttcccagtgtttattatagttggttaagactgtaacactaagttctggccagtggtatatgggcagaagtgattatgtcatttctaggcctgttccataaaacctcaacactattttccacagcttcttccttcatctgccagcagatgcagaagatccagtggaggaacctgaggccctcttctaggtgaaaatgagctctccttccacctctacccaacctccattggactaggacctgaaaaaaaaaaaaaaaaaaaaaaaacaagcctttaagccactagttagtccacctggacaacatataccatgtagttttgtgcctctccatacacttaaaacattgccttgttcacagttagttctcagtattcattgaacttaaataaaagttgaaattttttttttttttttttttttttttgagacaaggtctccatcttttgcccaggctggagtgcagtggcacgatcttggctcactgtagcctccacttcctgggctcaagcgatcctcccacctcagcctcccaagtagctgggactacaggtacgcaccaccacacccagctaatttttgtattttttttgagatggagttttgctcttgttacccaggctagagtgaagtggcatgatctcagctcactgcaacctccacctcccaggttcaagcaattctcctgcctcagcatcccgagtagctgggattataggcatgcgccaccacacccagctaatttttgtatttttagtagagatggggtttctccatgttggtcagggtggtctcaaactcccgacctcaggtaatccgcccgccttggcctcccaaagtgctgggattacaggcgtgagccactgcaccaggcctaatttttgtatttttgtagagatggggttttgtcatgttacccaggctggtcttgaactcctgtgctcaagcaatctgcctgcctcggcctcccaaattgctgggatttcacaggcacgaagacactgcaccctgccaaaagttgaaattcttattccaaggcaggtcttttcctaggacctactattagccagcagtctccaaaatgggtaatgagccgcattatccgttggagtatgggaagaaaatgaaaacttttacttatttttgataaaaagagaaatttcattttactaatatttaattatgggttaatagtagcacatggggatgtgctcaaaaatgctttcctaatgggatactgaggtaggcagactaatggccccccagagatgtctatgtcctaatccccagaacctgtgactgtgtcgcattatatggcaagggaaataaatcaaaattgtagatgcaattaaagttgctggtcagaagactttaaaagagagattatcctggattatcactgtgggtccaaagtaatcacaaggtcctcataggtggaagagggaggcagaagagtcaatatcagagtgatgcaatgtgagaaagactcattgctgggtttgaagacggaaggggtctatgagccgaggaatgcaaacagccactggcagctgaaaaaagtaaggaaatggattctcctctagagcctccagagaggaatgcagccctgctgataccttgattttagcccagtgagactcttgtcagacctctgacttatagaacagtaagataaaataaacgtgtgttgttttaagctactaagtttgtggtaattcgttatgatagccacagaaaactaataataggtacataacacaaaaaattgtatgggtcactcccctgtgatataacattaacagatctaaaacaaattttagactttaactctttgtaaactagcataaggaaaataacattaacatgttccttggtggcattcgcattcagtcagtcaaatatttatcaaattcacggttctgtataaagctcagagttaaacattaaagcataaatgtcctccctcaaactttattacctaaacaaagaagtgaacgaagagccaggcatggtggctcacacctataatcccagcactttgggaggccaaggcaggtgaatcacctgaggccaggagttcaagaccagcctggccaacatgatgaaaccccatctctactaaaaatataaaaattaaccggatgtggtggcacacacctgtaatcccagctactcaggaggctgaggcacaagaattgcttgaaaccaggaggcggaggttgcagtgagccggtatcatgccactgtactccatccagcctggacaacagagcgagactctgtcttaaaaaaaaaaaaaaaaaagaagtgaagaaagaggtgtgacatagtctaaaacatatccttactctgatttaaaaaacactgacactactggccaagtgtggtggctcacatctgtaatcccagcactttgggaggccaaggcaggtggatcacctgaggtcagaagtttgagaccagcctgaccaacgtggtgaaaccctgtctctactaaaaatataaaaattagctgggcgtggttgcagctgcctgtaatcccagctactcagtaggctgaggcaggagaattgcttgaacttgggaggcggagattgcagtgagccgagatctcaccattgcactccagcctgggcaacaagagcaaaactccatctcaaagaaataataataataaataaataaataataaaaattaaaaaaacactgacactgctattactactgttcatggacctcctgaaggctgaataacagcacctggtaggaagagttctggggccactgtatcaaagctgtcaagaaaattacttactgcttacctacaatatacctggaaactgtgctaattgctttataaatatattacctgagatgaaattacccccactttatcatctaggaaaatgaggtttggagtatttaaatgacttgacaaaggttaaagagggtactggaatctggatgtttggctccaaagtctgtgttttgccttgtgataatgagaaagaaagaaaaaaaggccagtggttcaataaaaccacttttggtttttgattcataaaaaagaactgcccttctacgaaccaatgaaaatctacctggtttgctttacaagcttttctgctgccaacgttgagcagtaagcagcatacatatcataggggttcttctgacccatactggtctttccagaaaaatgtgattctaaaggttatggtaacaacaattaagaggcctaaataaacctataatacaatgttaaaacgtggacataattttgatacttatgttttctaaaaggcctacatctaaaacactgaaaccctgctaataaccattaaaaaaaaagaaaagaaaagaaaagaggccaggcacagtgactcacacctgtaatcccagcactttgggagatcaaggtgggaggaccacttgaggccaggagttcaggaccagtctgggcaacatagtgagaccctgtctctaaaaaaataaaaaaattaaattagccaggcatggtggtgtgtgcttgtagtcccagctactcagaagacagccaggaggatcacttgaggtcagaaggtcaaggctatagtgagctatgaccataccactgcacttctctgcctgggcaaaacagcaagatcttgtctttaaaaaaaaaaaaaaaagaaaaagaaaaaagaaaaagaaacagatgcatgcaaagattgatgaaacctaaataaattggtgtactattttttctttttttttttttgagactgagtttagctcttgttgcccaggctggagtgcaatggtgcgatcttggctgaccacaacctctgcttcctgggttcaagcgattctcctgcctcagcctcccaagtagctgggattacaggcatgcagcaccacaccaagctaattttgtatttttagtagagatggggtttctccatgttggtcaggctagtctcaaactcccgacttcaggtgatccgcccacctcggcctcccaaagtgctgggattacaggcatgagccaatgcatccagcctattcttttttaaaaagtatgtttttccagaatttttatctaatttcctctcataattttggaagaaagggacctgtaacgtactctaccagactccactaacctttaacacgtagcacaaaataaattgctttgcattttactcccaaataatacaaagataccatcatttcttggacttgggctagaaaaaaaaaatcaccaataacaacaacaaaaaggccaggtacagcagctcacacctgtaatcccagcactttgggaggctgaggtgggaggattgcttgagcccaggagttcaagatcagcctgggcaacatagggagacctcatctctactaaatatcaaaaaattagctgggtgtggggcacgcctgtggtcctagctactcaggaggctgaagtggaaggcttgagcctgagaggttgagactacagtgagccgtgatgggaaaaaaaaaaaaaaagaaagaaagaaaaagatgaagaagaagaaagaagaagagaaggcaatggctgagatctcaagtcccagaagaactatgaatctaaacccgtaaaaaggcagtaatatcctcgggtaagtgcagttcaaacatgttttagaggtattacatcatggaaaactggttgtgctaggtcttagataggagaattcataaggaaaactcagctgaacagacattaaccaccagagtctcacatcaggtgacactaagcagagctggttcagtctcgctttctcctttttgtctttggtttttaacagtccaattttaagacagccaaaggcagaacaaacattgcttagcaatcagatcatgtcaatagcactacacataataacaagaggcccaatcaagttcatggtccaattttacttttttggggtaaagcaatacaaagatctaaaaagttaaagtcagatctgcttgcttacaaatattagaacagtttaataaatagaaaacagccaagatttctgggaggaaaatatataccctctatcttgaataacaaactgaaattaaacaaagaatgaatttataagtagtttaacaaaaattttaaatcacattgctcaaaactgccatgcaagcgaaaaaaaaaaaaaaaaacaagtctcctgacaaaggcagaactattaatacatatacatacagtgactttaaatatggccaaaaagctttttcttaatccaggaagttcaaaagagaactaatatccacaaactcaagtatttaagttgtcttcccaagccctgaaaaagtttcttcttcctttccaaatttctcctttattctaaaattacttataaatttacaccaaagtaacaaaatagaaatatagacttcaatctatgtgagcacatttctgaaacaatactctcacaatgatttatttcttctccctctcccaaagtgaatgaaatgtatggaggaaagaaaatgtcaatctactaagtatgtatcaagcaattaatatttgcaaggtttgtgctctccacagataaatattagagtacttgaaatttttgtaatgcctgtcacatatatattaagtacagtgccatgcaaaggggattaagtgggggctacagaaataaatgtgatgttcccttcttcaagggaacaaacgatggtgatgtataacatttactgagcacctaaggacgtgtcagacactgttctaaatacttttacagagcttatctcatttaatccttgtaaaaatatgtgataagtatatttctattttatttaattatttttttttttttgagatgtagtctcacttgatcacccaggctggattgcagtggcgcgatcttggctcactgcaacctccacctcctgggttcaagcaattctcctgcctcagcctcccgagtagctgggattacaggcatgcgccaccacgccgggctatttttgtatttttattagagacggggtttcactatgttggccaggttagtctcgaatacctgaacttaggtgatctgcccaccttggcctcccaaagtactaggattacaggcctgagccaccacaccaggcctatttctattttagagataagaaaaataaagattaagtggctcacctaagggcacacaatgagcaaatggcggagtcagggagtggatttttacctcttaaactttaagctatacagcctcaatatatgatacttcagattattgtgacagtagtaataacaataataaaaaatagtgacaggtaagatttagtgcctttgtactgtgatcaattctttatgtatattatctaatttaatcttcccatcaagctgatacagcagtactactattatttcctacttcacaggtaagaaaactgaggttatagatatttcacaatttgctcaagatcccctaaattactacgaggcacaaccatcctgaatctctcctttgaattccaaacttgtttatccaactgccaagttgatatctcctgatctcccatttccaaaactgttccccacaatgtctccccagcacagttactggcaattcaattcttccagttgttcaagtcaaaacctaagtaatctgcacatgtgtatggtggtttgaaataaaaaatgaataaatttaaagtttaaaaattgacaaacaaaaaacctaattaagaggcatcctttatgcctccttcccttgtgctaatatccctcaccgatttcctctttaaaaaatattcagggccaggtgcaatggcttacacctgtaatcccagcactttgggaggccgaggcgggcagatcgcttgagctcaggagttcaaaaccagtctgcacaacgtggtgaaaccccatctctaaaaaatatatctatatctatatctatatatagatatatatataaaatcttagtgtgtgtatatatctacatatatatacacacacacacaaaaattagccaggtgtggtggtgtatacgtgtagtccctgctactcgggaggctgaggtgggaggatgattttagcccagcaggaggccaaggctgcagtgagccatgatggtgtcactgcactccagcctgggcaacagagcaagaccctgtctcaaaaaaaaatctctattttttcttggagaaataagaaaaattaaaagaaagaagatattcagaacccagctggttgcagtggctcacacctgcaatcccagtattttgggaggccagggtgggaggactgcttgagcccagaagtccaagactagcctggccaacatagtgggtcagtctgtctctataaaaaaattaaaacaaaaaaattatcccagtgtggtggtgctcacctgtagtctcagctacttggcaggctgaggcagaagaattgcttgagccaggggttggaggctgcaatgagctgtgatcatgccactgcactccaacatggacaacagagcaagatcttatctcaaaataaataattatgaacagtattttaaaatttctcaataaaatattttgaacctaaaattatgtggttggcctgccaactaaatgttagggcaaaataaagactttaccaaatgagtaagaactcaaagtctccagggtgtggtggctcatgcctgtaatcccagcactttgggaggctgaagtgggatgatcacttgaggccaggagttagagaccagtttgggcaacatagagagaccttgtctctacaaaaataagacaattagctgggtgtgacacatttaggtggtacacacctgtagtaccagctgttgtgaaggctgaggcaggaggatcgtttgagcccaggaggtcgaggctgcagtaacccatgatcacacccactgcactccagcctgggtgacagagcaaggctctgtctaaaaataaaaataaaaataaaaaaattcaaaacccaactcctcttcacctttactaccaccatgtggtcccagtcatcatgagctctatctagatgattgcaatagcctccttaagtaacttaagttacacacttacatagcttcaaataggcatataataaaaaataacagtcccctaccctgcccacaccacattgaatcacctcctcagagggaaccactttcaactctttttagctatttattctatttaccttcatacatctagctaacatacactgccatttctgaccttatctactgattttacagtgtagcagctgaggatttagcattcttaaatatttcccttccaatattgttataagataatttggggtaaaattgacattcaggggaaaaaaatcaagactcaggattacatcgttaaaattattattattttttagagacagggtcttgctctgtcacacaggctagagtgcagcggtgtgattacagctcactgaaaccttgaactcttgggctcaagagatcctcccacctcagcctcctgggtaggtaggaccacaggtggtggccccacaatgggtttttttttgtttttttaatcttttgctgagacagggtcccactatgttgcccaggctggtctcagcctcccaaagtgctaggattataggtgtgagccaccgtgcctggccagcatttacattattatgactgattataatcactatgaggccaagtactatattatgatttcactttatttcttctataattgtttgtattttaccccttttttcatttgcttagttattacatgctatcatggtttggttgtgtcccacccaaatctcatcttgaattgtagctcccataattcccattttggagggacctggtgggaggtaattgaatcatggggacaggtctctcccatgctgttttcgtgatagtgagtaagtctcacgatatctgatagttttataaaggggagttcccctgcacatgttctcttgcctgcagccatgtaagatgtccctgtgcttttccttcatcttttgccatgactgtgaggcctccccagccacgtggaactacgagtccattaaacctctttcctttataaattacccagtcttgggtgtgtctttattagcagcatgagaaaggacttatatgcatgcctactgctacttctttccaaagcctccaacaaaattgtaaaattcttctgaatatggatttccaccctgccaaacatatcaggaaatacataagttctttcctcacacccccacttcccaacatctctcctgaatcttgtaatccttcgaatccaacctgaactgcttattttgtagactgttgcacaacagtcatcctgggacttcccattacctttatacccacttctttctaggtctcaaggcttcctttttatttttattagggtgttttgtttacttccctgttttgaagggacacatcctccaatagcatcatgagaaggggctcatgagaggcaaattttttgacaatttgcctatctaaaaatatcttcactctactctcatgcttgattggtagttcagctggacataggattctaagtaggaaatcattttctctcagaaagcatcttccattgctctagcttttttgtatgggatttttttttaaattttttcctctgtggaaatgtttagaatatttttattacccatattctaaaatttcataatgatatgctctgggtggctgttttttcattcattgtgctgggccctttcaatctggaagcacatgtcctttggttctcccctccaggtattagccaggcccggcacaatgggttagtctgcatactgaatggtgagaactcaaagagcatgagcctatggctcatataaaaaatgttttaattttattatattgccaaagccaaatacttctgagaaaggttgtcatttttaaaaaactgtcttcctttatttgggtctattcattttctccaggaaaaaatccatcaatttcctggcaagtggcagggttgagggtaggataggaatgattcttgcctgcctgagagccaggtgatggaaggtgactagaagtcttatgagcctcaccattccagtatgcagactatccccccatctcctcttttaggtattgcattctatcagatgttcactagtatgaagtatttctggttcaatttttctccaaaaataaaccatgtcttattggggtgggtgatatttaactgattagttacaagaaatggggatgttgactttcaggcccagttaccccttaaaagactttgaatagccctcttatttttagcccaagcctgacacccaccttcagttcctgagcttttataagtttctgtgatgcaaactggcttggttctaattggcatcagcttctagagatactacactataggcactacaaatacagtggtgaaaaagataaacttctaccctcagagagctcattcaatactggaggctttaagcaataggtaaacaaatgaataaggttcttttcagaagtaatgagaacttgtaacaaatatcgatgtctattttagactagtcaaaaagatttctttgaagaggggctatctcagcagaaatatatcatatgattctggaataaagtaagtacaaaggccctgaagcagggaaaaaagcttaatgtgtctgagaaacaagagggttagtgagtgtggttagaatgatgtaagaaaaaggaagaatgattggaaatatggtcagagccacgtaggccaaatcatttagggcctgataggttaaagcccagagtatgaactttgaagaatgacaaaaagctgtattaggaaattcagcagggaaatgacataatctgatttaccctcttaaaattcaatctggctattgtggggtaaaaggggaagacaagagatcaattaggatggttgggctagagtagtaagtgtagaggtaaaaagactcaggacatattttgaagataatgctgaactacttgatggtttgaaatagggtgtaagagaaagataataagaatggtaagtttttggctcaagtgatggatgaatggtgggagaggtctggaaagaagaaagggaatgcggcaggaaattaatagtggtccataatgggtactcaataattagtaatcattgtttatattaaaaatcttcagccaagacacagtggctcacacctgtaataccagcactttgggaggccaacgggggcagatcacttgaggccaggagtttgagaccagcctggccaacatggtgaaatcctatctctactaaaaatacaaaaattagctgggtgtggtgacacatgcctgtaatcccagctactcgggaggctgaagcacgagaacctgggaggcggaggttgcagtgagcagagatcatgccactgtactccagcctgggtgacagagtgagactctgtctcaaaaaaaaattaagatcaccttacagtctagtgttacaaaagatgctttgtgaactctcttgagagtctttcacctagttacccaccaggattacaatgataaaatcagagagatccactttattatttttttttcaaccttcaacagatgcaaaaaaacattttaggctgggagcagtggctcacgcctgtaatcccagtactttgggaggccgaggcaaacggatcacctgaggttaggagttcgaggccagcctggctaacatggtgaaaccctgtttctcctaaaaatacaaaaaattagctgggcatggtggcgcgtgcctgtaatcccagctactcgggaggctgaggcaggagaatcacttgaacctgagaggcagaggttgtagtaagctgagattgcaccattgcaccccagcttgggcaacaagagcgaaactccaactcaaaaaaaaaaaatttttttttaaaacactgcccatttattctggaacacactccacatccacattcactcacccttaagatattttaaaaacctgattatttaaaaattgttcaacatttaattcaatgtgatttcttatttatatatttatttattttattttttattttttttttaacatacatggtctcactatatcacccagtctgtgtttcagtggcacaactgaaaccacctttgcaaaagagaaatctgacatcgttaactctatcttgcctccaacctcaagctgtttgtctttggtcattcctgggcataggccaagctaactttgggaggaatttagtttacagtttaaccttaaagcaaggatgataatagcccttcccaaaactaaactacctttgtaaaactaaggaaaggccacaaggttaggattatgggaggggagagaattctgctaaaatgtaggtatagttctacaatttcttactgcttgggagtcatgtggctagagatcacaagatttgtgacttctccaactgctcctatagataacatcactattatagaacctaagactggttttctgagagatttttttcagaccaaccccacccagactcatgactcatgactcaactggtcctgtagcccagccttccccaacctttttggcaccagggactggttttgtggaagacaatttttccacagactcgggtgagggtcaggtggagggatggttttgggatgaaactgttccacctgagatcatcaggcatttgattctcataagggacgtgcaaccaagatccctcgcatgcacagttcacaacagggttcacgcttctatgaaaatataatgccaccgctgatctgacaggaagcagagctcaggcagcaatgcttgctcacctgttcacctcctgctgtgtggcccagttcctaacaggccacaggctgataccggtccataacctgggggttgaggactcctgctgtagccctacacagaggcacactcagcgcacaaggacttttccacacccccaattaatcagcagcacccattccctcagccctgcccaccaaattgtccataaaaactctaacctctagagggcttcaggaagactgatttaagtgataactgcctctttggcatggctggccttgagtcaattaaactctttcttactgcaatgccacgatctcagggaattgattttgtctgtgcagctggcaggaagaagccatcatagctcactactcctaggctcaaatggatcctcccgcctcagtctcccaagtgctcagattataggtgtaagccaccatgccctgcctcagtgtgatttctaacaactgatctggtccattctcattaaacagaagaaatcaaagcacagaggttaaataacttgtcctagagaatataattaggaaattgtggagctgtgtgaattgtacaagagaaagagtggaagaaaaggctggaaaaacagactgaaccttaactgtcagtctaaataatttttgactcgattttgaaaccaatgtgagccacaaaaagttttaagaaataaactatacaaccagagctgagtatcaggaagagtgaaaaagggcaaagagacagggaaaataattcactccaggtgaaagtgaagaaggctgaattacagcccacatatacgggaaggaatagatgcaaaagcctttgaatatttagaatcacagcttagcttctcattagaagcaaggaatacatgataaccaaaaatggctggaatttttcaggatggataactggaaagatggctgtcttaataactgagactgggaaaatatcctgccatattctcacagcattagctaatgctagtctatttcctacatagtataatttacttcttaaggagactctctgggagacaagaagcctctatttctcttgcattaatcatgatattacctagcacagggagggactgagtagttccaagcaaatatttgtgaattgaaggcatagtcttcaatttcatatttggtgaattgaaggcatatttggtgaattgaaggagtctaaaagaaatattaaatttctcatggcataaataacagagagacccagtgcagtggctcaagcctataatcccagcattttgggaggccgaggtgggaggattgcttgagctcaggagttcgagaccagcctgggcaatatagtgagaactttctctacaaaaaaattttcaaagttagccaagtgtggcggcatacgcctgcagtcccagctactcaggaggctgaggtgggaggattgcttgagcccagaaggcagagattgcagtgagcctgggcaacagagtgaggccctgtcttggggtcgtggggaggtatgagaacaaatctgagtgtatagttcctcaaaaaggccactggggagtggaagtgagtggggcatagaactgggttacagatcttgagcataagacttcctggcgtaaacaaccttattcacaagagacctaaacaatcagtccctgcattcaacaaagtactttattgttcctttttttaactgataactttgagcaactgatgataaaataaccaatcttcactgggcccatgtataaacagaatacacacacatgaacaaaatttacacaagtactacctctatgacttaccaggcccacacttttcctcccaaatagaaatcttaggaggaagggagataaagggaaaaagggaaactaggaggttggggtcaagaaaaagagaactacaaaggttcagctcactcactcctgctgggcacacaatagctctggcagaagagaaccaaggtatgcccagaggattaaatgcctaccacctggcagatcatgcagataggcttctttcccaagtagcctttccaaagcactaacagaagaattttcaactcattctttttctttttctttctttctttctttccttcatttctctctctctctctttcttttaagcaagagaccttttcttcaaaactcttatacagaagttcaatataaaaaagataaaaagtgcaactgttctgactagatgaagccaagagaacagaagtctcatctactcagccacctcccatacccggggccagcacctgagaaggcacatctgtgtaatcctagggttccaagagatggattcttcccaatgtagatctaatctcaatttggggaaaaattctggttcatacttctgcacctataaaagaaagcttataatgtttacagcttgaaaatagactaagagccatactaacaaatagtaaccaaaaaatttaaatcctaagtattaacagcaaattgctaagacaaccagaaagcatttagaaaatacaaattctaagaaccttgagaataaaacatagtcatgcttagtttggcatttaaggagtcacagggaagtataataaatgtttccattacattaatactcgtctgggtaacaaaagccaaaaggactttgtttgctctaggccactggttagaataatttccttttgttgtcttcaaaatatatagtgaaagtgaagacataaaaacataaatgatataaataattagaagcttcttttaaaaagtaatccatttcaggcttttaaaccacagtatctttgagacagatggcttatgcagaacaaaaatggtcaccatcagagggcaaacccacgtggctaacaataattacattctcatgtattatacttgcagtgtgacagttcctgtgccagaggctttatatatatcatctcatttgtgggcttattgggaagatttagatagactgaatgctacctttcatacattagaaaacttggctgagagcaaagaacattacttttttaagttaagggggatgagggtggaggtggggatcattcctaagcaataggatcaaaaggagataagctaagaaagtacatcaaggagatatggaataggaatggtaatgttggtctcatcacaaccctacatgtttctaggctggaatacatatacccgtagcaaagcaaaggcaaagatgtaggtagcccagcattatcaaatacagtaggcactagcttcatgtggcaatttaaatttaaagcaatccaaataaaattttaatttcttgtttgcattagcaatatttctgtgcttattagccacatgtggctactggacagcagaaatatagaacatttccatcactgcagaaggttctattggacagcaatgctttagtagaaaaccgttgaatctattaaaagcaacagtaggcactcaacaagtgtttagtgagtaaatgaataaaaaaaagataggtgctttgtggacactgctgccaccgccaggagccccgtactatcagccatggtcaaccccaccatgttcttcaacatcacagtcaaacagcgagcccttgggccacgtctccttcgagctgtttgcagacaagtttccaaagacaacagaaaacttttgtgctctgaccactggagagaaaggatttggttataagggttcctgctttcacagaattattccagggtttatgtgtccggttggatggcaagcatgtggtctttggcaaggtgaaagaaggcatgaatattgtggaggccatggggcactttgggtctgggaatggcaagaccagcaaggagatcaccattgctgactgtggacaactctaataaatttgacttgtgttttattttaaccaccagaccattccttctgtggctcaggagagcactcctccaccccatttgctcgcaatatcccataatctttgtgctttcgctgcagttccctttgggttccatgttttccttgttcccttccatgcatagctggattgcagagttaagtttatgattacgaaataaaaactaaataacaacaacaacaacaacaacaaaggctataataggccactgaaagaagcagccagaggaaaagaaactaataataatagctaacatttactgagcacttaccacataccaggtactattctaagtgatttacgtgtactaatttaattaatcttcaataacaactccgtaaaatatttactgtcattaccctcattttatagatgggaaaactaaggcttagagaggttaactaaactttcctaagatccaggatttgaatccaggcagtttgatctagaatctagagcaagcttgtccaacccacagcccatgggccacatgtagcccagaatggctttcaatgtggcacaacacaaattcataaactttcttaaaacactatgagattttttttttgcaattgtttgttttagctcatcagctattgttagtgttagtgtattttatatgtgaccccagataattcttcttccaatatggcccagggaagccaaaagattggacacctctaatctagagccttttttttttttttttttttttttttttgagacaagctctggctgtatcacccaggctggagtgaagtggtatgatctcagctcactacaagttctgcctcctaggctcaagccatcctcccacctcagcctctaaagtcgctagggctacaggcgcacaccaccatgcccagttaatttttgtattttttgtagagaaaacaaggttttctctacaaaaaccatgttttctctacaaaaaatacaaaagaaaacatggtttcaccatcttgcccaggctggtcttgaacttgtgagctcaaggaatctgtctgcctcggcttcccaaagtgctgggattacaggtgtgggcacacccaacctaaagccttcatttttaatcatactatagtactactttttaaaatagatcaaacataaatgtatacagtgtagaatgattaaatcaagctaattaacatatctactacctcacatcattttttgtggtgacatatttaaaatttactcctattcctggatcatatagcagttctattttctgtttttggaaatatacattattattaactatagtcaccatactgcacaacagatttcagaaatgtattcctcctatgtaactgaaactttgtgtctctgaccaacttccccctatttcctcccccatcccatccactcaccccatcctctggtaaccaccattcttctctccacattttttttttttttgagacagagtcttgctctgtcacccaggctggagcgcagtggtgcgatctcggctcactgcaacctccgcctctcgggttcaagtgattctcctgcctcagcctcctgagtaactgggactacaggtgtgtgccaccacacccggctgattttttgtatttttagtagagatggggtttcaccgtgttagccaggatggtctcgatctcttgacctcgtgatccacccacctcagcctcccaaagtgctgggattacaggcatgagccactgcacccagcctcttctctctacttctatgagatcgacttttttagagttcatacataaatgagatcatgagttatttgtctttctgtgtctggcttatttcatttagtgtaacatcctccaggttcatccaagttgtcccaaatgacagtatttccttcttttttgttgttttttgagacagtttcgctcttgttgcccaggctggaacgcaatggtgcaatctcagctcactgcaacctctgcctcccaggttcaagtgattctcctgcctcagccccctgagtagctggggttacaggcatgcaccaccacacccggctaattttatattttttagtagagacagggtttctccatgttagtcaggctggtctcgaactcccgactcaggtgatccacctgcctcggccttccaagcttttagtttgatgcaatctcatttgtctatttttgcttttgttgcttgtgcacatccaaaaaattgtctacccaatctcatggagatttttctattatgttttctttttttttttgagacagagtctcgctctgtcgcctgggctggagtgcggtggcgcgatctcggctcactgcaagctctgcctccagggttcacgccattctcctgtctcagcctcccgagtggctgggactacaggcacccaccaccacacctggctaattttttatatttttagtagagacggggtttcacagtattagccaggatggtctcgatctcctgacctcgtgatccgcccacctcggcctcctaaagtgctgggattacaggcgtgagccaccgtacccagcatacattttcttttagtagttttacagtttcaggttatactataccattttattatataacaagtatatctaaagattttgctgtaatggaataaaatttatttaaagtcaactttccatgcatttgctagttcagttcacagtgaagagagtaagaaaaggaatgataaaataaaaagattagcaggaaagatgccaaaatgctaatactagttttagccctacatgctgagattaagggcaagttttattttctttttcttactaattctattttctaaatgtttgcattgcaattatgtatcacttctgtaataataaaaaaattaaaatattacttcttaagctagatattacttaaaatatgatcatcttaaaaattcctaagcagaatatcaaagcctcatctacctcactctcaaacatggtggaagccccctaactgatctctttgctaccagtctctctaacactaaaccattctgcatcttgtcatcaattaccttatcattctagtttctgctcagaatccaatcacagatcataaactacaatcctttggatttatgcaaagcatttctggataatttgacccaattctacttttccacctttatctaccaatactatcctatcaaatcctcagttcttctaagagaagcctggtagaaagaacataggccttagaggagactttggcccatacataatctcttggcctcaatggagagtgagtgtgaagatgaaatctttaaataagtaacacacccagtatacaacatgccttcaataaatggtcattattattattgtcattattagccaaataggattttattcactgactcctcaaaaagctttgcatttttatatctgtgctttctatatcactatttgctctgagttcctcccctatcttctaaaatccttttaaaaatcaaggttcattattatgcacgacatgcctgcatcaaaatattttatgtaacccataagcagatatacttactatgtaatcacaaaaattaaaagtaatttaaaaaaaaattcaaagtccggttcaagtcccctcctagaaggcttccctgaccctttttttttttttttgagacagagtcttgctctgttgccaggctggaatacagtggcgcaatctcagctcactgaaaccactgcctcccaggttcaagagcttctcctgcctcagcctcccgagtagctgggactacaggtgcatgccaccacacccagctaatttttgtatttttagtagagacggggtttcaccatgttggccaggatggtctcgaactcttgaccttgtgatctgcctgcctcagcctcccaaagtgctgggattacaggcgtgagccgtcacgcccagacttccctgactcttcaaagttaatatgacccctcactcatttgaactcctaaggcacttaagagtttattctactcaaatggtggtgtcttagttaatttattagttctctttccatcaatgtaagtagagcaagtaaagtataaattccttgctagcagacactctattttatatatatcttgatatctttctgatgtctgaatatatcaccaggcatatagtagatgctcaaaaaatgtgttaatctggccaggtgcggtggctcacacctgtaatcccagcactttgggaggccgaagcaggtggattacctgaggtcaggagttcaagacaagcctggccaacgtggtaaaaccccgtctctactaaaaatacaaaaattagccgggtgtgatggcgagtgtctgtaatcccagctacttgggaggctgaggcaggagaatcacttgaacccaggaggtggaggttgcagagagctgagatcgagccattgcactccagcctgggcgacaagagtgaaactccgtctcaaaaaaaaagtgttaatttgacttataaatttgaaagaaagtcaccacaataaaaatactggctgaatatttttgtagtagactaggaagccaataattctatataaggataaaaagtttcaagtaagcagtataatttaattccataatttaataccattgaccaaacatgtaagtcatacttaagccatatgagttctctctagcctaatataaacatacaaaaaatagcaataaatgaccctaagtaaatagtactttaaactttacaaagcatcctgcacataaaccctaactaaatatacattgaattaaattgtcttatttggtctcatttaaaaatatactggccaggtgtggtggatcacacctgtaatcccagcctgaacaacacagtgagaccttatctcatttaagaaaaattttttttaacaaaatcatttttgtttttaatatagggtctcactctgtcactcaggctggagtgcagtgctgcaatcatggctcactgtagctgtgaactattggctcaagagatcctcccacctcagcctcccgagtagctgaaactacaggcacatgccattatacctggctaatttttttttgttgtttgttgttgttgttgtttgtagagatggggtttcaccatgttgcccaggctggtcttaaactcctaggctcaagagatccacccaccttggcctcccaaagtactgagattacaggcatgagccatcatgcctggccaaataaaatttttttttttttttttttttgagacggagtcttgctctgtcaccctggctggagtgcagtagtgcaatctcagctcactgcactaggttcccagggggaacctccacttcccgggttcaagcaattctcctgcctcagcctcccaagtggctgggactataggcacgtgccaccacgcccggctaactgtttttttgtatttttagtagagatggggtttcaccatgttagccaggatggtctcaatctcctgacctcatgatccgcctgcctcggcctcccaaagtgctgggattacaggcgtgagccatcgcgcccagccaaattttttttaaaaagaaaatatacttgcctgactaaaatatcaaaataattaaagcaagaaagattcagatacggattattaaaaagtgacaattacataaacttataaaaataattgtccactttgggaggccaaggagggtgaattgcttgagcccaggaacttgagaccagcctgggcaaatggtggaactctgactttacgaaaaatgtgaaaattagctggatgtggtggtgcgcctgtagttccagctgctcaggagtctgaggtggggaagctcaactgggccctggaggtcaaggctgcagtgaaccatgatcatgccactatactccagcctgggtgacagagtgagaccctatctcaaaaaaataacaattctcaaaggcaaaatgtgtctcctcaagtgagtgctaaaagttaaggatagataacttgagggtgtaattttacatttattgccactcattgatttaattacaatttcccaaaaagtaatcaggaaaagtaaataaccacataaagaccaatctctcctctttgataaattaccagtcagcaatagaaaacaattgttctaatgagctgctactaatgttctaatgagagtaaagcaacttaagagataaaggaagttgctttattaaatgcagttaattaccaataaattaagtctcaatgggtagaaaacgacctagagtaccactaaaccccagcaagatagattcagcatgataaatcctgaatccctcctttttttcctattagtgctattctagcaagcctccaatgtttcagttttctcattgatcagaaggaaggaaaagccattacctaaggatgttgggatgggagagtctattcatgagctgtacttctttcagcatgtttgcccggttactgctcaatgtgttcatcttaagagccatcacctgaccagaagctcggtgtcgtacctagaatattaaatagaacaagaaaagagggtcaagggcaatagttatatgtgaggtcaacatctccaaatgtacaatatgccaagatatttttgtgccactttagataaaatatacatctaattacattaaagtatcacttccatgaatgaagatgaattattctacccaagaacagtattatttcacattgagttggccagaaaaacactgttactaacatctcaagaaaacatgtctgatatacaccatggaatactatgcagtcataaaaaggaatgaggtcatgtcctttgcagggacataaatgaagctggaagccatcatcctcagcaaattaacacaggaacagaaaaccaacactgcatgttttgaacattgagaacacatggacacagagagggaaacaacacgcaccagggcctgttagcgggtggggggtgaaggaagggaacttagaacttagtcaacaggtgcagcaaaccaccatggcacaaacctgcatgttctgcacatgtatcccatgttttcttttttttagaagaaataaagaaaaaaatgaagaaataaataaaagaaatcatgtctggtttgttgctgttgttgtttttgtttgagacagggtctcactgtgtcacccagactggagtgtagtggcacaatctcggctcactgcaacctccacctcccaggttcaagtgattctcctgcctcagcctcctgagtagctgggattacaggcatgtgccaacacacccggctaatttttgtatttttagtagagacaggttttcaccatgttggccaggctggtctcaaactcttgacctcaggtgatctgcctgcctcggcctcccaaaatgctgggattacaggtgtgagccaccatgcccagccaatcatgtctggttttttgttgttgttgttgttgtttttgttttgagacagagtcttgctctgtcacccaggctagagtgcagtggcgtgatctcggctcactgaaacctccaccttccgggttcaagcaattctcctgcctaagcctcccgagtagctgcgattacaagcgcctgccaccgcgcccagctaatttttgtatttttagtagagacggggtttcaccatgttggccaggctggtctcgaactcctgaccttgtgatccaccagccttggcctcccagccaccgtgcctggcctgtttttaataccttagaaaaaaaaaatgagggaaaatttttaagctgattcctcatggctgaccttggtgagtcttaagacaccaacagaaaagagtcccttctgtggcattctaagtgtgcaaaacgaagatatatgcatgagccttatgtaacacttaatgaaactgtctttataagatgctaaacccacatactcaaagtctcccccaagtaccataaaaatccataggccgggcacagtggctcacgcctgtaatcccaggactttgggagaccaagggggacagatcacgaggtcacaaaatcgagaccagcctggctaacatggtgaaatcccgtctctactaaaaacacaaaaaattagctgggcgtggtggcgggcacctgtagtcccagctactcgggaggctgagccaggagaatggcatgagcctgggaggcggggcccgcagtgagtggagattgtgccactgcactccagcctgggtgacagagcgagattccgtctcgcgaaaaaaaaaaaaaaatctataaaaaaaaaaaatttcatgctaaatatagaaagaagtccgtgaaccttttagagctaatattgtagtaactctacccaaagcaccttataatcatttaaacacactcaagttaaatacaacaaacatgggccacaccactcacactattacccatatgcacagaggaaagtctacttctaaaagtattcgccctctatagaactcaatctattgtgcatgtgtaaatattatttatcatttcaatgcacactccacaggtttcataaaccataacactttacttgagaaagattgttttcaccctgtaaatgtggtctcattggtagcaaaataagaccaccagacaaaacattttgtgtgattcaaagaagctaaactgagatatgtgtgtttcctgcttaggaattatgaatgaggcagtagaaaaatcatgaagtcacaaagatctttctcgttaaaaaaatttcatttcatatcttgcacaacagggactttactatgcaaaaatgtcatcatcctacggacttcaggagtatcatttcagtatgctatactcaaccaaatgggaattccaaaagaaaacatgacaacttacttaaactcttcaatatccaaaaactccttgaaatgacaatagctccacaagtttatcatagctattaatacaggtcagacatcacagcttatcttagaattcaaacagtgtttcagagaggccaggcagaagagggaaggctgttgagggggaggccgggccaaaacacaaagagccacaggaaccctgatcggaaaaactaaggcaggcagaacactggctgcctctcctctcctagatcactgagtgagatttggaacccagctctcttctcagtgcatcaaggattctgttgtaatgtacctcttgactgatgaaagagaagtagctttccatttcagatcctgcatggataagttaaaagaaacatttataaacaaagagctcactggtagtatttttccaactctatttacagaagacatctgtgttttaataaggactctccagctgaaagtcactcttcttatttttccatcatctgaaaactgtcacactaagattttaacaaaatggcaaaacccatgaaaagatcattcatcctgaccaaccgggatttatccctgggatgtaaggatagttcaacatacgtaaatcaatcaatgtgatacattatatcaacagaatgagggacaaaaaccatatgatcatttcaattaatgctgaaaaagcatttgataaaattcaacatctcttcataataaaaaccctcaaaaaactaggtatagaaggaacatagctcaaaaagccatatatgacagacccaaagctagtatcatacttaatgaagaaaaactgaaagcctttcctctgggatatggaacacaaaaaggatccccacttttaccactgttatttaacatagtactggacaccctagctagagcaatcagacaagagaaagaaataaagggcatccaaattggaaaggaagaagccaaattattcttgtctgcagatgattatgatcttgtatttggaaaaacctaagactacactaaaaaaactattagaactgataaattcagaaaagttacagcatacaaaatcaacatacaaaaatcagtagcatttctatatgccaacagtgaacaatctgaaaaagaaaccaaaaagtaatccaatttatagtagctccaaataaaattaaatacctagaaattaagttagccaatgaattaaaagagctctaaaaggccaggcacagtggttcacgcctgtaatcccaatactttgggaggccaagacaaaaggattgcttgagtccaggagttcgagaccagcctgggcaacatagtgagacactatctctacaaaaaatacaaaaaaattaactgggcttggtggttcaagcctgtggtcccagctagtcgggaagctgaggtgggaggattgcttgagcccaggaggtcaaggctgcagtgagctgtgatcgtgccactatactccagcctgggtgacagagcaagactgtctcaaaaacaaacaaaaaagttctctacaatgaaagttataaaacattgatgtaagaaactaaagatacaaaaaaatggaaagatattccatgttcatgaattgcaacaatcggtatttttaaaattcccatactactcagatactaaactttctatggaatcacaaagacccagaatcgccaaagccatcctgaggaaaagaaaaaaagctgggccgggtgcagtagcttatgcctgtaatcccagcactttgggaggccgaggtgggtggatcacctgaagtcaggagtttgagatcagcctggccaacatggtgaaaccctgtctctactaaaaaaaaaaaatacaaaaactagctgagcgtgatggcatgcccctgtaatcccagctactcgggaggctgagcaggagaatggcttgaacccgggaggcagaggttgcagtgagccaagattgcaccactgcactccagcctaggtgacagagctgagactttgtctcaaaagaaaaaaagaaagaaactggaggaatcacattacctgattcaaattataccacagagctattgtaaccaaaataacatggtattggcataaaaacagaaacatagaccaatggaacagaatagagaatccaataacaaatccataaatctacaataaactctcattttcaacaaaagtaccaagaacatacattggggaaaggacagtctcttcaacaaatagtgctgggaaaactgtatagttacatgcagaagaatgaaactagactcctatctctagccatatgcaaaaatctaatcaaaatggattaaagatttcgatctaggacctcaaactatgaaactactacaagaaaacatcgggggaaactctcccattggtctgcaaagattgctcgagtaatactccaaaagcacaggcaactaaagcaaaaatggacaaatgggatcacatccggttaaaaagcttctgcacagcaaatgaaacaaagtgaagagtcaatccatggaatgggagaaaatatttgcaaaatatccatctgacaaaggattaataaccagaatatataagaagttcaaacaactctataggaaaaaaaaatctaacaatcagattttttaaatgggcaaaagatctgaacagacatttctcaaaagaagacatacgaacagcaaacaggtatatgtaaaggtattcaacatcactgatcatcacagaaatgcaaatccaaactacaatgagatatcatctcaccctagttaaaatggtttttatccaaaagaagggcaataaagaattcttgcaggctgggcacggtggctcacgcctgtaatcctagcacttttgagaggccgaggtggaggattacctgaggtcgggagttggagaccagcctggccaacatggtaaaaccccgtctccactaaaaatacaaaaattagctgggcatggtagtgcacgtctgtaattccagctacttgggaggctgaggcatgagaatcacttgaacctgggaggcagaggttgcagtgagccaagatcacgccactgcacttcagcctcagcaagactctgtctcaaaaaaaaaaaaaaaaaaaaaaaaagaattcttgcaaagatgtagagaaaggggtaagcctcgtgcactgttggtaggaatgtaaattggtatagccactatggagaacagtttggaggttcctcaaaaaactaagaatagagctaccatatgatccagcaatcccactgctgggtatataccaaaagaagggaaatcggtatgtcaaatacatatctgcacttccatgtttattgtagcactattcacaatagccaagatttggatgcaacctaagtgtccatcaacaaacaaatggataaagaaaatgtggtacatacacacaatggagtactattcagccataagaaaggattagaacctgtcatttgcaacaacatgggtggaacttgaggacattatgttcagttaaataagccagacatagaaagacaaacttcacatgttctcatttatttgtgggagctcaaataaaacaattgaactcatagagacagagtagaatgatgatggttaacagaggctgggaagggtagtgtggggtgtgggggagtgggggcagttaatgggtacaaaaatatagcttgatagaatgaagaagatttagtacaacagggtgattacactcaacaataatttaattgtatattttaaaataacagagtataattggaatgtttgcaacacaaagaaatgataaatgcttgaggtgatggatatcccatttatcccaatgtgattattacacattgtatggctgtatcaaaatatctcatgtaccccataaatattatctactatgtacccataaaaataaaagtttaaaaaagatgccccaaccatcatacacagttataaaacagcaataacatagctaacatttacagcatttgctacatactaggtactgctgtataacttctttatacatattaacttatttaatcttgaagataatcctgtgagacaagtatcactaataacctcattttacagccatggaaactgaggcacagagaaattaaatctttctcaagatcgtacatctattaaatggcagagacacaatttgaatacaaactatgcaaagaatattgagcctgatacagtcagaccaactgattcaagaaaaaaagcactgtgtgaacattgcataaatattctaccaagggataataatcatgatcttgtatgtatctcacaacatggtcttgtaatatagaaaacaaaaactgacaatgtaaggcaaatgtgacaaatctatgatctttatttttatttttttttaaacagggtctcactctgtcacccatgtttgaatgcagtggcatgacctcagctcactgcagcctccccctcctgagatcaagcaatcctcccacctcagccacttgagaagctgggaccacagctgtgcaccaccatgcccagctaatttttatatatttttttagagacagggtttcgccatgttgtccaggctggtctcaaactcctgggctcaagcagtctgcctgcctcggcctcccaaagtgctgggattacaaacatgagccactgcgcccagctcttaaattcctgatttttttttttttttttttttttgagacggagtctcgctctgtcacccaggctggagtgcagtggcgtgatcttggctcgctgcaagctccgcctcccgggttcacgccattctcctgcctcagcctcccaagtatctgggactacaggcacgtgccaccatgcccgactaattttttgtatttttagtagagacggggtttcaccatgttagccaggatggtctcgatctcctgacctcgtgatctgcctgccttggcctcccaaaatgctgggattacaggcgtgagccaccgcgcccggcccctaaatattatgagacattttaacacatctctcaaaaactgaaagctcgccaggtgcggtagagatcaggagttcgagaccagcctggccaatatggggaaaacccatctcttaaaaatacaaaattagccaggcgtgatggtgcgtgtctgtagtcccagctacctgggaggctgaggcagaagaatcgcttgaacccgagaggcagaggttgcagtgagccgagattgtgccattgcactccagcctgggtgacagagcgcaactccatctaaaaaacagattaaaaaaaaattttttttttaaacctgaaagctcaagaagacaagaaattagtaaggatatggaacatttcaataacaaaagtggcatctttgatctaatccttcctcaaagacaggcattttttttaaagtatatatgacaaaatttatcaaaatgctactaaacaaaaattacaggaggcataacagttttggattgagttcctgcactaggctttaacagacgagactaaaaatgaaaacggagttacccgtgctaaagttctactaagttgttccactaagttgttatctgactttccaagaaatcaggaaagagagataacagccaatcacccaaactgaccagcttcaatcttcaattggcataactaaagtccctccgctttaactcttacacaaaagaagtagcctgaagttagttgatactaacaaatcagttacttttctgttgtttgatatccctgcctttgcattataagaactttgaaagggctaataatacactctcaggtctttgcttctgcttttttaagcccttctctgactataaagccaaattcttccactcagctcattggtacacttattctattttaggaaatgaagagttgctggactctagaatagcaataaagactattgaagtctttaaactatatttattctaattttgtcctttaacagatgtggctaccacaaagggacctgaaggagactgctgaagaccctgagaccctaagctctgctaacccctttttggatgagaatctgtcttctcatggagcctaaagagttgtgaagatgggtatggtggctcacagctgtaatcccaacacttcggaaggctgaggcaggtaggctgcttgagcccaggagttcgagatagcctgggcaacatggtaaaacacatctctacaaaaaaaaatacaaaaattagctggttgtggtggtgtgcacctgtggtcccagctactcaggaggctgaggtgggaggatcgcttgagcccaggagatcaaggctacagtgagccatgatcaagacattgcactccagcctgggcaacacagtgagaccctatctaaaacaaacaaacaaacagaaaaaatagagtcgtgagtaaacctctctcaggtctgagctctgctcttttgcctttgatctctctgatctctttgccttttgggataccaagggttagtttgtgttgtgagagagcacttgatgatgagacagctagggttagtttgtactgtagcatggcacatgacttttgggtttgtggtggctgacaagtcactggcaagggttgcatctttttgcttcctctttggcgacatttcatgtgtggttctataaaagtcttgagccaagcccccaagaatatggctggacagaaatgtgggttacacctcacttgctactaatatatggacggacagaaatagaggttgcgttatatttgtagttagcgtaaagagctacagttttataaggcagaatcacccaaaaaattctggagataatcctccagtgacttacacttcctggacaaaaattgagcttatggcctagaacccatctactgaaaagtaagcagattaaacaatacgaattatttactcaacaccaattttcttcttttttgtgactgaaagaaacccaacctggcaatcttccttgcaactaggagagtctatgttacacagtgctagtaagaagatgcaagaggccgggcacagtggctcacgcctgcaatcccagcactttgggaggccgaggtcggcggatcacgaggtcaggagatcgagaccatcctggctaatatggtgaaactctgtctctactaaaaatacaaaaaattggccgggcatgttggcacgtgcctgtagtcccagctactcaggaggctgaggcagaagaatcgcttgaacccgggagacggaggttgcagtgagccaagattgtgccactgcactccagcctgggcaatagagcgagaacctatctaaaagaaaaaaaaaaagatgcaagtggaaattgctgcatggaatttctggggatgctattgctttcttgatgaaattgtactttttacttcccccttattatagcctggaacaaagacatgatgcgcacataaagagtagttattagggatgctcaaccagtaagtataatgcaaatattcaaaaaaattttccaaaatccaaaacacctctggttcccagcttgtggataagggatactcaaccttttactggccaccagtaaaaaccttgcttgaaggggtcagagaaggattcccagaggaagtcatccttcagttttcttcaagaataagaaagagcttgtcaaatagaacaagcaaggaaagggcatactgagcaggtgtaaaagcatgtgcagagtctcagaggaataagagcatgggatattctaaggaatggtgagaaactgggtttggctcaaggcctggtgggtacatgttaaggaattgcaagcttgtgatgagcctagcatggaaagcaagaaccagaaaataaaaaatttttagggcaaggcacagtagctcatgcctgtaatcccagcactctgggaggctgagacaggaggatcacttaaacccaagagttcaaggccagcctgggaaacatggtgaaaccccatctctacaaaaaatacaaaaaacgttacccaggcatggtggtgcatgtctgtggtcccagatacttgggaggctgagatgggaggatcacttgagcctgggcaacaaagcaataccctgtctctacagaaataaaaatagtcaggcatagtggtcccagctacttaggaagtaggtcttgaacacctggcattaagggatcctcctgcctcggccttccaaagtgctaggattacaggtgtgagccactacactaggccgagtatttatcatttatatgtattgggaacatttcaagtccgctcttctacctacttagaaatatacaatacattgtccaggcacggtggctcacgcctgtaatcccagcacttttggaggccgaggcgggcagatcacaaggtcaggagatcaagaccatcctggctaacacggtgaaaccccatctctactaaaaatacaaaaaattagccgggcatggtggcaggcgcctgtagtcccagctactcgggaggctgaggcaggagaatggcgtgaactggggaggcggagcttgcagtgagccgagatcaagccactgcactccagcctgggcaaaagagccagactccgtctcaaaaaaaaaagatatatacaatacattattaatgatagtcaccatactctcctattgaatattataacttttttttttttttttttttttggagatggagtttcgctctgtcacccaggctggagtgcagtggcatgatctcgcctcactgcaatctccgcctcccaggttcaagcaattcttctgcctcagcatcctgagtagctgggacaacaggcacatgccgccacacccagctaattttttgtattttagtagagatggagtttcactgtgttgcccaggctggtctcaaactcctgagcttgggcaatctgcccaccttggcctcccaaagtgctaggattacaagcatgagccaccgcgcccagccgcttttttttttttttttttttttttttttgagaccgagtctcactctgtcactcaggctggttgcagtggtgcaatctcggctcactgcaacctccacctcctgggttcaagcgattcttgtacctcagcctcccaagtagctgggactacaggcacgtacccaccatgcccagctaattttttttgtaatttcagtagagacagggttttgccatgttggccaggctggtcttgaactcctggcctcaagtgatctgccctccttggcctcccaaagtgctgagattacaggcatgagacactatgcccagcctataacttacactttctatccaactatatgtttgtacctattaaccaactttctctatcccacgcacccttcccagcctctggtaactatcattctactctttacctctatgagatcaactatttcagctctcacatataagtgagaacttgcaatattagtctctctgtgcttggcttatttcacttaacataatgacttccagttccatctgcgttgctgaaaatgacaggatttcatacatttttatgtccaaatagtgatccattttttatatataccacattttctttttccacttatccatcaatgaatgcttaggttggttccatatatttgctactgtgaatagtgctgcaataaacatggagatgcaagtatccctttggtatattgatttcccttcctttggataaatacccactaatgagattgctggatcatatggtagttctattttttacttttttgagacatctccatactgttttccatagtgaccatactaatttacattccccccaagaatataagagttccctttacgctgtatcttcatcagatctggtttgttttttgtttgttcatttttggggttttggggtttgttgttgttgttattgttgttgtttttgagatgggatctcactctgtctcccaggctggagtgcagtggcatgatcatagcttactgcagcctcaacctcctggctctagggatcctcctgcctcagcctcctgaatagctgggactacaggcatgtgccagcacacccagttaatttttgtatttttggtagagacgaggtttcaccatgctgcccaggctggtctcgaactccggagctcaagcaatcgcacctgcctccatcttccaaagtgttgagatcacaggcactggccaccgtgcctggcctgtttttgtttgtttgtctaagacagggtcctgctctattgccaggctggggtgcagtggcatgatcacagctcactctagtgtcaatctgggctcaagcgatcctcccacctaagcctctcgagtagcttaaactacaggtgtgcaccactacatccagctatttttttttttttttgtagagatggggtctttttgtctttttgatggtagccattctaaatgagataagataatacctcattgtattgatttgcatttccctgattagcaaattttttatgatgttgagcatttttcgtatacctgttgaccattcctatgttttctttcaagaaatttctgttcatgtcctttgcccatttttaaatgggattttcggggtagggagagatggttttttattttttactgttgagttgtttgagttccttgtatattccaaatattagcccctttttggataaatagtttacgagtatttcctcccattcaaaaggttgtctcttcactctattgtttcctttgctgtgcagaagatttttagtctaatatagtcccatttgtcgatttttggttttgctgcctatacttttgaggtctttgccataaaatctttgcctagaccaatgtcttgaagtgtttcctctgtttacttttctttcttttttttttttttctttttttgagacaaggtctctctctcttaccaaggctggagtgcagtggcttgatcataattcactgcaatcttgaactcctaggctcaagaaatcctcccacttcagcctcccaagtagctgggactacaggtgtgcaccaccatggctggctaattttttatttttttgagtcagggtatcactctgttacccaggctggagtgcagtggtgtgatcacagctcactgcagcctcaacttcctaggctcaaccaatcctctcacctcagtctcccaggtagttgggactacaggcacacgccaccacacccagctaatttttttgtattgtttgcagagacagggtttcaccacgttggccaggctagtttcaagctcttgagctcaggcaatctgcctggcttggcctcccaaagtgctgggattacaggcatgggctactgcacccagccatttttttttttttttctaaagacagggtctcactatattacccagactcatctcgaactcctgggctcatgtgatcctcctgccttagcctcccaaagtactgggattataggtgtaagccactgtggtctaattttttttttttttttttttttttttgtagagacaaggtctcactatgttgctcagtattctttttttttttttttttaagacccagaataacatgctgaaacccctatgttttcttctagtagttttgtagtttggggttttacatttaagtctttaaattatctttattttattttattttattatttgagacagagtctcactcttttgcccaggctggagtgtactggtgtgactggatttgacttttgtatatagtaagagatggagatccagtttcattcttctgcatatataatataccatgttctcagcaccatttattcaagaaagtgtcttgtccccagtgtacgttcttggtacctttgttgaaaatcagttggctgtaaacacgtggatttattctgttccattggtctatgtgtctgatttatacaaatatcatgctgttgtgctcagtatagccttgtaatatatattgaagtcaggtagtatgatgcctccagctttgttctttttgctcaggactgctttggctatttggtctcttttttgtttccatacaaaattttaggactgctttttctatttctgtgaaaaatgacattggtatcttctttttttttttttttttttttgagatggagactcactctgtcacccaggctggagtgcagtggcgtgatctcggttcactgcaacctccacctcccaggctcaagcgattctcctgcctcagcctcctgagtagctgggattacaggcacacaccaccacacctggataatttttgtatttttagtagagatggggtttcaccatgttggccaggctggtcgcaaactcctgacctcagaagatccgcctacttcggcctcccaaagtgctgggatcatgagccaccgtgcctggccttttttttttttttttttttttttttttgagacggagtttcactcttgttgcccaggctggagtgcaatggcccgatcttggctcaccgcaacctccaccttccgggttcaagcgattctcctacctcccctcccgagtagctgggattacaggcatgtgccaccacacacagctaattttgtatttttagtagagacaggttttctccatgttgggcaggctggtctcgaactcctgacctcaggtgatcctcctgccttggcctcccaaagtgctgggattacaggcatgagccactgtgcccagccaacattagtatctttttttttttttttttagacagagtctcactctgtcacccaggctggagtgcagtggcacaatctcggctcactgcaacctctgcctcccaggctcaagcgatcctcccgcctcagcttcccaagtacttggaactacaggcatgtgccatcatgcctggctaatatttgtatttttagtagagatagggtttcaccattgttggcaaggctggtcttcaactcctggcctcaatccacccaccttggcctcccaaagtgctgggattacaggagtgagccgctgcgcctgacccaacattggtatcttgatagggatttcactgaatctgtagattgtttttgggtagcatggtcgttttaacaatattaattcttccaatccatgagcataagatatctttctatttttttgtgtcctcttcaatttctttcattagcgttttgcagttcttcttgtagggtctttcactttcttggttacatttattcataggtattttattataatttttgtagctgtactgtaattgggattgccttctagatttttttcagctaattagtggtgtatagaaatgctgatttttgtgcattgatttttgaatcctgtaactttactgaatttatcagatctaaaagattttggtggaatctttaggtttttctagatataagatcattttatctccaaagaggaacaatttgacttcctcttttccaatttggatgccttttctttctttctcttacctcactgttgcagctaggacttccagtactatgctgaataggagtggtgaaagtgagcatccttgttccagttttcagagaaaaggctttcacagcttttccctatcagtatgctattaggtgtgggtttgtcatatatggcctttattatgttgaggtatgttctgtctatgactagtttgttgagagtttttatcataaagggatgttgaattttataaaatactttttctagattttgaaggttaccttaactctgactacctggaacagttaaattctgaaatggctggtttgatatgagacagacaagcaaagcttcttggttacagacacacataagtgttgctcatagatgttggggtttggggatggttctgaatacttccaagtagtctttttgggagcatttaatttttgttccccaaacagtattggtatatactgacatctcagtcacccaatgactctgaaaactggtatgtcagaaatacctaataggctttctcctaacttttacctttaagtagaacatctactatctcacatcatccttactgcccagttcttagccatcttaacaaaagttacttcatataattccatgactatagagctaaactcttttctgatagagtagttattaaaacatagaagcactggctgggcacggtggctcacgcctgtaatcccagcactttgggaggctgaggcaggtggatcacctgaggtcaggagttcgagaccaacctggccaacatggtgaaaccccatctctactaaaaatataaaaactagccaggcatggtggtaggcacctgtaatcccagctacttgggaggctgagacagcagaattgcttgaacccaggagatggaggttgcagtgagctgacacggtgccactgtactccagcctcagcgacagagtaagactctgttaaaataatatcacataccactgatgaagacacttttttaagtttttaacttttaataaaagttttaagttcaggagtacacatgcagatttgttacataggtaaacttgtatcatgagggtttgttgttcagattatttcatcacctaggtattaagcctagtacccattagttattttccctgatcctctccctccactctatgataggccccattgtgtgttcttcccctctatgtgtccatgtgttctcaccatttagcccccacttataagtgagaatatgcagtatttggtttgatgaaaacttttacagtgagatctcagaaaggcatacagagaaataaacacaaccatgaaataagatactgataatctgaggaaaaaccttaagtattttagattcagactacaacaataatcaacatttaaaagagaaaagattcactctctagacaatttcataagttactgtttggaaagttaaaaaattagtcagtttttagtacagttgtgacactgaggccaccgtagaagcaccagcattttgagatccagtatctaagttttcagacaaagctcccaaacagaaaatataaaaacctttacctattcaagcacaaaaataaaatatcccaaaataacataacattcacttactaaaatgttcctcttactttccttaaaccacaactgttacaacactgcaagaaatttacagtttgcatgacaaactgcatatgcactaaataataaatgtataaccatgaatgcgaatgaatcaatttttcagtatcaagcagatggcagatactagctcttttagtttctacatctttgaagctcagttttctcatttatgaaatgaaagtgtaactacttacaagattgttatagatactatgcaataaaatatatacatgttcttaatacagtacctagctcaaagaaatagctccatagatatcagctacctatataacagaaataataactagcccttaaatagggtgaattatttataacattattctaatgctttacgcataatagttcattatattttctcaacaactctaaaggtagatattattacaatcctcattttgcagatgaggaaacggaggcacagaagtcaaggtcagaaagtttgtaagtggtacagccaagactcaaacccagctaggcatggtagcaaacacctgtagtcccagctacgcaggaagctgagacaggagaattgcttgagcccgggagttcaagacaaggctgggcagcatagcaagaccccatctctcaaaaaaatttaaaaattagccaggcatgctggtggtacatgcctgtagtcctagccattcaagaggctgaggcaggaggatcacttgagcccagcagttccaggttacagtgagctaaagttgtgccactgcactccagcctgggcaacaaagcaagcgcccccccactgccactttttttttttttgagacagagtatcgctaggtcacctgggctggagtgcagtggcatgatcttggctcactgcaatctctgcctcaagcgattcccattcctcaacctccggagtagctggaattacagacatgcaccagtacacctggctaacttttgtactttttgtagagacggggattcaccaagttgaccaggctgatctcagactcttggcctcatgtgatctgtccgcctctgcctcccaaagtgctgggattaaggtgtgagccaccacactttgccaaggcccccccaaaaaaaggtatcattgctccaataaaagcctgtataaaacatacagaacggacaaaggagggaatgatcaatcatgctatgaaaactatgataatggtaagaaaacaaggcatctcatttcacataatcatcaaaaataaaatcacacctaaaaaatagtggggccaggggctgggcgcggtggctcatgcccgtaatcccagcactttgggaggtcaaggcaggtggatcacttgaggccaggagttcaagaccagcctggccaacatggcaaaaccccgcctctactaaaaatataaaaaaattagctgggcatggtggtgtgtgcttgtattcccagctacccaggaggctgaggcagaagaatcacttaaaccggggaggcagaggctgcagtgagccaagatcgcactactgtactccagcctgggtgacagagcaagactcggtctcaaaaaaaaaaaacaaacaaacaaacaaacaaaatatatatatatttgtaccactgcaggtgacagagtgagatcctgacactctcgtttgctgactttaatgaatcaggcagccacactgtgtgctgtcatagagaaaaggccacaatggcaaggaactgaaggcagccttcagcaagaacttgaggccctcagttcagtgacctgcaaggaactgaatgcttccaacaaccacataaagttagtagcagatccttccccagctgaacttcacataagagagcagctctgactgacaccttcactgtagctttcagagaccttgaagaaggcaatccagtaatccagttgagtcagacttggactcttaaactacagaaaaagatataataaatatatgctcttttaaatcactacatttgtggtaatattgctttgttgttgtaattttgtttttttgtttgtttgttttttgagacagagtctcgctacatcgcccaggctggagtgcaatggcatgatcttggctcactgcaacctctgcctcccgggttcaagcaattctcctgcctcagcatcctgagtagctgggattacaggtgcctaccatcacgcccagctaattttgtatttttaatagagatggggttttgccattcgccatgttggtcagactggtctcgaactcctgacctcaggtgatccgcctgcctcgtcctcccagtgtgctgagattacaggcgtgagccaccgcacccagcctgttgttttttaatagagacagactcttgctatgttgcctaggctggtcttgaactcctggcctcaagcaatccttctgcctcagcgtcccaaagtgctgagattacaagcatgaaccactgcacccagccaaaattattctttttttttttttttttttgagacagagtctcactctgttgcccaggctggagtacagtggtgcgatctcagctcattgcagcctccgcctctcaggttcaagtgattctcctgcctcagcctccgagtagtgagattacaggtacgtgccaccacgcccagctaatttttgtatttttagtagagacggggtttcaccatgttggccacgctgctctcgaactcgtgacctcaagtgatccacctgcactggcctcccaaagtgctgtgctgggattacaggcataagccactgtgcccagcaaaattgtttttgttttgttttgttttgtttttgagacaaggttctgctcttgttgcccaagctggattgcaatggtgctatctcggctcaccgcaacctccacctcccaggttcaaatgattctcctgccccaccctcccgagtagctgggattacacgcatgcaccaccatgcctggctaattctgtatttttagtagagatgaggtttctccatgttggtcaggctggtctcaaactcccaacctcaggtgatccacccacctcagcctcccaaagtgctaggattataggcgtgagccacctcgcctggccaaaattgttcatttttaaagagagacttttatggtatgtgaattatttctcactaaagcttttttttttttaaatttacattgatactttgctgtgggatgggattccaggttttatagttttcacaatacataccaacagacttacatcatgggtaatgacgtgtacttgaattatctcatgagactagaacaatcattttcttacaagatttcaaggaaggagactttctaggaagtttccaattatactcccaaacaaaactaggactattataaaaagaaagcaagagccttttactgtatcccaacagaaccactcttttttctttttgacatcctcaacagaagcactcttaatttgaaacattaaacaggttgtcggccactgctacgctgcagctgaaaagcttttccacttactagagggtagaagctggcacaattattccatttgcttttattttcacaactgcacacacatgtgccacttccacttccacatacttcagttcttccctaaataaatttcactaacatccaaatcgttccaattttcttttttctttttgagacagtctctctctatcacccaggctggagtgcagtggcgtgatctcggcttactgcaacctccacctcctgggttcaagcaattctcctgcctcagcctcccaagtagctgggactacaggcatgtgccatcgcacctggctaattttagtatttttagtaatgacggggtttcagtatgttggccaggctggtcttgaactcctgagcgcaggtgatctgcctttcttggcaaagttctgggattacaggagtaagccaacatatccggcctactttcattatttctaagaagctaaacacacttaaaagaggagattttctgtaatctcagcactttgtgtggccaaggtggggggatcacttgagacctggcgtgaaccactgtgcccggccaactaaggtctatttttaaggatgaccagatgatcctaaattccaaaactaaattattttaaaggaagacaaataaactggccgggcatggtggttcatgcctgtaatcccaacactttgggagaccaaggcaggaggatcgcttgaggtcaagagtttgagaccagcctggccaacatggcaaaaccccatctctactaaaaaatacaaaaaaaaaattagccgaacatgtggtgcatgcctgtggtcccagctactcgagaggctgaggcaggataatcgcttgaacccggaaggtggagtttgcagtgagttaagatcacgccactgtactccagcctgggtggcagagcgagatccatcgcaaaaaaaaaaaaaaaaaaaaaaaaaaaggcatacaaataaactacataaatccacactctaattgtaaagtaatccatcaaccaatctttattttgctatctaggacaactaaaagtccttaagttacctgcactagaagtcaaatatttccttttatcaccactgatatactttttatttaacctgacctttaaagctcgataatcatctgtactttgtaatcaaagataaaactaaacatcacctaccggtgcactacagctattagatcaggagtcggcaattttttctgtaaagggtaaaacagtaaatatcttaggctttgaaggccaggtacagtggctcatgcccgtaatctcaatgctttgagaggccaaggtgggaggattgcttgaggcaggagtttgacaccagcctaggcaacatagcgatacactatctctacaaaaaaatttaaaaattagccgggtgtggtggcacatgcctgcagtcctatctacttgtgaagctaagatgggaggatcccttgagctcaggagttcaaagttacagtgagttatgatcatgctactgcactccagcctgtgtgacaaaatgagactctattaaaaaaaaaaaaaaaaggctttgagggccatatggtctctgttacaaagtactcgatgagtacagatgtgttccaataaaactttatttctaaaactttggtccaagggctgtagtttaccaaatactgtatcagactatattatatgcaaccaaaaataaacagacctattcccccctttcccattgataatgttttcaccataaaattaaacaattactttctaaaataccacaaaatacatttaactagctttcttctattttgtaataggcattcatagtgggataatgctatccctattgcctcaaatgaggaataacagccaactatgagattcaggtttaggattcagatttgaaccacacacactgtacagaaagactgagccaataaataaaaataaagcatttaggttcacatccagaatctatttgaccccagcagaggcaaaagttagttcaccatattggaacatatccacaacctagaataaaataactcccagggaaaatgaaaccgcttttgcaaaattgtaacagtaagagaaatctaacatcgctgactccatcttgcttctaaccacataagctaaactgtccctgtccatatccgggcataagccaagctaactatgggaggaatttagctcatggtttaactttaaaacaaagatgataacagtcccttcaggaaactaaccccctgcttgcttggggatgaaactgcctttataaaactaacagactggccacacagttagaattatggttcaggggtcatgcagccagaggtcacaagatttgtaacttccccaattgctcctacagataacatcactattgcaaaacctaagactggtgtttgagtatttttcggaccttgcattctgatgcatcagatggcaccacctggattggcaacctataacgagaaaccagcttgactggtcttgtgacacccccaaccaccaccatctagtaactaactcagtgaaagaaggcagtttcaacccactatgatctcaaccttgacccaaccaatcagcactccccaatccctagccccctgcctgccaaactatcctcgaaaaaccctagcctctaaattcttggggagatagacttgagaaatagctctcattctcattgcttggcttgctctgtgattattaaattatttctctgctgcaactcctgctgttctcaatttattggcttttctgggaaatgggtaagaagaaccagttggacaattacaaaaacatctacccttgaagatgggctttcaataaaaaattaaaactcaaagtagaaacaaaaagccacgaccaggtgcagtggctcacacttgtaatcccaacactttgggaggctgaggtgggaggatcacttgaggccaggaattcaagaccagcctgggcaacataatgagaccctgtctctaccaaaaaaaaaaaaaaaaaaaaaatcagtgggcatggcagcatgcacctgtgatcccagatacttgggaggctgaggcaggaaggtcacctgagcccaggaagtcaaggccacactaagccatgatcacatcaccacactgcaaactaggtgacagagcaagaccctgtctccaagaaataaataaaccatgaagaagtaccagtaaacacaattaatagcaggacttatgatctacactctaagagttgcaactaatctgaaaagtatataacaaaaaaaattttaaaggtcaaattttactcagctctttgcaagtatattagaaaagttgtaagaaattataattttctagtaaaatataatttacaaaaattgtcctcaggagaaacaaaaacttaagtagaccaattatcctagaagaataggaaaagttttccaagtacttggcacagaatttcacagtggaattctaccaaatatttaagaaataaatcattttaataccacttaagctgtttcaaagcatagaagaaaaaaaacttccttttttttttttttagacagggtctcactattctgcccaggatagctcaagatatccaaggtaggcggatcacttgaggccaggagtttgaaccagcatgggcaacatagtgagactccatctctacaaaaaagtcaaaaaaattagctgggtatattgttgcacatctgtaggcctagctactcaggaggctgaggcaggaggatcccttgagccaaggagctggaagcaccagggagctatgatcgtactactgcactccagcctgggcaacagaaagagaccctgtcgtctctaaaaaaattttaaataaaaataaaaaagaggaaacattaaagcttaaatgcatatattagaaaatatgaaatattaggaaaaactgagataagaataacattccagatcctagagaaagaacaaaaaaataggaccaagaaagtaggcaaaagaaagtaaccgaagatagaattagaaaacaatgaactataaaatgcatacaaacagtaggtaatcagtacaatcaaagagtaattatttgactgtcaggttctgcccagggtaaagctatcagcaggcttggcaaatatacaaagtcaaacttccctaaggcaggtacagggcaaaaccaaatacccctgcctccataatccattttttaagctttccatttatcagtaaacaacagctagtttaaaaaagaaagaaggggtatcctttgaaagaaaacataaatttgtgttaagtgtgattttttaaaatggggcctcagccaggtacagttgttcacacctataatcccagtactttgggaagccaaggtagggggatcatgtaagcccaggagttagagaccagcctgggcaacatagtgagacctcaactctacaaataattttaaaaattagccaggcacggtaatatgctagtagtcccagatactcaggaggctgaagcaagaagatctcctgagcccaggagttcaaggctgcagtgagccaagatagtgccactgcactccagactaggtgactgagtgaggtctatctcaaaaacaacaaaaaatgaaatttaaaaatataattgcttctttcacagtaacacttagcttaaaacacaaacacatttaccaagctgtacaaaaatattttctttctttataagctttttctattaaattttttttttttactctttaaacatttatgttaaaaactaagacacaaacacacacattagcctaggcctacagaggtcaggatcataatatcactgtcacccatctccacatcttgtctcaacagaaggtcttcagggacaataacacacatggagctatcatatcctatgataacagtgccttattctggaatatctcctaaagggcctgcctgagatggttttgcagttaacttttttttttaataaataggagtacactctaaaataacaattaaaagtataatgtagtatatatataaaccattaacatagtcaattattatctttatcaagtattacattctgtacataattatatgtgctatactttatacaattggcactgtggtaggattattagcacctgcaataccaccgtcacgggtaatacattgcactatgatattacaacaggtacacaatgtcactaggccacaggaattttccatctctattataaccttataggaccaccattttatatgcagtccatcattgtctgaaatgtcattatgactgtatatacaggatctatatgagaaaaaccacaaaactctgatgaaagacatcaaagaagaactaaataaaatggagagatatttcacattcacagataggaagactcaatgtgtgtgtgtgtgtgtgtgtattttgttttttttttttggtagagaccttgtgtctacaaaaaaaatacaaaaattagccaagcatgctaatgcacacttgtactctcagctactcaggaggctgaggtgggaggatcacttgagcttggtaattcaaggcttctgtgagccatgaccacaccaccgcactccagcctgggagacagagtgagaccctgtctcaaaaaaaaaaaaaaaaaagaaaaaagaaaaagaaaacaacctgattaaaaaattgaacagatacctcaccaaataagatatacagatggcaagtaagtatttgaaaaatactcaacatcatatgttgtgttaggccatacttgcactgctataaagaaatacctgagatcaagtaatttataaagaaaagaggtttaattggctcacagttctggaagctgtatatgaaacacagtgccagcatctacttctggtgagggcctctggaagcttacaaccatggaggaaggtgacggggtgggggcagcatgtcacatggggagagtgagatcaagagacagagaggagggggaggtcccagattcttttaaacagccagatgtcacatgaacaaactgagcaagaactcacttatcaccgacgggatggtactaaaccattcatgagggatccactaccatgatccaatcacttcccactaggccccaccttcaacattgggaatcacatttcaacatgagatttggagggaacaaacatccaaactatatcttatgccattagatatttgaaaattaaaataacaatgagatactactatataccacttagaatggccaaaatccaaaacactgacatcaaatactgacaaggatatggaccaacaggaactctttattcattcctggttgaaatgcaaaatggggcagggtgcagtggctcacgcctgcaatcctagcacggtggaaggctgaggcaggtggatcacaaggtcaggagttcaagaccagcctggccaagatggtgaaaccccacctctactaaaaacacaaaaattagctgggcgtggtagtggacatctgtaatcccagctactcaggaagctgagggagggtattgcttgaacccggaaggcacaggttgcagtgagccaagatcacaccactgcacccgagcctgggtgacagagcgagactctgtctcaaaaaaaaaaaaaagaaaaaaaaaaaggaatgcaaaatggcactgccactttggaagagtttggcagttttttataaaactaaacatatttttaccatacagtccaccaattgcactctgtgatatttatccaaatgaactgaaaacttatgtccacaaaaaaaccccacacatgcgtgttgacagcagctttattcataattgtcaacatattgaagcaaccaagatgtccttcaataggtgagcagataagctgtggtagattgagacaatgggatattattcagtgctaaacaggaatgagctattaagccatgaaaaagcatggaggatagattaattaattaattaattaatttcatgctatcaagagtgtggtgatgcataatttcttgagattgctacattattatatccaggtgtttctttaaccactgacacccattttacaagttttgatgcacacgtacaagtgcctggaagtaattttaagacatctcaatttcaaaatagtgaaagtgttagaaatgatgaaatgtagtagacagttttttatgcttaactcatctcgagtttatttcagtgtttgaaattaggtataaacatttaattttatcttttttcagatagttaattgtctaaatacaattttttaattagtctactctccccccagtgggttgaaatttcatttttatccttgaattctggtgtgattgacatttgaatagacagaacaatggaataaaacagaaaatccagaagtaggctgaaatatatatgctaatttagtgtatgatagagatattttcttaaactagtaaggaaaagatgaactagtcaaaagatgttaacataactaggtagtcatctgaaaagcaaatagaattggatcaatgttttataccttacactaggataaattccgaatggatcaaaaatttaaatattaaaattataaaagttctatagcagaatatggaagaattaatttttttaaaattaataggctgggcacagtggctcacgcctgtaatcccagcactttgggaggccaaggcaggtggatcacctgaggtcaggagttcgagaccagcctgaccaatatggtgaaatcccgtctctactaaaagtacaaaaattacctgggcgtggtggcatgagcctgaaatcccagctacttgggaggctgaggcaggagaattgcttaaacccgggaggtcgaggctgcagtgagctgagatcgcaccactgcactctaccctgggcaacaaaacgagactcacaaaacccacaactatgctgcatcaagtccataaaggcctcttaaataaaaaattaaacttctaagtaatgggaattgtcatagtttaattggcaagaagtacatcttataatcaatggcatcttatattcaacgaaatctgtcataaaagcatgaggaaaacagtattttcaaaacctcttaggctatatgcaaaatccacaagttgtaaatgaaaagactgatatgtttattttgtatttatttatttatttctttttctttttttttaaattttattattattatactttaagttttagggtacatgtgcacaacgtgcaggtttgttacatatgtatacatgtgccatgttggtgtgctgttgcctaggctggtcttgaactcttggactcaagcaatcctcctgtcttagcttcccaaagtgctggggttacaggtgtaagccaccactgccaaaccaaggtttaactacataaaaactaaaatgataaaagatgggcaaggagaaaatacttgcaacatacataataaagaattactatcaggcaggcgtcagatgtccccagcacactggagtctgggatttggtgctgatggtgcctcatcagcatggacaaacactgccttacagctggactttagtgttgggagctgttaattattctaaagttccatagattcatgattttatagttagagtttatatctacttgtgtttttagaggaagaacccaaggccaaattattttgaagtgggagtgggctggaccagagtcttcctgtgcccttttcatgctgtgtttgaggatgtgtccattgctacatccatgtaactcatctggggcagcagatgtgtgacagcaaaccatctaacatttttcagggataaagttaagcagaagtatgtagtaaatatgagtgcaaaagtgtggctgagccatatgtgcccttgatttgatttgggaagcctgagggaggcagcattcctagccacatgctgcctgcccagcacaaggtagggtggtacccggggtggtgaaggggcagctctgtagagcatggtctgccttaggacctgaattgtcctcaaagcgcatggactgtggaaattgttcacatgaaccagagatatcactctttaggattctattggcagcacctaaactggctcgacatttgtggaggtggtgtttctttgaagcacgaacctttgttttataataattaaaatctttatttggtggctgggagtggtggctcacacctgtaatctcaacactttgggaggccgaggcaggcagatcacctgaggtcaggagttcaagaccagcctggccagcatggtgaaaccctgtctctacaaaaatataaaaattagccaggcatgatggcaggtgcctgtaatcccagctactcagaaggctgaagcaggagaatcacttgaatccgggaggcagaggttgtagtgagccaagatcacaccactgcattccagcctgggagacagaacaagactccgtctcaaaaaaaaaaaaaaatttatttggtataatttaatatagtttagaagctatctaatctggtttttttttggaggggcaaactcttttgaaaatataagttttgcttttaattaaaaattaagtcttagttaaaactcaggctgcacaaaattcttcagttacttcccattactttatcagtaatattcaccacatcttcctagatgtttattgattacagtgttgggatcaaattctgcattaaatgtatgcaaatacattggacaggctttgtgtttttcactgtgaaatgcaatggtggcttgaataagaaagtatctagaagccaaattaacataataatgacttcaaaaaagaattactatcaggatatgtaaagaactacaaaaaaaatcaacacaacagaagaaggcaggtaagaacataagtgaacaagttttataaatgaccaataaacaaaaggacttcactaacaatcagagtacaaaaattaaaatgaattaacaagtcaggaagttgaagcaggaagattgcttgcggccaggagtttgaccagcctaggcaacacagagagggaccccatcttaagaaaaagcctgggcacggtggctaacgcctataacccagcattttggactttgggaggcaggtgcaggaggactgaccaggcccaggagttcaagacaagcctgggcaacatagcaagaccctgtctcaaaaaaagaagaaaaaaaaaaagctgagtgcagtggctcatgcctataatgccagcactttgggagactgaagcaggaggatcatttgagtccagaaattcaagatcagcctgggcaacagagcaagactccatctgtacaaaacactttaaaattacctgacgtgacagtaacatgcctgtaatcccagctacttgggaggctgggatgggagagtcacttgagtccaggaggatgcagtcagctatgatcacgccactgcactgccgcctggatgacaaagtgagatcctgtctctaagaaaagaaaaaaaagaggctggacatggtggtgcacacctgtaatcccagcactttgggaggcagaggcaggctgatcacctgagcccaggagttcaacaccagccttaacatggtgaaaccacaactctacaaaaaaaaatacaaaaattagccaggtatgatgctgtgtgtctgtagtcccagctactcgggaggctgaagtgggaggatcacttgagtctgggaggtcaaggctgcagtgagatagcaccactgtactccagcctaggtaacagaatgagaccctgtctcaaaaaaaaaaaaaaaaaaaaaagagagagagagagataaaccctctctaacatggttaattgactgtgacatgaagggtgccaaaaccattcaatggggaaaggacagtcttttcaacaaatggtgcttgtaaaatttggtatcctcaagcaaaagaatgaaattggacccttactttatacgatattgaaaaattaacttaaaatgatcaataacctaaatgtaagagctaaaactataaaactcttagaagaaaacattgtggaaaatcttcatgatattggatttggtgatgattccttggattgacacaaaaagcaaaaggtaacaaaagaaaaaattaatttgacttaatcagaatttaaaatttctgtgcaaaaaaggacaccatcatgggagtgaaaagacaaactacaaattgtgagaaaatatttgcaaatcatatatctggtaagggataaatattccctatatataaaatatataaatacaatgcaattcaaaaatgagcaaaggattcaaatacacatttctccaagaagatatacaaaaaaggtcaacaagtacatgaaaagatgctcaatatcactagttgtttagaaaaatgcaaatcaaaaccacaatgagataccacttttcacaccaaataggatgattaccatgaaaaagaaaaataagtgtcagtgagcacatggagaaactggaacccttacatattgctgatagaactgtaaaatggcacaaccactacggaaaacagtctggtgggtcctcaaaaagttaaacatagattgactaagtgaaataaggcagtcaaaaaaagacaaatactgtatgttttcacttacataagatatctagggtagtcaaactcttagaaataaagtaggatagtggttgccaggggttggggggaatggagaaatgaggagttgtttaatgggtacagagtttcagttttgcaaaatgaaaaagttctggagtttggaggcacaaccatgtgtacatacttaacagttgtgttaagtatgtacttaacataattaaatactgttaagatagtaagaaaaagatttattttttatttttttattattttattttattttatttttcccccagagacagagtttcgtcatgttgcccaggctggtctcaaactcctgggctcaggcaattctcccgtcttggcctctcaaagtgctgggattacaggcgtcaaccacaatgcccagccaaaatggtaaattttgtatgtattttaccataatcttttcttaaacatagaattactcatatgactcagcaattctatttacagctaaatacccaaaagaattgcaagcaaagaaccaaatagatacctgtatatcaatatccatagcagcattagtcacaatagccaaaaggtggaaacagccccaccatcgacagataaaatatgacatatatacacaatgcaatattagccataaaaaggaatgaaattctaatatatgctacaacatgaataaccctgaaaacactatgctaagtgaattaactctaacacaaatggataaatattatattaacccacttatataaggtacctagaataagcaaattcataaaaacagcaagtagaagatattagtgggtgggagtgaaactgcccccacagggttcacaagaagtgcatgccaggttctggacagaaatatagttataattaagcattaatcaggccgcactttggcccacttcctggttgctaaaagtcatatagcactagatactgactatttgcattcctattgttcctacagaataggatttctgacattagggtcataaaactttaagattttatttctatccccatctttcctataacaggatctctgacattataatcataaggcttttgtttaaggattgcttaatatgtttttcagacccctgaattccagcaaccagtttgaagtcccccacagaggaacgggatctgcaagagaatacagcttcttcatctccctgtcccatgacttcatcctgtactctttaacaaataaacaattgccacacttcggcccacttcaaaacccttaaaaaaccttagcccccatctcttacgggagatgaatttgaggttttcctccatctcctcatttggcggccctatgattagacctttctctgctgcaacctggagtctcagcttattgacttgctgtgtgcattgggcaatgaacccatttacagttacagaagggagaattagtgagttaacgtttcatgggtacagagattctgtttaggtgatgagaaagttctggaaaaggataatggagatggttgtacaacattgtaaatgtaattaatgacactgaactgtacacttaaaaaatggctaagatggtaaatttatgttatatatattttactgcaataaaaagtattttagagaaagacacattagaaagaaagaagctggaaatggtacatagagacaactctatggagttgttttggtccaaaaaaaaacaagacatgggaaagtatacctattaataaaagaaacaataggggctgggtgtggtggctcttacctgtaatcccaacactttgggaggccgaggcaggctgatcacttgagcccaggagttcaagaacagcctgggcaacaaggtgaaaccccaactctccaaaaaatacaaaaattagctgggcatggtgtcatgcacctgtagtcccagttactctggaggctgaggtggggggatcatctgagtccagggaggtcaagactgcagtaagccatgatcacaccacactgcactctagcctgggtgacagagcgaaaccctgtctcaaaaaataaaataaaataaaataaaataatagaataaaataggttgggcgcggtggctcatgcctataatcccagcactttgggaggctgaggtaggtggatcacttgaggtcaggagttcaagaccagcctggccgaaatggtgaaactctgtctctactaaaaatacaaaaattagccaggtgtggtggcaggcgcctgtaatcccagctactagggaggctgaggcaggagaattgcttgaacccgggaagcagaggttgcagtgagccaagattatgccactgcaccccagcctgggcaacagagtgagactccatctcaaaaaaaataaaaataaaataaaataaaggggaaataacagagccaaaatatttgggttttttttttccttaaaagaatttttttaacatgttaatggtaatacttagtagtgaaaatacaatgtagaaaagagaggggagaatttcttaggcaatgcctattagtaggcaagtggaaatggaatgtacaatataaacagaaataatggacttaggagcatgagtagttgatccatagtacaaggtataaaggccaagtaactgggtaaagatgtgtgttgatagctatttgtagtaatggaagtctgcagaagttctcttctgcttgcttcaattttctcagtgaattgggaagcaattcattaattactgacaatgaggactagtgaggaaatactgggatttgatgagagaagaaaaggtacaaaatactctcttgagggagtgagtgaaacagggaaatatgattgcttaggagcattatgggctcatattttttgagacagggccttgctatgttgcccaggctgctctcaaactcacagcctcaagcgagcctcctgagtagctcgggctacaggtgcatgccattgtacccagctatcaattttactgaagataagcaaacaaaaactatatatgtgggtgtgtgtatatataattttaatatatgtatttaaggtgtgtgcataatatatgtatatgcacagaaagagtccagaagtatacatactgaattgttaatagtggttattactggagaatgtatgtgtggatacatacacacatgtgtggctgggggtagaggtgaggtggaagagaatcctatgttatttgaatttttaaccagcatattatttttgggattcaaacaaaatatcttaatataagttaataaatagcttgaaaggagaatttagaacagtgttcaagatccacagcacctttattaggcaaatcctacatcctaattaaacacaactatcaacctgcagtaaatgtgaccacagcaagacaatatgagaaaagctgaagactcactcaccttgaacacttcagaaaagaagccagaccctattttttcacaggtgaaatcatccaaacgcgtcagtctggaaaaggcacttataagagctcgatacgaagatggccaaactcttcccacctggctcacatttccttctcctccaccacctccttcaaactcttcaagacgctccacacgtggaggaaatcctgcaattgaattccgtttgctccgatccatagtctaaataatcacttttttcttcttttaagaaggaactccacacataaatttttgttgaattttacttctcttctggtttgacactaaagagatcaaaaaaatttccactgaaatctttaatgaataaatacatgtaaagcaataaatgctcaatgcaaaaatatttcctttcacattctagttcctggttttcagatctaaaaaatgttttatgtctttaccctcaaataacactgatatatttaaagcccaagatatagtcagtctttaccatgagtagaatatcatgaagatcaccaattacattctaagtaacaaaataacaatgataatatctatcattcattgagcacctactttctaggaaacatagtataagagcttgacatacatcatctcgtttgattctcagataatccatgatataaggattattatgttcatttcacagagagatcaagaaatcagtcactaaaaggcagagataaaatggaagctgggtgcagtggctcacgcctgtaatcccagcactttgggaggccaaggcaggcggatcacttgaggtcaggagtttgagaccagcctggccaacatggtgaaaccccatctctactaaaaatacaaaaattagccaggcgtggtggcaagcacctgtaatctcagctactcaggaggctgaagtaggagaatcacttgaacccaggacgcaggggttgcagtgagccgagatcgtgccactgcactccagcctgggcaacagagtgagacactgtctcaaaaaaaaaaaaaaaaattgaagtgcaaagcctgtctgattcaaaagcctgtgcttctttctaccaatcaataccctttatagcctcatataatattttatttcaaaaattaattccaaatatataaaacaaacattacaaggagacttcaaaattatatattatataatttttaaaaaagaaaactatatccaaaagcaatctaaaaattcactgttgatgaaaaagcacagtccagtagaagtaactatagaaggctccatcccatctggtacataactaagaataaaagcacaagcctactttttcttttagcctgtctctccctctttctacttttttccatgagactcaattgtaagggttctatgcaaaatacaacattgtgactcctcaattagtgaaatgctttcataaaggaggtggatacctactcagtttaccaccaccacttctaaccagctctgcaactcagaaaagtggcaggaatcccagggccatcttagtaacatgagtctgcctccttacccattgccagaagtcagcaccgtacccagtgtgtacaaccacagtttctttcctggcaatgtgcaattggaattaaatagtccagtctcaatatggcggctttctaaaatagaagccatgtaaactcagaagctgctggccaggggcattttctataatactgcctggaaggcagaagaagtcaagagattgaggccaattttcaaagaaaaaaaaaggaagggaactttttgaattccctattctgctctaatccccaattcttaaggcctaactgcatcctgaggttccatgagatctacctgaatctagttaatctagttctaccacagtcttcaaaaaaggaagaatactctgagttcccaaataacaaaacatttaagtacctctattgaacctatgccaaaaagtggcatcagcaccaccagaccaaatacttacatccacaagaacaaaaatttagggttagctggccacagtagctcatacctataatcctaacactttgggaggccaaggcaagaggatcacttgagctcaggagtttgaaaccagtaagggcaacatagtgagacctcgtctgtatgaaaaaatgtaaaaactagccaggcatgatggtacacgcctgtagtcccagctacacaggtggctgaggcaggaggattgcctgagcccaggagtttgaggctgcagtgagctgtgatagcaccactgcactccagcctgggcaacagggcaagaccttgtctcaaaaaaatttagggttataagacaaaaaatttgcagccacaaaaaagaatgaaatcatgtcctttgcagcaacatggatgcagctggaagccattattctaagtgaactaacacagaaacagaaaaccaaatatcgcatgttctcacttataactaggagctaaatcttgagttcacatgaacataaagatgggaacaacagacactggaggcccccaaatgggagacaggcaggggctgaaaaacttcctattgggtactgtgttcactatctcggtggtgggatcaacagaagtccaaacctcagcaccacacaatatacccttgtaacaaacctgcacacatacctcctgaatctaaaatataaatggaattttaaaaataaaatagaggctaggcatggtgactcacgcctgaaaaatcccagcactttgggaggccaaggcaggcagatcacctgaggtcatgagtttgagaccagcttggccaacatggcaaaaccctctctctacgaaaaacacaaaaaaattagctgggcgtggtggcagtcacctgtaatcccagctactcgggaagctgaggcaggagaatagcttgaacctgggaggcagaggttgcagtgagccgagatcatgccattgtactccagcctgggcaacaagagtgaaattctgtctcaaagtaaataaattaaataataaaaataaaataaaatagggtcgggtgcaggggctcattcctttaatccaagcccaggctgaagtgcaatggtgctatcacagctcactgcagcctcaaactcctgggttcaggcaatcttcctgcctcagctacctgtgtagctgggactacaagcatgtgccatcatgcctgccagttcaagaccagactaggcaacacagcaagacccctcatcactaaaaaaataataataattttaaaaaccaaattttcttaattttagagccagtagaaaacatcaacttcagtcattcattttatatttgaagaaacataaggcccagaaagtgcaaatgctaaaagttaatgctataacctatttactagcaaagctagacttgaaaccaaaaagccaagggtagtgtatttctcaaagtatgtctgttgataatgtgcttcaaactacctgaggagcttgtttaaaacccagagtcatgggtcataatagctttttttttggaaacacaaggtttcactgtattgcccaggctggtcttgaactcctggcctcaagtgatcctcccaccttagcctcacaaagtgctaagattacaggtgtgaactgcccctggccactgttttttttttttaaacatcaggaattttaaaagcatttcctcatttaatctcaaaacgtggccaggcacggtggctcacacctgtaatcccagcactttgagaatcccttgaacccaagaggcagagattgcagtgagctcagatcacaccactacactccaacctgggtgacagagcaagactccgtctcaaaacaacaacaacaaaaaaacccagcaaggtaggtctgatctccattttacagaaaaagaaatacaggctcagaagatgaagtaacttgctaaggatacagagctagtagaaccagaactggaaccaagttctatccagcaccaaagctcaaacttcttccatttcattattacttagctcagtatttttccactatgagagctgtagaaagaacagagacttaagtgcagaggaaggctaggctgattataatttgaacagagacagaaaagaaaaaagaaactttagaaaaataaaagatattgaagtaatatacaaaacatatgtaaagtacataaaacatcgttgactatataaaacatagttgtctgctaaactgaacaattcgatgtttgccatcaactgactttttcatttttgagatataaactctttaatttttatgtgtacatagtaggtatatatatttacagggtacatgagatattttgatacaggcatacaatgtgtaataatcacatcagggtaaatgaggtatccatcacctcaagcattcatcatttctttgtgttacaaacattccaatcgtactctcccagttattctaaaatatacaatgaattattgccgaccgtagtcattctgttgtgctatcaaatactaaatcttattcattctatctaactatattattgtacctattaaccatcccatttcccactcaacacccccaacacactacccttcccaccctctggtaaccatcattctattctctatctccatgagttcaattgtcttaatatttagcttcagcaatgcgtaagaacatgcaaagtttgtccttctgtgcctgacttatttcacttaacatgatgtcctcaagttccatccatgctgttgcaaaaaaagggatctctttttttttttattttttagatggggtctcgctctgtcgcccaggatggagtgcagtggcgtgatctccgctcactgcaagctccacctcccaggttcatgccattctcctgcctcagcctcccgagtagctgggactacaggcgcctgacaccacacccggctaattttttgtatttttagtagagacgaggtttcaccgtgttagccaggatggtctcgatctcctgacattgtgatccgcccacctcggcctcccaaagtgctgagattacaggcgtgagccaccgcgcccggcagaggatctcatttttttatggctgaataatccatttgtgtaggtgccacattttctttatccattcatttgttgaacatttaggttgcttccaaatcttggctattgtaaacagtgctgtaataaacatgggagtgcaaacgtctcttcgctatactgatatcctttcttttgggtatatattcagcagtgggattgctatatcacattgtagctctacttttactattttgagggacctccatagtgttctccatagtggctgtactaatttacatttctatcaatagtgaacgagggttccctcttctccacatcttggttagcattatttgcccatcttttgaataaaagccattttaagggtgagatgataactcattgtagttttgatgtgcatttctctgatgatcaatatgtttaggaactttacatagatctgtttgccatttgtatgcctccttttgagaaatgtctgttcagatcttttgcccattttttaatcagattgttagattttttcctatagagttgtctgaactccttatattttctggttattaattctttgtcagacgggtagtttgaaatattttctcccattctgtgagttgtctcttcactttgttgactgcttcattttctgtgcagaagctttttaacttcatgtgatcacatgtgtccatttttgctttggttacctgtactttggggatattactcaagaaatctttgcccaaaccaatgtcctggaaagttttcccaatgtttccttgtagtactttcacagtttgaggtcttagatttaagtctttaatccattttgatcagatttttgattaggtttttcttctgcatatggatatcctgttttcccagcaccattcattgaagagattgtcctttccccagtgtatggtcttggcacctttgttgaaaatgagttcactgtaggtatatggatttatttctgggttctctattctgttccatcagtctgtgtgtctggttttttgtttttgttttgttttgagacagggtctcactctgttgcccaggctggaatggagtggcgtgatcacagctcactgcagcctcgatctcctagggctcaggtgatcctcccaacttagcctcccaagtagctgggactacaggtgcatacaaccacacccagctaatttttgtactttttttttgtagagacaaggttttgccaagttgcccaggatcatctcaaactcctaggctcaagcgatccaccctcctcagcctcctaaagtgctgggattataggcatgagccaccatgcccagcctatgtgtcggtttttatgccagtattctcgtgttgttttggttacaatagctctgtggtataatttgaagtcaagtaatgtgattcctccagttttgttctttttgctcaggaggcttttggctgttctaggtcttttgtggttctaaaatttgaggattttttttctatttctgtgaagagtgtcactggtattttgatgcagactgcactgaatctgtagatcgttttaggtagtatggacattttaacaatatcgattctttcaattcatgaacattaaatatctttccattttttggtgtcctcttcaatttctttcatcaatattttatagtttatagcctggccaacatggtgaaaccccgtctctactaaaaatacaaaaattagccaggcatggtggcacacctgtagtcccagctactcaggaggctgaggcacaaaaattgcttgaagccgggaggcagaggttgcgatgagccaagatcacatcactgcactccagccttggcgacagagcaagacactggataaaaaaaaaaaaaaaaagtcttatagttttcattgtaaagatctttcacttatttggttaagattgttcctaggtattttatcctatttgaagctgttgtaaatgggattaccttcctgatttctttttcagattgtttgctgttggcacacagaaatgctactgatttttgtatactgattttgtatcctacaactttactgaattgttatcaagatatgtttcattcgtaacaaaataccttactaacctcctcagtgccctcagggttccctgagagtggcaaatcctagttttccatattacagcacagaagacagaattgctcattgcagctcaatgggtctggttttacattctcagctagctaggaagaggtaagaaactgctaactgtggcagggcacagtggctaactcctgtcatcctagcactttgggaggccaaggcaggtggatcacttgaggtcaggagttccagactggtctggtcaacatggcaaaaccttgtctctactaaaaatacaaaaattaggccagacacggtggctcacatctgtaatcccagcactttgggaggccaaggcaggtagatcacctgaggtcaggagttcgagaccggcctggccaacatggtgaaaccccgtctctactaaaaatacaaaacttagccagcatggtgacacacatctgtaatcccagccactcaggaggctgaggcatgagaatcacttgaacacaggaggcgaaggttgcaatgagccaagatcacgccactgcactccagcctgggagatagagcaagactccatctcaaaaaaaaaagaaaaagaaaagaaaattaaccaggcatggtggtgtgcacctgtagtcccacctactcaggaggctaaggcaagagaatcacttgaacccatgaggcagaggttgaagtgagctgagatggcaccactgtactccagcctgggtgacagagtgagactccaaaaaagaaagagagagagagagagagagagaaagagaaaagagatggaaggaaggaaggaaggaaggaaggaaaaaaggaaaggaagaagaaagagagagacaaagaaagaaagaaaaagagaaaaagaaagaaagaaagaatgctaattgcaactgagctgctttggtaggagtcttgttagaagttttacaatagcacaatagactaaattttggtatttgtatcttggttcacagcacttttcaagaggggtaaatgtatttcttaaatgttatatgcttagagatactcttgcacataaacacaagaggcctgaataaagatattcatttcattttaccagtgtgtgtaatcagcggaaagaaaggaaacaacctaaagttcatctgtaggagtaatagataataaactgtggcatattactcaataaaacatacagcacttagatgaacaaattataagtagcaatgtgaatgtatttaaaaagtaatgtagagttggggagaaaagcaagttgtagttagcgatattattaaaatttaattcaagaaaaggttttcaaagaagttactgaaaaaaaattgcacaaccaccccacagtataccatttttataaaaatgtattttaaaaatacacaaaataatatatactaatcgggcatggtgccttacgtctataatcccaacactttgagaggccgaggaggtggatagcttgagcccaggagttcgaggccagtctgagcaacatggttaaacctaatctctacaaaaaatacaaaaattgaccaggcgcggtggctcacacctgtaatcccagcactttgggaggccgaggcaggcagatcacaaggtcaagagatcgagaccatcctggccaacatggtgaaaccctgtatctactaaaaatgcaaaaaatatctgggcgtggtggtgtgcacctgtagtcccagctactcaggaggctgaggcaggagaattgcttgaacccaggaggcagaggttgagtgagctgagatcgtgccactgcactccagcctgggcaacagagcaagactccgtctcaaaaaaaacaaaaacaaaaacaaaaattacccaggcatggtggcatgcgcctgtagtcccagctactcaggaggctgaggcagaagcattagttgggtcccaggaggtcaaggctgcagtgagccatgaccacaccactgcactccagtctgggcaacagagcaagactctatctcaaataataataataataatatatattatatattatatattacagaaaagcagaatagcatagtcatgaatgctatgacatctacagccaaacaatctgggttcaaatccttgctccgtaacttctagttatatgaacttagatatgttatttaacctctctacatctctagttccctatctgaaaaatgaaaataaaaacagtgcctacattttatatttattaactcatttaatccttacaataaccacaaagttattgattaaatggatagtacctaataaacaataagcattcaactcctgtttgttattataattattaaagatattacatatttatagtgaacatctaaaagcatgaactaaaaatgaagacactaaattcataatagtatttgcctcaggggaaagaaagtgaaatgacaagaaagggaaacaaaagagacatccactatactaataaaattttgtttccttaacgtgatgaagtggccaagtggttaaggtgatggactgccaataatatttttgtttccttctattgaaaaacaaacctgtggcaaataacacaaaatgatatatctgttaattttatcatttttcattaattaatatttgttaattctgggtgttatttattatactgtactcttttctgcatttaaatttttttaatttcaaaaaagtttaacaggtttgttgttttttttttaagatgcagtctcgctctgtcacccagactggagtacagtggtgcgatcatggctcaccacaacctccgcctcccaggttcaagggattcccctgcctcagcctccctagaggcacgcgccaccacacccggctaatttttgtatttttagtagaaatggggtttcaccatgttggtcaggctggtctcaaactcctgacctcatgatccgcccgccttggcctcccaaagttctgagattacaggcatgagccactgtgctcggccttcacagttttttttttttttaagtctattgctaatgcaacagctatgtagcatgcttaagccaaaacattgataacaatttggcaaataaacagcatgccagtgtgcaagccaagcctctagactctcaaacttttattctgctaaatttccaccgtagtttttagtcctaggaatatatatatcttaggctaaaacttcaaaatcatgggtgaatttttggatggcctaacttatttaagtccacaaacttaaaatattgggtgggatcactggctcacgtctgtaatcccccaacaattttagaggctcaggcaggatgactgcttgagcccaggagttcaagatcagcctgggcaacatagtgaaatccccgtctctacaaaaaatacaaaaattagcccggcatggtggtgcacacctgtagtcctagctactcaggaggccaaggtgggaggattgctggagcccaggaggtcaaagctgcagtgagccgtgtttgggctactgcattccagcctgggcaatagagcaaacgtctgtctcaaaaaaaaaaaaaaaattagagagctcataacaaacactgatatttagtgtagagaccctatcacatgctaaagtaatactaatgattagatagctgagatgagtggtaagaagtagagtcctctccatgggagtaagaactgtattaatccattttagagaagtgctgagcaagagaaaacttccaaaccatgccttctgctcccttggcgagcaaactaaatgactatattttaaatgaaatcaaccaagctataaatggctgtcaatttattctgacaaattttaataactaataaaaggcagcaaagatatacacgtacaaaccctaaaaccaagcccaattttataaaatgtgggaatgattacttttaaaataagaaaatacattatttcaaatatatgacattttatgatggtttctgcctctggattacctctcttggtcttatatattgagtattatctattgatactaatagtgtccctcaaagtattaatatactttttttggaacagagataactacagttaccatcacattaccagaaaaacataaggcgttattgtcacaatgatgggggtgtgggatgagcactactggtattttagtgggcaggtgctagggaagctaaatgtcctacaatgcacaaaacaaagaattgtcctgccctaaatgccaataatgccctggttgagaaacactgtgttagagaagcttaatcatttttgttcttagactaggaaatagcatttagcagtctttcaaaaatgcccaaattatgtggcttataaggacacaagtaattttttagtaactatgttctcaacttaaatattataaacttggaagttcaaaactttttcttttctacataggtaggtttgttttttcaaatattaatttcatttatataggagttgatttgtttttcacaaagaaaatacaactaaaagctttgattggggaaagtaatttgaaaagctaccaattaaaaaaaagttagtgaactaaatagcctatcttcaatattatattttttaatctttccaaagtaagaattccaaaaatcatttttcagaaatatcaaggaaatttttaggactctcagaccacactcctgtctgaaatatgcttctggaaataataactgcagccactatttactacagaccacgcattctaccaagggttttgtatgttatctgtaatctttgtgacaactctgcaaagcatgtattatcatctctaatttaaagaaaaagaaatcaaaatcctgagagattatgacttctccaaatataaacaactagtgagactcaggattcaaatctagtagtttcaaacctaagcacttcccattataacatgtctccttcagaaatacatcaaatttctgtgaaaaatgatttgtgggttagctacgtagaaagctactactattccccaacttccctcaacagggtgagtaaaaagtgtacaaatgatggctctaccagtctctgaggcaaaagccttccttcagtcattcaatcacattctacagacagaaaaatcagtattgatttaaacaggctttctaaagaatggatgccatgctgacagggaaaatatgccaaatcccaatcattctctattttccattctaatgcacagtatctgctgtttctcaccccttcatttcagcaaaacaaagtagatacaacttcacaatagtccagacacaaatttaatcctgcaatgcactagaaagctatctaccaacaggtagctggatttggcagtgtcagccagcaatcaaaaattgtcaatgtccatccaaatatggaatcatatgtgcacaaagttggtaatattatcccacaaagtcatcaaaaaagatttctgagaattcagtggactttcacaccctagatataaagagtagaaaaagactgcaaacataatataccaatatcctcatcacattgttttctttctataatcataaaaagtccccacctaatccagaataaattaaggattcattatgagtaatatgtagccccgaaaactggccacttattttctagaatgggaatactgacaagtacattagctgtgtatcaataccaaacacatggcaaatctacatgacaagtctgctcagctgttattctttctatggaccaacacagctaatacagacacgtttcaggatgactatctaattaaaaataaaagcaatactgctgagcttaccttcctgctgtgaaataatgagttgcagtttccattcaaaccaaaggcaatctagcataaaaactggcatcccttatctaattaaccacgaatatacacaatggcatatattagtaccagacagatcaaaagccagttcttaaaagtgtattagctcttctaaataagcatcatatttgctgtgtaacttcaatccaccaggccctaagccatgacataaaacagaaacttagggtgaaagttataaaggcagttagagatgaactagtttaatctttagaccaattcaggaatcccctctattagctgactcaaatgttaattgggtagccactaggtgcaaggctttaggacaggtgctatagtatttactgagcatttactataatccagatgcttttccaagtgctttacatttaatatccataacagtcctataaaatagatgccattattacccccaatttacaaatgtgtaaacgaaggcattaaggaattaacttgcccaatctcacaaccaagaagtggtagaaggctgagcacagaggctcacacctgtaatcctagcactttgggaagctgaggcaggtggatcacgaggtcaggaggtcgagaccatcctggccaacatggtgaaatcccatctctactaaaaatacaaaaattagtcaggcatggtgacgtgcacctatagtcccagctactcaggaggctgaggcagaagaatcacttgaacccaggaggcagaggttgcagtgagctatgatcacaccactgcactccagcctggtcgacagagcaagactccgtctcaaaaaaaagaagcggaggagccagaattcaaacccagaggctgtactcttaatcgctatgttaatattgcctctctggtaggaggatgtacaaaatggaataaaacatgactccacctttccaagaactcagtctcctgaaagatacatgtaaatcaatgaatataatagagtacaataagataattttttttttgagacagtcttgctctgttgcccaggctggagaacagtggtgcgatctcggctcactgcaacctctgcctcccgggttcaagcgattctcctgcctccacctcccgagtggctgggactacaggcacgcaccactatgcccagataatttttttgtatttttagtggagatggggtttcactatgttggccaggatggtctcaatctcttgacctggtgatctgcccaactcagcctcccaaagtgctgagattacaggcatgagccactgcacccaaacaagataattgttaatgacagataagagggaaggcttaattaaggtactggcagtgaggaaaaagaagtgagagaagataagtgaccatttttttagagatgggggtctcactatgttgcccaggctggactttacaggcatgatcactgcacactacagcctcgaactcctaagctcaagggatcccctttgcctcagccacctcagccgcctcagcactaccatgctgagcagagataagtgacatttttaaaaaggtgttctggccaggcgcagtggctcacgcctgtaatcccagcactttgggaggccgaggcgggtggatcatgaggtcaggagatcgagaccatcctggctaacacggtgaaaccccgtctctactaaaaatacaaaaaaattagccgggtatggtggccggcacctgtagtcccagctactcgggaggctgaggcaggagaatggcatgaacctgggaggcggagcttgcagtgagccgagatagtgccactgtactccagcctgggcgacagagcaagactccatctcaaaaaaaaaaaaaaaggtgttcaagtccgggcaccgtggctcacacctgtaatcccagcactttgggaggccaaggcgggcagatcacctgaggtcaagagttcgagaccagcctggccaacatggggaaaccccacctctactaaaaatacaaaaattagccaggcatggtggcaggcacctgtgatcccagctacttgggaggctaaggcagaagaatcgcttgaacccaggaggcagaaattgcagtgaaccaagattgcgccattgcactccagcctgggggacaagagcaaaactccatctcaaaaaaaaaaaaaaaaaaggtgatcaagtagacatatgaggtacaagaggtacccagatgactccaagtttaactagaatccctcccatgtttctggtttgggtaactgggagaatggctagccattcacctaaaggatatgatgtgtaaggagacgcaaattcttctcagatcttactgagtttaagttgcctgaaggaacaccagttaacaatgtccaggaggctgttggagacaccatactggagcttaggagagaggactagactgaagatgtacacttaaaagttactagcatgccgggcgcggtggcttacgcctgtaatcccagcactttgggaagccaaggcaggcggatcacaaggtcaggagattgagatcatcctgggtaatacggtgaaaccctgtctctactaaaaaaaaaaaaaaaaaaaaatacaaaaaaattagccaggtgtggtggcgggtgcctgtagtcccagctaatcgggagactgaggcaggagaatggtgtgaacccgggaggcagagcttgcagtgagccgagatcgtgccactgcactccctggcaagacagtaagactccgtctcaaaaaaaaaaaaaaaaagtcactagcacttactaaaaaatttcccaaagtacagaatatgactctaggtaataccgagttcctaccatgcaccaaagcccaggcaccttctttttgtgcttaggtgaaagcaggtaagtggtcaagggaacatcaatatatacaggacaaaaaaaggaagagtatacaaatgagactaaaaaggaaaaacgcaagaataaaaccagaagaaagtatattgccattgatagtaatgacaaaaaccacaattacttttgcaccaacctaatatgtcacagaaaccaaaagtggaaacaacacacatatcaaataccacaaagtagtatatggtatgaagaaaactgtccactggattggacactacagaaggcagagtcagcctggcctactaaaacaacaccagtaacaaagagctcactacagtagtctgttctattattgcaaagttctggttgttaaaaagcttttcttctttccaatgacataacaaaaagcaaacgcattggagtacacactactatgttcaaattctgactctgaagaattaacagttaaaataaccaaatgcaatgatgatacttggctagatcctgatttgaacaaaccagctataaaagacaattagggatttttttttttttttttaagataaggtcttgctctgtcacccagggtgtagtgcagtggctcaaccatagctcatttgcagcctcaaacgcctaggctcaaacaatcctcccgcctcagccccccaaagtgctaggattacaggcatgagccatcatgcccagccaattggggaagttttaataagcacgactaccagacaatagtagaaaattactgttaatttagttaagtataataatgatattaagatcatatatgacattttttggccaagcgcagtggctcacactttgggaggctgaggcaagcagatcacctgacctcaggagttcgagaccagcctggccaacattatgaaaccctatctctaccaaaaatacacaaaaaattagccaggtgtggtggtgcatgcctgtagtcccagctactcaggaggctgaggcatgagaatcacttgaacccaggaggcggagcctgcagtgagccaagattgcactctagcctgggtgatggagtgagattcggtctcaaaaaaaaattttctgggccatgcacagttgctcactcctgtaatcccagcactttgggaggccaagacaggaggactgcttgaggccaagactttgagaccagcctgggcaacatagcaagaccccatctcttttttttttattgtatttatttattttttgagacggaatgtctctctgtcgtgcaggctcaagtgcaatggtatgatctcagctcagtgcaatctccacctcctgggttcgagcgattctcctgcctcagtctcctgagtagctgggattacaggtgcgtaccaccacgctgggctaatttttgtatttttagtataaatggggtttcaccatgttggtcaggctagtctcgaactcctgaccttggcctgccttggccacctgccttggcctcccaaagtgctgggattacaggtgtgagccaccacacctggcctccatctctttttttttttttaatgcagtttctgatcttctgtgtatactaaatgtatctataactttatatgctggaatatgaaataacacaaaactaatattggacccgatgcaaataatgtgagatggtaaagcactaggtgaatttatgaatttccaggataatatctcctttgatcaattttcctagttaaatatgagaaggcctgaaaaggaccacttggggcagaaaggcaactcatgggctgggtgcacagcatggcaacagagcaagactctatctcaaaaaaaaaaaaaaaaaaagaaaagaaaagaaaggcaactcaccttttcttctgatgttagagggctatttcagaatttcagagactgtgggaaagaaagtaatcaagaggaaagaggaagttaggttccttgtgttagcctggcctttttttttttttttttttttgagtctcgttctgttgcccaggatggagtgcagtgacgcgatcttggttcactgcaacctccacctcctgggttcaagcaattctcctgcctcagcctcccaagtagctgggactacaggcatgtgccaccacgcctggctaatttttgtatttttagtggagacgggttttcatcatgctagccagactggtctcgaactcttgacctcaggtgatccacctgcctcagcctccgaaagtgctgggattacaggcgtgagcccccaccacacccggccaagagaatatttttatagccatgaaaaatgacagttgctatcagtacacaaagatatatgtacaagaatattaaagtataaattgttggtaactgtgatggttaatactgagtgtcaacttgattggactgaaggatgcaaagtattgttcctagtgtgtctgtgagggtgcggccaagggagattaacatttgagtcagtggagtggacgaggaagacccaccctcaatctgggtgggcaccatctaatcagctgccagtgtagctagaataaagcaggcagaagatggaaaagcagacttgctgagtcttccggccttcatctttctcccatgctggatgcttcctgcccaagaatgtcagactccaacttcttcagcttttggactcttggacttacaccagtgatttgccaggggctctcaggcctttggccacagactgaaggctgcactgtcagcttccctactttttgaggttttagaacttggactgatttgtcactggcttccttgctcctcaacttgcagacggcctatcgtgggactttaccttgtgatcatgtgagccaatcttccttaataaactccctttcatatatacatatatcctattagttctgtccctctagagaaccctgactaatacagtaacagaaaaatggagacaatccaaatatccaaaaatagagatagattaaataaattacagtacaggccaggcacaatggctcacacctgtaatcccagcactttgggaggcccgaggcaggtggatcatttgagcttaggagtttgagaccagcctgaacaacatgaggagactttgtctctacaaaaaatacaaaaattggctaagcgtggtggcccatgcctgtagtcccagctacttgggaggctgaggcaggagaatcgcttgagcccaggagcggaggttgcaatgagtcaagatgacaccaccgcactccggcctcggcactagagcaagaccaatcaatcaatccatgtgcatccatacaacttaatattatgtagtcattaaaagaatgaggtagctagccaggcgcggtggctcacacctgtaatcccaggactttgggaggctaaggtgggagaatcacaaggtcaggagatcaaggccatcctggctaacacggtgaaaccccatctctactaaaaacacaaaaaattagacaggcctggtggcacacgcctgtagtcccagctacttgggaagccgaggcaggagaattgcttgaacatgggaggtggaggttgcagtgagccgagatcacgccactgcactccagcctgggagatagagtgagactccatctcaaaaaaaaagaatgaggtagccaggcacagtcactcatgcctataatcctaccactttgagaggccaaggggaggatcccttgagcccaggattacagacaggagccaccgcacctggccgattttttaattttttgaagaggtgggttcttactatgttgactagattggtcttgaattcctggccaacgtggtgaaaccacgtctctaccaaaaaaaaaaaaatacaaaaattagccaggcgcggtggcacatgcctgtaattccagctactgaggagcctaagtgaggcaggagaattgcttgaacccagaaggcagaggttgcggtgagctgaaatcgcaccactgcactccagcctgggtgacagagtgagactctgtctcaaaaaagaaaaaaaaaatcaaaaaaacaaatacaaaagatatagtcattaaactgaattcatactgatatataatagatggaatttctttaactttctgatagaggtttgcttcctttaatattttttcctgataaaagttcaggaaagtaaatttcaggcaggtggatcacctgaggtcaggaattcaagaccagcctggccaacatggctaaaccccgtctctactaaaatacaaaaattagccgggcatgatggcgggtgcctgtaattccagctactcgggaggctgagacgggagaatcacttgaacctgggagacggtggttgcagtgagctgagatcacaccactgcactccagcctgggcagctgaacgagactccatctcaaaaacaaaaaaaaaaagaaagattttaaccaaatttcagactagccagaaggaagcaacctgtaactgttcagacaatacaggtgacagttaaaaatcttcaatgatatctgttgcttataaaattctttagcccggcattcgaagactctgctccactataattaggctaatcattattccctactctgctccactataattaggctaatcattattccctacacttaacgcacccttctgatgtagtgttgactttctgcctcagcttatatgatgttcatgtcattctagctcttgtagtaatctgactatactacttacttggcactcaattaatgtctttttggtcttcctagctccactctcacacttttttcaatctgtttcaccaggctaagtaaacttctgagaatcattcatgtgtcatacaaaagttctgcctcatttgacccctacccacatctccagcctcatctatgtccattcctctatctgcagtcacaatctactccaaacatagagaattgctatatttgtagagccctgctcacacttcaatatctatgcatgtaatattctttctccctggtgtgttcttcccagattcttccacatgactctctcagtaatcatctcatgtgggaggtgttctctgacccctcaatctcattttctgtgctttgatatcaccctgcacaagtcttagttattatagtcatcatatagtattttaattgttgcttatcatctctttcactggactatgagcttccagactatgagctcttttagttcaagctaagggcttggactcaaacttaccttcaaactatggcaatacaaagtataatactacaatattgagtcaaaatgtacagtggagaaaaagcaaaataaataggacatcgagattccacattttcaatgtaaaaaacatactccttctttcattcactcagccaacatatatttatttagcacctcttacgggccaggcactatgccaaatcctggagagatggtgacgacaatatagacatacacagacaaataattctgagaggatacagtccaaaatgttaacaatggtttttaacttttttttttttttttgagacagagtctcactgtgtggcccgctcaggctggagagcagtggcacaatctcagctcactgcaacctctgcctcctgggttcaagcaattctcctgcctcagcctcctgagtagctaggattacagatgcacaccaccatgcccagctaatttttgtatttttagtagagacggggtttcaccgtattggccaggctggtctcaaactcctgacctcacataatccgcctgtctcagcctcccaaagtgctgggattacaggggtgagcaaccatacccagcctgtttttaactttttgaatcatgggcaaattatgaataatgtgtatcttctcctttaaaatctctattttccaattcttccttaatgaatatgcattacttttataatcgccaaaaaaatttttaacatccttccaaaatacaaattcctaacaaacagtagcaatacaaaacccaaagtaaatactatgtaatgtgaaagtgaaacaaatgttgagaacttttagtcagattctagttacacctaatacaaagaataataggactaagtataaaaaatactttatgatttccatagtgaaatcattgtggaagtcattgtgaagaagattccatgaaattgtccaaggaaaacactgaccacaagatcaataccaccctagttttccatactgcagaaagaaaaaaaaaattttttttttttggagacggagtttttgctcttgttgcccaggttggagtgcaatggctcaatctcgactcactgcaacctctgcctcctgtgttcaagcaattctcctgccttaccctccaaagcagctgttacaggcatgcgccaccacgcccagcccccccaaaaaattatattattctattttatttaattcagaggaagagagaatagcctccacacttgttccaaagacaaattaataaataacaccatatttaatctgtataatgatttacagtttacagttcacagagcattttgatcttcacaataattgttttcttgttcccatcggatagattaaaaaaataaaggactgaaatgcagaaggcccttctttttttttttttttttttttttgagatggagtctcactctgttgcccaggccagagtgcagtggcaagatagatctcggctcactgcaacctccatctccctggttcaagccattctcctgtctcagcctcccgagtagctggaactacaggcgcatgccaccacacccggctaatttttgtatttttagtagagacgtgatttcaccatgttggtcagctggtctcgaactcctgacctcaggtgatccacccgcctcagcctcccaaaaagtgctgggattataggcgtgagccaccacgcccagtcaggctcttctatcttttttactcaatatccaaaagctataaaagaaaagactgagggccgggcatggtggctcacacctgtaatcccagcactttgggaggccgaggtgggcggatcacaaggtcaggagttcgagatcagcctggccaatagggtgaaaccccatctctattaaaatataaaaattagctgggcgtggtggcacacacctgtagtcccagctactcaggaggctgaggcagaagaattgcttgaacctaggaggtggaggttgcagtgagccaagattgcgccactgcactccagtgtgggcaacagagcaaaactcagtctccaaaaaaaaaaaaaaaagaaatctcacttctgtgaatttatcccacaaatatccttgcacacatataaaatgacacattcaaaggccctttttacagcattgtttataatatcaaaacactggaaacataaatgtccattataaggaattagttaaataaattatgatacatccattcaatggaatactatgcaggtgattaaaaagaaaataataataataataaatgaataaataaataatatatatataggccacagtggctcacacttgtaatcccagcactttgggaggccaaggtgggtggatcacctgaggtcaggagttcgagactagcctgaccaacatggttaaaccccgtctttactaaaaatacaaaaattagccaggtgtggtggtgcacacctgtaatcccagctactcaggaggctgaggcaggagaatcacttgaacccgggaaatggaggttgcagtgagctgagatcgcaccactgcactccagcctgggtgatgaagtgagattctgtctcaaaaaaataataatatatataaccaaaaaaaaagaatgaggaagctctctatgtactgatctggaaaggtctctaagatatataaagtaaataagcggccgggcctggtggctcacgcctgtaatcccagcactttgggaggccgaggtgggcggatcacgaggtcaggagatcgagaccatcctggctaatacggtgaaaccccatctccactaaaaatacaaaaaattagccaggcgtggtagcaggcgcctgtagtcccagctactcgggaggctgaggcaggagaatggcgtgaacccaggaggcggagtttgcagtgagccaagattgcgccactgcactccagcctgggcgacagagcaacactccgtctcaaaaaaaaaataagcaagattgggggtgggaagtgcagaacagtggggaaccatgggcaactgtacatgaaaagtgggaaaaacaggactatacaattgacccttgaacaacacgggtttgaactgtacaggtccactcatgtgctgtagttattcacaagtgtgatcatagcacactatggcctcaaactccaggcctcgagtaatcctcccacatcagcctctggagtagctgaaactacaggcaaagctgtattacatacagatttttttcaacaaatatattttttaaatttttggagatgtataacattttgaaaaaaactcagaaacaaaacacctagcctagaaacatcaaaaaaattaagaaaaagttaggtatgccatgaatgcagaaaatatatgtagatactagtctattttattatttactataagatatatacaaatctattataaaaagttaaaatgtataaaaacttatgcacacaaatacaaaccatacatggtgccattcatagtcaacagtaaacaaatggaaaggtgcagtattaaatcacaactgcataaaattgactatagtatatactgtacttctgtaataattctggagccacctcctgttgctgtttcagtgagcaagtgttgtgagtagcccctaaaatgctgtgtgatgctaatcgtctccacgtgagcagttccttcctccagtaaaaagtgtcacagtaaaaagtgatctctcaaggttcgtgcatatttttcatcatgcttagtgcaatactgtaaaccctgaataacaccatgagatccataccaagtgccactaatgctggaagtgctctcaagaaacagaaaggtcatgacattatacgaaaaagttggccaggcatggtggctcacacttgtgatctcaggactttgggaggctgaaggcaggaggattgcttgagcccaggagtttgagaccagccacggtaacatagtgagaccatgcctctacaaaaaaataaaaacttatcctggagtggtggcacacacctgtagtcccagctactcaggagactgagatgggaggatggcttgagcctgggaggtcgaggccatagtgagctatgatcagaccactgcactccagcctgggcaactgcccctgtctcaaaaaaataaataaataaaaatttgaattgcttgatatgtaccacagattgagatctgcagcagtagtggtcagccattaaaaaaaaaaaaaaaaaagtaaattcatgaagccaggctatgcaatgccaacagcaacagcagttaagttttgcgggaagtcaaaaattatacctggggccaggcgtggttgctcacacctgtaatccaggcaccctgggaggccaaggggggtggatcacctgaggtcaggaatttgaaaccagcctggctaacatggtgaaaccctgtctctactaaatatacaaaaattagctgggcgtggtggcaggcccctgtaatcccagctactcgggaggctgaggcaggagaattgcttgaacccaggaggtggaggttgcagtgagctgagatggcgccattgcactccagtctgggtgacaagaacaaaactccaattcaaaaaaaaaaaaaaaatgtccgggcgcagtagctgacgcctgtaatctcagcactttgggaggctgaggcgggcagatcacaaggtcaggagatcaagaccatcctggctaacacggcgaaaccccatctctactaaaaatacaaaaaaaattagccgggcatggtagcgggtacctgtaatcccagctactcaggaggctgaggcaggagaatggcgtgaacccaggaggtggagcttgcaatgagctgagatcacaccactgcactccagcctggacaatagagagagacttcgtctcaaaaaaaaaaaaacaacaacaacaaaaaagaggagccgggcgtggtggctcacacctgtaatcccagcactttgggaggccgaggcaggcggatggcctgaggtcaagagttcaagaccagcctggccaacatggtgaaaccctgtctctactaaaaatacaaaaaaattagttgggcatggtggcgcacacctgtaaacccagctactcgggaggctgaagagggagaactgcttgaacccggcaggcagaggttgcagtgagctgtgccattgcactacagcctgggcaacaagaacgaaactccgtctcagaaaaaagaaaaaaaaaaaaaggaaattaatgaagccaggttatgcaacaccatcaccaacagcagtagttaagttttgccgcgagggggcggcggagggggggtcaaaaattatatttggggccaaggcacagtggctcatgccagtaattccagcacttccggaggctgaaatgggaggagtgttgatgcccaggagtttgagaccagcctaggcaacatagggaggccctgtctctacaaaaaaaaaaaaattagccaggcatggtggcatgcacctgtggtcccagctactcattcaggaggctaaaaagggaggatcacttgagtctacaaagttgagtctacatcgagccatgatcctgctactgcactccaacctgcgcaacagcaagagattctgtcttaaaaaaaaaaaaaattatacttggattttctaccgcacaggggttggcttcccaacccctgttttgttcaagggccaactgtatcatttcatttttaattcttctttttttttttttttttttttgagatggagtctccctcttgtcgcctaagctggagtacagcggcgcgatctcggctcactgcaacctgcgccttcctggttcaagtgattctcctacctcggcctcccgagtaactgagattacaggcacctgccaccatgcctggctaatttttgtatttttagtagagacggggtttcaccatgttggccaggctggtctcaaactcctgacctcaggtgatccaccggcctctgccgcccaaagtgctggagttacaggcgtgagccaccacgcccagccatatattcttatttgtaagcattcgcctaaagaaagtctaaaagaggccgaacgcggtggctcatgcctgtaatcccagcactttgggaggctgaggcgggcagatcacttgaggtcaggagttcaagtctagcctggccaacacggtgaaaccacgtgtctactaaaaattaaaaaattagccgggcgtggtggtgcacggctactcagctactcaggaggctgaggctggagaatcgcttcaacccggaaggcggaagttgcagaaagccgagactgcgccactgcacaccagcctgggcgacagagtgagactcttgtctcaaaaataaaaaataaagggccgggcgcggtggcccaagtctgtaatcccagcactttgggaggccgaggcgggtagatcacaaggtcaggagatcgagaccatcctggctaacatagtgaaaccctgtctctactaaaaatacaaaaaattagccgggcctggtggcgggcgcctgtagtcccagctactcgggaggccgaggcaggagaatggcgtgaacccgggaggcggagcttgcagtgagccgagatcgcgccactgcactccagcctgggcaacagagcgagactccgtctcaaaataaataaattaattaattaaatcaaattaaattaaaaataaaaaataaagtctaaaagaatataaagagactattcaaagtgtttgggagagggcatggaaccaggttaataaagaacagagatggaagtaagatttttcactgttttgttttttgttttttgtttttttttgagatggagtctcgctctgtcgcccacgctggagtgcagtggcgcgatctcggctcactgaagctccacctcccgggttcacgcccttctcctgcctccgcctcctgagtagctgggacgacatacatgtgccaccacgccctgctaattttttgtatttttagtagagacggggtttcaccgtgttagtcaggatggtctagatctccggacctcgtgatccgcccgcctcggcctcccaaagtgctgggattacaggcatgagccaccgcgcccagccgacttttcactgttatataaatttattttttattttatttttttttttttgagacggagtctcactctgtcgcctaaactgcagtacagtggcatgatctcggctcactgcaacctccacttcctgggtagaagtgattctcctgcctcagcctcccaagtagctgagatagcaggcgcaggccacctcacccagctaatgtttcatatttttagtagagaagggggtttcaccatcttggccaggctggtctcgaactcctgacctcaagtgatccacctgcctcagcctcccaaagtgctgggattacaggcatgagccaccgcacccagccctaaatttatatattaaaaaagtttacatttaataaccagttgaatgtattatctattcaaagattaaatgtatcttaaaaaaaaaaactaaagctcacaaaagataagtaatttgcctttatattaaccatcatatagttaataacaacagagttgaatacaactaaggttttcctaatgttcttttccttttatcacactgccttttggaaattttcaggaatggaagacataaaacttattacaaccaggcttttctctgaaacagccactgcctgtgattgttcagggaaaataacactagtgagactacactgaagtcatctccatatgatgactttgtaaatagtataatagccattgttgggtcaaaacattcaccatcacccacacaatacaatgtaataattgggcttcatctactagaaggagatgaaattcccataaatgcctttaccataggtttcaaattccaacactacattctttttgcaaaacaaaatgaaatgtatgacactaagaatatatgtataaatactttcatacagggaagaaagcataaaagcaagtcagttttctcctcaaaataagtccgggatgagcatatttaaatgtgtaattttctttttacaattaactaaaaccttttgagaccagcctggccaacatggtgaaaccccatctctactaaaaatacaaaaattagccctgcatggtggccctcgcctgtaatcccagctactcaggaggctgaggggcaggagaatggtgtgaacctgggaagcggagcttgcagtgagccgagatcttgccactgcactccagcctgggtgacagagcaagaccccataaaaaaaaattaattaaaaaaaaaaacaaacgcacacacacacaattaactaaaaccataaaaaaatgttactgaggatcctgaggtggagagtccctagcctcccagcatacacacacacacacacacacacacacacacacacacatatatacattttttttttttgagacggactttcgctcttgttgcccaggctggagtgcagtggcccgatctcggctaaccgcaacctccaccacccgggttcaagcgattctcctgcctcagcctcccaagtagctgggattacatgcatgcaccaccacgcccagctaatttttgtattttttttttcagtagagacagggtttctccatgttggtcaggctagtctcgaactcctgacctcaagtgatccacccgccttggcctcccaaagtgctgggattacaggtgtgagcaaccgcacccagccagcacatatattttaaacagaatcaaagcccatcatatgtcaagcttacaaaggattttttgtgtttgagggtctatcccaaacatatatctgtaagagagaataacacatcatacatccagggcatcaagtatctgaggatatcaccattaattcatatacaaacatctgtaccatttggtactacttttcaacaagtgccaaggaaccaccaatccaactctgggtccctccttggtgagcaggcccacctataggacttactatctcctctgctcaatctcctgctatcatgctggacaactgtgacattcatattgatgacatattcaacacagccccctaatctcccactacttcaataacctacacctccattccccttcaacagcattgagacagttaagccagtttttgtctttaccttgaaataatgaactctgggctgtccaattatatatttcttacaaaatctggtcttcaaccacatttctgattgtctttttattctctaagtacaccagcctccctctagattttgcttcttataactcccagcttggtcccttggaatgaaacatatctcctacactatcaatagcagtgtaaagttgcttcccattttatctttctgtcctgcaagtttccattttgaatcaatccaaccatcttttttgtcctactattcttaggctgttgaagaaagtgtaaaatccatgctcctgggccccattacaaatatattatttctaactagtaggaccctcaatgtggtcaacaatcttttagctcctgagtttttttttgcttttttttttttctttcccccaggctggagtgcagtggtacaatcttgactccctgcaacctcagcctcccggttcaagcaatcctcccacctcagcctctccagtagctgggacaacaggcatgcaccaccacacccagctaattttttaattttctgtagagacgaggtctcacaatgttgcccatgctggtcgcaaactcctgggctcaagcgatcctcccacttcagcctcccaaagtgctgggattaaaaaatccaaagtgagccactacacctggccaacaattttttttgttaaatctttattctctttcattttccatttaagattcccatggccataatactcaagtcagaaactcaccatagtgtcttcagtctccaaactgacttctccacagataagtaatcacatcgataaggccatctgttaaactccctcactttccttcccttctaccacatcattatccattttcactactatccttttggtgtcaaagggcaaaatgcctgactgacatatttcctagatgaaccttcccctcacttacagaactgtttcacctgtactgaaaagaaaaacacacatgtgccataatggaaagaacacaggtttcagaactagacatacctgctcaaatccttgtccacagtactctccactgtaaaagagggatactgacatgttaaccacaaggctgttgtgatctataaagcatctttatgtacctggcatatagtatattctcaataaagatgagtttcactagaaccagctctccttcacaaccaaactctggagaataattttactcatttctcctcatttattcctcaatccatcatgatctcactactaccttctttgccatccccaccctaccaaaactgcatttcagaggaaacaagtgacctcctgattgctaaatatagggcaggccaggcatgatggctcacccctgtaaccccagctctttgggaggccggggaaggcagatagctttgagctcaggagttcgagaccagcctgggcaacgcagagaaatcccgtctctacaaaaaatacaaaaaattatctgggtgtggtggctcctgcctgtgatcccagctactcagaaggctgaggtgggaggatccgagactgcaccactgcactccagcctgggcgacagagtgagaccctgacaccaaagaaaaaaaaaaaaaagcttcttaactctcattcagctggacctcgaaagcacgtgacattgatagtcaccgccccccactcccttcttgaaatcctttctttggctcctattataatgctgttatgttctagttcttgtcccgttcctttaatctctctttttcagtgtctattacctttcaaacaatgatgctccttctggtccacagcccttctcatctttcagtattaccattccatactaaggcacacaaatatcccccatatattctcttgaccctccaaatttatgtatccaggtccaagctttctcccaattttcagacccaaatttccagatacccacagtgatatttcaaaacacctcaaactcggctgggagcagtggctcacgcctgtaatcccagcactgtgggaggccgaggtgggcggattgactgaggtcagacgttcgaaaccagcctggccaacgtggggaaaccccgtctctactaaaagtacaaaaattagccggacgtggtggcgcatgcctgtaatcccagctactcggtagtctgaggcaggagaatcgcttgtacctgggaggaggaggtggcagtgagctgagatcgtgccactgcactccagcctgggtgacagaatgagactccgtcaaaaaaaacaaaaactaacaaacaaaccctgaaacttaacttgttcaaaaccaaatttattaccttctctcaaaattgcttttttatgctccctatttcagatgagatcaggagcgttgagggtggtataaccagagactatgttccctatttcaattaacactaccgattcacaccatcagccaagtcagaaactttctactattcttctcaactttattttgaaacctcttggaatttcgggccattccctcccgcctggatgagcacactcgttttctgcctacctggcctttccgcctccacggtcttcactttcaatccttcctctatattttcaccaaagataatgcaatcataccaagctcctgcttacaaaaccttcaacggctccccatgcatgcagcatgaagtccaaattcctcagcaagttcttctcagaggtatacaatttaaagacttttaaattacgcaaacctggatttcgcttgtagcgaaatctgaacactggcttagtccactcttcacagcgaagagtaaaaagcagagaggggaaaggaagggagacgatgacaagcgaggaaagaagagggggaaggcagtagggtctgaggggagggaattgttttcctgggtagaggtgaacgttttcgagggaagagtgtatcggagggaagtcaagtgaaggaacccagatctctgaggcaggagcgggtatgcgagcagggaggcgctcagtggggagctggaagtctctgaaacaagagttttccgagaaaacgaaagatccctaatgcgagcgaggtaacttctaatgggttcccaggttctaagggggagcagacgtggcggggagcctgagggaagtgagaaggaaaggggaaagcggccaggaagggagcgtccgccgccgctgagagggggacctctgggaagccgaggggtcccgtcgggtgcggagggacgcaggcgcctctgctccggggcagaggaggtggagcggcagcgcgcgcgggccaggcaggatgcccgggtttgtgacccccgtcctcttttcacgttacctgaggcaggactgagcagccagaggggtgcctgcgcgggcaagaggaggagacggcggcaaagagggagcatagtaaccctcacagctcgttggtggcagcggctccttagcctgcggaggcggtgggagcccctagcgcagaagccggcgactcagctaggctagcggcggcggcgaacgaggagactactgccatggccccacagtcggggccgctccccccgcctgtttggcggggccaggaggacgatccgaccagcgaagccaacagggcagctggtagctctgctgagctcccgggccgcgaaagactgaaacgcctacccggcccagcaggggggttgggggcggggtctcggctggccacgcccctccctcaagccctccctcagagtagccagtcaaccgtcaactcctgataaacgaggtagtggaattgcccaattagcgctaggaatgccacgtggtatgagggtgggcacaatgggcgtccagaaaagccaatcaacagccgtaggtgccaactccggaggacgaagggaaccaataggaaggaagtcgaggtaaaaacagaagaagcagtgtgtgggaaaggcggaaccgaggaggagggaatacacctgggggaaacccaagtccaggagcctcttagagggcggggcagtaaacacaagatggaccaataaaaatgttaaacacagaaatgattggtaattgataaagccaatagaaaatggactagactggcgcggctttcgggttggtcaaggtatagctgagtaaggaaaagcggtaagaatgctgcgtcctgcaggatttcagtatagtgaggaggaaaaaatatatcaataataccgacttgaaatagtaagagcaatcagtagagctaaacaaaatgctagggaagcaattaatcatgactatgagattcggttaagtgaaagcttagaggaggtaacacttcagctagcttgaaaacagattttgaaagaaagctggtggggaataagttgggattttttgttgtttttgttggttgttttttttttagaagggtctcactctgtcgcccaggatgatggagtgcaatggagcgatcatggctcacttgcagcctcaaactcctggattaagatgatcctcccaactcagcctccccggatagctgggactacaggcacacgccagcatgcctgactaattttttgtatattttgtagagacggggtttaccatgttgcccaggctggtctgtaactcctggactcaagtgatcggcccacgttggcctacgaaagtgccgggattacaggcgtgagccaccgctcccagctaagaattctgcccagctgttcaaggcacatatttcttcactttttgcatgtgcctggacatcaggagctcataatctcatgactgaagagactagaacaggaggagggcaagagcaagcagtatgggccttactgtattagcactcccaggggttagagaccccttttcagacatcttaagactttcatcctcctggaagagtataagtggtatgcattcctggtggccataaagtttaagaaatatggccagggccgggagcagtggatcacgcctgtaatcccaccactttgggaggccgaggcagggggatcacgaagtcagaagatcgagaccatcctggcaaacatggtgaaacctcgtctctactaaaaatagaaaaattagctgggtgtattggcgcgtgcctgtagtcccagctactcaggaggctgaggcaagagaatcgcttgagcccgggaagcagaagttgcagtgagccaagatcgcaccactgcactccagcctgggcgacacagcaagtctccgtctcaaaaaaaaaaaaaaaaaaaaaatatggccagacacagtgattcacttctgtaatctcagcactttgggaggccaaggtggatcacttgaagccaggagtttgagaccagcctgggcaacatagcgagaccctgtctgtacagaaaaaaaaaaaaaaatgagcccaaaatggtggcatgtacctgtggtcctagctacttgggaggctaaagccagaagatcacctgagcccagaggtcaaggctacagtgagctgtggatggtgccactgcactccagcctggacaacagagcaggaccctgtcccaaaaaaatataaaaagaaagaaagaagtgtggtaggagatattggagagagaagaggctgcatgtgggttgggcttaaatgccaatattcaaatttgtcttttgttttttatgctgtgagagctattcttgagcaggaccataaactaaacagggcagtgttttaggaagattaattggtagctcacagaatctctgaagggagaagagagatcaccccagcccagtccccctgaccaaaggctttttggtaccattcttctggcaacaaatcatgtgctgccacctggtgacagctcaaataacaattttccacattgctatttaatatttctgttgaggttgggtgtgtgggctcagacctgtaatcccaagggctttgggagactgaggtaggaggatctcttgagcccaagggtttgagaccagcctgggcaacatagtgagacacatctctacaaacaaaaatccttttataattagctgggtgtggcatcacatgcctgtagtactagctactagggaagctgaggcaggaggatcacttgagcccaggagttcaagaccagcctaggcaagatggcgaaaccctgtctttacaaaaagtacaaaaaattagctgggtgtggtggcgcatgcctctggtcccagctacatggtagactgaggtgggaggatcgcttaagcccaggaagttgaggctgcagtgagctgtgatctcgccactgcactctggcctgggttacagagtgaaactccatctcaaaaaaaagaaaaaacaaagtggacccatgcagttcatgttccgtgttgtccaagtagtgaaaaggatcaggatcattagtcacaaggcattttttaatgaaatataatagaaaatatcagtgtatcactcccactaaggataaaaattaaatcataacatttttatttcagttaataaatctacacacatatttactaggtcacaatgtaaattgtatttcttactggaagtcacagccaaaaaattcttaaagccactggattagaggcagagagactgaaagaagagaccagggaagaggctgctacagaaatgcagtctgggctgctaaggatgatgtgtggagatgccaaagagagcctcaagcagtagaagctggggctaggcatggtagcagctcacacctgtaatctgaacactttgggaggccaaagttggtggatcagttgagcccaggagttcgagaccagcctgggcaacatggtgaaaacctgtctctacaaaaaatatttaaaaattagccaggcatgatagcgtgtgcctgtagtcccatatattattacttggggggctaaggtgggaggattgctttagtacaggaagcggaggctgcagtgagccaagatcatgccactgcactccagcctgggcaactgagtaagaccttgcctcaaaaaaaaaaaaaaaaaaggcagaagctggagatgaggaaaggtagcctcctactgtccagatccaagtcccaccagaatatctcatcctcctttgcatcccccagcactactgccctagagcagtgtcctacctcattctactcaccagaatgggaactcccattactttccaagttcaactgagcttgcactcagaaggtacagctataggctgggcatggtggctcacaactgtaatcccagcactttgggagggcgaggcgggcagatcacttgaggtcagaagttcaagaccagactggccaacatggtgaaaccccatctctactaaaaatacaaaaattagcgcacacctgtaatcccagctacttgggaggctgaggcaggacaattgcttgaacctgggaggcggaggttgcagtgagctgagatggggggcaaggatgggcaggcagtgaaaagcctcagtagataagacagataatagctacttcaagaaggtaggggcgggcagcccagaaacagggccttggaggggagggtgggcaaagaagccttcatcctactattcttaacgagtccttacaggtcattcaggagcattttggggccccaaaggaataggtcctcttgcttaagactctgggcatggagctgaaagatgctgggctccaggttagaaagggtgctcctctggggatctaagaggaaagaaaagggaagagaaaacaagtcatcagcaagcattgtgatatgcatagaactaggccctaggcctttctaatagagagggacatagaggactgacaggataaacagcaacagaggtcagtgagttcacagaaaggcagagactccattctacctagtgttaaataattaggcagctggcattcaggcaccattcagatttagcctcccccaaaacgggaatccttgtccttatccttacctggcttccataaaagttcccagctactgttactgtccagaagactgaattaagagctggatgaagaaacagacatggtgaaggtagtgggcagaggcagcttagattggacaacatgaatggagatcctggaaaggggaacagaaccagaaacagagaagataatgatgtatcaagggggcccttccaacacagaactgtcctccttcctcaggctaggactctggtctcctccctctttttttttttttttttttttttttttttgagatggagtctcactctgtcacccaagctggagtgcaacggcatgatctcagtttactgcaacctccacctcctgggttcaagtgattctcccacctcagcctctcgagtagctgggattacaggcacccgccatcatgcccggctaatttttgtagagatggggtttcaccatgttagccaggctggtcttgaactcctgacctcaggtgatccgcccacctcggcctcccaaagtgctgggattataggcgtgagccaccgcgccctgccaatctctcctccctctgtaacatccaaacatacaaaggtacctcactgactctctatcaggtaaagaatgcctttatgggatacaacccagatactcatactaccccaaaagcccaagtcaaatctaggatagctgaactttggtccccagtgcccgacctgtgagacaatttccctccaatggcacagcacccataccccctgacctaaggaggttgtgctccctccaggcatcttggtcctctgtcctggtagcctccagggtatgacccttgccttcctggccactttgcaactgctctaacatctgccagatcatgggctcaggtggaaccaaacctctccctctctccctccccatgactgtcctcttcagcacacttggaaccctcatgtcggcaaggatagtttctcatggccgggagcagaaaggttagaaagaagagctctggagagagagagagtcagcacagggaagagaggaatgaagacaggggcaggagagggtatcctggcctccctgcagaacaggatagacagagaaaggaaaggtcctccatagagaaatatgcagagacaagtctgaacctagtcctaccttccaactgccaacctgagcctgtcgtccctcagccagctgtttcagcagcagctcctggtgctggcctgcagatgagagagaatgtaagggggctgttccccaacttctttccttctccctccctgcctgtgaccagcctgctgccaaaaactgagacagaaacattctggctcagccattgggacgcttccaagctgactgaagagattaaactcacaccatgagagacaaagagtgcaacaaaatacttggccacacttctcagtagctcaggcagttggagccatggccacttaatgggagagcaagaagactttccaggccaggcgcagtggctcacacctgtaatcccagcactttgggaggccaaggcaggcggatcatctgaggtcaggagttcgagaccagctcggccaacatggtgaaaccccatttctactaaaaatactaaaaatatgaaaaaaagtggctgggcatggtggcgggcacctgtaatcccagctactcaggaggctgaggcaggagaatcgcttggactcgggaggcagaggttgcagtgagccaagattgcgccattgcaacacagccttggcaacaggcaacagagcgaggctgggcaacagagcaagactccatctcaaaaagaataaaaataaataaaaataaataaaagaagaagatgactttccagaaaaggggacaaggaaacgcatattcgcccccaaccaccttttacttactcaactggtactgcagcaacttcaattccttctgcataatctctgactcctcccacagcactgcaggagtgacagcagtgctattctaaagtcaatcaacaaatccagagtaagaaggcaagtagagtatctagggtcttgtgaaactcttagagaggatgatccccaacttgtcccactacaaatgccaaaagttcaaaggcctcaagaaggcaaggccgcactcagtgctcaatggcgcccaggctggagtgcagtggcgtgatctcggctcgctacaacctccacctcccagccgcctgccttggcctcccaaagtgccgagactgcagcctctgcccggccgccaccccgtctgggaagtgaggagcgtctccgcccggcagccaccccgtccgggagggaggtggagggggtcagccccccgccaggccagccgccccgtctgggagggaggtgggggtgtcagccccccgcccggccagccaccccatccgggaggtgaggggtgcctctgcccggccacccctactgggaagtgaggagcccctctgcccggccaccaccccgtctgggaggtgtgcccaacagctcattgagaacgggccaggatgacaatggcggctttgtggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatctgtgaccttacccccaaccctgtgctctctgaaacatgtgctgtgtccactcagagttaaatggattaagggcggtgcaagatgtgctttgttaaacagatgcttgaaggcagtatgctcattaagagtcatcaccactccctaatctcaagtacccagggacacaaacactgccgaaggccgcagggtcctctgcctaggaaaaccagagacctttgttcacttgtttatctgctgaccttccctccactattgtcctatgaccctgccaaatccccctctgtgagaaacacccaagaatgatcaataaaagaaaaacaaacccaaaaaaaaaaaaaaaaaaaaagaaggcaaggtcttgactatcccttactcagtctgcagctcctgaggaaggccattggtagtactgcattctcctggtcctgtttgcatctgggcttgggcttgggcttgggtttgctcccacacctggctctgaaggccctgcagttcctttctcagctcctccaggcattgctccaggagaaaagcactcccctttggggccccctgcagcaaccttagtgatgctgtagtgggacaagttagggatcatcctctctaagagtttcacaagaccctagatactctacttgcaaaacaagacacatgtgcacacacaacaggtgtgtggcaaaattgtgtgcatacatatgaagctgtgtatatgaagaaaataactggccagataccttccaggacactgatctggtacttctgctgctctcgctcttctagcaggccctgcactgcctgccttagtgcctgtcacctccccaggcagaaaaaagcacatgaactactgtataacagcttttcccgacccctagtatcctcatcttacacaaacatcacatatacacaccaaggattccaagcctcacctgagcctgacattgaaattaggatcagagaatagcaacctcaccccagagagaggatgggctctaggactcagggcagctcagcctttgtggaactatgggagtctctaaagcccaaggctgttgagcttggactcctgactgcagaggcaagtgatgagaggaaatccaggtcccagccaggtccccggctgaggaaataaggaagggttaagtgcagggtctgtgtggggaaacagagttcaggaaaggacagagttggaatttggaaggaataatggatgatacgggcactggaggaaggcacagaaagagaaagggcttggaagtagaaagagacattacttacctgcggtggagaccccaagaagatacagccactgctacagaagaaacagatgcacaggccaatgagctctgtggagaccccaagaggatacagccactgctacaaaagaaacagatgcacaggccaatgaactctgagagtcccttagcctccccacgcaaactggggacctccaccaacccctcaccttattccggaccacatttccatcagtagcgttgagaagcacatccagctgctcaaaccagctgaggctcgtattcatatcctgtggcaggggagcggcaggggtctggctccctggtgtcttgtgcttgctctcctagcgggggatacccaaggtatccccaggaaaggccaccacgttagatggaaagagggaagtggggatgcaacactggggtaggtggatgcactatcagaccaaaactgcgatcctgtgactagggaaaggaaggacgctcttggggaactgggggaaaagcgggataccgtgatgatacgcagatatcaggtggggattgaaggtgccagaacctggttgagacctccccagaagtagtacactggcgccaccacgccaaacctgtgccagtgacaactgccgccgccgggttcaaaacttcgggttggttttgaaagtccgactttggactggctgccgcagcgccacctgggaaactgaggtcgcctcttgcgaacacaaccggcgatggaggcggtggaactacctttctctagaagagacacgtacatgcacacccccaccgtgtagcttgccgggaaactgagtcttcctgatttcgtgtggctgtctccaaggaggaaacgaactacgcatcccaagatgcatcgcgcataggcaatatggtcccgctactggacccatttcctacctgggaaatggagtcgaagctgactcaaaacgtaacggcccaattgtccttgagacttcattccccagcaagctcagcgtgtaacgtgcgctatggagccgaaagtcgcagagctgaagcagaagatcgaggacacgctatgtccttttggcttcgaggtttaccccttccaggttagtttatccctcctgctgttctagggcgaaatatatgattggcttcgttgcaactggcgtgaggcctcgggagcctctgatcctcctgggttcctgcagcccagtgtccatgtgacaacagggacagagtttcagtgggggcttgggttaaaaaggtagtggtcgaggccgggcatggtggctcacgcctgtaatcccagcactttgggaggccgaggcgggcggatcacctgaggtgaggagttcgagaccagcctggccaacatggtgaaaccccatctctactaaaaatataaaattagccgggcgtggtggtgcatgcctgtaatcccagctactcgggaggctgaggcaggacaattgcttgaacccatgagacggaggttgcagtgagccgagattgcgccattgcagtccagcctgagcaacaaagagcgaaactccgtgtcaaaaaaaaaaaaaaaaaaaaaagttgtcgcatgtttaaccttttgccaccatataatgccggattcgttaacgggagacaccatatgacctgtagcgtgtgtggctcagattgtcacctatataatttacaagaagaaagggacctgtgaggcaaagtcaccttggaacttcctaaaggatttaggagagggcaaagcctagaaggtttgcatagctatcatttaggtcagctgaggaaggaagggcattcctggtgatgaacaggcaaacaattggctggtttgttccctctacc

SEQ ID NO: 309 - DNA, 25043 bp, Homo sapiens
tgcccggcctacattttcttttctttcgtttttttgagacagagtttcactcttgttgcccaggccagagtgcgatggcacaatctcagctcactgcaacctctgcctcctgggttcaagggattctcctgactcagtctcctgagtagctgggattacaggcatgcaccaccacacccggctaattttgtatttttagtagagacggggtttctccatgttggtcaggctggtctcaagctcccgatctcaggtgatctgcctgccttggcctcccaaagtgttgggattagaggtgtgagccactgtgcccgaccccggcctacattttctttatccattcatctgttgatggacatttagtttgatttcatatctgcctattgtgaacagtgctgcaatagtgtgtgtgtgttttttttaagagacattgggggtgggggttgagggatgggctattgcccagactgggctcaactgatcttcccatcctggcctcccatgtaactgggactacaggtgctcactactatgctgggctaattttttcatttttgtggagaccaggtctctctctgttgcccaggccagtccctaaatattttcaacctgcagctggttgaattcacggacgcaaactcgcatacacagagggctcactgtaatcagagtatgaaagaaacatgtaggaaggcaaatcaagaaagaacgcaggccgggcgcagtggcttacgcctgcaattccagcattttgggaggccgaggcaggcggatcacttgaggtcgggagtttgtgaccagcctggccaacatggtgaaaccctgtctctactaaacatacaaaaaattagccaggcatggtcatggacagctgtaatcccagctacctgggaagctgaaggaagagaaaccgcctgggaggcggaggttacagtgagccgagactgcaccactgtaatccagcctgagtgacagaggaaaaaaaagagaatgcagaattggggacacagaggagggaagagtttcttatacctgttgtctggaagctgcaatgggaagggccaagctcttggggtggagtcaacatgaaggcctgggtaggttcatcctccatgctctggactgctgtacaggaaaagatggcctaagttcatctcctccatactactgtagggttccattcctggtctcctaccctacccatactagcctttacccttcaaggaccaccagtctaatctcccagctcccactggtacaggattcaaataacacagaagtcctcaccttccaggccctgattctccagaaagcactgggtagcttgtaggtccagatcttcagaatctggtcggggaggaatataagacagtttaaaacaaaaatcatacctgacactaaactccttaaataatctctacctttctctccccaaccccagctgttagaaccctggttgatttcagaggtctaggaaggaaggccagcacttaccaccatagttgtcttcagagtccttggtcccacccacatgttgttctctctcccttcctgtggggacctgggctccctctctctgtggctgggtggattcccctagagtgtctgtgtccaccaccagatctgtgaggttctctcttgagatagggaggtcctgctccacttgtgccacaggtggcccaccctgggcccccacctcatgagctctctcctgcttaagaacagctgcagcccactctgccccagcatccccttctgctggaagctggctctttcttacatctgcaactactgaggctgttagggaggtgccctcctctgcatctgtttcacagtccccatgcagaggccaggcttcctctagagataccacaagcagctttgctggtcccccaactgctttcacatctgtttgatttgtcccctccacagacacctgatgcttctttatatgtataatggctgaccctggcgggacttccttctccacttgtgtgttgatgtccactgtggtggaggcttggcttctctccaggtggatcccaggtgagctcttatctgcttccacactgtcatcactgtccccaaaaggaggttggtccttttctgaatgtgctctaacaagggctctaatctttgtgtgatccttgaggacagcttctctattttccactgggagctcttcctcctccacgtctgtgtcactgtctctctcagtggtggtttggcttcgctgcagaaggaccacacgttggggcatgtcctcttctgcatctctgttccatatagcaggctggctctctttcagatgtgccaaagtcagcgctgctgagacttcttcctcgtcatctgtatcgctgttgataaccatggaagcttggcttttctccagagggacagcctgtggggccttgccttcttccacatctgtatcactaccagcctggctctcctgcagatgggccaggcctggtgctccaggaccccttgtacctactccatggaagatcttcctcttcttcataggaatgacaactggggttgctgggatcctctcttcttccgcatcagtgtcgctgtcgatgaagccaaaaggctgagccctttccaaatggacctcagctggccttccaggaggcctgctgtcatcatccacatctgtgtcactgtcctctccaggaggttggctcctctccagaatcaccccagctggaaccaccccattccctgcacccctcttgacttttgtatcattgtccctctccttcactaaaggctgatccttttcaagctggatttcagttacaacttcagcttcagactgctttgcctctacagtggcacctcttctggcagctgaggaggcctcctctgtggctggttgctgaccttcttccacatctgtgtcactgttcaaattgaaggcaaaaggcggcccaaggccgcccaggaccggggaatgcccctcttcatcactgtgaagggaagaaaagagagtctatagaatttatttccctggaagggataccccaactcaactgtgagctccttgaggggagacacaaggtagcatatttcttcttctgtttccaatttgttttccacttggcacatcagatgtgctccataaaaattcagctgagtgaatgaatatgtatggttccccagccccaactctcatgataatcatctcttttagagattgatcctccagcccctggttcttcctcattttgaagactcaggtgtctgactctttggcactcacctctctggaactatcacagaggaagatgtggtccttgatttttttaccatacgcctttcagaaagaaaatctgtcaagaacagaaaggaatgagttgacaattgtacactcattattcctgtctcctcattctccctgccaatatacaaacttacctacttcctcctccgagtcctcagccaacagaagcctctggggttgagtttctccctgtactctgggtgtctcttctactgtcagagggccccgggagacaaagggcagagagacatccaggcgatggtactggcagagcaagtcagcaaagagaatcaattcctggtccctcagacggtgactcaccccagggctcaaaaccttaggaggtctcaggatttgagtaccattaaggctcccacagtctcggaggataggtgccttgtcccaggctaagatttcaatctctgcatgttgtttggagatagatggaaagggcagggccacagagcagtcaggcattcggcctaccacattcttcccgaggtgtagtgggaaatctaagaattagagaggtagataagctccaagatcagagtcctggcctgtcattaggaaaaagtgcctattaggtactctactactcactcaaggcctccatatgcattagaaaaataaaaggccctaggacatctaggcactgaaagagtatatgcgataccccatccatccacaatggatgtttttttactgttataaaatacacataacacaaaatgtatcaccttaataattttaagtgtatagttcagtggcattaagtgcattcacactgttgtgcaatcatcactaccatccatctccagagcacacaattggattttatttgattttttttttttttttgagacagggtctcattctgtcacccaggctagaatgcagtgtcatgatcatagatcagtgcaatcttgaactcttgggttcaagtgatcatctggctcagcctcccaagtaggtgggactgcagatgtgaaatgaaccaccacacctggctaatttttaaatttttcgtagagacagggttttgctatgctacccaggctggtctctaactcctagtctcaagtgatccttctgccttggcctctcaaagcacgggaattacaggtgtgagtcactgcacccagcttcatttcaatctcttaattttcttttatcaaagtaaaatcacttccagtgagtccagggtagtagtctgcaactatcaactcaatcggccccatctcttccattcatgaaaaaaaaaaattcacatctcattgaaacatacataagcttcttgcaaccctccaaataccttaccacaaaaataaaagatctatatcaatacttgaacatccaataccctctgacctttttctggtccatgggcaccactaaagatatgtagccgccctactggctccacgttacacctcaaggattcactggattgctctgtctcctcctcttcttcaacatcccagtcaatagcctgggtgtcctccatgatctgggaaggatacacattatcaattatcctcattattggttcacacaaacagcatcagagttatcagactgaaaactagggggtaaactggatcattatgaacgttgatgcttctctttccaccaatctttctgttgttaaccttctgaagcacttaaaacatttttttcttttttgtgatggagtctcgttctgctccccaggctggcatgcagtggtaagatcttgggcccacggcaacctctgcctcccgggtttcaagcaattctctcacctcagcctcccaagtagctgagattacaggcacctgccaccatgcctggctaatttttgtatttttagaagagatggggttttgccatattggccagggtggactcgaactcttgaccttgggtgatccgcccaccttggcctcccaaagtgctgggattacaggcgtgagccactgcgccccgttgtttttctttcttttttagcccatgctttttatacttttaccagaccacctcagtttgatcagatgcaactgcaaaaaatgataataaaagatgacatatatagaagcttcctatgtgtcaagcactgttctaattactttatatcgactctgactcatttaatcttcacaagaaccttgtaaagtagtattactatcttccatttcttcagataaagaaactgcaacatagctgggttaagattttcagatctccttgaaacatacataagcatatataaggttaagacttgccccaaatcactcagatgtctctcctctaaaatcttgatggtttttcgtgcacacagaataaaatctaaactccttagcgagaccctccatgatctgaacttcacatcttgtaacgcctacccctcgcccgcaaaagcctatggttcagccagacattttccccagtcttcgaacacactgttcttgtcttcccacatcttcatgccttagcccaattccttggctttttcccacctagttttctggtccaacttctaccatcctttaagattcagttcaaatgtcactttctttcttttttttttttttgagatggaatctcgctctgtcgtccaggctggactgcagtggtgctatcttggctcactgcaacctctgcctccaggcttcaagcgattctcctgcctcagcctcccgagcagctgggattacaggcgcccggcatcacgcctggctaatttttgtatttttagtagagacggggtttcaccacggtctcgagctcctgacctcaggtgatccgcccaccttggccacccaaagtgttgggattacagcagtgagcaaccgcgcccggcctcaaatgtcactttctcagcaaaccctttcctggcgtgttccctgccttctcgtgttcctggtgtatcctgcctgttccacagtggtcaatggatttgtgcttactctaagatctctcgctatattgtaaccattactttccatttctgccttcacactcacccacctccaggactggattaggggaaccgtgtctttcccctagggtccatcatattcattcaatggttatggtatacctgtttgaagtatttggtatacatctgtgaaccaaacatgaaatcgaccctgccctcgggaaggctcatcaccgagcctactgatgaaggaacaaatgagatggaaagaaaatagcataaatggaattcacctgaaaatatgccactctagagggaaactgttgacaggtagggaaagtaggatgccccatggataaagtgtcaactccgtctttatgacaggccaactcagcgggtgcccaccacgcttggctccaattcaaagagccaccatctttggtccccacctcagtgggttcccttgtggcccgacgtctccctgtgtcttcatacctaaactcggagcggggcgccaggtaaggatgagtattacagtccgagaagcgaacttccaagtcacctccgcccagtcgcacccaaggtacgcccctcccgccttctgggggaaccaagatggctcccggggagccgtgggccaggcccctagaactcacctactttaagtccccgcgcgcgccaccagtaacggtcgcgacccaggtggagcgactgcgtgtgccgaaaaagagcttatttgctgattggcttctgccgctgtctttcacaaccgcagccagtcgagcggaggcacacccaaagccccgcccccttagagttcaaataggtggtgtctcccaggctgctgagatcagttaatgagacggtaattgaaggccgccgtgcgccaacagaataatgcacgtcgattgggcagctccaagggacaacccactaccgcttgcccgcccaccacccacttcccgcgcagttccaaaccgcgaccagagagtctggcgccagctgccggcaacggatagaggggctgtgtcatagacgtccgacgtgtctggtaaggccagagcgcctttcctcggtcctcctagacatggtgtccgctgactcatgagaaatgaaagtgggttgcgcgttgcagtcgtggctggaggctgcagtttggagaacagcccgtaggcgtggcagttcactcctgttgcattggaatttcatttccttttgatttggtttgtagtagaagtaatatctttcttcctgggaatacgtctctgacggacattttgaggtcattttcttaaatccaagatcctaaagatctgtagtcgaacagagaaaactggtttgctctctgtcttaaaggctgtccccacctttcgaggggcgagggaaggatcataaaatcatttatttttattttttaattaactaatttatctattttttgagatggagttttgctcttgttgcccaggctggagtgcaatggcgcgatctcgactcaccgcaacctctgcctcccaggttcaagcgattctcctgcctcaacctcccaagtagctgggattacaggcatgcgccaccacgcccagcttatttttgtatttttagtagagacgtggtttctccatgttggtcaggctggtctcgaacttctgacctcaggtgatccgcccgcctcggcctctcaaagtggtgggattacaggcgtaaaccaccgcatgcggccatctatattttattttttgagacggactttcgctcttgttgcctaggctggagtgcaatggcgcgatctcgactcaccgcaacctccgccttctgggttcaagcaattctcctgtctcagcctcccgagtagctgggattacaggcatgcgctaccacgcccggctaattttgtatttttagtagagacggggtttctccatgttggtcagtctggtctcaaactccggacctcaggtgattctcccgcctgggcctcccaatgtgctgggattacaggcgtaagccactgcgcccggcctattttatctcacaataagacatgaagaaaatggtaactataacacttgcataattcataaagtcctttctgttggttatctcaattctgtgcacaacagtcaaataagcagattttacaaacgaggagctggagccctgcaaagttaaaggactttcctaggatcctacagctaatatagagacaaattgaaacaagttatctgattgtgtattttgagttatttctactcccacaaaatgactgtgttcatttccctaaaacgtaaagcattatattttaagtgggtagagagggcttacacaagttgatgttccctcatttagaaggcaacttagaaatacattgatctgcccagcgcggtggctcacgcctgtaatcccagcactttgggaggcaaaggcgggcgaatcacgaggtgaggagatcgagaccatcctggctaacacagtgaaaccctgtctctactaaaaatacaaaaaaaaaaaaaagaaatacattgatctgtgtgatcgaatgtgaattaacaatgacgttgacttgatactacatttctgagtggttaccacattttattgattgtatgcttctcaccagactgcaacatcctggaggacagggagctaattcttaatcattttgtaaccatagctcctaatttggtggatacatagtaactatcaaataagtgaataataaatctatgggaagaagcagatggactccgtcttgaacccactcaatttttcccccatcaattacccctctctcgtttttcaatactgggtctcttgcagagttgcagtggcggccacctggtcagtgaaatcagcgaattgaaaaaccactgacttcattaacatgtctaaagaggcaggctgaaaaaactgaaaatctatcaggcatctcattccatagttccctgtttgacaagaagaccaaggtgtcttcaaagtctgccctaaggtccagatctcctacccacgtaggagacttctagtttcacaaatccccgatgtcggtttctctaaactattttattctttgaacatactctccagacaacatcgctatcctgaaaagcccttgctgcaattttgtttctctttcaaaacaatggctcgaaaatttccaaggaaatagcaagagggcgattcccttcttgaagtatttgagggagcagaagcttactgaagttcatgccttgggtcaccaaaggccaggggaggcagagcacggtgccagacttctccccatttttcgctgaactaagcaatcctttctcccctagaggtactgcagctgggagctttcagggcgtgtcttccccaccacccaacttctggaaccccagacttctcaattcctgtacccccaagaactgctcactttttgtacaaaaacctcaggcatagaggaaaggaatcttgcgcaaggtcgtttttcatttacaaaacaaaaaccccatgaaaaccaaaccggtacccacccattcgtcacttcattttgcagcatggacaacaataggggactacaactcccaaagaggactgcgctcgtccactggctcagaggccaatggacgcctggtacatgaccggcatcgactaatcagggccaggctcgatgaggctttgtctccctaccgcgcgcggggccgattctcccgcctcccagccccggcgcacgcgcgccccgcccagcctgctttccctccgcgccctcccctctcctttctccctctcagaaccttcctgccgtcgcgtttgcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaaggtaagaattttacacctcttttatttctttttacaaggaaaaatccaggtaagttatgaaaaaatggttgtggggcatttgcacccgctatccttaatcaagatttgcccctctcaagtttgttacatttatatatataacaattgtagctagcatttgcctttggaaagctgggaatcatttttcttggcaggcacattttggagaaactagtaaaagggctcttcgggtttgggggcgggaagaccgaggacttataagatgttacttaaaagggcttctaacggtccgagaaccgggcagggagagagatgcggaaacggtcgcagacaaagcggggcgaggttttgcccatgtgcatcccgcccaacccccctgcggggtacttagggccaaaccggagcgggaaggggtgaggccatcgggcggctgcagagagctccagcgcaagggtggggggcgatgcgccagggtgggctgcgctgggcgctacctttcacaaaagaccagggaccccaacgcgcccgcgaccccagagggccggtcctgtatttgttcctgggtggaaggagaataagaacgggattaattttacttgctttcatggcccctaagagagacttttttagggcgtgaacagatatgtcgagaaaatgggggtgtgtggttttctttaatgagtccctcaggacttaatgggagagaaagaatcctttaaatcaaggggtagaaatgtagcgaaggaataaaaattccgaggccaagggggattttttttttttgcgcgcggttacagtgtagcgggggaggggcgggaggaagtgcggctgctacgttgtagcagaagggcggggccctgcggggcggggccggggcgccgtgggcgcgcggggacaatgcggcgttgcccgccggcaggggcgcgctaccttgggccccgcccctcgcgcgcggaatttttgtccctggccccgcccacgcgcgaagtcttttgtcggcggctcgacctgcgcgtgcgccgcagtcacgtggagggcggggggggtggtcgactgcggcggcagctctttcctcagacccccagccttttgtgcgccgcgcggtggggcggtgcccagcttgggggaaggagagcggcgcttatcgaagtgtggtcgacctccatccgcccaccgagcacttgggacccgctgcacatatccagagcagggaaagctgtggctttctcgggggagcgagtgtctaggggaagggtgtggcaggcccacgggatgccatgccctagaacaacggcctgagcgcttgtggaattaaaatgggagatgtggggccgaggtgggcgaattgggatccctccaggtcaggggttcgagaccatcctgggcaacaaagcgagaccctcccccatgccacgtttctacaaaaaataaaagtaaaaaattagctgggcgtggtggcgcgcgtctgtggtcccagctactcgagaggctgagatgggaggatcggttgagcctgggagttccacgctgtagtcatccgtgattgcaccactgcactgcaggctgggcaacaggaagaccctgtcttaaaaattagaagaagctgggcgcggtggctcacccttgtaatcccagcactttgggaggccaaggtgggcggatcacgaggtcaagagatctagaccatcctggccaacatggtgaaacccgtctctactaaaaatacaaaaagtagctgggcgtgttggtgcgcgcctatagtcccagctactccgggggctgaggcaggagaatcgcttgaacccgggaagcagaggttgcagtgagccgagatagcgccactgcactccagcctggtgacagagcgagactccgtctcaaaaaaaattaagaaaaagatgaaataaaatggtagttggggacatagttggctgggacttgacctgttgtggtctcgttgctccccctcggcagttctgggaggtgatcagtgatgaacatggcatcgaccccaccggcacctaccacggggacagcgacctgcagctggaccgcatctctgtgtactacaatgaagccacaggtaagggcaggagcccgggcagctcaggttcccttccctgtctcccacttatctgggatctctttccatttctgggcacgccttatcccctttgggtgaatctgtcattttgtccctttcgtgaaccaccgtcggggccaaagacgtctgctgccacctggtggcgggacctggaatgacaagtctctgatccctgctgtctcccatttccagtatatctataaaccttcccttctgccagatttcacagctcttaactttattctctgtaggtggcaaatatgttcctcgtgccatcctggtggatctagaacctgggaccatggactctgttcgctcaggtccttttggccagatctttagaccagacaactttgtatttggtgagttatacagatgatattagcagatgatataccatcgtgttcaacttatttgggtgcaaggacacagcaaaagttaggagatgattgttgtattggagtgctaatacagaaatgtgttctgaaatctaacggagggtagaggtagtgcctactattgctggtaaattatggggcagtagggggagaatatatcacagtgaaggagaaagaagatacatccgagggaattatttgaaaagttgaaagatggaaacatcatgtatcttccataccctgttaattgagcttttctcctgactgcattccaggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaagctgcgagatgtgtgcttatttagggaaacacggctggctgatggaggcatggggcctgagttcagttgcactgctctccttaaattgacacttaatattgagtccctgtcctacggattcaaccaactggatattgggaaaagagttgtactggacatgtatagacttctcattattccctaaacaataatagtataaattatttacataatatttgcattagattaggtattacaagtaacgtagagatgatttgaagtacacaggttatatgcaagtactacattttatatgagggacttgggtgtctgccgatttggtatctcagggaggtactggtaaggacactgactgctttatagaccctcacatcattgtttctggtacccaaactgctctgagcaccagtcagtctttactgtagtctctgacagctcactacagccttgatgtcctgggctcaaacaatccatctcattctcccaagcagctgggactgtaggcataagccaggtgagccagtgcaccaggcccaccaatgagtcttaactggggaaggcataggcttagatgcaggatccagggatggaaaatggaagctgagaagaatgacaaatcacgtgtaactggtttccagaccagcatccacatcctctgggaacttgcagaaataaatgcaagtttttcatcccacccagatgtactgaaccataaatggttgaactggccttggccacccagcccaggattcctttgggttatgtgtacccatggccatttcctgtgatcctgtgggcttagtcaacctatgacaccaagataactagtgaagccctggtatggtggctcccacttgtaatcccagcactctggggggccgaggcaggaggatggcttgagcccaggagttccacaccagcctgggcagcagtgaaccatctaacaaaaaaaaaagctgggcatggtggtgcatgcctgtagtcccagctgctggggtagaggggggtggtggttgttgggggtaggggggtggggattggatgggaggattgcctgagcctgggaggtagaggctgcaatgagccctgaccctacccctgcaccccagcctgggtgacagagcaagaccttgtctttttttttcttttttcttgagatggagtcttgctatgttgcccaggttggagcacattggcgcgatcttggctcgctacaacctctgcctcccgggttcaaggaattctgcctcagcttcccaagtagctgggattacaggcacccaccatcacgccgggctaatttttgtattttagtagagatggggtttcaccacgttggccaggactggtctcaaactcctgacctcaagtgatccacccgtctcagcctcccaaaaagttctgggactacaagcatgagccaccgtgcccggcccaagcccaagaccttgtctttaaaaaaaaaaaaggataactaggcgggattgctaccttatggtcccattctaaaacaatctgtaccatctactacctcatacttttaagttcacaatgcaagtctcaaagctaccctgaaaacaataattccttttgccatgttttcaggaattctaggaactagtattattcccaacattccttctattttagcatgcttttctgactataatacactgttggggggaaaaattaactctaaaactcttgacagtatataagtaacttgcttttctcccattctagaaagcctattgtatgcaagaaagcctattgtatgcaagggaagaagctacattctagcattcattttctttctaatagagccaggatcttgctttgtcacccaggctggaatgcagtggtgtgatcatggctcactacagccttagactcctgagctcaagtgatcctcccaccttagcctcccaagtagctaggactataggcaagagtcaccatacctgagtctagcattcattttttttctctttttttttgaaacagtctcactctgtcacctaggctagagtgcagtggtgcgatcttggctcactgcaacctctgcttcccaggttcaagtaattctcctgcctcagcctcccaagtagctgggactactacttggcatgtttcaccctgcctggctaatttttgtatttttggtagagacaaggtttcgtcatgttggccaggctggtcttgaactcctgacctcagatgatctgcctgccttggcctcccaaagtgctgggattacaggcatgagccactgtgccgggccaagcattaatttccagttgcttctgttttattagtacttacttacagcaatttatttgggtagcaaagttgaaaacctccagcccatccctcagtcttggtcaggaaaatattctagacaacaggctcaaacagtctgatttaattaggaagttaaataagttgaggtggggtggagtgggatcatcagaaggctgacatgggaccgctggagttggcaatcatagcagtgtgaggttggcaaggggagcaacccccttcaagacaaggcacaaactatttggcaaggagagatgaggggtgggacctcactgtcaatggacatgctcagggaggccagtgggttacatgcaacaggaggatcattcaggcaacttcagctatgaggctgggcatctgtgagggctgaaggctcaggctgttctcaaaggcttgtgattcacctggcaaaaagacaacagtagatgacacttgggaacattcgggaggctgaggcccctactctcccgggccccagtttagacgaatgggctataggcagaacacacacggccagggttctttctggtgccctaccacctgtttccccaaacaaagacatcaggacccacatacaataaatcactgaagagaggagagggggcagagccttgtttgcacactctccttagctctgaatattctactgcaggcctccaggaggctccaaggaacccagcttgaaggtcattggtatgatccagtgcttttatttacatacgctttttttttttctttttttttttgagacggaatctcactctatcacccaggctagaatgcagtggtgcgatcttggcttactgcagcctccgcctcctgagttcaagtgattctcctgcctcagcctcccgagtagctgggattacaggtatgcgccaccatacccagctaatttttgtatttttggtagagatggggtatcaccatgttggccagggtgatctcaaacttctgacctcagctgatcgtccaccctggcctcccaaagttctgggattacaagtgtgagccacagcacccagcccgaatatgcatttctttctctttttttttttgagacagagtcttgctctgttgcctaggatggagtgcagtggtgctatctcggctcactgcaagctctgcctcccaggttcacaccattctcctgcctcagcctccccagcagctgggactacaggcacacaccgccacgcccggctgttttgtatttttagtagagacggggtttcactgtgttagccaggatggtctcaatctcctgacctcgtgatccgcccgcctcagcctcccaaagtgctgggattacaggcatgagctaccgcgcctggaatttttttttttttttgagatagagtcttattctgtcacccaggctggagtgcagtggtgtgatctcagctcactgcaaccttcggctcctgggttccagcaattctcctgcctcagcttcccgagtagctgagattacaggcatgcaccaccaagcctggctaatttttttttgtatttttagtaaagatggtgtttcaccatgttggccaggctggtctccaactcctaacctcaggtgatctgcctgcctcagcctcccaaagtgctgggattacaggcgtaagccactgcacctggccccatttctttaacatacacataatgcttactatataccaggcactattctaaacactgcaaatatttgctcgagcccctcaacaattcaacagggtagtttctaattattaacccaattttaagatgaggaaacaggtatagagaggttgattacttgtccaagattacagctagcaggcattgtagctaggattcgcaacaaaacagtggttccagagcctgtttgctgacttctaccatgatctacaggtgaattaactggggcgctgagaaaagcagtgatatgccctagaattaattaactgtcaataggctgcaactagttccctatactagtggggtgaccacaagcacaggttgcagagacagtcgacctggatttcactccagctgcactagcagaatgagtaggaacatgctggatgttgagtttctggactttgtaaaatcctatataccctaatggtagtttgatttaaaacaactcatttatgtagaagcttagcactgtgtctggcacacagaaagtgattaataaacatcaatgactcccaggcctggatgctggttaaatgctaggcatactgtgtcacacaacacaggaacctagcaattctcctcagctccaacctgagacctcacctgggagatgctcacgcctgtgagtctttccacactctctggcaggcgagttagaatgtccagtacttccccagtcactttggctgcccccatggtcccactgccgctggacaccagtgtgatcttattggctgaagtcaagggaccactgatctcctctgccacctggcaggagagagacacccactcagtgcccatgatctgaccacattcctcataaaacaacttactctgggttttaaggtcctcgttccactgatcatccttcctcactttggtcactaataattcccacccctaatttagagtccccctaggctgtttctccctaagcccctcactacaccccaccccttagtccctggttctatttcctcctttcttggtgcccacatgacctccagacctggggcagcttctctagcagcatgtccagctgagcagcctcttggtacagctggaaggcttctgccttcttggccatctgctcagcctcggctcgggctcgggcccctatggcaaaggcctcagcttccccacgcatctgagggttaaggatgcttgtgagattgacggaaatcattaagaacaagaaatccccgatcaagcagcaacccccaccctctccacaagccagcatggaactgcctcttaactcacccgcacagacgcggcttctgcctccgcctgcataattagttgggacctgtggacagaagggaagtggagggtggagcccagcagcccttactcccaggagaaaggcccagtgctgcagaggcagacgctcctgaaacctgaaatccataggagtccaggtggtgaaggcttcagcactccatcttggggtgcctaggtggcaagtgagctaggcagggtcagggaggggacatttacttctctgcctcggctaggcgctccagcttgtagcgctccgcttccgctggcttccgcacccgggcctccagctccttctcccgccgggcgatctcctgctcctgcactgccacctgctgggcccgctccaccacctgcacctgcacccgctgctcctcaatctgctgcttagtcttggccacctgggtaggagggtgaagtcaggttcacgctctgagtcagaggtgaagagcaagtgcccgggaaccagagctccagagtgggatataaaaataggagccggtggccgggcgcggtggctcacgcctgtaatcctagcgctttgggaggccaaggagggtggattgcctgagttcaggagctcgagaccagcctggccaacatggtgaaaccctgtctctactaaaatacaaaaaattagccaggtgtggtggcgaatgcctgtagtcccagccacccgggaggctgaggcaggagaattgcttgaacctgggaggcgaaggttgcagtgagctgggatcacgccactgcactccaccctgggcaacagagtaagactccatctccaaaaaaaaaaaaaaaaaaaaaggagcaggtgcatgaaggtgggttccctcctgtctgcttggccagtccagtggagtccagtgtttctctgatgagcccccgtttaatctatttttcccacgtgtgcccccttctagagtataaataccttgagggcactgagcacatgttggctttctgctatctccagtcttgctcaaatccccccactgttgctgcgataaccttagtgctagcctaggctactgcaatagctgacttattttttgtgggggtggggacaggtgatcttttttgtcttttgcacatggtgcagatttaacagaaaaaaaagtgaaccacgaggcttcttcctcattctccaaaccacctgggtccctttcccagagaaaccaccaagaccagcttcttgtgtatccttccagggatactctgaacatctacaagaatgtgtgtattcatagaattcctcttatttaggcagatttctttctttttttttgaggcagtttcgctctattgcccaggctggagtgcagtggcacgatcagctcagtgcaaccttcacctcccaggttcaagctaatctcttgcctcagcctctcaagtagctgggactacaggcatgtgctaccatgtctggctaatttttgtattttttttagtagagacggggtttcaccatgttggccaggctggtctcaaactcctgatctcaagtgatccatccgcctcagtttcccaaagtgctgggattacaggcatgagccatcgcacccagcctagatttcatcttcttattccttgcagtgtgagggaatcagaaggctcttatcaagatgctagtgaggagaggtgccaggcaaggaacacattttttttttctttttgagacatcatcttactctgtcacccaggttcaatggcgtaatcatggctcactgcagccttgacctgcctgggctcagatgatcctcccgcctccccctctagagtagctgggactacaggtgtgaaccagcacacccggctattttttgtactttttgtagagacagggttttctatgttgcccaggctgatctcaaactcctgggctcacgtgatccacctgcctcggcttcccaaagtgttggggttacaggcatgtgccatcacacccagccagaacacatgccttcgttgtcccattgctcaggctcagccatgcaccatcatcattgtaggtctcatcaatacatgtgatgcttcccctgcctcctaccttcccccgggcccatctgttcactccagagagaagcatagctctggagacggcactctgtactgtctttcaccctaaattttcaaacccgttccaaactggcctcgttgccctctacaccggtgtgcaggatcacctctctcctgtgtcccttaggcaaccatttgtctgtttctttttccttcctgtctatgcccaccttttggtgaaactcaacctccagaagcttcctcagaaagaatataaagacaatattttttctgaggtcttgctttctctgagatttttattctacctttttttgagatggaatttcgctcttggcacccaggctggagtgcagtgacgcagtcttggctcactgcaatctccatctcccaggttcaagcaattctcctgcctcagcctcccatgtatctgggattataggtgcctgccaccacgctcagctaatttttgtgtttttaatagagatggggttccaccacattggccaggctggtcttgaactccttatctcaggtgatccacctgcttcggcttcccaaagtgctgggattacaggcgttagccactgcacccggcctctacccttctattttaataccagttaggctgaaagcaggctgctatgttgggattaactttccatcagaattctgaaggcattcctccatggttttctagctttttaagaaatctgggcttgggccagtcatggtggctcatgcctgtcatcccagcactttgggaggctgaggtgggcagatcacctgaggtcaggagttcatgaccagcctggtcaacgtggtgaaaccccgtctctactaaaaatacaaaaattagccagcaatggtggcacatacctgtagtcccagctacttgggaagctgaggtaggagaatcgcttgaacccaggaggcagaggttgcagtagctgagatcacgccattgcactccagcctgggtgacaagagcaaaaatccatctcaaaaaaaaaaaaaaagaaaagaaagctgggcttgatgcagtggctcatgcctataatcccagcactttgggaggctaaggtgggaggataacttgaacccaggagttcaagaccagcctgtgcaatatggcaagatctcacctctagaaaaaaatttaaaaattagctgggcgtggtggtgtgcccctgtggtcccaactactggggaggctgaggtgggagaatcacttgagcctgggaggttgaggttacagtgagccttgtttatgccactgtattggacaacagagcaagaccctgtctctgaaaaaaaaaaaaaaaaaaaaaaaaaaggaatctgaagtcattttgaagcctgcctctttgagatctctctctctctagaagctttcatattttttgtcctcagcattcttaagtttcacagtgttatgtttcaatgtatatatttttcattcattgcattgggcacttagtagaccatttcaatctaaaacctcatttttatataatttttctcagaatgtttctgctcccaataagtcatgccacatttgcatgtgcttgacttttttttttttttttggagatggagtctcgctctgtcacccaggctggagtgcagtggcatgatctcatctcactgcaacctctgcctcccaggttcaagtgattctcctgcctcagcctcccgagtagctgggactgcaggcgcgtaccaccacgcctggctaattttttgtatttttatagagttggggtttcaccgtgttagccaggatggtctcgatctcctgacctcgtgagccacccaccttggcctcccaaagtgctgggattacaggcatgagccaacacccctggccctgcttgactcttattagtccctttcccttacttccctgcttctttctgtggggttttatttttcccctttgtcagctcttgccaggttaccaagcataccctgtccctggctttcttggttgctcccaaatctgtgatggcttgctctgttgcccaggctggaatgaaatggcacgatctcagctcactgcaacctctgcctcccggattcaagtgattctcctgcctcagcctcctgagtagctgggattacagtcaccatttcagctaatttttgtgtttttagtagagacggggtttcaccatgttggccaggctggtttcaaactcctttgtcatctgctcagagggaagaaggtctcaacactgaaaggaagctctgagtatgtgggtgaggcttgctgactttgagcttcaccctacggtgatctggataggccatgtacggagaaacatctgattcaggattttaagttatttctttttggattggtcatgttccccagagcagtcttctgatctcttttttggaagatggaagttctgggagctgagtggggttgagggggttggggttggggttggctctcagtatttagcattcatgaaagttatagtcatttcatgcccctgttactggtaaactatctaggtcctcacctgtgctgggccagcccccatcacatcctctagtctactctcttcagataatagacttccaatggcaggtatggtaactcacacctgtaatcccagcacattgtgaggctgaggtggatggatcacttgaggctagcagttcgagaccagcctgg
